United States Patent 9,328,346 (POLYCOMB-ASSOCIATED NON-CODING RNAS) - sequence listing, part 37

SEQ ID NO: 6401 - RNA, 63201 nt, Mus musculus
uguuccgaaaggcuagcgcuaggcgccaagcggccgguuuccuuggcgacggagagcgcgggaauuuuagauagauuguaauugcggcugcgcggccgcugcccgugcagccagaggauccagcaccucucuuggggcuucuccguccucggcgcuuggaaguacggaucuuuuuucucggagaaaaggugagacagcccugaggaacagaaaggguaccccggaauacucauaugaaaggcaggaagcugcugguggagacggguguuuacugauuaggaaaguaccuggggcggaaccaaagggucccagacguuuucaaacaggacucuugggaagggugcaguuugugcauucccgggggcagcugugaggaagagggcaaaggaucuacgagggggaguucuggcuguaaucguaucuugaagguuguauacggaugcgggcuaaaggaugagaggaaaggcgggcagaaguguggcagggaagaggggggaaaaacggaguuuguggagggaaacuccugaagaacuagacccgaguacauuucacagaagguucuagaagggaaguacauaagggaauggcaauaguaaugaaugcuguuggcagagaagacguguuuaaagagagccuuaacagggaaacauccagaagagguaggguggagacgcuuuagcaguuuuuaaguguuccuuuuggcgacuuuuaaaauaauaugugugcuucuuuuuuguuugguugguuagcguuuauguuggugguuugguuugguuugguuuuggcuuuuguguagccuuggcuguccuggaacuagcucuauagaccaggcuggccucgaauucacagagauccaccugccucugccuccugaaugcuggguaguugauuaguuuugagacagagucuagucucauuuauauuagcucuggcuggcuuggagcuguguauaauagaacaggcuggucuuaaacacuccuccaccugccccugucucuggggaggagggggucaaagauauccacuaccauucucagcuaguuuuagaguuugugagacagggccuucuguaauuggguuguguagcucuaggugaccuugaacucuauccuccugccuguacuuccugaaugcugaaaguacagguugaaacaaccauaucugaucuuuuggccuccccaaacuagcccaaaaagacugcugaacuucugaguccaagccauccuccuccuucaacuucuccagucccugaaacuauagguaugacaccacugguuuugauucuaagcaagaaaaagaacaccagacucuggggaaaguucauauauauaucacuucuguccagucacuccauuuuagcuuuuuuuuuuuuccuugaagaaaggaagugacccaaggaaggcuuucauaucaaagaguagagaauuuagauugcuagcuacaaagagcaacugcuaagaauuuuauuuaucuguugauuuauugguguuuguuuguuuuguuuugagacaggguuuuucuauauagcccuggcuguucuggaacucacucuguaguccaggcuguccuggaacucagagaucugccugccuuugacucucagugcugugaucaagaauaugugccaccacugccuggagaaauuuuuauuuuuuaaagauucauuuuucauuaucuuuaauuauguguaugugugugcagagguucugaccuggauguagcguuccagacaucugacaugggugcugggaagaggcacauauuuuuaaccacugaaccaucucuccagacccugaguuuuuuguuucuuaagauuuauuuauuuauuuuaugugaguacauuguugcugccuucagauacaccagaagagggcaucuaagcucauuacagauggcuguaaaccaucuugguugcugagauuugaacucaggaccucaggaagaacagucagugcucuuaaccgcugagucaucucuccagcccccggguuggguuuguuuuuuguuuuuguuuuuguuuuuuuuaauguacuauauguaaguacacuguaguugucuucagacaccccagaagagggcaucagaucucauuauggaugguugugagccaucaugugguugcugggauuugaacucgggaccuguggaagaguagucagugcucuuaaccgcugaaccaucucuccaguccgguuuuggaguuuuuaaaagaauuuuuuuuaaacaguuccauucauuuuauauaugugaguacauuaucacugucuucagacaugcuagaaaagggcauuggaucccauuacagaugguugugagccaccguguggaugcugggaauugaaccuuuggaagagcagugaguuuacuuaacugcugagccaucuuauuagucccuuguuuuuguuuuuuagugaaguuuuuucaucaacuguugguauaauucuaaagcacuccaaauuuaaauuuuucuuauuuagaaaugacaagccuggugcaguagcuuaaacaccuguacucaguaggcugaggcagggcgauugcuucaaguuggaggcuaaucugggcugcauaauuauuuccagaugugugugggcuucagcgugagaacuccuccaaaaagcauggaugggggugacuuaccuucaguaauuccagcacuaaguggguggaggcaggaggaucagagguuuaagacuagccuugaguacauaagguacaaagccaguguggguuacaugacaucuugucucaaaaagggaaagaaaguuggcaagguaagcuacuguauuuaaaagcccuuuaauguaguuuaauugcauguguuuuuaaauuuguguuaaaaguucacuggaacuggaagaaauggauuuaucugccguccaaauucaagaaguacaaaauguccuucaugcuaugcagaaaaucuuagaguguccgaucugguaagucaacagaagaguuuacucagcuggaauucuucaugugguuacuguucaugcaaaugaguagcagaggcuuaagauaguagagaaaaacacucuguauuaaaaggacuuuguauuuuucaucccugaagaguuuuaaaaauacagaaagguggucuucacucugccaucccuccucccuguccaggcaaagccugacuugauguguucuuccucauggcaggauucuggcuuuuucuccaggggugggacagccugaucucuuagaaugacucucauaaauagcaucagaauaacaauggaaugcuugggguuugugagggccucugucuaccuuugacacuaggguggaaacugguccuguaaauuuacaugagagugccccuguccucagcuuuuagcaaguccagugugggaugagguuuuaaauuucucuuucuauaaaauuaauugaggccugaccuuuuggucuauucaggccuuuccacuuuccugcuuuuuguuuuuguuuuugguuggggguuauacuagauuugguuagaccaacucaaucucaaacucaccaucuugcccaggcuggcuuugaacucagauccuccugccaaggauucuaggcauacacuaccauaccuggcuaaaagagugaguuuugaccaguguuuaucuguguaaguauaacucuuaccuccaagauaggaaauguuuccauuaccuuagaaaauucucugguguucucagugaguucuuacuuuucaggccuacuaggaccuuuggaaaugaggcuuuagugugugauuuugugauuuuuagaauuuugugcacuagggcucagaauguagcuaguauaauggcuuagcuagcacaccgggagcccucgguucaguuuccaucacuguauaaguugggccuagugaccaacaucuauaaucccaucagaagagugagacuuaggaguggauaucaggucaucuuugacugugagacuagccuggaguacagaugacccugauucuuuuugcuuggaaguagagaaacuuggugaauagcuuuaggcuccaaguucaguuuucagccccaaagauagaugauaaagaaauggauacucggggaaaaugaauccucuggcauaaggaauguuaaaaauccuaagcaagggcuggagaaugcucuuccagaggauuugaguucaauucccagcacccacauggcagcuuacaacugucuguaacuucaagaucugacauccucacacagacauacaugcaucagaucccauuacagaugguggugagccaccaugugguugcugggaauugaacucaggaucucugggagagcaguuagugcucuuaaucucugagcauacucccuccgccuuuuaaauuuuuuucaagacagucuuccuguguaguucugacugaccuagaacucaccauguauaccaagcuggccuugaacucacagauauccuccugucucugccuccaaagugcuagaauuaauaacauguacugucauauccuacuuaaauuugaaauuaguucuuaaaaacuuuuuaaaauauuuauuuauuuauuauauguaaguacacuaacugucuucagacacaccagaagagggcgucagaucucauuacagaugggugugagccacugugugguugcugggauuugaacucaggaccuucagaagaacagacccuuaaccaagagucagugcucuuaaccucugagccaucucuccagccccugaaauuaguucuuaauacuuuauuuuagugcuggggguuaacuuggggacucgugguugcuauguuguugcuguguuguuuuguuuuuguuuuuuucuguacaggguuucaguauguaacccuagcuguccuggcacucacuguguagaccagacugaccucaaacucacugagaucugucugcuuuuuccugggauuaaaggcaugugccacugugcccagcuuuuaaauauucuuuaguaauaugguauuagaguacagcauuuagaaguagggggcuggagagauagaugucuuggugggaaaacuuuuaccaugagagcaugaggaccaaaguuuggauccccagcacccccuaaaugcuagacuagcaaugacagcucuagguucaagugaaaggcccgucucaaugcuuaggguggaaaggaaggagggcaucagccuggagccuccacaagugugcacacacaccacaugucaaaacauagcuuuuuaguuaaucaguuaggugcuuguuuguuuaaggggguuguguuuuguggcuuuuguuuuuguuuagcuucgauggauaaaugcaaguaaauuugccucugugcuucacgggguuguuauuuuguucagagucaaguuaauaagguuuagguagaugugugugcuuccagagacaagauuucaaaagugcuagccacucuacagcauugcagcugaauaaaaacaaguccuaaugagauuuacaaccaagucuaugaaauaucaaagccacagaggcagaaauaacacugcgagagaaagaugggcugugagaagccuaaguuuacugaggauaauuauaaacagugaucaaaaagucuucaguaacgugccauuuggguccauuuauucuacauucccgugggacucagucauaaaaguguaauguacuuucucauucuggcaaauuaaaccaucaguuaaaaauucaggcuggguggugguggcgcacgccuuuaaucccagcacuugggaggcagaggcaguuggauuucugaguggcucagugugccgacugcucuuccgaaggucccguguucaaaucccagcaaccacaugguggcucacaaccaucuguaacgaaaucugaugcccucuucuggaguaucugaagacagcuacaguguacuuacauauaauaaauaaauaaauuuuaaaaaaaauucagauacauacaaacuaaagaugcaagggagaaaguuacugcuaaauuuucaguuguucaaugucccuggcuucuucgugcacuucuuguucuccuugagacagggucucaaaggucucaguccuccuaucucagccucgaaaugcuagaauuaugggugugcauuugcaagcuuuaggcuugcuuuuuguuuugagauggggucucacuguguaaaccaggcuagccucuacuucucagaggcccacuccucugccucccaguguugggauuaaagguauaugccaccauaccagguuugcuuuuaauaauuuaauaauaguuguuuuuaaagcuuaaggucauuuauauagaaugcucuauagugggauguucaaccuacgugugugucugugugucuguguguguguguguguguguguguguguguguguguuugauuuguuuuguuuuccaguuccugggauugaacugagggccucuucauggucggcugcguuacacguacagucccaaccuaccugggugaauuuuaguuaugugaagcuucuuccucuguauguuaauaggaaacgaauccuauaggcacacucuacugcugaguuacacgugcagcccaugcaguuaguucuuaaugauaacugauuagaacuaaaaacuguuacuuggagcuuuuaucgcugcuauugggagacagauccaaggagauuucugaauuggaggucagccugguuuauguagcaaauuucuggacagccagggcuacauaaagauccugucuaaaaccaaaauaaaaauaaauacauaucuaccuaccuaccuagaaaaaaauaaaacaaaaguuauuccuuggggugggugcaggauaaggcgcucaguccucagaucuccugcacugagauuccuucugucccucaauuaugaguggcagcuuuguuuuuauucucaagguggggucuugugauguucagaguggucuccaagucccauguucaugucgucuuccuaucucggccucccaaguaucuggaacugccaauaugcacuacuauaccugacucuguggcaggcccuugugguguuugcuaguccuugauguguguguauccaugugggggaaguuguuuuguuuugucuugcuuuuugcuuguuuguuugucccccccacccccuccccacacauacacaggcuuucucucuguguagcccuagcugucuuggaacuggcccuguagacaugauugaccuugaacucacagaucuaccugcuucugccuguuuuguuuguugguguuaaaagccuaggucaggacuggcuggccggcucuuuuuacaaaaauuaaaugugacuguaauauuuuuuaagugcugaaauggguaccuaguaguucugguuuuuuuuuuccccccaaauccaaaucuaaaugcuguucccagugacucauccuguuaaaacucaaaaguacagauacgcaguaggcugaaaauacuguguggcacgaaaaguguuuaaaacauuugaauuuuguaguaaacauuuacucuuaucagaagcuagaagagaaacauuuuaauuuuuuuuuccauuuucauuccuauucaucuccaagcucuuccuacaacagucacuaccuuuuuacauaugggaguuuucaucuguucagaguugguguuuacaguguguuuauauagcuuggaucauaauuaccauacugaaauauaauuauuucagaauugagucaguggugagaaugaaagccaucugguaucaugacucaauccaauuucucuuuuacuaagaacuuccuuuggugucuagccugucucagaagcaguaacagagcagucuccucuguggacauuggauucucacagugaccccagaagacugccaagggggacuaaguucagguagacagcuuggcucgagguuguucugcuccuguagacagagcugguaguaggagccagccuucaggcuuagucagguguggucguugcccucugcaccgucaggaccccucugaccacaaguccuacauuacuaagccccuuugggcgggcuuuucccucccagccuuucccgugauccuguucuacauguaacaaaaggacuguguuucucucacacuagcaagucaucucuuuagugucuuacauggccguuaccgcuagaacucagugucuguaucgcacacagaauaaaguaaagacaauagaugaguuuccugccugccugggcucccagcuaccucuguccucuacugcaggccuccaugaugcccucucagaguggcuggcaugcgcuaccaccaggcacaguccugcucagcuucacuucuccgcugugcugucucugcucgucuccagugauugcaguuugucccuuaugacucagcuguccucugccgucacuuccuuguuuguguauuuuuugugccguucuauauagaccugcucaugugcacugcgcuguguccuuuuguccuauuuaguuuuuccuucuagcacauuucuuccuucuagaugauaaguuugugcagcucauuuuccuauuuuauuugugcaaaugcuugaacuuguccuacucaguuuuaaaaagucaagucaaucccaauccaugccaacacagcgcugugaggugggcugucaagauggcucagcagguaaaggcacuuaccaccugacagccugcguuugauccuuaggacgcacagauuguucucuggcuuccacaugugcaccguggcaagugcacacacucacacaucgcccaguacauacacaguacaaaaguacauucuuuuaaguacugugaggcaaucaaaaauauauacacuaggcuucacauaaccauggcuaggguacauacacuccaagaucucuaaagggugucuuguaaccucagauaauacugaacccugcauacacuaugguguuuuccccucccccucucucaaugcauacauaccuuugaugaacuuuuaccuuuucauuuaaaggagcauuuuaugcccuugcugugguaugucuaaauugccagcuugauaugguggcauauaccuagaauaccaggauuucagaacugagucaugagggucugugaguucaaagccagccugaguuacauagugacacagaaucuguggggugggguggaguggggugacuggcaucauugcuuguuagcucuggggccauaguaagucgaauuuaauguuacucgaacacagacacuuuuauagccuagcacccgauuucguggcaaacuucuacugaucuguuagcaguuaugaguacagccuggauacacuggacuaaagcagagcuaggcuggguuuaguacccaguaacacauaaagguguuuaacacugcacaaagggaugaugauucagauucuggggggauggaguaauacugacuaaaaaucuucuacauuuaaaaacucauggaugugccagugggauggcucacuggccaaugcaccuaaggcacaagccuggugaccuuaguugguaacacucauagccaauuaaaaggcaagcaaguaaaaacuuacaaugggcuggagagguaacuuagugguuaaaagcacuugcugcucuuucagaggacgcagguucaguuucuagcaccuucaucagguugcucacaacagccuguaguuucagggaaucugacacccucuucuggcucccaaggacauugcauaaauguggugcccacuauacccacaggcacaaguccucacaaaagucagucuuuuucuuuucuuuucuuuuuuaaauuauaacugagggaaagcuugcuauaaagcaaaccuuucgggggacuggagugaugacucaacaguuaagagcacugaaugcucuuccaaaagguccugaguucaaaucccagcaacuacaugguagcucacaagcauccguaacaagaucugaugcccucuucuggugugucugaagacagcuacaauguacuuacauacgauaaaauaaauacaucuuuaaaaaagcaaaccuuucugucuuuuuuuuuuuauggguuuugugugugugugucuguccauaucaagguaugucacauguguuuagguuccuagauagcccaggaaaauguaucagguccucuagaauauagcuccugacaguugugagcuacaugaugugagugcuggggacuggucagguccucugcaggacuagcaagugcucuugacugcugagccaucucccaucuuuucagccacugguuugacuggggauggaggguucuggaggguggccuugaacuuucaguauguccaggaugacccaaauucauucuccuucuucuauuucucaaguucuggaauugugggacuacacuaccacacuaaggacaauuuguguguguguguguguguguguguguguguguguguguguuuguggaguuuaguuaagauucaggauaugcguuggaaaugaugccugacagugaaaauaaccaaugugagagaaauaucaguugucaagccagggccuugaacuugguugggaggugcucugcuguugagccucauucccaaccuagagcuaaucuuauagaugcuggcaguaauccagagcagugaggagaccgguauuucugucugcuuucugaaugcuugaugaaaggaucuuuuguuuuguuuccuuugagacggggucucauuguggaacccugacaggucuugaacucucagaaucuaucugcuuccuuucugccucuccagggguggaggcaccagcacacccacaggaucaaauuuucuccucugaucuuuguuccuagcaaggcagaccuuugauacugaauuauucuaacuuucuuuuuuuuuuuuuuuuuuuuuuuuugguuuuucaagacaggguuucucuguagucuuggcuguccuggaacucacuuuguagaccaggcuggccucgaacucagaaauccaccugucucugccucccaaguacuaggauuaaaggcgugcgccaccacugcccggcaugaauuauucuaaaauagugguucuguugggguucgccaaaagacccuuacucacaaagaccacaaagaccgccaccaucgcugcaacccacauaaggauuuuuauugauccuacauguuggggacuucccucccagcacgcaggccagaggagagacccagaacaaagaaagaacacacuuuuuauaccuuuguaaggagcagauuugagcaacaggauucucauugguguagcaaguaacccuuucaggcauugguugguuuguauagugacuaaguaacccuuuggccuagugacucacuuugcuugccccaugguggguuauuaugauuuggucagcaaagcaguaauacauucugaacuuauggaucagcuauuaacgccacagcuguuaauguucucgcaacaaggucagggugguuuguggucuuuuucagaaugcaauauggggcgggaggggggcaggagaauugcuaaucuuauuaugguuauuucucugaggacagcuaauauuguuuuggcagcuuguaggcuaauucauuuugacugcuaaaacuauguuuuuacauuuguuuagucaggcagcuuccuuaucuggcucugcacuuggucugcugguacaguuuggaaaguccuuuucgaagagggaagguacuggguggucuugaauucauuuugaauauuacaguuaucaaccuuccuaaugcuuuggccuuuaauacaauuccuaauguuggggaugacccucaaccauaaaauuauuuuuguugcuaccuugugauuacaauuuuucuacuguugugaguuguaaauaucugcguuaucuguguuuuccaacggucuaagguuuauuaaaccccuaaggggucacgacccacagguugugaaccacugucuuaagccuauauccaggcucagguauagcaacuuaaagcugaaccucuuuagccaaaaccaaguguuuguuuguguauaaacaacuacuaagccacacuuauucuuucuuucuaguuuggaacugaucaaagaaccuguuuccacaaagugugaccacauauuuugcaaguaagugaaugguuuuguagauccauuaguagcuuuuguacguguucuucacugcacagcauuuguuucuucaguuagaugacaagaaaacuagccuuguuuccucagggagcaccuaggaauuccucauguauauuggcuguagccaucguucuugguaaaguuguaacauagcuuaucuguguauaagaagucacauagccgccaggcgugguagugcacgccuuuaaucccagcacucgggaggcagaggcaggcggauuucugaguucaaggccagccuggucuacaaagugaguuccaggacagccagagcuacacagagaaacccugucucgaaaaaccaaaaaaaaaaaaaucacauagccauguuguacagagguucuguuggguuuugguguccaagggugaauguaggcugaaagcaguugugaaaugagcagcucuguuucagccaucaccccuucuugucuccguucacuccuaagugaccuuccgcucuuccugagcaggaggugcaguguuugugaguuuuguggugcugaugaaaauagggaucugaacgauauauauuuauuuuauuucuauaucugaacaauauauauuuauucauucauaucaaugacuccagucacacguagcccuccguaucuagagauuauguguuggcugaaugaaucacccaugggcugaaaauguccuggaaaucaggaaacaaauugcaucuacauggaacauccacaaaccuuuucuccuuuucauuguucccuaaaguauauaaagucauagccacguaucauuuaauuuacaaauaaauuucuauuuacguguguaucuuugcuuaugugaauguaugcauguauguguuggaucuccaggagcuggcguuacagguaguuguaagcuguccaguguggaugcugggaagcaagcucagguccucugccagagcagcaaguccuuguaaccacugagccaucuuuccagcccuggaucauuuauauuuuauuacauuaccuauucuaaguaaacuguaucuuuuuuuuuuuuuaagauuuauuuauuauuuuauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagcccaaacuguaucuuuuuauguaaggaacuugaguauccaaagauuuugguauccaugagaccuaucucgcccauucugagggaagacuguuaagaaucuugcucuuuuuuuuguuguucaaacaguuuccgauguuauaguucuagcagucuaugaaguucuaaaugacucuuagggcuagccugcaacuguugacaucuuagggcuagccugcaacuguugacaucuuagggcuagccugcaacuguugacagagaugcuucacaggggugcuuuguuaugcuuuccuuuuuuuuuuuuucuuuugguuuuuugaggcaucucaacugugugucccugaguagauuugagcucgguauguagaccagaugggcucugaacuuccugugguccugcuucugcuucccaaauacugaugguacaggugugagccacagcaucuagccuuugaaugaagguaucuaaaucagucgugauagcauacaccuugucuuaguuacuguugcugugauaaagcacuguaaccaagagagauuacagaaggaaacaguuaacuggggcuuagaguuccagaugaguccaucaccucaucccucagucaggccgggaucacagcaggggccuggcagggggugugacuggcauggugcuagaacguuagagcucacauccugacccaggaagcaagaauaauggaaauaguaauuuuuguuauuguuauuuaacaacuuucuggccgucuggcuucuacauguuaaacuauauauuguguaggaacaguuucuuuuuucuauuuuaguuuucaucaugugcacucaugugggucgugucagagcauguguagaugaguguagaugcccauggaggccagaggaagguguuggauucccuggaguaggaguuccaagcauuuuugagcuaucugugggugcugagaacugaacucggguccucaauaacagcaauccaagcccuuaacugcugagccauauuucuaguccucuuaauggcauuuugggacaugaugggaacauucuaagauagggcuaauuugagguaauagucuacuggguucugucuuguucgugguucuuuacccccucugcuguuuucuuccccuccccucucucuguguuguccccucugcaauuccaccgucccuguugccuugauauuucuaccuugccucucuggcccagagcacuggagccagccagcugugaacugaaauuguaagcgaaaacguuuacuccaaagagugagaguuacagucuccacgugccuguguuguuccauauuuaccuuaccuuaguucaggcugacacauugcucaguaccacaucuggcuguagcuguuuuacuggauagugcaacucuuaaagcuuacuccucaaggaguuuaugggucaguagcaacagcauccuguaagagcuugcuauucucuuagcccuauccuacacuacugaauaaagcauuuaaaaauaaggaauuuaaaaagagggaaauauauguuaaaagacuuggccauacacuacauuugucuccuaguucacuauuaacacuaacuuuucaauuccuuucaucuuccuugguugucauuaauguugguaucugcuuuuuauucccuacccugucaugugcauuaaaauagcaaggauuuuccuuugcuuuagcacuuacuguaucuggagagguaccaguuaugaguuagucgugugccugagucacaucguuaauuaucaccacugaaucucuaccgcuuguccaugagccauucgaguuccuuuuuguguguggagugacuuuuggguugaggaaaugacccaguuggcaaaguaugcaccauacaaaacuaaggucuuuaugugcccaggacccaaagcuaagcguggcugugugugccuggaaucccagggcuggggaaggagagauaggagggucccugggcuugcugacuaguuauuacagccaaaucaacaagccccgggugcagucagagagccugucucaaaaaauaagguggagaaugauuggauuaagagcccuggcuaucacugagugugguggccugcacuuuaaucucagcacuugggaggccaaagcagguggaucucagaguuugaggucaaccuggucuacuaagugaguccggaauagccagggcuacacagaaaaaccuugucucaaagaaaaaaaaccaaccaaacaaaaaaagaguccuagccauccugggacucauucucuagaucagccuggcuuugaauucaaagaaccuuuacaaguacuaaccacauuaucuuuucuuuuaucucagugucugucugucucucucucccuuccuuccuuccucccucccuuccuucccucacccccuucucucucucuuaacagaguuucuuuguguagagccuuggcuguccuagaacuuacuuugucgaccgagcuggccuugaacucagagaaauccaccugccccugccucccaaaugcugggauuaaaggcuugugcacuaugccagaguagaauuauauuauuuuaauuacuguagauuuguagugagauacagaguuuuuguuuacuugguccaaaaaaacaaaccugggguuuauguauacuaggcaagcacuuuacauacauacacacauacacaacacacacacacucacacacacacacacacacacacacacacacgcauguuuguauauguauguguguguauauauauauauauauauguauguauguauguauguaucuggcacuuggugcugagccuuuaaacuaauacaaccauuuuauauuaacuacuuaagcauuuauaucugauuauacagcaugaaauaauuaugaauauaucauuaaauaugcugcauuaauuuuuuuaguguuuuacuugaucauagcaguaagucauaugcagguaagugcaauuuucauaggucauuucuuauaucauuugauuuuucugcuuaugcagcaucuaaaaauaauuacugaaaaaucauugguuguaauuuaccugccauuacucuuuaaaugacucuuaaaggcauucguggcuguugccuuuugaguguucuuucuacaaaagaaaaaaaaaguaacuuaaauugguuuucuuucuuucucucuuucuaauuuauagauuuuguaugcugaaacuucuuaaccagaagaaagggccuucacaauguccuuuguguaagaaugagauaaccaaaagguacauaauuuguauaaucaugggagguuggaagcaacauggcaggaaaagguagaaauuaauauguaaauaauauuucuauaaaaccauucaccaauagaaaaauauacuaauguguuuggggacuaggggugcuuacuaaguaggcacaaggccucugacuucacuugacaguaccucauaaaucaggcaucuugccugacgugccugagcagguaagguugcugucaagcugaagaccugaguuugguucccaagacccaugauggaaggugagaacugccuguccucuagccuccaagcaugaacuguggcauacacgcacucuuucucuaaucaaucaauuaauuguuuuuuuuuuauuauuauuuaagaauaagagcuggagaguugacucagagguuaaggguguuuguaguuuaugacugucuaugaaguuauuuccuuggaaguuuuuaugagacaucugcugucagcaagucuuaccaccuuggugccuuguucucccacccacaugcuagucagcccccauccuacuuagcucucaacuccagugcgcucaggugcgauggccauagauaacacacucagucuuucagauggagcugcacuuaggucagccgcacaucgccuaccacgguuaguucuguuagggcacgguuaguucuguuaucuuucagucaguccuguuuugccaguguuuagaucauaguaggcugucagauauuuuuaaaagaaaaauuaauuauauucuaccuaagccuaagucucucuucagauuuuggugucuguuuucaaaaugacaaauuuacuauuugauggaagucugagaagaagugcuggcaguaaggguugaguugggauguuaaguaucaaucguaaguucuuucugcuguugauuuauaucuacucugaauucaggguagaauuuuguggcagggacggguuaagacaaggucucucuuuggauuggaaauuaccaugacuaaccucaaacuagagauccuccugcuucugcugagaucgcaggagugugcuacucugcuggguuuuuugguuuguuuggaacagugucauguaguccagauuggucuugucuauucuucuaucucugucuccuuccuacauacuggggucacaggcagacacagccaugcuacgcucgggacuauucuguuaggggcuuuuaccaaaguauuuuaaaaaucuguauagucaaaaagagaaugaaaacauacagacacccaaaaucaaagccaaguaaauauacucaugaaguuuauucucaugucacugauucagugauuauaaugugacgucucugguaggacuggguuuguacugugcuggggaucaaaugacuaguucucugggguugugcuuucugcugcaucuacagucggaaagcuacaauccauguguuuaugugucuuuguuuuagugugcuuaaaauuaauaaucacuuauauaugcuucucaaaaaaaaaaaucugauuucaggagccuacagggaagcacaagguuuagucagcuugcugaagagcugcugagaauaauggcugcuuuugagcuugacacgggaaugcagcguaagugucgugcagccugaggcagugcuccaggggcugguggaaaccugagcgcauuuggagcuauuguaugagacuggucugguuaaauuaugcuuuacuuauugcacuuauuuauugggaggcccggagcacaggcugggacagaugugucuauuuguauggaacccagaggucaucuccagggauuguuccucaguuuuugagacaagguuucucagggauugagcugauagaguuaguguuggugcuagcggccuuuacucacuggcccuacuuuuuacauuuuuauaacuaguaauuguauguguuuguguaugagaugugagugcacacaugcaugcgcuagggcacacauuuggguauaaaaggacaauuuugggguugauuuuuuuuuuucuuccaccuuuacaugguuuuaaaccugaaaauugugaggaaaaagaccaaauccaugauugucuaauuagagcuagcuuuaucccaauacuagauaggacaguggacacuggccagguacauaccugggccucccagaggauggcauugaauucuguuagucagguacucauacagacagaacacacaggcuauguacuucccaccuucucccaaucugggagggggaggggcaagcauucauucugauguacuuccugccugccuaucaagcuuguccuguguaguugggacagccaaucuuacagcucccaguauuccaggagguucucuguccucgggcagguggggcuuacagguuaacuuuagcccucacccaucauuuaugaucaagcucagguccucacgccagggcaagcacuuguaccugcugggcuagcuugucagccugcgguuuuaaauuacuccuauuagucuugcauuuuauaugucaaucuugcuuguuuuuguuuguuuauuuuugagacaguuccuggcuauccuagaacucucuguagacaagacuggccuugaacucagaggucugccugccucuacuuccuaagugcuaggauuaaaagguaugugccacuaccaccuugccuagcauguauaucucaauguuucugaaauagggagcauuuuagagaauugugguaaauuuguuaguaagcaaguuuauuaguuuuuagguauuucagagguaauaaaaauaacuuaagagucuuugaauuucuaaacaggacuuuuaaaacaguuauagguagucagagcuggagagacagcucaacauuucagaauguguaacuacucuucuuaacagaggacccagguucaucucucaucagccagagcagguggcuuacaacuuuagggcugcaaugccuucugacuucugcaggcaccugcacacauguacuccacauaaacucaugcucacauacacauaguuaaaauuuaaacguaggcaagcaugauggcagacaccuugaaucgagcacucagaaggacagguggaucuuggaguucaaagcuaucaaauuccagacuaaagaaggcuauacagaaccuaccuuuaaaaaaaaaaaaaagcccaagaauauuaaauauacccauaaugcauuauuuuuguuugcuuguuuuuugagacagaguuucucuguguaggucuggcuguccucgaacucagagacccuccugcuucugccucuucugcugacgccaccaccacuaggcuuuuuuuccuauuauucuuauacagcaaacacaauauucuuuuuggauauuuagugaagauuaaugucuuuuucuaacuaaaacaugccccuuuuuguuuuacaguuacaaaugguuuuaguuuuucaaaaaagagaaauaauucuugugagcguuugaaugaggaggcgucgaucauccagagcgugggcuaccggaaccgugucagaaggcuuccccaggucgaaccuggaaaugccaccuugguaaagcugcuuuccacguuuuuuucugccgucucuuuauugagucuuagugaguuagugaguguguggaucuauauaagaacuuaguagagagaggauggugauuguacauuuaguggcuggacaaguguucuaauaaguaagaauuaaauucagaaagucaggggaucuggugugaucaacaggcgcuuuacaggcccuuugccugccuuacaacuccaucugcucugaugcagguccgaaaugggcacagugucccugaucuuuuguaagcaaauuguuugcaaauugcuucaacuuaaccaguguaagaauaaagaaaauacaaugacuugcucugcuccaguggaugauggagaucauggaaauacaccuucuaaguauucuuagaaugcugggauuuuauggcuggcaauccuuuuuaaaaaugcuuuuauuuaaauauuuuagauuuuuuuaucauuaauuauguaugugguggggguugugcaugugacuauagaugcuuuguagucuagaagaggcuaucagagccccucuaccuaaaguuacauguagcuaugagcuguucaauguugcuacuagaaaccucugcaggaacaauucaugcucuuagccucuaagcugucuugacgcgguucauggcuuucagucagcauguaaugcaguccacgugcuuacauauacuaaugcacugugacauuuucaagugagauuguucauaguucuuucccucuguucccgcccuugcuaccucugugccuccuuuguagccuccccuucagauuccuccucuuaucauuuauccuucucaaaaauacauuuuauguugcuggccuucuagugauuauaauuaguuuuggaaaaauaaaucugaaaaaauauuucacaaaguaaaccguaggcauucuuuacuguuugacagaaggacagccuagguguccagcugucuaaccuuggaaucgugagaucagugaagaaaaacaggcagacccaaccucgaaagaaaucugucuacauugaacuagguaaggggcucagguuuuauuaaguuggaaaugauacuugcuagauuguuuggcuuagaguuuucucauagauguguauguguugcauggaguuuugguaagugaagaugaaauaauuuuauggguucuaucaugaauuauagauuuuguaaaaguuaaaacuuuacaucuugaagaaucuuacuuuauaaaaggaacaaaaggaaaaaugucugguuauggguuuaagugaauuuugggaaaaacuuagucauaauagaaaaaaaaauguuugguugccauagaauuuagaaggaucugggauaaauucuacaagcucuguguucaaucucaagcuggccaaaaagacugagagcucagacaggcuucucuaucuuagcacauuugucaucccagcaucuaagaggcuaaaguaggagaauccucagugaguuugaggucaaccagggauacacagagaacccuagcccaaaaucaucgucaucaccaucauugccaccaccacuaccaccaucaccaucaucauaauaguaaauaaucaaauugggaagaauggugguguuuugaguuccagacuaccaucugucuccaucaacagcagaucuauaaaaauaucccagagacuggggagauaucuuaguuggugagguacuugucaccuaaauucaaucccuacaaucuacaggguggaaggagggaaaucagcuccaacaagcuguucucugacaucuacacugcacaugcaugcacauacaaguaauuauggauuacuaggaguagugcaaacguuaucggcuaauauucaggagcacuugauuagaauauaggugcuauuguaguuuuuuuauaccuuaucuaaaaugucaguccugaggugaugagaaaauuaacuuacaaagaaguuaagaauuuggacauaggaagcuggcuuuggggccugugcuuucggccacuucucuguauugccacaugugucuguaccugcuacauaguggguauuaauuauaaauauaauaaauauuucuggaugaacuauuauauguuuuacaaaaagcaggguuuuuuugguuuguuuuggguuguuuguuuugguuuuguuugagccuuaauaaucuugacugauuuuuggguuuuauuuucuuuguuuuuuucuagacucugauucuucugaagagacaguaacuaagccaggugauugcaggugagucaaagagagccuuugucugugaagcuauugucauaucuaauuaguauugaggagccuagauuuagaucauaguauuagaaaaaaccuuaaggaccauuuaguuuuaucuacuuuauuuucugggaaaucuuuuuuuguuuguuuguuggauacuuuuuuuguuuguuuguuggguuuuuuuauuauuuauuuacuuuauguauaugaguacacuucucugucuucagacacaccaguacaucccauuacagaugguuaugagccaccaugugguugcugggaauugaacucaggaccucuggaagagcagucagucuucuuaaccacugagccaucucuccagccccgaauacuuuuuuaaugccaaacgaguuuuagauaacaguggaagucagcaugcacuuguuucugccagaucguuguucucugaguuucucauauaugguaauaauuacuuauuuugggguggggucugucuauagagcccuggcuguccaggaacucacuauguagaccucuaagucucagaaaucgucugcugcuuuucaagucaccaaaggcauccaccacuaugccugacccaaacaucuuuuauuuaguuuaguuuauguauaugaguacacuguagcuguucaaaugguugugagccuuucaugugguuguuggaaauugaauuuaggaccucugcucgcucugcucggccccgcuugcucaguccuugcacacuucagcccaaaauuuguuuauuauuauacauaauuacacuguaguuaucuucagaugcacaagaagcggaggucugaucucauuagaggugguugugagccaccauguguuugcugggaucaaacccagguccucugggaaauuaacccauguucuuaacccugaaccauuucuucauuacuccaagguguuggaccauccacugagugugcuuauagguuguugcucuaaaggcccccacaaccucgaaggaaacugucucucccucagaaucuaucaguuguccauagcuccuuaguuagggguguggcucaugagccccuccccucucucugcuagaauguugauaggcuugaucauguacagauguuguguaaaccaaaauugcuaugagcucauguacagugccucugucauguccaauagacacuguuuugcucuggucuuuccaacuuacgguucuuagaaucuuuuuuuuuuuuuuuuaauguggugugaaccucuuuuuuuuaagguuuauuuauuuauuauauguaaguacacuguagcugucuucagacaccccagaagagauucaguuaucauuacagaugauugugagccaccaugugguugcugggauuugaacucagggccuucagaagagcagucggugcucuuaaccacugagccaucucuccagcccucuuaagagucuuuuaaccccuucuuuaucaauggucugugagcaugcuugcaagaguaugugagugugugugugucugugucugugugugugagugucuguguguguguuugcauaucuagaaagcaacauucuacacuacucugaccuuagugacuguccuuggagaacagaugucagaaggugagucagucagcucaguuguuccagcccuaccuagagacacgaacauaauugaucuugcacauuugacugagcauagaauuucuuauuagggguugucuuuuccccuuuagugugagagaccaggaauuguuacagaccgccccucaagaagcuggagaugaaggcaagcugcacucugcagaagaggguaagucaggccuuccugacauaaugacacuaaggggcaguggagugaugccguuccauuauucccaucaucugaaggccauuugccaaauuuauuuaucauuuaucauucacaacaucuuuuuaaagaauuaaaaugucgggggcuggagagauggcucagugguuaagagcacugacuccauuuccagagauccugaguucaauucccagcaaccacauggugguucaugacugucuguaaugggguucaaugcccucuuccaguguuucauacauaaaauaaauaaaucauuuuuuuaaggaauuauaaugccauuauuuuuucuucagcugccauugugagauagugaguaguacuagacuggggugguuauaguaauaucuuguguaacuaaagcugccaaugauuuuuuuuuuaagaguucuauguaacccagagcaauuuaaccauacuuuuguuuaagccuuccaagcuggaacuaaucugcuuuuauuucaaucuuaagagacuaugggggcuggugagauggcucagagguuaagagcaccgacugcucuuccgaagguccuaaguucaaaucccacaaccacaugguggcucacaaccauccauaaugaaaucugacauccucuucuggagugacugaagacaguuacaguguacucacauauaauuaauaaauaaaucuuaaagaaagaaagaaagagacuagggaaauaagauaugugcucuaauuccuguguuugagaaaauaucuuaaucugcacaauaggauuguaugagcuagaucuucaguauauuugguaguuuaugauuuuagcuccucuaaagaagccacuggaaaccaguuaguggugauggaagccuuuaaucccagcacuuuggaggcauaggcaggugaaucucugugaguucaaagcuagccugggcucauagauuucucagacagacagggcuacacagagaaacccuaccuccaacaaacaaagaaauaaaaaacgccaguggacuggggcuggagaacuggcaaagcagugaagagaacuuguuccucuugcagaagaccuggguuugauucccaggacccacacuggguaguuuguaagcauccaaaacucgaguuccaggagaucugcagcccucuuuucucuucuuugcgcaccaggcgugccuguggugcacauacuuggauguaagccaaaacacauagacccuuauuuuuuuuuuuaagaacaucuaaaauuuaaaagguaaauaaauaagguuaguggauugguuuuuacuccccaguuguaucugguauguaguuucucgugauaauuccauuuuaaagaaccuucuuauuuuguguauuucagcugcuugugaguuuucugagggcauaagaaacauugaacaucaucaaugcagugaugauuuaaacccuacugagaaucaugcaacugaaaggcauccagaaaaaugucagaguauuucuauuucaaauguguguguggagccauguggcacagaugcucaugccagcucauuacagccugagaccagcaguuuauugcucauugaagacagaaugaaugcagaaaaggcugaauucuguaauaaaagcaaacagccuggcauagcagugagccagcagagcagaugggcugcaaguaaaggaacauguaacgacaggcagguucccagcacuggggaaaagguagguccaaacgcugacucccuuagugauagagagaaguggacucacccgcaaagucugugcccugagaauucuggagcuaccaccgauguuccuuggauaacacuaaauagcagcguucagaaaguuaaugagugguuuuccagaacuggugaaauguuaacuucugacagcgcaucugccaggaggcacgagucaaaugcugaagcagcuguuguguuggaaguuucaaacgaaguggauggggguuuuaguucuucaaggaaaacagacuuaguaacccccgacccccaucauacuuuaauguguaaaaguggaagagacuucuccaaaccaguagaggauaauaucagugauaaaauauuugggaaauccuaucagagaaagggaagccgcccucaccugaaccaugugacugaaauuauaggcacauuuauuacagaaccacagauaacacaagagcagcccuucacaaauaaauuaaaacguaagagaaguacaucccuucaaccugaggacuucaucaagaaagcagauucagcagguguucaaaggacuccugacaacauaaaucagggaacugaccuaauggagccaaaugagcaagcagugaguacuaccaguaacugucaggagaacaaaauagcagguaguaaucuccagaaagagaaaagcgcucauccaacugaaucauugagaaaggaaccugcuuccacagcaggagccaaaucuauaagcaacaguguaagugauuuggagguagaauuaaacguccacaguucaaaagcaccuaagaaaaauaggcugaggaggaagucuucuaucaggugugcucuuccacuugaaccaaucaguagaaauccaagcccaccuacuugugcugagcuucaaaucgauaguugugguagcagugaagaaacaaagaaaaaccauuccaaccaacagccagccgggcaccuuagagagccucaacucaucgaagacacugaaccugcagcggaugccaagaagaacgagccaaaugaacacauaaggaagagacgugccagcgaugcuuucccagaagagaaauuaaugaacaaagcugguuuauuaacuagcuguucaaguccuagaaaaucucaagggccugucaaucccagcccucagagaacaggaacagagcaacuugaaacacgccaaaugucugacagugccaaagaacucggggaucggguccuaggaggagagcccaguggcaaaaccacugaccgaucugaggagagcaccagcguauccuugguaucugacacugacuacgacacucagaacagugucucaguccuggacgcucacacugucagauaugcaagaacaggauccgcucaguguaugacucaguuuguagcaagcgaaaaccccaaggaacucguccauggcucuaacaaugcugggaguggcacagagggucucaagccccccuugagacacgcgcuuaaccucagucaggagaaaguagaaauggaagacagugaacuugauacucaguauuugcagaauacauuucaaguuucaaagcgucagucauuugcuuuauuuucaaaaccuagaaguccccaaaaggacugugcucacucugugcccucaaaggaacugaguccaaaggugacagcuaaagguaaacaaaaagaacgucagggacaggaagaauuugaaaucagucacguacaagcaguugcggccacagugggcuuaccugugcccugucaagaagguaagcuagcugcugauacaaugugugauagagguuguaggcuuuguccaucaucucauuacagaagcggggagaauggacucagcgccacagguaaaucaggaauuucacaaaacucacauuuuaaacaaucaguuucucccaucaggucaucuauaaaaacugacaauaggaaaccucugacagagggacgauuugagagacauacaucaucaacugagauggcggugggaaaugagaacauucuucagaguacagugcacacaguuagccugaauaacagaggaaaugcuugucaagaagccggcucgggcaguauucaugaaguauguuccacuggugacuccuucccaggacaacuagguagaaacagagggccuaaggugaacacugugccuccauuagauaguaugcagccuggugucugucagcaaaguguuccuguaagugauaaguaucuugaaauaaaaaagcaggagggugaggcugucugugcagacuucucuccaugucuauucucagaccaucuugagcaaucuaugagugguaagguuuuucagguuugcucugagacaccugaugaccugcuggaugauguugaaauacagggacauacuagcuuuggugaaggugacauaauggagagaucugcugucuuuaacggaagcauccugagaagggaguccaguaggagcccuaguccuguaacccaugcaucgaagucucagagucuccacagagcgucuaggaaauuagaaucgucagaagagagcgacuccacugaggaugaagaucuucccugcuuccaacacuuacugagcagaauaagcaacacaccugagcuuaccagaugcagcagugcugugacacagcguaugccagagaaagcggaggggacccaagcaccauggaaggguagcagcagugacugcaauaaugaggugaucaugauagaggcaucucaggagcaucaguuuagugaggauccaagaugcucuggcagcauguucucuucacagcacagugcugcccaagggucaacugcaaaugcaaacucccaggauuccaauuuuauuccaccuuccaaacagaggagucaccagugugggaaugaggaagcuuuccuaagugacaaggaauugauuucagauaacgaggaaauggcaacuugccuagaagaggauaaugaccaagaagaggauaguauaaucccagauucagguaguuuuguugguuuauuugccccagucuacagaagugggcugaacauacacagucaaaucuccuucuuggggcuagagagauuucgggugguuaagaguagguacuuuggggguuggggaaaggcuggagagauggcucagcuguuaagagcacuggcugcucuuccagaggauguagguucaaauccuagcauccauguggcagcucacauuuuuuuggucacuucaauuccaggggaacccauuacccucacacuuauacaugcagguaaaacacaaaugcacauuaaaaaaauaaaguggugcucuaucuaagaccaaguugaauucccagcacccauuucagguggcuccccccggugucuccugcauuaguguauaaguagcccacacagacauacacaugauuaaaaauaaaauauuuuaaugcugucaugcagccagaaugccugggggcaugagcuugaguaaccuaauuuucaguagacuugauucuacuuuuuauugcagaauuuuucugauuuguuugggcuuugguuuugguuuugguuuuagacaguuugucuauguagcucugacuagccuggaacagagaucugccagccucugccucccaaaaucugggauuaaauacauucauuaccucacccagccuauugugggaguucugaaaggaaauccagugucccaaauguagccaauuaugugacaugagggagaaguagaagcuauacaaggggaggaacaggcacugaggcugcaggguucgcgguccaguuuuacaucugagucucugauuguguugucauuuuaugugaagaggcauccggauacgagagugaaacaaaccuuucugaagacugcucgcagagugauauuuuaaccacucagguaagaagcaggcacgcguuugugauguccucuggauaguguaaaccuacgugcucauacaugguccuuuguuuccuuaagggacacuucuaaagcaucuggguggaacucacuaccuuuuaacuguagaaccccagccagaucuaaaaauccuacuugccuuauagcaaaauuauaugaaagcacuauuguaucaaagggauauguuuauucucugaaccaaacugaagccuacaggauucuuuccacuagaggccaucuuaccuuucacuguauuauuucuuuuaauuuuugucuuuuauuaucuaguugcuuguuaguaucuuucuacuuggaaacgaauggccaggguauucauuccugcaccugguaacucccacagaugacgugagugcuccugcacucgaggcaggacaggcucuugggaaaaacaucauucucacagccagauccuagguuuaucgccuaacuuucuuuuugauuaaaaagaaaaaaaauuccuaaacuugcauuucaaaccuuagauuugucuagguauuucuuuccuguguuuaucuuucacuagcugggcaacuucugaggguuccccauccuguauuccucuacagaguccuaggcagaguguacagcaagucuggagcaaguauuggucagacucucugugccugaccaugugaucucaguuaauuggcuuauuuucucugaauuaaaauagcgauacuuuuuuuugguuuuguuuuuuuuuuuuuuuuuuuuuuuuuuuuuugguuuuguuuuuugagacaggguuucucuguguagcccuggcuguccuggaacucacuuuguagaccaggcuggccucgaacucagaaauccgaaucagccugccucugccucccgagcacugggauuaaaggcaugcgcugccacgcccggcuucuuuuuuuuaacauacauauuuguauguauguauguggauaugccaccaggguaaauguguggaggucaggugacacagucugugcggcagugcugaggaucaaaucagguccuccugugguggcaagugagcugacucacuggucccguggugugguuugaaucaucuugcuauagcuucuguuucucuuaaagcauaaaugugcuuuuagcugcagcauacgagugacuuuucuuccccuucuuuuuuuuuuuuaaagauuuuauuuuauuauauguaaguacacuauagcugucuucagacgcuccagaagauaaucagaugguugugagccaccaugugguugcugggauuugaacucaggaccucuggaggaacagucagugcucuuaacugcuaagccaucucuccagcugucuucuuuuuuuuuuuuuuuuuuuuuuuuuuaagauuuauuuauugauuauauguaaguacacuguagcugucuucagacacuccagaagagggagucagaucucguuacggaugguugugagccaccaugugguugcugggauuugaacuccugaccuucggaagagcagucgggugcucuuacccacugagccaucucaccaguccccccgucuucucuucuuaaaaaguacaaaacuaaaugaaacugggaauucuuaguauuacuaaggucacuuuguugucaccaaagacagcauccccuguugguuccagcaccccaguggcagaggcagguggaucucugaguuccgggccaggcugguuuacauggugaaugccaggccagccaggccuacaaagugacaccuugucuuaacaaaauaagacaaaaauugauuaaaagacuuaaaucuucucaugguccuuucuggauuuauuuggggcucugucaauaugucugucaccuaauucugucccuuagcugcuuguuuuuuaaguuucagcuuuuuauuccaucugucuuagccauacuguauuaaaucugacauucaauacacuacuguguuguuucuugggucucugauccuauucccagaaagaugcucauuauuugaucaggauucauuguuuuaaguguuuuuauaucaaguaucuauucaagacagguagcuuugauguugaguugcacggacaagcaaaaugauugcaauggacuuucccuauguucauauagaacugaaggguaagagaugauacagagugccucauguggaaucacugauauacuuugugaugcucaugguguguguauaguauauguguagugugggugugugugcagugaaggugcaagauugucuccucccacccacuauguaggaccuaaggauuaaccucaugucauuaggcuugguggcaaguaccuuuucacacugaaccaucuugccaacccuccuaccucccccccccccauuuuguaacucaaagauuuaauucauuuguccauuuucauauuaaacacuggcugugaaguuccucugugaugggcagugguacgggacuuaggguugcauaccuuguacgcccaugaccuuggcauucccagugugagggaagcuuagacaggggaaucucaacuuugaagcuagccgaggauacauagaccgcucuucaaaacaaaaagaacacaaaaucaacaaggauuccuccucccaucagggaaguuguguguuccccugaauguagugaugcuuuggcagccugagccacguaaugaggcacacugcuguccugauagacagguauugcugggcuuugaaagauuagaaaagauuaccaaaugggaaaagaggggaugugggaacugaggcaaagauacagauggccugaaugcauagggaccgccacugagcagucuagugucucuagaaagcugggcugaugggaaaugcugggcgucaauaacagauaggaucaagcuguccucagacuuuggaaugguuuaucuaggaaucugaacuuugacuugagggcaguaaugacgaaguucuuuagcgcugaaaaauacuagcuuauuaacugagcuguguuacgccauuugaggcccuuuuggaaaaaggauucuugauguaaagagauaaacgugguaaccugucuggcuuuguccucccuggugcauuugagcaccuauaccuauaguagaauugucuuaaguuuuacauuccuuccuguaggaaaagccacugcaguagugguccgauuacuuuucuuucugauuuucugguauguuuacuggccauguggaaguuagauggcauagcugugaguguuauuaauucagcuuuuaaagaauuggucugauaucuguguggggccuuggcuaggauuugaucagugaugucaguacucacggguaccacgugguggcauugguggcacugcagauguuggcagcauuacagucucaguagcagugggaaccuuuguaaagcucgaaauuacguuuuguuuauuugguuuuuucaucauaaaguucuccugggaacuaugaauuuaucauagcuguaggaagaauauggcuugauuuuaguggaaagcaaagucacuuucaaggucaaaagacagagaaggugaaacagauuuuguuccccuccagcagcugaaaaccuagcaucggcauuucuucuaaaagugaugaagagacauacauauugggaaauucuuuauuuguccacauccuuugcuugucaaauaccuuagacuugcuagauugucugugacaggaucucacuguguagucuuggcuauccuggaacucacuauauagaccaggauggccucaacucaacucaacuacugcuauuaaagcuauuaugcuuagcugaaauuacucuuuuuuuuuguuuguuuuguuguuguuguuguuguuuguuuguuuuguuuucugcuuucaagacaagguuucucuguguaacaacucuggcuauucuggaacucacuuuguagaccacucugcaaucuggccuugaacucacaaagaucuaccugccucuaccucccaaguacugggauuaaagguagcuagauuacgucuuaagguggaucaguaaacaguaugaaccuaugggaaagaagaguucauuuucuugaauugaaaacaguaauuugggcuggagagguggcucagcgguuaagauaacugacugcucuuccaaaagcccugaguucaaaucccugcaaccacaugguggcucacagccaucuguaauggcaucugaugcccuuuucuggugugucugaaagucaguuacagugcacucacacacguuaaauaaauaaauaaauaaauaaauaaaucuuuuauaaaaaagaaaagaaaaagaaaacagcaacuuguuauaggcuuucuagaacaucguaggaaauuauucaacacugaauccauguaaaaacuaaauuuacuuggaucuaagcacagcgauguaucuuuucacucagcuacaaauacauuuuuaaauuuuaaaaauaauaagaaauaaauaaauggggcuggagaaggggcucagugguuaacagaccacucaguucagaggaccuggauucagcuccagcugauggcuucaaugcccuuccgugaccucugagagcaucgggcacgcacauggagauaaaucauucauaaaccugaacuuaaaaaaaauuuuuuaacuaggcauuuuguagacuaauuaaaugucuuaucucacaguagcgagucuuuagaacacaguuuauauaguuugugaacagauucuugugaauuuaagcuuaaaguacuguaauuaccccagucugucccccaucuuuaaaagaaaaugaggagcuacagugaagcagaucuaucuggaagagcucgagggugcacucuccuccaacaucauuuucaaacaauugcaaggucauuaaccacaugaguaugguuggauuaaaggguauucagccagaacucauaauuccauauuaggugaucucagcucccaugcuaaaauuaauugcugugacauauucuuacuucguggcacaucucucagaguauauaacuuucuugguguucuuguuugguuuugcagcagcgggcgaccaugaaguauaaccugauaaagcugcagcaggaaauggcucaccuggaagcugugcuggagcagcgugggaaccagccuucuggccacuccccuucccuccuagcggacccuugugcccuggaagaccugccagaucuggaaccaaacaugucaggagcagguguguagugcugaacaaaugccaguguuacaagcaaacuucuucccucccucgacccucuguuuccuucgaagagugaggacugaguuccaacauugugugaucuuugcucagugcagguuuacugaguugcuccacgaguaacuugggaaccuuagaccuagucccugcucacgagagcugugccacugagagggacccaagggaaucuuaauucauguucuucucuggguguuuagaaggagaugcuauggaccccauaggaaauagaaauaguucuugcacuucguuguuagagaguaguuauagguagccccaucauuucagaaagccaugugaaaauaagacccauucagaugaaauccuuacagugauagaucacaaagugaagaucugcuuccuggguuuucugauuuauaagacgagaucuuugguuucaggagcuucaccuuauguuuucaaguagaaagugggcuuugguggucauguugguaaucccagcaguugggguguggaggcagagggaucaggaguaagggaaguuuucauuuagagaauccuggugugcggcaggccacccacaggaggaguuggugcuuaggaacagaugagggcagugagccuucucggaguuucuucacugaaguccuacaugacuugcugcucaaguuccuccugcaacccuuccuguacaguccucuggacccugaggcccuccuuugacuauuagggacucaagucuguucaucauucagucaagugaccuuggucuccacacgugccuugucauauuuccaugcucagaaagaaacaguagcucaugcaagggaagcugcuuguaaagcucucuccuugaauacuuucuuuguaagcgcaucuucauuuaguucaucaccagauaaugaagcccagagucccauccccuauacaguaaucucuggguacugucacugucauuacugugaaaauagacaggacuuucagugcucuuacacaagauaagacuuguuagugucuggcuuugaauaucugccuaaaccuacuaccucauauuuggcauacacaauagaggguugguugaagguuuguguuguuuuguuuuuagcucccacugaaugucucccgauaaaguguuccuuuguggcucauuucuaaaauacuugacugucaugagcaacuccagaguugagccuuucuuaccuuaggcugauguauuaagagaaacucaauuucuuuucccuuuuaaaagaaaggucugacagcacacaccuuuaaucacggcacucagagaggcaggugcaagaggaucucuaugaguuaaggccacccuggucuacauagcaagcucuaggacaggacuauauagagauacccuaucuccauaaacaaaaagauuuuuuuaauauauauagacuuaagcacuaggguuaauaaggauuacagaaagguacaacugcugugugggccugacaguuaccugcaaccccagccuaagaaggcagagacagggacccccagaucaagcuggcucgggagacuugccaaacagcaaacugggguugagugagagacccaaccucaaugaguaaaguaaaauagccauggagagggccagagagauggcucagcaguuaagagcauuugcuguucuuccagaggaccgagauucaauucccaacacucacauggcagcucacaacugacuguaacuccuauuccagaagaucugacacucucacacagauauacaugcaggcaaaacaccaaugcacaugaaauaaaaauaaauuaaaaagagccauagagaaucauuuuuuuauaucaauaucuggccuccaaacacuaauuuacauguguguucacacaugucacauacaauaugcugugcacaucugagcagguacuuuaaucacugagccgucuccccagcccauggucuuaaagaugaugaaaugcccuucccuggggucuuaacaucaaugcccagcucuucugcauagguuuuccuguuugucuaagguuuaucccacaaccuucagaaauauuugggcagaaauuuguacacacacauuauaccucuaaggauuuucuucuaucgugucauauucccugucauucagugagcaaauauuaacacuuaugagaucauggcucauugugguaaaaguaauuuucagauacaucugagcuuuucuagcugguagcauauuuauuccuaggaauacuuguucaauuuuucuaggauccuccccuuugaauucugaaugaguugggaauaguuggaauaaacaucuuauguaaccugugucucucugugugugugugugugugugugugugugugugugugugugagugucugugucuguguguguguguguaagagaaagagauugagagagauuuguuuucucuuuuuuaagauuuauuuauuucaaaugaaaaaaaauauuucauuuauuuauuucagugacauuuugucacugucuucagacaccagaagaucccauuacagaugguugugagccaccaugugguugcuuggaauugaacucaggaccucuggaagagcagucagugcucuuaaccgcugagccauuucuccagccccuuguuuucucauaauagcaggauucugcugugugauccuaacugaccuggaacuucaugucucuuuaauggauaaaagauauuuaauuuaaauauacauauuuaaauuuuuaaauaguuuuguugucugcauguguacuugugagcaccugguguccacagaggccagaagagggcauuggcgcucccuggaacgaaaguuacaaggcuguaagacacuacaugaacaucauacgguucuaggaaccaagugcaaguccucuguaagagcaacaaguccucuuaaccucugagucuucuuuuuuggacuguuuuugaugcuuaaauauucuacuauacaugauugcuccacacuuugaauugcaaugccuucuuuuauuuacguguuuauuuggacaaauucucucuagacugugcuaagacucccucuggagaccaggcugaccuccaacuccacacucacacacccuuguuuguuuguuuguuuguuuguuuguuuguuuguuuguuuuaagagauuuauuuauuauguauacagcauauaugccugcaggccagaagagggcaccagaucccauuacagauaguuguaagcuaccaugugguugcugggaauugaacucuggaccccuggaggagcagacaguacucuuauaaccucugagcgaucucuccagccugcuaguuuguuuuugagauagggucucacaguauagccuuuucuguccuggaacucacagagauuucucuuucugugccuaccaaauacuaagauuaaagguauacacugucauaccuagauuucaaugacuauuuaaugaauagaagauacuuacuuuucaauuaauuguuuuugauguuuaacuauuucuucugcugugcauaguagcauuugccucuuuaguucccagcccuugggaggcauaggcaaguggaucucugugagguccaugccagccuggucuacagagugaguucauguguuccuuuuuaagccauuucucaaagggaauagcaccugcuagagccuuaaccuugagucugauaugauuuucccuuuccugugccuuucauuauuauuuccuauuguccuagauuucuuauccaguaccaugagguaggugcaugccugugugcguguucccaguaauugaaaguaugaggcaaaugucaucucaucugacucuucccugcgccacccacccaccaccuccgcccccaccuucuccuuccacuaaagcuccagcagaccuggugccauccugaugagcuuggugcuuccaguacuuuugcuuuccugguggcagagauuuuggcauaggucaguuugcuuccaagauaagaauacauuauauauuuuuguuuucuuaucauuauuuaguacuagcuggugcuauccuuugucugcugaacuagucauaucaguaaaauucugucuaauaucuuuguuuaaauaccagcuuugggacuuggggcguacuucaguugguagggugccuggcuaacagugaagugaaggaguugguaucugguaccuagaaucagaugugaucacacacagcugggauccugcagcaguggcggccggagaucaggaguucaguaucauccuuggcugugcguucuaccacugccauccgugcuggcacaggcugguaaaacucugagaagaugacaguccuguuacacagaaaaagagaagaugaguuugauugucauagauugcugcuuuuaaaaaaaaucaauauccucaccugaauuaagaccaucagaacaaaugaguaaaauagauuuuucucauuccauuuaaagcaauuuuaacuucaaagaacauuaaugagaauccuguaagccaaaauuugaagagcgcuugugaugacaaauuccaacuacaacaucuggagggucccaccaguggagaugacgagucagggaugggaagguaagagacguccgucuguggcauccgagugacaucuuuguuacacugaacuccugucaacuuuccuccuaucccugagcuguggccaugacucagucagucaugugauuucuaugcaaacauggggcccugaguucagaucccuugaacccaucuaaaaguuaucuguaacuuugagcugggguuccuggggcagggacugagacaggcagauccugcgugcagugagcuuagauucagugagagaugggcauauagccauauagaaucccaacggguagacuuccucuagccuccaagugcaaccacaacgggcaccuacagccauauuuuaaaaaaaaaaaaaaugcaagaagcaguaacacaagccuauaauggcaacucuggggauacaaagacagaagcucuuuaucuuuaguucuguuggccagccuguuuauccaaauugguuagcuugaaagacacccugccucgaaaauaagguagagaugaaucaaguuggauucucaguguuggauugcgccuucuuccugcucccuuaugcagguaauguuucuccuguccugccuggguuuguuuuuuguuguuuuguuuagggguuauguugguugguugguugguugguugguugguuggagacagggucacccuagaugguguggaacuuucuguagaccaaccuggccucaaacuuggaguaguccuucuuccaccuucagaauacuagauguacacaauuacagacccuuagugacccuaggucacguuccuuugucgauuuggauauaggcuuuguuguguauguacaggccuaagcuacaacccgaaaaaagggaacuuagaucuaacuuugucuuugagguuagaauguaauguaacugaacuaaaacagaagccugcuaccugaugguagucuccgggcagaccuugcccugauugaauuuuuuaccucccuagaaaaagugugucucuuaauuuacucugggaaauauucaaaauaucauuccaggauauauauuuaaaucaccauugcuaaaaucuauacaaaaaaaucuauauuaaaaaaaaaaaaagacugucacguuaaaauucugaguucaggaauugggggaauguaccaucucagcuggcuuuuauuuucagaacuacuuaacaccuaucaggacagacagacaucuucagcacuccaagcaacgaaagaacucuuguuuucucaauugcuauugugucuguauaucccuuugggaauggugacagguugucgguaaucuaacaaugcucuuucccuugccuugcacuuaacagaggacaucucaaggcuaugguacuagcauugugauugugaccaaauaaauaaauaaauaaagucagcuuccuugggcacugaagcuguguuuaguaguaagcaucucauuggcauacugucaugaacacuccaaacacucgaggaacuacuuacuacacacauauauuauuaucuuuaagggaugugauaguggggauccgaagcaggccuucccaugugcuaggcaagugcuuuagcucugagauaugugcuuaccccuaagaguugacuuuugauuuuguuguuuuuaauuuauuuguguauguauuuggagacaggaucucagauagcccaggcuggcuuugaacuuaccauguagccaagggggucuuuggccuuuuccuugggagguagacucugagucaugugcuacuauuccugacuuuuauuuuauuuuguguaugugagugguuugcucaaauguaugucuguaucaugugcauccuggagcuggaauguuuauuggacagcugugaacuaccauguguuugcuaggacuuaacccagguccucuccaagaaggaaaaaaaugugcuguaaaguauuaagccauuucuccagcccagccucuuguuuuuggacaucuuaagggcagggaauaaaagugauacucuaaauucuuccaaaauuagguagaaauaaaguauagagaugucaacauggcucaguuuucuaucuccauaagaggccucacaugcauuuggacucaaggggaauauggaaucuaaauuaggaauaguggguauuuggcaaaaagaaaaaaaaugcugacauucuuuucaacagcuccaagaucagccucaggccucagggcuucagaccagcucugaggggcugucaugugucagcagcagcauguuaggcagcaugaauccaaggguuuuuuugcuggucauccccuauuucucugacagucagauguucuagucauacguuggcugcugagggggcgugaucaggccuuucuuuuguuuuuguuuuuugguugguugguugguugguugguuuugguuuuucgagacaggguuucucuguauagcccuggcuguccuggaacucacucuauagaccaggcuggcuuugaacucagaaauccaccugccucugccucugccucugccucugccucugccucugccucugccucugccucugccucugccucugccucugccuccagagugcugggauuaaaggcgugcgccaccacugccuggcugaucaggccuuucugagcugguagugaugguuuuccucuuucaucccucuccccaggccuuccccuuuuaaaucuccguuggcaggcaguaggggcucugcacauggcugcucuaggcaucuucaaaagagaaacucccccucucaggaggagcuccuccagccugcuggaucagaggcgucaucugagccacacaauucaacagggcagucuugccugccaaggcgagagcuagguaauacuccaucuuuuuuaauggaaagacuuuuuguuucacugucugcuguuguaguaggucuucaaaugcacuggcuuguggauguuuguuauccuaagguaagugcaccuuugaaaaauaacucgaguugcagucugaguagcaagucugaccacgguggguuagcaauaauugacuaugguagacucugucaucgacauguuuggcuucaucuguuagaaucuuaagacccagaauaaaguuaggagucuguccuuugucacauccuaaagugagcuaucuuuaauaaauauaaaugacugucuuuuaugcuucauaaaucacauaaaaugauauauuuuauuaauuguaaaucaguuuuuguuaguaaagaaaggcuuuaauuacucaucaaaaugcaugaucauaaaaacacuauuuggcaucagaugcagugucuggcugcguucuuaccucgcuuacuuuuuuguuuaagauguacuuacuuacuuuuaugcuguguauaugggaauuuugcccacgugugucugugcacugcauguguaccuggcgccuguugaggccagaggcggguguuuugaucagugacguuuuccuaaaucuacuguucuuaacaugcuuaguuagcaccuguuaagugaaaaauguaaugauuuuauuuaugauuuuaaccuucuguuccuuccucaugaaaaucuuguauauugacugcccccaaauuggacaauacaguaaauaagaguauuuaaaaucaccucuucuccuguccaguuaugaguaauaaaauauugcuauuuuggcuggucaugguggcccaugccuguuagugccaguaccugauuggcagaggcaggaggaucacugugaguuugaggccagccuggucuacacagugagcuccagggcacauaaugagacccucuaccaaaauaauaguaauaacaauacuaauuccuguuucuuuagauauuuuacucaguuuuauuuuuuuaaauauaguucuaaaauauaauacagcgggacaggucuguggucucaguagcugauguaggaggauugccucaccuacaguucaaggccacugucaucagugacacugcagacccuauuucaacuaaucaauucaaauuuaaaaaugguuuuaaacuuguuauguagcccagguaagccuugaacuugugauucuccugcuucagccuugaguagcugggguuauaggcccaugccaccaggccugacuacagacuauauuucugaacuggcaagauagcuuaucagauaagagcacuugucaccaaaucugauaacaggguagaaggagagagccaacccuuuacauauaaugccguauuauuccuuuuagauuuauuuauuucguguaugugggugcacugucccugucuucagacacaccagaagagggcaucggauccccauuacagaugguugugagccaccaugagguugcugggaauuaaacucgggaccuuuggaagagcagauggugcucuuaaccacugagccaccucuccagccuauauuauucuuuagagaaguuaugguaccaugcuuucacuacuguauuuucuucuucuuaacacaacuuaaugggucuuuuucuucacagaaacuagaaacuucaguucaacauuuucugccacuuaaguugaguuugucuuccuugcagaaggaaccccauaccugggaucuggaaucagccuuuucucuaguagagaccccgaaucugaguccccuaaagagccagcccacauuggcaccacaccagcuucaaccucugcacugaaaauaccccaaggucaaguugcuuuccggagugcagcugcugcuggugcugauaaagcagugguaggaauugugagcaagauaaagccggaauugacaucuucagaagaaagagcggauagagacauauccaugguggugucaggcuugacccccaaagaaguagugaguguguccucuguaccucucuaacuguggcuugacuuuggcugccagauaauuaguauaaguaguggcaauggauaaccuguaggaagaaaguuauuugaagaaauacuuggugaauacuaggcaccuugugagguaugauagagauuuugaauguauuggaauuuccuuuuuuuuuuuuccaaacaaaacaaacaaaaaacaauaacugaguaacuagguagagcagcucucuucaguaggcauugucuucccccucaguucacaucaaguaaacuugucugcauuucuccagggcuugucuuuaucuuggcugggaacagccugucuguccuuucugcccugcaauacuuacccccucgcuuacuagggcuugggcaccucgggcccuugugcaccuccagagauggaaauuguuuuauacucacuauaaacauuaagcccacugaacccauuuuucucuuuaagcugcuuauagauuuuaacaauucuggggaauuuauuucuccuauaguuaacuguuacgguaauauauaauaacaugucagaccaucgauuggauuuaauaguagaugccauuuauuacacacugagaggcaauauuaagcaauaaacucuuacuuaauagagccuucauaggcguggcuccauuccccauccuaacagcucuccagguagugugacucagcauagauucucgauggccccacguguuccgccauugaaaaggcaaggcaagcuuugcugcccucacagaugcaguauauccauacaagaugauaacuugauguugucacuucacagucccaugcuccagcagcaguuccucuggaaaaucuuacacguacuuguuugaauagcuccugguggacuuccuugcacacagagaauuccccuucauugaaaucuuuuuguuucuuuguuugguugguuugguuugguuuuuugguuuuucgagacagggauucucuguguagcccuggcuguccuggaacucacucuguagaccaggcuggccucgaacucagaaauccgccugccucugccuccagagugcugggauuaaaggugugcgccaccacugcccgcucauugaaaucuuuuauuaccuuaauccuuuguuuuugaguucagcucuuuagagauagcuagaguagucuaaucauuuucgccuugggcaauucugagcugcagauuaaacuauaagugcuuggguacauguuuucuuuaaacaagcaaagaagaaaacuuugagcucuauucagacuugcugaaguguguuaaauuuaugaugaaagccacugacuauauuacacaugauuaauucugaagcccauauuaagaugaucuuuucagcaguugccugucuaacugaacccuguuuuaaagcugggauuucagcaauuaaccaguucagaauugcuaaugacacuggcagagggcaacagcaaaaguuggaggaggguagcauuggcuucgccagccugcuguucuucagugcucaguggcaguguggagugaggcagcacgggcuggcuuccauugcaguacuaaggggcgcauaaaucuuggcguggguggggaaggcuaggaaaugaagcuucuugguaagcaagcuuauuuaccaaacaguagcuaccaguuauuuccacugugcccauaauagauaugguuaauuucuuuuacugccuauugauuuuuauuugcuugauagauaauagcuaagggacucuagauuucuuuuggaaagaaugagucucuuccaauauuuuuccuuaagagagaauugauauuuuuuguacugaaucuacaaauaccuuugcuugagugcuuuguaacuaucagaguugaaucuugacuuuaagcuauguauuaucuacaacagaacuuucuauauaaggcugguuacaacucaguuugagauguagacuuauaaauuuauuagaguauaguaggcugucauucuguaaagaaacucaagagaaucaggcuauaugaucuuugguuauaauuccauggcuucuuguacuauauagaacuacauuagaaaguuucucugacuuauacaugguuuuggggguuuuguuuguuugaaggcgaggcauuguuuacuugugugagacaagaucucacuauguaguccuggcuggacuagaacucaguauguagacuaggauggccuugaacucauggaucugccugccucugacucucaaguaccaugccugacugauuuacacauauugucaauuuuuuuagacuucaggcauguuuuauguuuaaaagccaggaugggguaagccugccaaccuggguucaauccccaaaaugcaaaugaaaauggaaggagagaagcuauucuacaauccuguccuuugacgccuacacagacacgcugaagaacaagcacacacaaucaacauuuaaacaguuuuaagagaugugccuuuuaugagaauggagacucaaaaucagaguaauuauuacuuuaagcuguguagcagaauuaacagcauaauucaguguuugauuuuuguuucagaugaccgugcaaaaguuugcugaaaaauaccgccucacuuuaacugacgcaauuacugaggagacuacacauguaauuauaaaaacagguacacuacaaacuuuuacaggcuacgcuguauuuacaucauaagcuauaugaagagcuaugucaaucaaguuaagcaucccuaacccaaaaguucaaaauccucaacuauuugaauguagacagcaucggaaacggagaacuccacuucucgugggauaguucauaggcaggaugugggcaugggcagcacguguguaccguugccuucaggugugcagaugaagcugaggggaagggugccacuuaauugacaugcagaaggcccuggauccgcaguucucaccuguggguccugacccuuuggugagguugaacaacccuuucauggaggucaccuaagaacgugugaaaaugcaggugcuuauauuaugauucauaacgguagcaagauuacaguuaugaagaacaguuaugguuggggggacucaacacaaugugaagaacuauauuaaaagguugcagcauuaggaaguugaggaccacugcucuagguacuaucucuagcaccauaaguaagaaaugacccucagauuggccguggagacucacaccugugaucucaacguucaggagacugaagcaggaaaucauaaguuuaaggccagccuaggcugugaagcaagacuuugucucaaaaaauaaaugaagcaacagcaacaaaauuuggauuugugcuaugcauggaagaugucucaauauauaugcaauuuugcuaaaaaaaaaauacuuuugggccuagcauuccagaguccuuagccuaucuuuguuuaagcaagccauggaugaaguuuccugauagucauucauugcuuuauaaagguggccauuuuguuugaccuacuaauuuggguuaaaauuuggggaguggccaggcaaagugcugaaccacuuccugucuaccugcuuggaguucagugcauauagaacagaccaaaucauggaagagcaagugaggcagagaagaaguaagucuucucucgaacucuggagacuagcuagcuacauguggccucuggcuugaguguggcugaguaaguccucuaaccuuaauguggaaaggggaaagagugagccacucacuugugugcuuucuccucguuuagucuuaauugugcuuguauaagauagcucugggagcuuucacugacuguguaaagucugagugaacagcagacauugcaggcugcuucccugcauuaacacagccugauaacguggagcaggugaagccuuugaauauuguggagugauagucuaggugauauccgcugugcugagcgcagugcuuuucauaguggcaacuaaugagcucagagagcauugaaggacagauggagaaaagaacucaguguaguuccagggcucgagcaauggcucaguggacccagguuugacccucagcacccacauggcagcucacagccaucuauaacucuugugcugggggauccagggugccugcgacuuuaggcaccaggccugcaugagacauguagacauacaugcaagcaaaacauacauaaaguaaauauaaaacaauugauuuuuauuaaaagugauguuugacaaaguaaaggaaugagacugaaggggccaagauauccaucuuuaagcagcugaaaaauuauugucaggcuucagaaauuuaaaaacaagccacuauuccuggggauguaggaaguauaaauuauggcuacacucuaaaaccuggcuaacagacucuguuuucugguguacucgugccccaucugggguauuucuccccacagggcucuaggcuuuuccaaggggcccaaggcucuuugacucuuugccuuaagaaagcuaaaaucuaggucccuucuucaguggaucguaccagggggcagugcucauuacaauaggugccaggacaagcuguggcaagcuaaguacuauugaagaggggaaugucguugaauuuucauacauuuuaagcagcaaguuuggaugaaaggugauaaaggcugaaaagggagcuuuaaaauacaaauuaaaccuaaaguaacucuuuaaacucaaaagcaauacaacauuuguugcuugugaacuaaaaucggcuuuuauagcauuuaaacaaaaagcuuccaaaaaaauaugaguaauucugugaggcaaaauggccacuucuacuugcagauggccugcugugcuugggauucaguugaauacuuuucuccuguuuaaaugguuuuuuucuguuugcuuaguucuucaaaggggccuuugaaacacuaggcaauaaacagauucuucagccacugcuuauugaaauacaaaaaagggauagcuauaacaagacuuuuccugaaccucucaggaauacaggggguaaggguccccugggagaaauugccugggugaacuucuuucacgucggcauuucugauuuaggaucuuuuuuucaaauguuggacuucagcacuauuuucuucucucacauauugcugucugguaaaauagaucucaguccauaucagucagcacuacagcauggguaaucaacgggaucgaacucuucagcuaaccuuggcaucucaaagcugagccagugauccucuggucuuaacauggcgucugcuucuuccaaacuuguaaaccccacaccugguugucugucaucagaggugaaucaccauuccagacugaucucgagcuagggcuggggcuccagcucuucaggggcagcgccucuuauucgcucuuccucagccuuuggguguuuuucauuuuugcagaugcggaguuugugugugagcggacacugaaauauuuucugggcauugcaggaggaaaguggauaguuagcuauucaugugaguacaauauuggggggugggggcgugucucugcugcucccucuagcaccucagagcugcauuuuacaccuaacauuaacacgugagguuucugcugaugccaagucugagcaccaaagggucucuagugguaucacaaaacuagcuuugucucuaggugcgugucgcuuuguucagauccacuggcauugcugagaaagugauuucuuucauaaccaguagggccugaucuucucugagcagagcuagcauaugaacaaggauucauuuaauagucggugggaacccaugcacagcagcacuuuuauaauguuuacacuagguagcagcugucuccagagggaggucucugccacgagccuugugaaucgcugagcuucccaccuccacagaagggacguguuguucuguucucugugacuuaccuucucuguauucucuucaggggugguccggucuauccaagaaagaagacuucugaaugugguggguaccugauacgaacugaucugggacaccucgcaugggucagguggggugucaggcggaggagggugugggucugcuuucuuccucaacaagggagugaugcagaacaggccaggaaaugucauauucucaggcauucuagguuuuaaaggaaagucuuuucuucggagaaagaauuuuacagauuaaaaauucggaggaacaaauaaugaaccaccuccagaaacagauggggugaugcaccucugugacccuggcauguagcaagagccugucuuuggguugauugguuugguuuguuuuguuguuguuuguuuguuuguuuguuuguuuugauacaaaguuucucuguguagcccuggcuguccuggaacucacucuguagaccaggcuggccucgaaaucagaaauccaccugccucagcuucccguacugggauuacagcuugcaccugguuuaagagccugccuuccucucucucucucucucucucucucucucucucucucucucucucucucucccuuccuuccuuccuuccuuccuuccuuccuuccuuccuuccuuccuuucuuucuaucagaaacaggguccacaguaauauaaaugauaauuauuaucauuguuacuguuauuauuugaguuucauguaucucagaauggcuuagaacuccugcuccuccuguaucugucucccgagugcugggauuguaagauuauagguagguuccacccugcuaagcuucuccugacuccuuuguacaccuuuguaggaaacuugcuauucaccauuguuaaagacuuuggguagggauguggcuugguuuaugcuugucuuugaggcccuggguuugagcuguaguaccucacaaauguguguuacaaaagcuuguuauuuaggcccugaggcagugggagcugcagugggagaaggucauuaauccugaaacuauauggguucaaagccaacauaagcugcuugagacccugucucagaaaauaaugaauaugcuaauaugcuaauauaucuguuuauaaguuaguuuccuuccuagaaacgcugcuuuuucuaauacuaagaagagugugagguacaucugguaagcacguaggaggaagaauaaguuuagaacagccgagagcugaugacaagagaucacacaaaacaaacucaguggaaucuguuuaaaacuguauuaugcacuauccugauuuuaauuucacauaaggaccauuuauugggagccugcuaagugucaguuaugaggaauaacaguaaacaagaauggccaauucccuguucuggaaaugauguauggagagauaaacaauaaacaagaggccaagcgaagucuuuuguuauuugugaccuaaauaacaagaaagaauugucuuugaaaaauauagagaaugguucuuauagguaacaacagaaagcauaaagauuuggauguaggagugaguuuggcuuacuaaagaaaaaucuagcugggcagugguggugcacgccuuuaaucccagcacuugggaggcagaggcaggcagauuucugaguucgaggccagccuggucuacaaagugaguuccaggacagccaggacuauacagagaaacccugucucaaaaaaaacaucguaguugaagacggggaauuaguuuagggagggaccagaggugagaugaggggaaggagucagccaaaggccaaggcaguucagauuuuguguuaaccacagucauaauuucaguuuuauuuuuaggauaaucuggagcauggauauagucucuauuuugggguucguuugaguuuuuaguguggggaaggugugugacuugacacguguggaggucagaggacaacuuguaagcaccagauguugguucucuucuaccgcguggaggcuggcaucaaagucagcaaagaucaaacuugcugucaaauuuggcagcaagagcuuugcccacugaaugcgguaccucuacccugugcuugguuccugcuccucaaacacuuacagccuuaguuucagucccaguggcuuucaagcauucuuccugaaaacuuccaccucccaaaauaguuacuaugaaaaaaaaaaucugaguuucuuuagaauaggguguaugggugugugcgugcacgugcgcgcaucagagacaacuuuguagacccuccuaccuuuauauggcucugugguggacucugguuaucaggcuucauggcgggcaccuuuaccuacugagccaucccaccagccccaucuuaucauugugaccucucuaacuguaaaucucucaacagaacucugaaaaacccuaauuucuucagaugacaaaauacaguugauuuaagugaccaagaauccuccaguuauccucucacaauguuagcaguuuaauguaaaugcuaagugaauguuuugagaagauacaaauguuagaaauuaaaaugcauuuuuaaaaagucaagucccuaaucccagcacucgggaggcagaggcaggugaauuucugaguuugaggccagccuggucuacaaagugaguuccagggcuguacagagaaacccugucucaaaaacaaaacaaaaaaaaaacaaaaacaaaaaaaaucaagucccagugggaugaaagccaacugguaauuucaacaaagauucucuuuggggauguugggauagcuuagacgaagguaccagcugcccugaccauuggaaugcagaccucaggacccacguggagaugaagagagccaaccucagcaaauuguucucuuaacuucuacaugugcgccacacaauaaauaaauaaaaugguugcuguaauaaauugacuuuagcagcugagaucccaguugucuuagucaggguuucuauuccugcacaaacaucaugaccaagaagcaguuggggaggaaaggauuuauucagcuuacacuuccacauugcuguucauuaccgaggaagucaggacuggaacucaagcaggucagaaagcaggagcugaugcagaggccauggagggauguuccuuacuggcuugcuuccccugccuugcucagccugcucucuuauagagccaagacuaccagcccauagauggucccacccacaaggggccuuucccccuugaucacuaauugagaaaaugccuuacaguuguaucucauggaggcauuuccccaacugaagcuccugucucugugauaacuccagcugggucaaguugacacaaaaccugccaguacaccggucauuaccucuaguucacaaaguaauuuccuuacuuuuggucaaaacuugugauucugaauaccuaaaguagauuugcuggcuuuacuucagaugaacguuggcgcucgcgcucucucucucucucauuauuugaaugaucuuuuuguguauguauacauggguguuuugccugcaugcaugucugugugaagaugauggauucccuggaacuggacacagcucacagacaguuacaagcugccaugugggugcugggaauugaaccuggguccucuggaagagcacucaguaguaguuaagugcacuugcuaaucugucaaggaaccaggguuuuauuccagcagccucauggguucucacagcuaauuuuuaacuccagguccaagacauauauauauaugguacauauaacauacauuuaggcaaaauacucauacauaaaauaaaaagaaugaauguuuaaaauauauuuucuaagauagggucuuaccuggguuugguggcaugucucuuuaaucucagcucuugggagaaggcagagucaggcagauuucugcaucccaggccagccaggcuccacggucuugucuccaaaaaauaacaaagacaagguuucauuauguaaugcuggcuggccuggacaugaguguagugccuuaaugcuucguggcugggccgucacccaccccaguaaucacagagguuuguguuugguuucagcaugaauuugaagucaaaggagauguugugacuggaagaaaucaccaagguccaaggcgauccagagaaucccgggaaaagguaaagucccucuuuaugugacagaaccccagccuaaggcucugcagccagcugcuauggugagguuagucuuuaccugguaggcacuuggcaugauugcuaucagaccacuggcugggcaguggagacagguuauuguuuuguuuuguuuccuagcccaagaaggcaaauggaguacuugugugccccauaagaaagagaacauuaggcugagggugcaguuguaguuuggguuccagucugagguuuagauccuagcugauggugacagagcuuggaccucagagaugggaagccuuuuguguuuccugcaccacggugucuuuucucuaagcaucacaugagugcuggaugagcagugugugcacagaaagugguuuauaguccacaguuuuacaacacugugauaugugugcauuaccucuauuucacaugagaaaauugagggcggguagcuuaaguuccccaucaucacauaacuagggagcgguagaagggggagagccuguacaccugcacuccaagucuaaauucacaagugucuuggcuuuagaaaguuguagacagcuucacaggagcaaaacagauucucccugcaacuuugcaaguaagagcaggacacucgaugacuuuccccagcguguuauagcagauggugcagccggaacuccaucuuccucgcaggaagaagucuucccaagauuucgcaccugccuggcaggccugagccagcugccgucucgguuacuggauaagugcuuguguucccaggcugcuuuucuuuuucaagugugcaccagcagguguuucagaacagucccacacggagggagcaccuucuguuccuucauagaaacuugagaggagaccaguagagguuguuuuucuaaggagaacugcucuggacaggaucacaaaucaagccuggaguucugagcccugggaucagcccauccucucucugagccuaucagaucccuguuccagaugccaagaacagcuguucacccugcuuccacuucuccuuguuucuaugagccgacccuuuguuccuauguaccugggagugcacaauuagcagugggucccuucucccucaagaucccuuaggauuucucucacauucaaaauagcacugauggaaauugcuugggcgaaguagugacauucagaagauacuaaaaugucacuacaguauuuucacaaagaaaucuauuuguagaggugagcuucagauuucuuaucucaccacuagacacugucaucaguaagcgucaaccuggauaugaagagccuucucaaggcagcguuuggcugccugagggaacuugucgcauuucugagcauuagguccugucagcacguuggggaucuguuuuauucguacagauugggagaacagcagagguuccugaacugccguucccaacaauaacugauuugcccgcugcuccuuucuccugccugcaguguaggaugaagccacuuccaauggagcuaucugugugcuuuuagccccuugaucuucucucucagccucugugccuaggugauuuuuagaccuagacaaauuuuguguuagugucauuaaaggguagaaagauggucaaaaaaaaaaagggucacucaaaugauauaugaaaguccuaggucugauggcacuccugugauacuaacacucaaggcuaaagcaggaagaaugauagcuugaaagccuuucaagaauucaugcccauguacacauaagaauuuauuuuucuuucuuucuuccuuuuuuuuguuuuuucuuucguucuuuuugaauucauacuaacacaguuguuacuagacacauugaagcuguucuaaguuucaucaaaaaaaaagaguucaaagcagauauuguguuuccugcauucaggaguuggaggcagguguauaguuuuuucaauaugguacaguggcacaugcuugcccugugccagccuuagcaucugugaaguccugccucuaaauaaaccagcuccuuaacagguggugguaguggugcacaccuuuaaucccaccacucgggaaggaaacaggcucacagaccucugcuaguuauaggauagccaaggcuacacgaagaaacccugucugggggagggucggaguacgguggggugggguggaagugcaaugaggaagacagccccucauccccacuguacauggugccacacaccguuaaucccaguaugacagacagacagauggaucucuacauuccaaguccaccuuuguguacauaaagaguuccaggcuaccaggaccauagugagaucuuuucucaaaaaauaaaaauaacugaaaauuuagaaguucaggcuugggcauaguaguacacaccuuuaaucucaguacucagaugacagaguuuggaucucugaguuggagaacagugagggcuacuauacauaccgagaaacccuuucuugaaaaaaaauuuuuuugacucaagagauggcucagugguuaguagcacugacuucucuuccagaggacccagguucaaauccuagcccccacauggcagcucauaacuuucuauaacucgaagaucugauacucucacauaaagacguucaugcaggcaaaacacaauacacauaacauaaagguaaauaauaaauuaaggcaggggccgggcggugguggcgcacaccuuuaauccccgcagaggcagaggcagguggauuucucaguucaagaccagccuggucuacaaagugaguuguagcuauagccaggacuacacagagaaacccugucucaaaaaaaaaaaaaucaaaauuaauuaauuaaaauaaauuaaucaagggagaguacagagauggcucagcaauugagagcaccgacaagucuuguagagguccugaguucaauccccagcacccacauagugacucacaacccucuauauugggaucugaugcccuuucuucugaugugcacaaagauagcacaccauauacauaaaauuaauaaaaauauuuuuuuuaaagaaaagggaaguuaagaaguacaguuucucgcucacaccguauuucagauguucaacaaccacaugugacuuguagccuccagccuuaggagaccagacacaggacauuuccaggaucacagaaaguucuucaggcagcacugaggagcacuguaauuacauuuuucccuuaggagggugcaugcucuguguguaaagcgagcauguucacauagcaggcgcucugcuggcgggguucacauuuacuucugacguaacaagccugagugggccucucacuucagccagagagcucugcauuucuugcuguuaaacauaaaggaccggggggauuguguguucguugucucuacuuuuguuuuccucaucucugaccagagucaccagcaugagccugggccggacuaauaacaaggugggaagugaaugacuacagaggccagagauaugacucagaggccuuggcaccuggaaaucugacuacuccuggccuccacuggcacuugacauauaugacauacaugcuuuuuuuuuuaaugacucuagaauguagauugauugaaugcaaauuucaauaaaauauaaaaucaguucagaaucuugaacugauugucucugggaaagaggacaaacugucaagugauagucucuuccauugugcauggagagugucuguauuucuuauaaaaacccacacucugguggugcuauucccagcauuuguuagauggaagcagaagggucagggauucaaggccagccuacauugcauuauaaguuuugaggccacuuggccuauguaagaucuugucucacaaaaaggggagacuggagggguagcucauugguuagugcuugcugcucauucagaagaccugauuuugauucccagcauccacauugaccaauucacaacugccaguaaccucagcuccagaagauguggugcauucuucauucuuccagccuccuuagacaccugcauaccacgugcuuuaucuucucuuuucuuguucucucucucugucucacacacacacacuuaaaaauuauaacuggggggcuggugagauggcucaguggguaagagcacccgacugcucuuccaaaggucaggaguucaaaucccagcaaccacaugguggcucacaaccacccgaucacgagaucugacucccucuucuggggugucugaaauaaauaguaaaaauaaauaaauaguaaauaaauaaauaaauaaaucuuaaaaaaaaauuauaacuguuucucuccaccccaucacuuacucuccucucuuugcagcucuucaagggccuacaggucuauuguugugagcccuucaccaacaugcccaaagguaaggcccugggagucugcagcguauuacagauagcauugaccuacauggaaguuccucggguggauuaaaugguccaguggaagacugcugugguucugggcuuauguaucaaaggcccuuguccuuguauagauuugguuaguuccuuucaaagggaaggucccucaucuuuuuucucugcuucccuucaccuccuggggcuggaguuguaugacuuaggagagggaagccuaggagcagugguucucauauuuauuuccucaugcuuuggugaccuucccucccaaccauaaaauuauuucgcugcuacuucauaacugauuuugcuaguguuaugagucauaauguaaauauccaauaugcaggauauuugauguaggaaaacccccccuccaagaggucgugacccacagguugagaaccacugcauuggugucuggccacagcaaggggcccuagcagugucacuuuguuuccuucuguacugguuacugauugcaguuuuagaaggucucaagugucacucaauguuuuauguguuuagacuuuaauauaaugaaagccagggacgcuagugaguauccugcgggagggguuaaguuaguagccucgguucaggcagcgccuccacaguucccgggaaugagcagauguuccuucaagaacaguaggaggaugcuuugagcaucuccaaagaagccuagaagguugcucagucagugcugcugaugcugaggcccaacuuccuaugagauucauccccuagauguguggauccuggcucacaugugaucuuuccuaaugacacgcuggaucucuggccagggugaccuguaucuuuuucccacuggauaaaauaucuuccagucuuugacauuuagaguaauuaccaugaagaaaggugcucucaagggccaugauugucaguucccaacagcaaacuaggauguagcggcaaaggaaaaagacuggguuuuucacauagugucuaacaauuuagcaaauuuuuggaaauucaguccucuuuuucaacauguuucauuuggaagaccaugaggccuuccuuaucuaccacauggcuucauggagacuaauaaccaaaaguaggcagcagcuacaucagcggcagauugacuuagaagucauacugauuuuaggguuuuucuauccuuaaauuaaaaaaaaaaaaaaaaaaaaaaaaaacagcucacugagguucgcuucaggggaggcuguagagggcacugggaguagaugugggucgcuauugugauuuuacaucugugcugugcagaugagcuggagaggaugcugcagcuguguggggcuuccguggugaaggagcuuccaucgcucacccaugacacagugaguaucacaguggggccuuaaggagaggaaaacacucuccuuccauuaaacaagucccccaaaguagcccaaagggcuuucucuacccuugacacuguagcagaagacugucugugaguaaaagcuuagaaacuguaagcauugaauguaucgagggaggucuuuuccuucuagcccuuuuaaccacguaaaaguggacaugacuuucccagaagcccugcuuuggcacuaaaugcuuuuuccuuucuggguaugcagggugcucaucuaguugugaucgugcagccaagcgccuggacagaagacagcaacugcccagguaaaguuucuccauguacuguacacuuacaucaugugagguccuguuggauggguuugauucccuacuaguuaguuaucugguuauuaccugacugauauaauucucagcugcuuuuuuuguuugggguuuuuguuuguuuguuuuuuuuuuuuccuuuuuuuaaauuuuuuuuuaauuuauuauuuauuauaucuuaaguacacuguagcugacuucagacacaccagaagagggcaucagaucucauuacaggugguugugagccaccaugugguugcugggauuugaacucaggaccuucagaagagcagucagugcucuuaaccgcugagccaucucuccagccccuguuugggguuuuuuguuugguugguuguuuuguugguuuugguuugguuugauuuuaagacaaggucaugucuuagaacgcagagauccaccagccucugcuuccugaguacugggauugaaaguguugucaccaugaguggccuguuuguugucuuggguuuugguuggccugcuauguaaugcauccuggucucaaauauuuggugaucuuucugccucagccuugaaagugcugagauuauaggggugccccaacugcacucaauguuuuuauaggguuuguuuuguugauugauuguuuugagguuuugguuuuucugagacaggguuucucuguguagcccugacuguccuggaacucacuuuguagaccaggcuggccucaaacugauucaucugccucuucccccugauugcugggaucaaaggcgugugcuaccacuacccagcuuucagccuauuuuuaauguuugcaugaaugaacaacuaaaaugucuauuaaaagaucuuuaugagccgggcgugguggcgcaugccuuuaaucccagcacucgggaggcagaggcagguggauuucugaguucgaggccagccuggucuacaaagugaguuccaggacagucagagaaacccugucucaaaaaaaaaaaaaaaaaaaaaaaaaaagaucuuuaugauggggcuggagaaauggcucaguggucaagagcacuggcugcucuucagggguccuggguucaauucccagcaaccacaugguggcucacaacugucuuauaacuccaagaucugacacucauacagacauacaugcaggcaaaacaccaaugcauguaaaauaaaaauaaguaaauuuaaaagaggaggcaggcuggagagauggguccaugguuaauagcauuagccgcucuuccagaggaccgggguuuaauuuccagcuacuauauagcaacucacaacugucuguaauucuaguuccagggauccaaugcccugaaacagacauacauacagacaaaacacugauguacauaaaauggguaaauaaauuuuuuuaaaaaaggaaagaaaaagaaaaucuucaguauguguguacaugccuguuuguuuacuuuuaaguguauauuuguagaaguuaaaaguacuguaugagaccagaugugcugguacacacuguuaaccucagcauuugggagaauaguuggaucucugccagcuuaaguaccgucugcucuacaggucaaguucaaggucuaccagagcuauaaaguaauacacgcuuggauguguguacauacauguacauuuacacacaagugaucguguuuaugauauuuugucuuuucacuuaagauauuccuccacaccaucugcucucucguggcuuuuccuaaaacagguugaaguucguauuauuucagucugggcuuuuaccacgcucacuccuuuggcuuuugaauaagguccuaauguguuguuucugaguaccugcuuagcccuaagaacuuauauacucagaucuuagaaugguaugguuggagucucgucuagaaggaugacuuacaccagucucugcuuguuucugucugcagauauugggcagcugugcaaggcacgucuugugaugugggacuggguguuggacagucuauccagcuaccggugucgggaucuggaugccuaccugguacagaauaucaccugugacaguagugagccacaagacuccaaugauuaauuuaagaaauggucuuccaugcccggggagcaccucucagucuuuggugcuuccacacccuacuuacuaaguauuuuucaugcauccgccuggaaaaaccagcuucuaccuaugugagggugggugccuuaaagguuuucuaaccaagucccccuuugaagucugucuugaacacaaaaaguuuucaccugagaaagcuuuaucccaccaauugagcaagaugcuaaucuguugcauaucguucuuggagagacaguagaguggcuuggcugaucugagcugggcauggugguacuugccuauaaucacagcauuugguggaaagagaugggcaugucgugaguuguauaugacugaagaacaaauagcuagugguccugauuuguuccuuauaaaauugcauguucauaaaggccaagagucaaguccuucaaggagauggcuugagaucugugguuugacuuaaaaucagugcuccucaaggcuccagguuuaguagccagcaccaaacaacacccagaauaggguuugugcaggacacugaggaaauucagagccagauuauguauuugaugugaaugugagguuuuucaagugccagugucaaggagagccuucuaauuccccauagcuuaugagcaguguaucuguuguagcagcucuaaguaacccauucuucuuuaaauacacggacucugauaugaauauuucaugucuguacaaugauggauuccaccaggaaaggaguuguugcuuucuuugaaguaauuucuucccuuuugcucccuguugcugaggcauacuacuucauaaauaauuuugcuugcugaaggaagagaacauauuuuucaugaacucauaaucuuggacuguuuauagauauuggggggaguaggucuucucuggccccccccaguaugcaagggcaauggagaccugauuauauaaaguauguuuauaaaugcugugcuguuaauacugcaaauaaacuaaauagcaaacauuuugaca

SEQ ID NO: 6402 - RNA, 29849 nt, Mus musculus
gguuucucuuaggcagccccuucgcaucuacgccugcuuauuacgucacaguaguucuguacaaagggugggaaucgcucccugaggccggaauaugagcgcaagguagugcccaaagcaguugcaaaacgaggucucaucccucccucagccuuccugccauggaagucuccaguuucgguaaauaagagacuuguguaagaagaacuaccaauuccagcaugcauugcggaacgaaaggccuucuccacagcaucucuuggaaaguguagucuuacgggaaaagagcuucucacaccggaagcaggcacgaguaccacaggaacccagucgguacagcggagaccuccucgcaguuaugcgucuuagcugcuaugaaucgcagcguucuguguucguguuuugugcacagaaaauagacuaaaaggagcuguggguuccaggaagacuacaauucccguccagccccgcgauucucggguaacuaguccgccaaugucagugaccugggaaaagcagaggguggccaaucggcuugggaaagggaaauccaaccagcugacuucugcgcgcuaguuccgccccucggccuggguguuuguuauuguuaugcgguucagagagcuucugucccucccuugccaacgcagcacugaccaaucgguagagagguuauuuugaggggcagauagaaagagccaaucaucuuguggaaaacuccgggaaacaugggacuaggcccggucucuguccgccauguuagauucaccccgcagggauagcaggcgagcuggccgcgaacgguccuugcacuggccacuggcaagcgccccccgugggcggaaagcugguaaggaagcuaccacuguuaccuagaaguaggggcacgccguucuuagagugcucggggaaguucaaggggaaaaucuugcaaagaggagugacuuuccguguucaggggcagccagucuuuucagugaccagaugagggagucgcuuggguugucaucgauagugggggguggauacugccugagggagacaguucauggcuuagaagggccaguuucugcuaagaaaaggucucgaucccccccagaacauaaagagggcuucgaugguggugacacucacuguccuggggacauggaguuccgggaaaccauuacuggaagacugggauuaagucugcgacaagaaaggacauacaucuuccucauucugucccuuuccuauuuuuaaggcucuauugaaggaagauaucuugagcuaggaccuuccaaauuagaaaggcaucguuuuucccguuaugucaaacacccaccuuucagaugacacauuuuaaaacucagguugcuugugccagcuucugguauagaaaaugaaguucagauucccaaauuggcuuuauuaaaauuauuugucgggguugaaaaauaaucacgugaggaaaagcugacuuagccacaugaacgugagucaauagguaugaguuuacagugccauuuaggaaagugcaggcuuaggcccagcuaccugacugcuggagguaaaccuucagguauagaugugguuaacuguacuuuugauauuuucacaaguucaagaugauugcucuggcugaaagaauuuucacacguaagcccuuuaugaagaccuguauauuggccagcuaaacuagaaccgccuacuuccuguuuucucccaugggcagaacagcugguugcuccaaaguauggaaacuaauucccacuuguguaauuucagaacggggaagaauaguuuccuuccagacagaaaagaguggaagaguauuucuugaaguuggaaaguguguuucacaauuuuuacauuuuggucacuuuguuuuucugguuuaaagaaaaaacaaacaaaccaaccaacuugaacgugcuggggaguugcuggggaguugaugagccagcgucugccuaaauuuuacagcuccuaagaaggaagaauugcauuucagguaaaugcaugcugguugucagcagggugggugcuagagauuagcauuagcuuggcaucgaagucaauucuagauaaagacaagugaugggaaaaaaugaauaauugaguauauaaaauagucagaauuaagaauacaagguucuuuuguuucaauuauuuauuuugaaaccguugguguuuuuguaugucuguaggaggguguuagauuccccuggaauuggaauuacagacaguuggaagcugcugcacgggugcugggaauugaacuggguucuuugggggggucggggggggggggaggcugagccaucucuccagcccuacaggcucuuaaaaugacaguuguauccauaguacaacacucugaaggcagaagcaggcaaaucuauagcaauugccaggccagcaugggcugcggagugagaguaugucuccuucaaaaauuaguaaauaauaaacuagaagcuaucuuagugaaauaaagaauuguuucuguugauaagaauuuauacacuuuguggugcuagaaaugaaccccacagcuaugcacauaauugacugguucggccuuauucccaaucuccuaggccauaauuuuauuaaauuccuuugguaacacuguuaaggucaucaaaauaguauuguuuuuauagauuaaacaguugaagcucagagauaguguuucucacagcucuaugacuagucugugguggaacugugucuggaacccugagucuucccgccccauggccucccuuccugugacauuggaaaagucuaggacuuaaucuuguuugccucuuguguguggagcagaaucuggcccuuucuagaugcagauuuaaaaaugugcugaauauuuuaagaggugaccuuuuuuuuuuuaaugccagugaguuuacuuguagcguuaaacaacuuaaacuaccuuuuccccuaaagucacagaucaucaguaagcaaaguccuucauuaaagucaaaccgacuuuaauaauagauaagugauuaaagaauuaccagcuucuuaggugugauaaugguggguuuuacauuuuuuuucucauaaauauuuacgaaugaaaggaugaauauuuugucaagagagacauugucaugagacaaggguguagcucagugguagagugauucccuaucgucuagacaucuguauuccauuugcagccccccacacacaacugaaaggaaggaauacuggauaacuaaauuagcucccaguuggauauuguggaagcuagcugauagguccaaaaggacucagcaaguuccuuucuuuacuuuuauauaccuuuaaaauuccccauaagugauuguaagagguucugguagauuguuguuguuguugcugcuuuguuuugguguugguuuguuugcuugcuuauuuucuggagacuuaguguucauucuguaacccaggcuauucuugaccuccuuaccuaaaauuggaaauuccgucuauuuguacuccccaaggcagagcccuugucuguguuaauccaccuugcuggauuacgcuacagaugcucaacuauccaagcacugaaauaggcagugaaaaaucuuagagaccuaaaacaugugaaggggguuuuuguugauguggauaaaauuuaaacucguucaacagccguuuacccuccccacagcccaccucuuuaauccuaaagauaggaucucauuguuuccuaggcugaccuagaacucuuggacuuccauuaccauccugcaucaacuucugaguaacugggacuacaggugugugcccaacuuggcuuuucucucuaacauagaaguucuauauaagugguagcuauaacauaagugcagaucuuuauagcaguaucuugagcauuagugucuuuauuuuugagaaggaaaaauccuguguaacagugagauuuguagaaaacacauuacuagauaguaaugucaucauggggacauugucugucuuauucacuaugaucuuccaagucuaacuuauauaucagagcugaagccuccggguggguuuuuaaucccuuccucuuccuuucaucuaccuguccucucagcuccagccagacagcauggaaccacagguuacucuaaaugugacuuuuaaaaaugaaacucaaagcuuucugguuucggauccagaaaauacaaccugggcugauguugaagcuaugguaaguaccgcuuuguucuguuucucaguggguuauacacagauauuuuucaaaauguagcuauuuugagcaguuuauuuuauccauuucuggaccuuuuggaaaaucauuuuuuacagggauuugguauuaguagagaauauguacaaggaaaaaggaagaaacaauuauguuccuuuaaacaucuuuaaaauuacauauauuaauuuuuuugagagagagcaaaaaucugggacaauuuugggaguugguucucucuuguaugagguaaaaugauauuuucagugaauuaggguuuagagacauucuggggauaaguuaggcuguccuucccugcagccaggccguaguggguguugucugacuggagagcaggcgcacugcuguguuuguuaccugacgaggaugggauuuguguuuugcaagaccggucaguugcuuuaucgcugggucaaagguuggaugucucagagcuggcagaaagcagcgcagcucccaugggugcccaugcagcagcuccucugcuccgugcuuugguuuagugucuuucaucuugcuuugcccuuuguacucuucugguuuguggguugccauggucaauguuuuccuacuugggcaucuguguuuaauguaaccauuuuugguuacaaauauuucuuuaccugguuuaucuauguggguaacuucagcaggaaggacauuuuagaaaggggccuuccaguguguuacagucguucccugucuuccagcaguuucucuccauccugcccuaggcagguggcuauugaggaagcagugggguccuguuaaaugaucugagcaccagauuucuuucuuucucuagcagcuguugggugaguuggcagcuugcccuuuuuuuuuuuuuuuuauuggaacuuguuuuguuuuguuuuguuuuguuucgcuugaguagcccuggcuguccuggaacucacucuguagaccaggcuggccuagaacucagaaauccaccugccucugccucccaagugcugagauuaaaggugugcaucaccuugccuggcuggaauuuuuuuuuuuucuuuuuuuaagauuuauuuuauguaugugaguacacugucgcugucuucagacacaccagaagagggcaucagauuucauugaaaaugauuguuagccaccaugugguugcugggaauugaacucaggaccucuggaagagcagucagugcucuuaaccacugagccaucucuccagcccggaaauuuuuaaauuauauccuacaugugcaguucacgucuucuuuaaauagccagagaaaacagcccgaggaacuucccacauuuccauguucaugcgguuaucugguagggucauacagucuucuacaucuugcuuuucuugcccaacaguauauuguagcugugguuccucgucaguagacacagcaaucuuagucuuuuacagcugaguccacgguguucuuaguauugcuggacgauguggauaggaccauuacuuacugauuuccccaccaagguuuucuuucuuuucccauuauaaaauagacaggaccuacaucucaguaugaguaacuuaugugugguucuauagaguagagucuauccaaagguugugugugugugugugugugugugugugugugugugugugugugugugagagagagacagauagggacuggagagauggcccagugauuaagaacacuggcagcucuuccagaggacccuguuggauuuccagcacccagguggcagcucaccgcucgcuaucuguaacugcagucucagaacgucagccauccuccucuuuccuuugcaggcagcgcacucaugugaugcacaggcauaugugaaggcaaacacucagaugcaucaaaugaaaagcauuuucauagauagugccaagugguccacagaauaauuauaacaaugcacagaaaaaaugacucaaugccuagaaggguguucuguuuuuuauuuuguggggccggaggucaaauguuggaccuucuacaugcuggacaaacauucugccacuaaguuuuguuccuugcccugaaccuuugacaacacugaauauuacaacuucaaaaaauauucaugaccaggcguggugcugcacaccucuagucccaguauuuaggagacagaggcaggcucugucuuagacucugugagucuaaggccagccugaucuacaaagugaauuccaagucagccagagcuguugaacagagaaacagccaugucucaaaaaaaaaaaaaauguucacaucuuaauaaugugucagaugugucucuguuuacacuguuuggcuagagguaagguugaauauguuuauauauuuauuaggcauuccuauuuccucuucuguauauuuugugcacauuuuuacuuguauuacucuguaagguuuuuguucguuuuuguaagucucucuggcuguucugaaacuuacucuguaguccaggcuggccucacacacacacacagacauccaccugccucagccugcugcaugcuggggauaaaagcuuaaggaugugcacagcugcacuggacacuggauuauuccuccugcuaucgguuuucaugaguguguguguguguguguguguguguguguguguguguguguuuuacaaguuuuaccccuuuaucuguuaacucuuacagauguuuucucuuagucuguuuuaaguuauuuuuaaaaacuauauuaagguguuauguacguuggugaagggcucaguuagcauuuccaaagcucugcauugaauccccagcaucacagaaaaaaaugaacauaaggggcuagggagagggcuccuuggguuaagcccuugccacacaggugugagcaccaguguuuggauucccagcacccauacaaauguaaguguguguuauggccuguccauagagggcauccugggagcaaauuggcuggcuagccagauuggggagcucuugguucaagagguuuugccucaauauguaaguuggagauucaugggcugcuaucugcaggcugcaagaguggucuuggaaaggcccacaaguuuaccacacuacugguggcuuaggcagaauacucuccggcuccaccauuacugcuaaugcauguaauguuuggaaaguucauauucaauaaaagaaagucaaaaugauucaucuuauauagugagauacacugagccaauuguuucauuugcagguaaaaguuucauuugaucugaauacuauccagauaaaauaccuggaugaggagaacgaggagguaaagugucugaacgccauuguuagagauuuacaacaggggccuuuucuaaagugcuaaggagcuuaaaguucagaauaaagcccauuuuaguggcuuacaccugucuuuccaguacuugggaaguuuaacccaaccuggacuuuaaaacaaaagacugucucagagacccauagggagguggggggggggggacgaaagaaaaaaguucauaguaguuuaaucucauuugccuaguaguuuaaauguauuugcuaguugcauacuucaugaagacuaugggcagggaggcaggggcagauggaucucugaggccagccuggucuacagaacaaguuccaggacagccagggcuacacagagaaacccugucucaaaacagcaacaauaauaacuauuggcaucugagcuggaguugagaaaugggaaagcaacaugaagacuaucagagaaagaaccuacaauuauagcaagacuugacauuuaguuuaugaugaugguggagcuaaaugggaacccuuuaugaagugguuaaagugcgcuagacuagcaguacuguauaucugguaugucgucaucuuuauuuucccuuaaggaagcagaaguucugagagguuagaaagcuugcccaaaggcacaaaaguacugaaguagggggcccagauccugggcuccuagcccuacacuaugcuacguguuaauaccacuaagauaaaacagagcacauuauuuaagcaguaguaggaauacugaccaccugaccugggaauuugcuaagagaccgauccuagucaacaaaaugcucaggugaugagacuuagaauucacuguugcuuuuuuucucuucauagauauccaucaauagucaagguaaguuccugagaaaaaccuuguuagcuuuacuuaauauuugccugacaugacaucuuuaaaguccaguacugaggaggcugaggcaaggaggauccuugguuuaaaggcacucuggacuucauagugaaacccuguuucaaaacaaauuaaucuguccgaugagauguuuccguuuaaaccaugcuuugcucuaacauacguuuuagaauagaauuugguauacuguaaacugaaguuguacccagucaucaucuguagcauuaguuuuguaggagagucuuuuuuucuuauugaggcagggucucaggguaucuucggcuuacuucucacucaguguguagccuaggaugaccuggaaccuccagcuccugaguacuggauuacaggcuuaugcuuccacccccacgauaggcaguacugggaaucagacuuagugccuggugcuuucuaggcaagcacucuaccagcccagcuacauccucagccucacaggggacuuuuauuguauaccaauguuuuuaauagaagauaguacauuuguaugggucauaaggacaggucuuauccaacaugguauuuaagaugcugaucuucuaaaaaugauacacugcuaguuugucacaugcaacucguucugcugguauugcauuuguuuuugaccuggcauauaugugaauaucaaugcacaggcaagucauguccguguuuaucaggcaguugguuguaguccauauuguaguccccacauccuuaugugaaccagguaaaaugauagucuuaacacaguccaggaaguucacugaaucuuaggcuucacaaagcauagucagaagauuuggguugauauuuugugcuuagaaggcuagagcagcacagagggacuugagaggaagaugcuauguaguagcuucucuugucacuggauugcguugcaauaacuuuuccagaggagaugccacaccaagugggcaccaacaacagaucaaaguauaaucucaccaaaguccaacuugguggaagcagugaguuuguugggcuuucuugcagagcagaguuauauguacaagagugugggaggacgcaaacagcuagaucacugcaagaucccaccccaucguauuuugcaaucuuaccuuaucauagagaccugcuuuuagccauccuucaauucuauaaauaggcuaucaucucucaagaccucuugcagcuagagaaaggaguggaaucucaggcaagggucuucugacaccccaguggaguaacaauagcuccauugccagaguccuggcuaacacugugcucugguugucauagcuauaggggaagaggccaggaaugaaaucuuauuaugaccagaaggaagagcaccauauaauaauaagggaguccauauaugaagauucuaagaauuugaauaggauuuuaagaauaaauuauauauuuuuaaggaguuuaacauugauauaaaauauauacagguggcuuuaaaagguuacuuggggggauaaacuauguaucauuucacaguugccacccuacacacccugccucugccacuucaggguaaaaguagcugucauguauagcaagaguuuucaauacaauacaucaguauuaacuauagucuuuguuuuacacuggaacuauaggauuagccaaguauggugugacccuucuguaaucccaacacacaaaggauuguaaguuugacauuauccugagcuacauagcuagacucuuccacacccucaaaaagcaaaaaacuguagggcagaugauauucaguguaauuuguaaaacuagucaaaaaaaaugacuuuuguuuuguuuuugucccuuuaggugaauaugaagaagcacuuaagguaauguuuacuucauauuauuuucaaguaauuugaaaaauacuuauugaaaccuaaacuccccuggaaaguacuaagaauagaaugacucccguuaguuagagagucugugguaaguagggcaaaugacucagcagcaggcaguuccugcuacaguucaggugaugugucaucucacugcgggacuuaaugccaccaucuuaaaaagaagccucagggguuaagaguacuagcugaucuucuagguucuaaguucaauucccagccaccacauaaccacaugguggcguggcucacaaccaucuguaaugggaucugaugcccucuuguggcauucgguguacaugcagguagaacacucauacauaaaauaaaagaggaaaaaaagaaagcagcagcagccccggacauggugguucacuucuguaauuccagcacucuggaggccaaagugccuggaucauugaguucaaagacagauuaggcuguguaauaggaucguuugagccuaguuuagggauaaccugggcaacauaauaaaacccaguuucaaauaaaauauauuguguacaggaaauuuuaggugauuuuuuuuuccucuuuugcaaugaugcgcucagccccucaugcaugcucuacaagugcucauaucccaccuaacaggacucucaggcugagguaaaggaaaacagcuaugaggcagaggggcuggacucuuagcuguucagucccuaauuuuucuuaaacauuuuauuuauuuauuuauuuauuuauuuauuuauuuauugguuugguuuuucgagacaggguuucucuguguagcccuggcuguccuagaacucacuuuguagaccaggcugaccccgaacucagaaaucugccugccucugccucccgagugcugggauuaaaggugugcgccaccacgcccaguuucuuaaaccuuuauauaccuucauggaaaccaaacagcguauugggguuuccauaauacuuuauuaagaagauguucuucacaaagauacaacuauuugagcucgcucucuaagaccccaggguagggaaagugagugcuuagcuauagggaaaagcuuuaaguagccaugauuacuaucagucuggaauuaauuuguuuuuuagaaaguugagauuagcauuaaugucuuacagagaaggcaguuaacagguaauacacaccucacucagagggugaagcaggaagaucuugaccuggaugccagccaggacaacccaggcgaccccaugucaaaacagaaaacaaaauaauuuaagaagagcccaguagauggcaaaaucucaccuaacaauuucuucacauuuuaacuuaaagcccuuuguaguuaauauucuugauaaacaucaggcuagauauuaauguagagguugacuaucuuuaucuaaaaugcuuggaaccagauaugcuucaauuuuuuaaaauuugauuuggggauauuuguacauucauaaugagaugucuuaggaaugggucccaaggcuaaauuugaaauuuauuuguuucauauacacuuuauauagccuaaagguaauuuucuauaguauccuuaguauacaguaugaucauaaaaugccaggugcuaauuuuuuccuuguggcaucacgucaguaccucaaagguuaaguuuaauuaagcaugccuagccuguucacuuagaaaugcaaacaaggagccgggugugguggcgcacaccuuuaaucccagcacucgggaggcagaggcaggcagauuucugaguucggggucagccuggucuacaaagugaguucaaggacagccagggcuacacagagaaacccugucucaaaaaaaaaaaaaaaaaaugcaaacaagggcuggugaaauggcucagcggguaagaguacugacuguucuuccaaagguccugaguucaaauccuagcaaccacauguuggcucacagccacauguaaugagaucugaugcccagugcauccgaagaccgcuacuuauguauaauaauaaauuaaaaaaaaaaaaagaaaagaaaugcaaacaaaaauaguuaacuauacuucuguauuuuggugcuuugacauuucauuuggaaaaggagaaucacaauuuuuuuauuuuauuuuauuauuuuuuuuuuaugguuuuucaagacaggguuucucuguguagcccuggcuguccuggagcucacuuuguagaccaggcuggccucgaacucagaaauacgccugucucugccucccaagucacaauguauuuuuauuuuguaacaugcucuuguaacacacuuuuagauggcuaacauuaagcaaggaaaucagcuacagaugcaaguccacgaaggguaccauguuguagaugaagcacuccccaaaaaugugguagaaaaccaagcggcugccaggacagggaagaagccacuugcacauuauucuucacuggugagagucuugggaucagacaugaagaccacagaggagccugcaccagagguaugaagaggaugggccuaucugaccaacucugacccuacaucucauugucucuccuauaacauucgaauggucaucaaagauuugggcaaagaggcuggggaaauagcuuugaaagcacaagacugugaguuugauccccagaacccauguuaaaaaagcaaaaagcuggaaagaugacuuacuggguaaagaccuguuguguaagcaugaguacgugaguucaaauccccgcaauucacaggcauagugucauguugcaacccugaugugucuguaaucccagugcuccuauggcaagauggaaagagagacaggaggaucucugaaagcugacccgccagcuaccuuggcaugugcaguaguaaacaguagaaaagggcucuguugcacacaagguggaaggcaagaaccaacacccagugcuguccucugauugccacauaugugcccaaacucacauaaaagccaugugucauacauguguaaucucaggacugaagaagcagaggcaggaggauccuugggacuuacagccuaguuggcuguuccaagccagugaaugagucagccucagaaagauuuuuuuuuaaaggugccugaggaauaacacuuaagguuuugcagccuccacgugcacacacuguacacucacguauaaagauuuggcuguuuuugaaacuagcagccuugauuuacuucaagagaaagggaagaaacuagaauacacauuuugauuuguauucuuucacaaaaaaaaaacaaaaacaaaaacaaaaaaaccccacacaugucacaugcuuuugacauuugauuaaagaaauaauacauuuuagaaaaauuuagaaaaaguaacuucucuuguauuuucucccagcaauguucuucugcuccuugugacacagaccagccucaagacaagcccccagauugguuuacaagcuaccuggagauggugaguguccucucugaccuggguguuagcagcaguguuggcacagguagaaagcugaacccagaugacugcagccucuggugcaggggaguggcagcugugacuucugacauaaagcagauguagugaaggaaguucuaaccugccugaagcaucauaaaaguugacgauccaguucuacguaugugagggagacagacagagucugugcuucaaaaagacacaguaacagcauugucccaaggaagaaucagcuuccaugagaggaagagaccuauuacauuucugugcauuccuccagcagccauuagccauguucuugaguuaacaccagaaccaggaaaccagagcuauuucuucucacuuuuccuggugcuggaacugaguuuuccuaccuuguguucugcauuguaguuccgagaacaagugguuaaggaaacgguggagaaacuugaacagagguugcaggagaagcuuguccuccagaagccacuccugaguuccucacccacagaagucucaaugccuauuucagaggaaacccuguuuuugccagagaaccaguucagcuggcauauugcuuguagccacugccagaagaggaucguuggagugcgcuaccaguguagguaagcaguuccugggcaggggcagccaccaacuagcauucugggaaguuuaggggaagcuguacaucuucuuucuccagcauagguaauguagcuuugauuuacaagcacaggauaauagcgggaacuguugagagugcuauucagauacgcauuuggguuaacugaaucaggcagauuaaguucugucagucaaaauuaggucacuaaggauagacagccccccccacccuugccccguucaaaacguucuuguaucuuacuuguuucuauaaacuauuucauggaacuagguaugagagggaguuacuuuucucauuuuacaaugaagaacuuaaaccuuggcauagccaaguggcaauugaaaguuaccauccagggcuggugagauggcucaguggguaagagcacccgacugcucuuccgaagguccagaguucaaaucccagcaaccacaugguggcucacaaccauccguaacgagaucuggcgcccucuucuggagugucugaagacagcuacaauguacuuacauauaauaaauaaauaaaucuaaaaaaaaaaaaaaagaaaguuaccauccagcuggugauggagccaguauaaagcuuaaacugguucauugcucucuacuucagggacuucuugcugcauaguuuuuacuauguuggucuuuucacacagccuaugcccauccuacaacauuugugaagauugugaagcuggaccauacacccaugacacuaaccauguuuuguuaaagcugcggagaccuguugugauauccucugagccauuuuucuacuccaaguauuccgcuccucgucugccugcugcuuuggaacaagucagguaaagccacacgcuuguggcugcucauuuauuuggcuucuugacucugcugacacaaaguauuauuguugaaaauaucugagugggggcuggugagauggcucaguggguuagagcacccgacugcucuuccaaaggugcagaguucaaaucccagcaaccacaugguggcucacaaccauccguaacaagaucugacccccucuucuggagugucugaagacagcuacaauguacuuacauauaauaaauaaauaaauaaauaaaucuuuaaaaaaaaaaaaagaaaaagaaaauaucugagugggcugaagaggugucucaugguaagagcacaggcugcuuuuaccaaagaccuugguucacuucccaacaucuacuuuggcagcucacaacagucugaacuccaguuccaggcgaucugacacacguuucuggcuuuugugagcaucaggcacacguguacacucauacacaugaauuaaaaauaaauaaaucuaucuuaaaaaucuggcaagaugccuuuaauccuagcacucacaagacagaggcagccagaucucugugaguucgaggccaaccuguucugcagagcaaguuccaggacacaaaaagaaaccuuaucucaagagaaaaaaaaaaucagauguaauccccagcacucagaaccauccugagucuuagccaggcuaagcuauguagugagucagucucauagcaaaagaagagugcaaugguaguguauaguaucacaaaauuauuaauagucuccuuguuccuucucaauugauguguaaugaaacaauugucugagacucaucaaauggaaaugaugaguaugaaagaaauuaagaaaguagaugcugggcuggagagauggcucagauguuaagaguacucacugcucuuccaaagguccuaaguucaauuccuggcaaccacaugguggcucacaacuaucuguaaugggaucugaugccuucuucuggugugucuaaaggcagcaacaauguacucacauaacauaaauaaauaaaaucuuuuuuaaaaaaagaaaagaaaagaaagaaacuagaugcauuguugacaugauugcagugccaaauguuucaaggcauucauucauuaucccacaggcuccaaaaacagguggacaagaacuuugugaaagcagaaaagcaaagguugcgggcugagaagaaacagcggaaggcagaggucaaagagcuuaaaaagcagcuuaaacuccacaggaagauucauuuauggaauucaauccauggacuucagagucccaaguccccuuugggccgaccugagagcuugcugcagucuaacacccugauguaagugcaaggccagggcugggguguggcuucccauccagcucucugacacaggaauguuaacacccuuuguuuaccuauugugucuccuagcacccacuguuuuaagcuucccauugucuuccaagcugguucaggaguuauuuuagacacucagcuuugaugccucauucagaaagcaagaaacuaacaaggcuuagaacagggauaauucagacuuuucuggaggcagucuggcaggguuggaaccaagaagcaagucuccaguuauauuuaugaacacuuguaauuacccuauauuuauggacacuuauaaucacccuuuaggcagcguaucuuuguuuuaugaccuggaauuugaucuuguguguguguaugugugugugugugucuggacaugugugccuugacaugcuggugagauccauucucuucuucgaucuuuaugccuucugaggauugaucuuaggucucugagcuugcauggcaagcaccuuucccagcugagccuucucacaggcucaaccuaaacaguguuaguauuuaagucaaguguauuaguacacccuucucuguagucacaguguggcauguuuggaggccauuacaccaguagcaagugacuaagcaucugcaucucuguccaggcuuccuuugcagcccugugccccaguuaugccaacacucagugcagcauuuguggaugagaauuugccugaugggacucaucuucagccaggaaccaaguuuauuaaacacuggaggaugaaaaacacggggaaugugaaguggaacacagacacaaagguacguuuucccucugaggguuaagacgcggaugugcaauagcaaagggcgcaccugacaagcauccuccuguuccuuucagcucaaguucauguggggaaacuugacucuggcuucuacagagaagaaagauguuuugguucccugcuugaaggcuggccacguuggggucgugucuguggaguucaucgcuccaaccuuggaggggacauacacuucgcacuggcgucucucucacaaaggccagcaguuugggccucggguuuggugcaguaucauaguggauccuuuuccuuccucugagagcccugauaauguugaaggggacaggaucagcucaagcaaagcugacgauuucuccugugagcaagaggugagcacuugggccauuggcccaggcccagguuauuuccucagucauaggaaugucaggcuugugacacgugcuuauauuguaguccaugcacuucggaggcugaagcaagaauauugcaggcucaagacuaguucuugcuagggacugagagagggaccugaacguaaaagaacucacugguagcuuguuauucuugcagauuucccaacaguuuacuguuucugaauucccaucagugugucagaauauaguauaguuaacuucugaagagagagggucauuuggauggcaguuucagaaguuccugucugugauuaggcagauccagugcuuucaggccucuagacuggacugacaacauacagcauagcaaaaacaaacaaacaaaccagaaaacacacuuaggccaagaugacaagagaaagaggaagggaccagaccuaaggaucucauguaaggcuacaccugagaaacauucauugucuaguaaugcauugcuucuagagaagcuaaagcuaauauaagccuuuucuuugcuuaccugccugccugccugccugccugccugccugccuucuuuccuuccuuccuuccuuccuuccuuccuuccuuccuuccuuccuuccuuccuuccuuccuuuucaagacaagguuucucuguguagcucuggcuguccuagaacucagucuguugaccaggccucaaacuugauccacuugccccugccucccaagugugggaauuaaaggcaugcaccaccaccacaggcucuagggggcaggcuuuuaacaugggguuuauggguuuacuccucuauacauuauuaugcugguauuuggccuaguccucaagguguuuagugucguuaggguuccggugcaggcagucccagaggacuuuugucuguaauggugcuugcugcaccaggaaaagaaggguaaccugaccgggcgugguggcgcacgucuuuaaucccagcacuugggaggcagaggcaggcggauuucugaguucgaggccagccuggucuacaaagugaguuccaggacagccagggcuauacagagaaacccugucucaaaaagaaaggcaaccuggccugcugcuaaacuccugguagcguuucuccuuaacacucaucuccuagaguaucccugagcccaaagacaucuucaucugccuguugcuugcugcagucugucguuacuuuuuuguuaguggaacagacuguacuguuugaacuuagagcuaaccaguguuaauuuccugguuugggcuaacuguacuuucauuaaguuguagaggaugguaggugaaagaacaguaugugaacucuuuacuguuucugcagcuuuucuagacgucccaaauaaaauaaaaaauguaaauguagagguucugcuauguuuuuauuuuaggggugaccuugucagccuggugcuugagcucuguugagguccuaaaauauaucccgauuauuugucccuauaggaagcuuuucuucuagcugaagaagagauuccauugggugaggugacaaagcagacagaagggacaggagccagugccucacagaagacaagacgcgcugccagugaaagggagcuguacauuccaucuguggaccuccugacugcccagguaagcaguccgcgcucggagggacaagggcagagagagugaguccugacaaaugagcuuucaccuuguuacugagaaggugcuguagccuucaugguccuggggaguuagagaugggcaggcuggauccaguaucucaugaggauaagauggugcguggagcaaguuucuaaacuguuugcuucugagugugaagcucaggcuugugcuuccccauggcuucccuccaguggucuuguaagcuuagccugcuucacucaccugcccacugucucuucuccccugccaguuagaguuugagaacaccauguuccuguuuaacucuucuagucacuugguugaggggggacaugaauuuaaauagaauugaauccaggcaauguccaggagaccugaugguccauucaggaaagagcauggcucccacuugugcugcagacaccuuuauuuggccaucucuuuuucuaggaccugcuguccuuugagcugcuggauauaaacauuguccaagaauuggagagagugccacacaacaccccuguggguaagauugucacuucacucaucuuguuuagguguuggcauuacacggucucuucuuggucugcugugcagcgcuagaggacgaggaucccucccauuuugugacagugaaguuguacccauaguccaucuccuccuuucccugucgucugucagugccacaguacacguguguaagggcugccguacuguaaagggaccccuucuucauucccucccuuuguuccuuucuucauaguuuuguauauuggcuuugaccuuguaggccauguacuuguuugugacucagcuuugaugagccagagcuaguugcguuccuggugagcuagaaaaguucugaugacaugacagcugguggagcauauuuggguuuauuuuaacccugcaggaagcaagaaaccuacaaacugcugcuucuggacacuugacuguuuaugaugucaugcuuucucucgguugaugguuuuccugucuucauucuccagauaugacucccugcaugucuccucugccacaugacaguccuuuaauagagaagccaggcuuggggcagauacaggaagagagugaaggggcgggauuuaaagcaccuccugguaagggguuaaauaucuguaaagcacgugccuucccuuuccauccaccucuccucacacguccauuccucauuaccucuaccucagcaaaucgaugucccauggcaucccucgcucucuacgucucaugacagcaggggcagcucuucccccacccaggcuuaggaugcacugacuggugagagcucucagcucuucagacacuaaguacaggcaggcuuuguaugucuuucagauuccacuguaucagcaaagaggaaagcugagaccccugcuucggucgaagaaacagaagaagaccugagugggacccaauuuguaugugagacuguaauucgaucccuuaccuuggaugcugcuccagaccacaacccuccuugcaggcagagguccccacagagugagugucccuagauuccuugcugaggagggaggaagguuaaucuuggugggcuuuugacgaugcuggcacgcuuacuagagcaccgagaacaaagaagccacccuaacucguuucuguccucucucaggggaauuacagcuguauuccaccgagggacagcagccacuugugcugccuggauucugcagaaaggauucuuccuguaaguugacaggaugccucagcaaaagcuuccauuggcagcugagucuucuccuuucucgcaagggcagcaaucugaaaagugggagguaacacaagaaugccaggcuguccccagcauuaaguucuaccauaaaaaccccuuugcaguucuggagaguggauguggauggagaacuugucuuacaagcucggggagcucagcuccauguccagcacucaguaaaaccucagguguuguggcagacccugucucaaaaguaagguagauggacagacauuuauaaaugccuuuaaucccagaauuccuggugcagguguaggcacaucucucuuaaguuugaaggccagcuauguagugaaacaccauuucaaacaaaagaugugggaaugacuucuagggaacuacacccaguguuggccuccucucuggucuucagacagucucacuuaucuaccugcacacuugugcacuaacaugcacaagaccuucagaacagacugcuaguaucaaauugauagagccaguuccauaugucucaauaacuauccaaaaaaauucaguuucuagugaaucauaauaauaccaaauucgagccgggcgugguggugcacaccuuuaauccagcacucgggaggcagaggcaggcgaauuucugaguucaaggccagccuggucuacaaagugaguuccaggacagccagggcuacacagagaaacccugucuugaaaaaccaaaaaaaaacaaaaaaccaaauucaagggcuugggaagauagcucaguggguaacagcccuuacucuuuaaacgagaccugaguuucaauccucauuacccaccuaaaagccaaacacagcccuaucuuccuguaaccccagcaucagggaacugagacaaguagauccccagagcucacugccagccagcuuagccaaaauggccagcuuuaaguucagggagagccaugaggaagacacuugauguccucaucugaccuacaugcacacauucagguauaaucaguauauaucacacauaccaaaaaaaaaaugaaauuugaccugcauauaccuuuaaaugugauuuuccuauuuuugcuuaaagugaacaugcacaugaaugcuuuuuuuuuuguacauacaaauagaagaaagguguggagggauaaaccaguuauucauaguuacugcucugauaggaucuugaggccuuucuacccacuccuaagauuuaccaguguucucaucagacuuuaucacuucucuaagguaaaggaaagcaagcagacaacaugaagugcuuacgacgaguccuuuuucugccacugauagcuagccuacgaguuuguuuuuuuuaauuuaaaaauuuauuuauuauuauuauaaauaaguacacuguagcuguccccagauguaccagaagagggcgucagaucucauuacgggugguugugagcuaccaugugguugcugagauuugaacucaugaccuuuagaagagcagucagugcucuuaaccacugagccaucucauagccccccauagcuuaucaguucugauggagcuuuaucucagucuuaacuuucacaauaaaaagaaaaaaggacaguaggauucacagugcucauuggaagccuggcuguuugagcccacacaccuguuucuguugacuucccaucuauuuguuuuggcaucgucuugagacagaauacagucauggcucuagaaacagcccauuccucugguucuuuccacugugcccguugugcuagcucgugauccacggccucuucccucacggugguuacuuuuauuccuuagugaaauuugccuugccugaagaaggaccgcguggagaugagagggaggagauuguccacauuguugaggaagaagucguugaggaagaggaggaaguccaagaugaagaaguccaaagucagucuucugcuuccucugaagauuauaucaucauccuuccugagugcuuugauaccagccgcccccugggggacuccauguacagcucugcgcucucccagccaggccuggagcgaggggcugaaggcgaaccugggaucgagucugggcuggaaccaacugaggcuagagagagacucccagagagggagagccagccacaggagcagagcaucagcgacauccucacaaccucacagccucuggacacggugccucuaguccccgagguggcaggacuuccagcagcauuguccagguacugcucagcaccucagccccccuguucuccagagcuggaaugaccagcuucaucuccaaaccuuucuuuuucuauaaucuaaacuuaggugaauaaaaauuauacucagauuucucagcacuuguaaauuugagauuuaaacaaauguuuguuuuaguuacccuuacuucccugaacauagacugucuacugacuuuuuuauaaaaaaucuuuaaauacaaacaucucuggaugaucccuuuauguuuugauucuuaaguugaguaacuguaacaaaaaugugggugaagggcuggagagauggcucagcgguugagagcacugacugcucuuccagagguccugaguucaaauuccagcaaccacaugguggcucacaaccauccauaaugagaucugacgcccucuccuggugugucugaggacagcugcaguguacuuacauauaaugaauaaauauuuuuuuaaaaaaaugugggugaggauuugucagcuccaagguuugccuggugagugugagggccuguucagcagaaaagcucgaaucuuccaugugcugcucucacaggcagagauauguauuaaguaacuuacagauauauaccacgucuacuggagcugggucauugucucuacuauucguauagaaaaugugagagcccuaaauauaauaaagagugcucaggaagggagaggugaccugaaugaagccaguuucucuagcuggauuguggcuagagaggacaucagagaguggaacucaguccuucugaccuucacacugccagauucacacaugaugggaucagcagccacgcugcugcacucuccuagugcuuguggcuacucuucagcucaccuucacuguucucucuuucuaaaggagcgccccuuguggacagugugagucaucaggaguggauucaccaggaguggauucaccagcuaccaugcacgaaguucccccagccccugaugacaucagaggagguaagccaggcucucucccuugcuccuuuccaguggacggacaccagguaugaagaggcucuccguuucugagacccguggccuuguucacagacuuugccucucccucuuucuguaugccucccucaugcucuggguuuccacucuuuguuuguuuuuuguuuuuugagacaggguucucuguguagcccuggcuguccugaaacucacucuggucucgaacucagaaauccgccugccucugccuccugagugcugggguuaaaggcgugagccaccacgcccggccuggguuuccacucuuaagccuguugcagaccuugcagaggugggcacugugcugugcugggaagagcagccuuggaagccagccagcuccagcuccaguuuugcuuuuccucacagacuaaugcggcagcucagcugguuugugaugccuucaggacugcgcccuuauuuuaggucucaggacuguagaacugugaaggagucaggagguccccacucaaggucacuuccucuuccaaaaaaugcccaaccuaaaacucugcgaacuaacacaucaggguuacaggauuagaggguuauuuuucuacucaaugauguccccagcauuucuagacaauuugucuuccucugugacuuaaaucagccacagaccuuucuaaaacuuaaaagaggaaaagaaaggagaaaaaaacuaaagacacccccauuaacuugccgccugccuugauaauagcuugugggugcugcagcuaaccaacagcucuuuugcuuuuagagcccagaggcucaacaggacucgcaaacagcagacagaggagcugugaccacucaagguaacgaccuugugaagucucuucuugagaaacaggaagacaucccagcauugcuucugcuugaaugagccucugagagcagguggcgagcaccuuaaaugagcaccuuccaagcacaggaaggagcacccucauuccuccuuguucuuacgucugacacuuaugagcaccaccggcagagagcuaaagcucaugcuuaagugcaucacuuuuuagggauuacccugaaauccaccucaccuguaaugcccaagaagacaagcaggccaagccccaggugcaucuagcugguuuucuuacauaccgcugccucucuggucccugccgucucagaucagaauccagaaaaaucacauuuccuuugccagguuuucucugagauguacagacagauggcugauauccaggugugcccaugaccacauuaauuuucagcugggauggaaaacuggcguaguaacuagggugugcguuuccugcaguacucaggucuucugccagccgagccagagcccugcagcaaaccaagaucuguagcuaugaaaacauuucauucucucuuuuuacaucugauuuuuuuuuucuuuuaaggauaccuuauuuuucuuucgagauuaucacccacauuaucuuguaaggucauguuuuauuaggggagauaauuugguuuuccucuguaggcaccacaaugggagcagcauugcuggaggacuggugaagggggcuuugucuguugcugccucugcguacaaggcccuguuuucugggccaccagucacugcacaggucagugugugguuucuuuuccuuaacuucagcccccaagucaccagugcaaauggcaguccuucugucuggauuggcaauuaacauggcaaggacuauguguagacagucucuuuaaugaacacacagccugcccgccauuuccuaucauuuuaauuaauuaagcuacucugggaaaaacaggaaaagaaccuaagauuuguugaagacugcauguacaaaguugcuguucuacaacaacguaguggacauacuacgggauaauaagacacacauuccugucaaacaacuguagggaauuggcaaaguauauacauuuccaggacaggauaggacacugugcuagugcaucuccaccuacugggacugaggcucuugggaguuaguaucugaagcacaaagcaaguguaccccagaaaaguaaugcuggauaugauagcgcucaccuauauucccagcuacucaggaagcagaaaaauugcaaguucaaggccagccugggcuacauaguaaaaccuuuuuucaaaauaaaauuugagaauauaaaaccauaaaaagguacaaauguaguuuaguaacaguagaacucuugcuuagcacccuagguucaguuacaggucuugucuucuccuuuggagauagaguaguguagcuggaagaguugugagugagcggaugauggauugaucugaagaggagaaaagaccaacucuaagugcggggguuuuauucuaagacauagaaggggaggguuguuguguuguuauggguuuguuuguuugcuuuuggaacagagucucuacauaucucuggcugucacuguagagcaggcuagccuuaaacuuacaaauucaucugcuucugagagcugggacuaaaggcucuacaccuccauuaacaggaaagagauaggcgcgugaggaccugccggugauuuaagugauuagcaaaggagugcaaggauaaagcucaggcuuuagccuagguacucaguaucacgcaucucagugaauaaaggugcuugcugccaagccgugacacccggaguuccgaucccgggaaggagagaacugacucucacaaguuguccucuggcauucacaugagcaccccacacacaaacauacaguaaaaugcauaauaaacugggcguggcggcgcaagccuuuaaucccagcacuugggaggcagaggcagguggauuucugaguuugaggccagccuggucuacagagugaguuccaggacagccagggcuacacagagaaacccugucucaaaacuaaaaaaaaaaaaaaaagcauaauaaauacacccccaaguaaaacaaguuuauuacuugccaguuuucuuaauguugaauuuacaacuuauccagguuaaaaguaaagucaugcagcaugcaguuggcuguguacaccuccauuacagaggauggauuugaccugaggcugaaguuugagagucauuuacauacagguucuagcaggagcugugugauuggauaagauuauccaggaaaaauaaaaggcagaagcagccuuuuaaguaucaaagcaacaggauucuacuaaaacagaacuuagaagaaacagggccacugcugcaacuuggggagguuuauaagggaucaguagacagugcuaaaugcugcagagagcugugaccuaauggugaggaauuugacaauucaaguaugccuugcuagcuacgugggggaaggaagguaaauauuagucuacaugucuacacuaggcagaaggugguguuuauaaaagagacuuaagguuggcaagccuagcagugaaacauguuaucaguacaaaugagaggaaagauuucugagguaguaaugguaaagagaaaaaaaugugccagacgugaugguaccauccuuuaaucucagcacuugggaggcagauagaucucugugaguugggggggggggggggguuguuccuguaaacggguguuagcuuccucuuaaugagaucacuucuguuuugagaguaaaaagucaaaaagacugcccaaaauauaauuucacaagucuacgcccaucuuacuugcuaucuggugagguucugucucaagccauccucaggaagucucucuugcucauauuugcucauuaccacuauuuuauguuaaagucuucgaggcuucucgucaucuugcucuucaauuauuacuuggcugaagaaugggugguuuuguuuguuugggguuuuggauacaagggcucauucuguagccaaaccuauguucuuccuccaagcaggaaucgcaggugugagccacugugccugagcgcgcugcuuucagaaaguccucugaagcauccucugucacccucuccuucaguuacgcacacacauagucagcagcacugucaaccccauugacuuguuagggaaacaggaaaguugugcccuugcaucugaucacccaacacuuugaauaaggaggaaacacuaggaugacaguguaauacagauuugcaaagaagcaaauuauauagaaaaaugucuccuugucucugcacagcccaucguuucugaagaucagaccacagcccugauggcccaucucuuugaaaugggauucugcgacaggcagcugaaccuaaggcugcugagaaaacacaauuacaauauccugcagguugugacagagcuccuucaagugaauaacaacgacugguacagccaccgcuauugaggacugaccuuguauuaaauaacugccugccgcucagagguggucucucugcugucauugaguguggguggaagcccuugcuugcuuuuuaaucugaugaaucuaugucucugaauugucaaaacaguaccuguuacaguauuuuuuggagcaaaucaaaggccagaacuuaaauuuucacuguagaaaugggaugaaugguaggaagacaguuuucaacucagcuggacagaacucucgccgcuguaguccguggaagcgaguaacuuggacuuccuuagaucgcuuuuccuucugcuuguauugaaauugaguauuuuccuuugguucauguggauguuuuuaaugggcuguuaaauauuaguuugguuuuuguuuuuuaaagauuaaccuugaauguuuccaagaauuauucaccuaguuucuauaaccaaucgcaagccucauagcuacauaaagacagcagaucaagaaagucauguuccucaaagacuuagaaaugaggaacacuuugcuuucagaaggccuagcaggaaccuggaaggacaggaggcauucggguuaacccacagcacccacugagcagugucugucaaaguaauuuugcauaaauuuuauuuaaggagaauccuggguagugugaaauauuuugcuaauccuauggggggggcaccuguuacagaaagggaaaguuaguagucguccuuuuacugacugucacaguggauuggaaggacaagcaugugcaaauacucaucucaguaaggucgggugugggugaaaggacacagaacugcugcugacuuuccgaauguguggaauccccuugugagguauccagcccuagaaagccgagaacaggaaguaaugcuuuggggcuaacccacagaaagguuaguuuaccauuagaauagaugggaagaaggcucugucaagaguucuaggucucauuuaguuuauaaagggaagcuuuggguccagauggugaaagaaaaggcaacacaacacuaaagauuuuauucauguuugagaaaagguaucugaacuccagcucaaaggggauaguuaaaauaguauuauuuaacuuaguugguauuuauaauaaauggcgaucuuaauuacucauaauauguuuauuuacaaucuaacucuugaaugcuucuaaauaaaccacaauucaaacugcaagccaacca

SEQ ID NO: 6403 - RNA, 1659 nt, Mus musculus
uucaccccgcagggauagcaggcgagcuggccgcgaacgguccuugcacuggccacuggcaagcgccccccgugggcggaaagcugguaaggaagcuaccacuguuaccuagaaguaggggcacgccguucuuagagugcucggggaaguucaaggggaaaaucuugcaaagaggagugacuuuccguguucaggggcagccagucuuuucagugaccagaugagggagucgcuuggguugucaucgauagugggggguggauacugccugagggagacaguucauggcuuagaagggccaguuucugcuaagaaaaggucucgaucccccccagaacauaaagagggcuucgaugguggugacacucacuguccuggggacauggaguuccgggaaaccauuacuggaagacugggauuaagucugcgacaagaaaggacauacaucuuccucauucugucccuuuccuauuuuuaaggcucuauugaaggaagauaucuugagcuaggaccuuccaaauuagaaaggcaucguuuuucccguuaugucaaacacccaccuuucagaugacacauuuuaaaacucagguugcuugugccagcuucugguauagaaaaugaaguucagauucccaaauuggcuuuauuaaaauuauuugucgggguugaaaaauaaucacgugaggaaaagcugacuuagccacaugaacgugagucaauagguaugaguuuacagugccauuuaggaaagugcaggcuuaggcccagcuaccugacugcuggagguaaaccuucagguauagaugugguuaacuguacuuuugauauuuucacaaguucaagaugauugcucuggcugaaagaauuuucacacguaagcccuuuaugaagaccuguauauuggccagcuaaacuagaaccgccuacuuccuguuuucucccaugggcagaacagcugguugcuccaaaguauggaaacuaauucccacuuguguaauuucagaacggggaagaauaguuuccuuccagacagaaaagaguggaagaguauuucuugaaguuggaaaguguguuucacaauuuuuacauuuuggucacuuuguuuuucugguuuaaagaaaaaacaaacaaaccaaccaacuugaacgugcuggggaguugcuggggaguugaugagccagcgucugccuaaauuuuacagcuccuaagaaggaagaauugcauuucagguaaaugcaugcugguugucagcagggugggugcuagagauuagcauuagcuuggcaucgaagucaauucuagauaaagacaagugaugggaaaaaaugaauaauugaguauauaaaauagucagaauuaagaauacaagguucuuuuguuucaauuauuuauuuugaaaccguugguguuuuuguaugucuguaggaggguguuagauuccccuggaauuggaauuacagacaguuggaagcugcugcacgggugcugggaauugaacuggguucuuugggggggucggggggggggggaggcugagccaucucuccagcccuacaggcucuuaaaaugacaguuguauccauaguacaacacucugaaggcagaagcaggcaaaucuauagcaauugccaggccagcaugggcugcggagugagagua

SEQ ID NO: 6404 - RNA, 9556 nt, Mus musculus
cggggccgagcccggcuuggacuccgagcuuguguuaaaugugcagcucccgcaguuucgauuuugcugagggcguugucaccugguaaggcgucccugggaccccaucucuuuacccuuuucaaagcaagaauucagagacguuugggcuuacucagcgcccaacacguuguugcccaaauuugacuaacggccagugaggugggauuuaaaauccuuccucgaugaaauccuaccuuuuccuuccuugccuaccauagcagaauccccuaguagagaggacuugacccucccgguagacaagagucccugcuccccacuuucaacacauugacucucucuggucuccgcugaauugagcuguucaacuccacccuacccuagaggcccuucuccccaaaggagcauuccagaaaacccaaucuuggagcugagcagagccuggaaucccagaccuaaaccaggugaguaagggucuuuauuuuagcccaggaagaugugaguauccuaaggaguuacugcgucauucaagccacuacucagggauugggggcaaaguucagauuuggccuugaccuugccuuaggaagaacagacuccgaagucucagaaagcaaugaauggaucaaggcucccucccaguccaguuucacaggguuucuuagccacagcucuuuuuuuuuuuuuuuuuuuuuuuuugguuuuuucgagacaggguuucucuguauagcccuggcuguccuggaacucacucuguagaccaagcuggccucgaacucagaaauccgccugccucugccucccgagugcuggaaucaaaggcgugcgcaacucugaccccuuaagcccugcuuuuccagccaaacucccgaauagaaagaagccugccuucuacacucccaaucagauuucaggccuaucugcucugggauuucuacagaguaaucacuugauuagaaaagacaaaaggacccuuccauaauaggaagcugugcuucccgcuccuaguccuacccagcuucccugucuuuaaaauaaaggacagcucagcuuuuccugguuuaaaaaaaaaaauucuacauucacuugcagaaaucccuuaaagugaaauaacuucugcuuuucuuugauuuccucugaauugaacucuuacuuaaaaaaaaaaaaaaaagaguuccaaggcaccucccaaacuguucuucccuaagcaaaagcuucuuagauaaugguagggcuucuuggcaaucuuaaaaacuuaaaaccucacaucagugcuaacagguuaauagcucugaaccuuguuuuauuucucauuagugaaaaauuccgcuggacuauggguaaggcagucucccagcucaccucucggaaggaugaggacaagccuauccuaccugauaacccagccauggccagccaggcugccaacuacuucagcacugguagcagcaagccagcacacuccuguaugccuuaugaaaaggcugcuaguuccagcuuugugacuuguccuaccugccaaggcaauggggagaucccccaaggugaguagcccaaggcucuggaaauacucuagaaaccagggagcgauccggaucugccccuccacaucuccuggaguagguagaccucuccuacguaugcagucucaggcuggccaagaaggacccagguccugcugugguucuauuccccagcuccuagaggaaaguuucgugucugucuguuccucaagccagugucuugggauuugggaaguuaaaaaugaccuuuucaagccaagcgugguggcgcacaccuuuaaucccagcacucgggaggcaggggcaggcggauuucugaguucaaggccagccuggucuacaaaaugaguuccaggacagccagggcuauacagagaaacccugucucggaaaaaaaaaaggaccucuccaaaggaacagggccaccucugacuuuguagugacucagugugucucauaccugguuauggaagucccauuccucuccgagcugaaagcugggcugucaacuucaauuuugacagugcucccaauccugccaugggacagaggcaucgugcuccuggcacugcaagauggaguggaggggcgcuugagggaggcuggcacaggaaauguuugucaugggcacuccuuggcauucucucucucuuucucucucucucucucucucccucugcagagcaagagaagcagcugguugcucucaucccuuauggagaccaaaggcugaagcccagacgcacgugagcuucauacaucccuuaggggcugccuuaccugucuccccucuuuagaucucccgguuuguuugguuuuuuuccauugguuuucaucuagaagcccgagucuuacugugcucaaacuuacacuacauucguguuuccaaggauuguuuguuuaagaaugauaguaauaguauuagcggcugggauuguagcucacugauaguguguuugcuuagccaacaugcacgaggcccuggguuugaucuuuagcaauaaaaagccaaugccauaguuuugcuaauuaacuuuguuucauaauguaggugacauauguuaaaauaucaugccccguaaauauguacacuuauaugucauucaaaauauaacauaauauaaggcagcauggaucauagcuaagggauagcuaaggccauuucauggcuguacaaguccuuccaagagagaauaaaucgcccugguugccgcuacuuuugcuauugcaguuuauguuucuuucuacgagagauugaaaacaagcugcucagaucucuguucuggaccacuuuggaaccucagaagcagcccugggcuucaguguggugcccaugauccuuuauguggucagcauccauuuaccauggauccccguaaccuccuccaaagacccucagcuucuaccugagagcuguugcccagccuccuccccagccacuguacuaaaaguacaucucccaagagauggcucagcaggucaaggugcuugcucucuagucuauaaccugaguucaaacuccaggccucacauggugucuuagucaggguuucuauuccuguacaaacaucaugaccaagaagcaaguuggggaggaaaggguuuauuuggcuuacacuuccauacugcuguucaucaccaaggaagucaggacuggaacucaagcaggucaggaagcaggagcugaugcagaggccauggagggauguucuuuacuggcuugccucaccuggcuugcucagccugcugucuuauagaacccaagacuaccagcccagagauggucccacccacaaggggccuuucccccuugaucacuaauugagaaaaugccauacaguuggaucucauggaggcauuuccucaacugaagcuccuuucucugugauaacuccagcugugucaaguugacacaaaacuagccaguacacaugguaagagcaaacuaacucccacaagugucccucugugauaaaauuagaaacaagcagugccccucauaaaaugcugaguccugucucuuuuaauucauaucucugauugauuagcauggguaaaugguaucccauucaaagaauuggcuuuaguuaaauauuaaaacucagagcucucaaauaaucguggacugguuucuaguagugaccauagcacucgcugagauguuguugugugccaggaacaguuguuuuuuccucuguggaccauaggaaauucuaugaaauacaguuaucuccacuuacggacauccugggcuuuugaagagguuagauagugucacugggcauuaugucaauggggauagagaguuggggugaaagccagguugccugccuuccaauccuguucugaaccacagcuagagagcuaagugugcaguugccagaugaugugaaagagaacguguuugggggucuugaguccccuccagguuucuuugguguucagauuucucucuuccugcuuucuuucacgcaggaagcucuuuguguuccugucgguggccaucugccugcugauuuucucccucaccaucuuuuuccuguauccccggcccauugcugugcguccugucggccucaacucuuccacaguaaccuuugaagacgcucacguacagcucaacacgacgguacgugguagccgcuccucauuucaccccuacguucuucuccaaagcaccaccauguagccuaagggguagauaccaaggaccucgugguaugcagaccauucugaggcaacaugagcuccguaguagaucguauggaauugggacuccgaaucauggagggucagaaucuggaccagaucagucauaggaaagaacagggauguccaggagaaaaaaauggagagaaacagaguaggguaaaacuggauauuggaggguuagagaaaugguuucgcaguuaagaccucuggcuguucuuccagaggacccagguucaguucccagcacccauacggcagcucacacugccuguaauccgguuccgagugauuugacauccucacacggaaaugcaugcagccaaaacucgagugcacauaaaaauaaaucuuuaaaaaaaacaaaacaaacaaaaaaaaccuggccagguggugguggcacagaccuuuaaucccaucacuuacucaagagacagaggcagacagaucucugugaguucaaggccagccuggucuacaagagucaguuccaagacagucagggcuacauugagaaaccuugccuugaaacacacacacacacacacacacacacagauccugagccagcagcuuugauggguagauucucacuguguuaccuaaguugggucuuaaauucccaagcucaagugaucucagccuccagacugacugggacuguagggguacaccacagaacccuuaaaggugaccccugucauuaagagccuucagaguccuuugaaacugaggcccaaaaggguggggugggacucaggccaaagagcuaggcugaugcagcugcuugugcucucccuaccauggggugccaucgucaccguuucuuuccugaaguuggaaagucgguugcgcguuauguugggacaaacacgcaaaggaacauuuccuuaaaguggacacaggagagaagauguucugcuaaagcaagcacaugaaaggacagguaugaaggauacuuggcuaacauguaacacacauguguuggucuaccuugcauaguugagcugcguuuuucaggacgcuauaaagagaaacaccaaagccaggugguggugcaugccuuuaaucccagcacuugggaggcagggucagguggauuucugaguuccaggccagccuggucuacaaagugaguuccaggacagccagggcuauacagagaaacccugucucagaaaaaaagagagagagagagagagagagagagagagagagagagagagagagagagagagagagagagagagaaacacccaaaaaaaccuugugcuggugugcugccauuucuagccgcuucugaugacucacuaauuagcugcaugugcugaggcaaggcguguggaggacaugugauguuuggaggguguaaauaggacuggacagagaugcggaggcugagcuaggcuugcugguacagcuaguugugcaaugcuugugggucacaagucuucguugaucuucacuucccugagagaggcacagcagagcuugagcugaggcugaggccuggcugucucugcgagguugucgugucgccgcuguugcuaaccugacuacugaacuggacugcuaguguauccgugaagugcgugccaguagauagagcugccgcugcugaccuaugcacugaacugcugauuuccagacagcacggaugggaguugcuccaaagagccuuucuaaacugguccacaucccccauauccuuuguuuuccacuacuucugguggauagugggcuacaagggagguuaacguguuuuaagaaccaucauuuaagggcuggagauauggcucagugguuaagagcaccaacugcucuuccaaagguccugaguucaaauuccagcaaccccauguuggcucacaaccauucguaaugagaucugacacccucuucuggcgcaucugaagacagcuacaguguacuuagauauaauaaauaaauaaauaacaucauuaaaaauaaguuuugagccgggcgugguggcacaugccuuuaaucccagcacucgggaggcagaggcaggcagauuucugaguuggaggccagccuggucuacagagugaguuccaggacagccagggcuacacagagaaacccugucucaaaaaaaaaaaaaaaaaaaaaaaaaguuuugagggcuggagagcucagcgguuaagagcaccgacuguucuuccgaagguccuguguucaaaucccagcaaccacaugguggcccacaaccauccguaaugagaucugacacccucuuucuggugcaucugaagacaguuacaguguacuauaaauaauauauaauaauaaauaaaucuuuuuuaaaaaaggucugaaaaaaauuuuaaauuaugcuuuuccuugcugucaccuccagaauguccugaacaucuucaacagcaacuucuaucccaucacagugacacagcugacggccgaggugcuccaccaggccucugugguaggccaggucaccagcagccuccgccugcacaucggcccauuggccagugagcagguaacgucccucuuccuggccagcccucuacacaggcauguaauguggugacggagaggggccagccugagguacagcuaaucuugugccccucugcuugacagaugccuuacgaaguugccagcaggauuuuggaugaaaacacauagugagugcccuuuggucuccucucuccuuaaccagcuaaauagucacugaagggcugcugagguaaagguguuugccaccauacccugaguuuaaucuuccagucuugcaugauaggaagagaaagagaacccacucccacaaguuguccguugauauccagacauuuaccauuacucaagugugccuacacgcaauguuucuugcuuuuugagacaggauuucucuggguagcccuggcuguccuggaacucgcucuguagaccaggcuggccucgaacucagagauccgccugcuucugccucccaaaugguuggauuaaaggugcaagccaccacugcccagcaaccaaauguauuuuuaaauuuuaaaaguauccacuuucugauuaccgguuuccugguugcuucagacucagggacccgccucaggccugcccucuuguggcuaggacugcaauaugcaaggguaaaaguccacauucucuuccuguugggccuagauuagaaugacagggugcaauuuuguuaaucuuuaugugaaucggacucuuugaaucccuguggaagaaaaauaccuaguuuucugccaagaagaggucagggugugcuugggccaauaacguggauggccaggugaccaggcucauccuagagaauaagaguuaggagugacaucuuagaggcuuccgaugggaggcaagaaaacugugccuugugacuuguaagucuccuuggaguuuccugaccaccugcucacuguaaaacaaaguucaauguucucucucucucagcaaaaucuguacauggccgaaaaucagaguccaccauauucuuuugaauauccaguaaguauggcguggaacuccuguguccccacucccacuucagucucgacuuagccauauuacacaggguaaagaaagagcacccgguaacugauaucgucuuuguuagcuccagagauuagggccuguuccagaucuuaucuuacacaggucuugcuuaggcgcccugccuggagcuucgggaacacagguggggcagcugccucaguaucuuggcagagcagguagccgaaggaagugggagggagguccuuagggagccagccucacacacacacaguagagccaggccaaagcuguccuuccccucucugauuuuaccacaagcccugcuuccucuccagggguucucugaccugcuccuuccuaagccauccgcaacagcugcccuucgagagcuuugaauauguagacugcagagaaaacaugucccugccccaccuggagcugccccgcccagccugaucugucugccgccccuggacuccaggcaccugcaagcugaucugcagcucagcuccguggagcucaaggaaagacuguagggacuuuguugaaggaaaaguccugcuuugggcccugccuuccccuaacacccucagcacacagagcuucuguaacaaugucauagucccugaguccucagaccuccccacucccccacgagucgcuucugauggaucuuacccauggucuguguggggaggaacggcuaccuuggcguugucuugggacugagcauguugguuacccagcuccgccagggugggucuucaaucgcaacgaagagaaagcuguaguuuuaucuagacuuugcagcauggaugaaucuuuuucaagcucuccucccaguaauaaguggcuuuggggauauccagugcuguuuccaaggucuccuugggugacuauaaauguucuccuguacugucuugcuuugaucaugugauaaugaggguaauagacuacuucucucaguaaaugguagacaauaagguccucauccucccagguucggaauacuaucccuggcuuccaggaagggagauuuacaccaucuaaacucuucucuauagacuggcuccaaugcuaucuucacagcagaaaccaaggagcugaggagaaaccaucggguguacccuagagcaaaggcagagccaguugcaaagauauuuauuaaaggaaaguuucuaagcccaccauccagagcccaugugagugcacacagguaagacaggcaguagagcaggcccaggggcaguguucagaaagcaugaaggacauaagcuguugauaccaggccaaagcuguggggcucucauggauucucugcaucaggcccacccucugcuguccucugggaugugacugaagagugacagauucaccagaauuuccuuccuugccugucacuacacugacgccaaaccacagguaacccccaguuuucuacuggacuccagguggagauaugaugucuguugccggagagcagaaauguguguucucuaaagcuagcuagccucugcccuccagacaggugcaaaggcgaagggcggugugguuggggaaaauugaauuugaagugagaagaaugcaaggaaauggugguaacugagcuggguaacuagccuggggcuacacagagggagaggaagucuugucugcaccaaguuuucccuccuggguagccagggcuaagguguacaaaccaaaggagacccagggaagucaagcugagauuagaguguauaaaccaucaaauguaaaagauuucuaacaauaaauuguucuuuagccgaaggaaaagg

SEQ ID NO: 6405 - RNA, 2206 nt, Mus musculus
uggucguagcauuuaucacagcugugggaagccacauaugccauuacaagauggcgcugguuucaauaagccaaugcccaugaauaugcguaagcaaccaaugugcgcaugugcauaagaguuuuuugccaagucacuaccuggcccgaggcauguuaaugagguacugaaagcauaaucaaucagauguagacauggcucuccuaggccuauauaagcaacgccaguucuggggcucggggucuuuccauucacaguaaaagcucucccaauaaacguguugcagaaggauccugucguggcaucuuucuugcuggggagucgggggucuacaaaguggugccgaaacccgggaagaaacaucuucaggcacgagcgaagacccccuguuacagggaggauucagaacugcaucaccgggauggagcgguuaauguaguguucccgcaaagcagacuguugagaaggauucaacugcguggauucagaacucuucagcuggggaacggugguaccgguaaguaaaaagaaauuaauauaagucucugagagguaugcuuuccuacggaauagaucugguaauugucgcugggguuguguugcuugcuuucuuucuuaccuugauauuaugccauugccuuaauugucaucgcccuggacacgaguguaucugcugggaauagcuagacagauacaaaagaucauaaaacuaguguagauaaacuugugagucgaccuuggggcuaagaacucacguagauaagugaguaucuuaaggacgcuucgguccaggacgaguauggguaccggccagucuaugccguuaguggagcuggugcaagccuugcucaaagaacgagguuuaaagguuucugaaaguacagugagaggguuuuuaaaagcgagagacucgcuccuugguuugucuccacugggucgcugaugcuaccuaguugggaaaagcuagggagagauauagcgagagaggaggcagaagggaaagugaaaagcaggaacaaggccuuuauggaagcugauuaaggcuuguauccaggacaagaaaugugagccagcuguuaaggaagggcagcgacuuuugcaggagcaccaggaaaguaugucagaaacagagaaaugaaaaggaagacgcgcgcgcagaaaaauaaguaaaauaagaaauauaaaaagagaaaaugaaaauaaaauaaaauauaaagaaacaaaagauaauauaaagaaugaagaucaaaaaauuaaguuaauuuacccuccucuagaggacuuugaguuacuagaauuaucuagcucggaggacucggaauuaucaguaggggaggaggaagaauuagaggaggcugcugcagaguaugaggcagaaagaugugguccaauagggaggagucgcaguguucccccaccaccuccgccuuacacagaaaagaaaacaauuggcaguggccacucuuuuugcacuccuaaaggauugcgaaaaauaugucaggcuuuuccuguuuuauaggaucaagcucaacagugacauuaugagccaauaucacauaaacaagugaaagauuuagcagagucaguaaggacucauggagucaaugccucuuuuacucagucccaaauugauagacuggcucaccaugccaugacucauucugauugggugagugugguaaaggcaugucuuacaaugggacaguaucuagacuggaagucuauauggcaugaucuguguuuugagucaggcccgugcuaaugcuacugcagggcaaccagcauggagcuuugaaaugcuuacaggucaaggucaguggauaaauaggucauaugcaaaagcaguguuuaaaggguaaaaagaguaggcuugagaauaaauauuaucucuauaauauuaauaaauaauaaauauuuaacauuauuuauaauauaauaguauauuuaauaauaaaauauuuaauaaauauuaaaagacaguauauuuaauaaaaauaaauaaaauuaaaauaaauaaauaauauuaucucuauaauaauaaauauuaucucugauucuguuuaugugguuaaugcuguauuagcauuagagaccgcuggaaauuuuaagcagucuaguccaguaucugaaauuuugaugaaaauaccggauuguguuuugaugugugagcaucccuuuuauauucaacauauuagagcacauacac

SEQ ID NO: 6406 - RNA, 36383 nt, Mus musculus
uacaaagacgguuaacuuuacuugacgucccuguaaacaaaagagacgagcgccgacccggaaguggaagcuguggcuucgcguucuggccggccggaaggagaccaaagggaaguuguagccauggcuguagccguggccgccgccgggguccuaaugggcucggagcccggcccggcggaagaacucgcuaaacuugaguaccugucuuuggugucgaagguuugcacggagcuggacaaucacuugggcaucaacgacaaggaucugggugagcuggaggaaggucccgauggcuuuugauuuugggggugagggaggcaggagagaagcgguugauggugugugugugugugucugucugucugugucugugugugugucaucgugacuugggcuccgggaaccuguggcgguggccucugcuugagaaccauccgguccgagcuauuagaaaccauuucugugagcugccggugaaggcuggggcagcaauuucugcucgauuguuguuuuucaguucuggggggcgaaauagcuuuaacaauagcagcagcagcagcccccgcgaagaugaugguuguaauuacggccaguaauuuuuagaagcucacaagauauuauggguagcucuucaucuacauuaucuuguuuggucuucgcacagucaggcaguagucagcaucuacuucgagcuugugcuuugagccgugcucuuaaauuaguuacaucuucuuaucucucacauacuagucauuagauguuuaagggcaaacugugacuaggggacccagagagaaaauaagaaaggcucggggcccagaucguaauuauaugcauagccggagcccuugugaaaaugagaggccgaguaugugaauuagaagcaugaggggaacacuuccguuugauagguacaggguugggugguguugggcuuuuucagaauguccucaaaaguaaaugacagccaggcaggcgccuaggaucucaggcuugggaugugagggcagaaugauuaguaauuccaaagucacacguagauaaucugaggguagcuugggcaugguauguaucaggguaugacccgucacaaaaaacgacgacaaagccgggcagugguggcgcacgccuuuaaucccagcacuugagaggcagaggcaggcggauuccugaguucuuuuauaauuuaauuauuaucugaguccauuuauaauuccuuuuuuuuuuuuuaacagcugaauuugucaucagucuugcugagaaaaauacuaccuuugauacuuuuaaggcuucucuggucaaaaauggugcagaauucacaguauguauaucugaagauucuuuguuuccuuuuuguuucuuugguguugcuacugaauuuaaauuuugaucgcacuaaaggauuuuuaaguaggaaggagcgauuugugcauaucaaguaaauaagccaucaaauguguaaaguugcguugcuggccagggagccagauuccuuccccacuguccuaggagaaugccgcaggacuuccggcaguaagucugaggaugcugacauucuuuuguuguuguuguugguuuguuuguuuuuaauuuuuuauuagauauuuucuucacuuacauuuuuuaaagauuuauuuaucuuauuuaugugaguacacuguagcugucuucagacacucaccauaagagggcaucagaucccauuacagaugguuaugagccaccauguguuguugcugggaauugaacucgggaccucuggaagggcauuuggugcucuuaaccccugagccaucucuccagccccugauguugacauucuuguucugugaaucaggacgucagggacaagccgggcaguuguggcccacaccuuuaaucccagcacuugggaggcagaggcaggcagauuucuaaguuugaggccagcuuggucuacagagugaguuccaggacagccagggcuacacaagagaaaucaugucucaaaaaaccaacaaacaaaugaaaaaugacgucaggagcaauaauagucuaggguuuggagacaauuuuaaaagaugggaagaaauggucucuggguaucguccaagccaguggucugcagccuucuaaugcugcaaccuuuuaauacaguuccucauguuguggugccucccaacuauacauuuauguuuuguuacuuccucauaacuaauuuugcuacuguuaugacucauaauguaaauaucuguguuuuuugauggucuuaggugacuccuaaaaggguugugacccacaggcugagaaccucuggucuaacuuagcuuccugcugucccaggcugacauucugugcuuucuugucuagucagcacacauugagggcauaagcacacuucccuacagcauauccuauuguaauauugagccagauccagaggcugacgugcuaugucugugcuucuuuucuuuguaggauucucuuauuagcaaccuccugcgucucauacagaccaugcggccuccugcaaagccuucuaccaguaaagguaaggagggcuccagcugagcagagccuccagaaggggcugggugguggcaucccugugaacugcacuuugcucucagcuguugcuaagcaagagaaugcucuaaucgaauucugagacauucaaaugagggcugauagucucccuccccuccuucaccagcacacugcuuggugaggcuuucgaaguuaauggauuuagacaaucaagcuaaauuuucuaguacguaugugauauauguaguaaaauguuguuuguuuuuugcauuugauacaaaucuaauguugaaguuauugcauucacuaguaauauuaaauauaucugucucuuucuuaucccugcuccuuaaugaacucagauccgguuguuaaacccaaaaccgaaaaagaaaagcugagggaacucuuccccguccucugccagccggacaacccuucagcucggguacgggggccguguggggagugucugcccaagugccuguccucugucccuuuucuucucccuagccauugucuggauuuuaacuuggugucuguugugugauguuuuuccgagcaagaguaugaaaggggggcuagagagauggcucagugguuaagagcacugacugcucuuccagagguccugaguucaaaucccaacaaccacaugguggcucacagccaucuguacugggaucugaugcaucuucuggugugucugaagacagcuacaguguaccuacauauaaugaauaaaucuaaaaaaaaaaaaaaaagaauaugaaaggguccagagauuaauauucaaaggcuuggggacuuggggaaacaaugguauguuuaaaagaugucauuuuaggauagcuauguuggugaauuuguuuaauuccagcauuuaggagacagaaacaagggaccucugugaguccaaggccagccugguuuauauguugaguucuaggauaaccaggguugcauagaaaggaaaaaaaaauaacaaaaccuuagaguuuacugaguacuuguuaaucccaaagaucggaugagaaaacccaccaacccaaaucaugaucaaguuaaauaaagcaagcaguuaauuaaagcaagcuuuuuucguguauauaggcugccucuuccuaagguagggcucaagaagucagcauugggcauggggaagacaaaguuuuucuagcucagggguaggcgauuuucaaaugggggauuuggcaggcaaauaggcaggguuagaauguaacaaggugucauaacaacaggugguuauaauaguaaccuuuugaaacaaagguagaguugcaagauggucacaacaacuuucugaaacagacaugauugccauuccuggaacaggcaguuacagaaccauuuguaauaaagguugccagugggacauacuccaauccuugagaaacagauuuaaucauaaauaggaaugaaccuaguuugccuuuauuguaagauggcucucaaguccaagauggaggcaagcuggcugaucauacuugcuguguaccaaccaaguaacaguaaagagagcagauaagguuuucugucuuuuugcagauuacaugcuauuuuuggauggagaguaggaaauuaauagccugcuuagugggagagagaaaugggcaguaaacaaauggguaccaguauacucugguauuuacaggggguugguuccagaacccacagguaccaagaucugaugcucaaguuccucagacaagaggaguauaaaauuugcauguagcacacaugcaucguuucacacacuuuacaucauuucuagauuucccaguacaguguaagcaccauguaaaaguagcagccuaggccauauugcuuaggcagucaaggaaaccuguaaacaugcaguugucugaaucuaggauauagaccuugucaauacagagggccuauagucugugucgcaguggauagcaguaaaaacuauagaauguauuggacaggaaaggaaagcacagaguguugcuuuuuaaaaguuuucacaucuggagccggggugauggcucaguggguaaaggugcuugccagcaugccugacaaccugaguuugguacccaggacccacaucauguuggaaggagggaacugacuucugcaggcuagugauguagaagguggguaggguuuuuuuuuuuuuuuucuccuuuucauuacuuugcuguccucugacccuauagaccauguuggaugaggaagaugugaaagucgcuguggacgucuugaaagagcuggaagcuuuaaugcccagcgcagcaggccaagagaaacaaagagacccugagcacagguuuguccuuauguccuguucgucuucacgugugguauacuaugacaguuggaauuuguggaccaguaaagcaaauuguggagaaaguguguagacucuuaacaggcugugucuagguuggacuucauugcuccaugcuaaagguauuuauaccagaaaugcuaugguguacagaagauagaaaucagagcugacggagaccaacuacaucuaugucauuacuggccuguggggauugugguccaguuaagaaguuagagguuccuagcucauacggagugacacuguccugggugcuuggggauuuagaggugaaguuggguugguuuauuuuuuucaaacagguccuuguugauuuauuagggacaggacaaagaagaagaagaggagucggagccgagaccgagaucgagaccgagaccgagaccgggaccgggaccgggaccgggacagggaccgugacaaggaccgagaacgagauagagaucgagaacgagacagagagcgagauagagagagagaccauaagcggagacaccgaucacgcucucggucacauucuagaacccgggagaggacuaaggggaaaucuagauacagaucuaggagcagaagucagagucccuucaaagaucggaaagaccgagaaaaguauggggagaggaacuuggacagauggcgggauaagcauguggaccgcccucccccggaagagccugccauuggagauauuuacaauggcaaagugaccaguaucaugcaguucgguugcuuugugcagcuggaaggccuaagguaauggcugacacucuuucacaucagggaugguaaccugucuucuauugcugaaguguguguucauaguguaagaagcuacaagaaucaggugugccaggguuuuuagggaguuugacguuuuguugauuucuucuaauuuuuuuaaagauuucuuuuuuuuuauuuuauguguauguguauuuuauuuuuuaauauguuuugcuugucuguaugagugugccaaaucauuaauuauuuuuuauuuuugagauggagucuguuuucccuggcuguccuagaauucucuauguagaucaggcugaccccaaacucacagagauccaccugugucugccucccaguuguugagauuaaagguguguuauaacgucgagccuuuuuguugauuuuuuuuuuaagggcuuugaguauaacuaggcaaauucccugacacauucuuuuuugauugugaaaugucccagagccauuccuuccuucgucugcccucaggagaucugcccuuugcugauugugacaucugagaauugaucucacccuucuuucucaguccguaucuuuuuuuuuuucuuuucuuuuuucuuuuuuuuuuuuuugguuuuucaagacaggguuucucuguagcccuggcuguccuggaacucacuuuguagaccaggcuggccucgaacucagaaauccaccugccucugccucccaagugcugggauuaaaagcguacaccaccaugcccggcucccauaucuuuuucuuuuggagggugguaaugcuaauacuauuuuauuguuuggcuaacuucuuagugcucuucugugagcuuaagccccuucuucuuccuccuccucccucuuuccuuccuuauuuguguauguuauguucguauguuuguguucacguguggcacuuuacuaacugggcaaucaucuuuuugagacaaagacucaccauuguaggcagugcauauaaccucagacucacugugaaucccgggcuggauuggauucaugaucuuccugccuugccucauaaggcaaagguuucaggcccauaaagacugcuuuguucagguucagcaggaguagaaaucaguuaggcagaguuauguuuaggcuuauuucagaggugucuucacuuucucucaggaagcggugggaaggccuggugcacaucucugagcuccgacgggaaggucgaguggccaauguggcugauguugugaguaaaggccagagagucaaggucaaaguucuguccuucacuggaaccaagaccagccugagcaugaaggugggugaugugucugucuguguccacagcugauaagccagggcgugugagaagacaucgagugagcagugugugugagaagacagugagugagcagugugugagaagacagugagugagcagugugugagaagacagugagugagcagugugugagaagacaucgagugagcagugugugugagaagacagugagugagcagugugugagaagacagugagugagcagugugugagaagacagugagugagcagugugugugagaagacagcgagugagcagugugugagaagacagugagugagcagugugugugagaagacagcgagugagcagugugugagaagacagcgagugagcagugugugugaguagacagcgagugagcagugugugagaagacagcgagugagcagugugugugagaagacagcgagugagcagugugugugagaagacagcgagugagcagugugugagaagacaucgagugagcagugugugugagaagacagcgagugagcagugugugugagaagacagcgagugagcagugugugugagaagacagcgagugagcagugugugagaagacagcgagugagcagugugugagaagacagugagugagcagugugugugagaagacagcgagugagcagugugugagaagacagugagugagcagugugugagaagacagugagugagcagugugugagaagacagcgagugagcagugugugugagaagacagugagugagcagugugugagaagacagcgagugagcagugcucucguugugcuuuaggauguggaccaagagacaggagaagaccuaaacccaaacagacggagaaaucugguuggcgagaccaaugaagagacgucaaugcggaacccagacagacccacucaccucucccuugucagcgcuccugaaguagaggaugacucgcuggagcgcaagcggcucacccgaaucucugacccagagaagugggagaucaaacagguuggggucucagaaucauucagcauguggcauuggugguuagaguggacccuagacauggcagccggugacugguuaugugagccaaguuaucccacuagcugugccucagugcccuucucuguccaccagggccagcgguggcagugugggauugacagugagcaaagcugaaccuuagugccuagccuguggugauugggauuuucguuguuauuuuccuccgucuucagugagcauuagaacaauggugugucaagcccuggguagcgcugggcugcagagacaguguuccaugguuccugcccuugagggacucggcacccagggcugagacagggcuaaacaaguaacuguagggcugcaugccagcaugaaugggccaggugcugugguggcaagggaaggcaccagugacccuuccuggggacaauaccucugagcccauaccaucagcaccacggugugcuggucccuggggauuggacaugugccuuacucugacucugaugugcuggccuccaggagaacacaccuugugugacaucucuggaauuaacacugaggaaaaaaggaguuuugauuguagcuauaggucuuaguuccagugcugccuccuucugcccuuugcuagaugauugcugccaaugugcuuuccaaagaagaguuuccagacuucgacgaagagacuggcauucuccccaagguggaugaugaagaagguagucuugggcgagcuggaggagggguugggagggugauugcaaguuguauugcuagaguugcauugcuguuugugguugacugaguggguauucgcugcuuguucccugacucacuccucaucucuggauagaagcgcguguuuagacagaucagccacccgugggacucauuuuccuuuuuuagauuuaguaccauuuuuuaaaauauuuuuaaaaaaagauuuacuuuuuaguuacauauauuuauauguguauauauauacacacauacacauacauacauauaugcguguauguaaaucagucuggccaugaauucauaaaaauaauacaccugcuuuucccucccaagugcugagauuaaaggugcacacagccaugccccgcuaaaucgauugaucugucugucuaucuuaaucuauuauuuauauugguguauuugcauguguguauguucuuucuauuguuauuauuuguuuucuugagccgugcauaucauguagcccaggcuggccugucauuuacuguguggccaagaaugaucuugagcugcugacccuccugccuccaccuucugagggcugggguuuauaggcgugagccgcuccuggcucuaaguccuuaucuacuuuuuucuucguggugcuggggauugagcguggccuugcguguaccagcagauacauacuguuacggagcugcagccccuuucaucuuuaugaguaagauuauuaugagguuccuaaguuugccugcuaguacauguaugaaagaccuuuucuuuuccaacauguuaaaaaagcuagauguuguuaccucagcacuuggaaggccucagugaggcaggaccauuacaaguaguaucaucuagaaugucaggacaguuuucuuccacagccuuggcuucuuuggaaagcaguuuuaaucaauucuuuggcuggagcauaaaugcccuagcaguggguggguuggggggcaguucuggacgaggaggaacaguaaccuuggguagaauuuugcuucuacugaugccuuuuugaccugggaagcuauuccuuuuaauuaaaaagaaaaaaaauuuuuuugcuuauuuguuuuguguguguguguacauauuuguauuugugugugagaaaauacacaugugcuguggcccacauauggaaaacagaacaacuugccauaguugguuuguccuuuuaccacguagguccuggggaucaaacucagaauaucaagugacccuacgcacuuagcuguccugccaguuuugggaagcuguguaugagagugugcuugucugucugugugugcgugcauagcuuuuaaagggcacuugcaguauuugguuugcuccuuccaugugggcuccaggaguugaacucagguaucuacuaagccaucuugucagccugaaaugaaauauuuuaaugaccaaucuuuucuuucucguuuguggugacuucuuuuugaugaacuuuuagaugaggaucuugaaauugaacugguugaagaggagccuccguuccugagagggcauaccaagcagagcauggauaugagccccaucaaaaucguuaaggugagagagucgggcuuuuaccugggcauagcuucugacuugcuuccuuaaagcaauggggucagcauaagcgggagucaggccgucugacuggaaaccaggguuuuguaaauggagaguggcucagcucugugcuuuugccuguuuaaccuuugugugcauaaguuacuauguuuugagagaaagcagagauaagcagaaggcuugcucuaucauuccuguguuuaggucccuagggcuugaguccuuggugcccuggagggcagaacugcaagagugcaaaccagaauccuuaaaaauuuuggugugcgccaggcaugguggcgcacgccuuuaaucccagcacaugggaggcagaggcaggcggauuucugaguucgaggccagccuggucuacaaagcgaguucuaggacagccagggcuacagagaaacccugucucgaaaaacaaacaaacaaacaaaaauuugguauggaacagauuaucuuaagggucugccagcccagcuagccuauauaauacucguaauggugguuuguuuguuuguuuaggugaggucuuacuauguagcccugguuggcuuggaacucucaaagauuaccugccucugccuccugagugcuggaauuacuggagugagccaucacauccagcuguaacccauuguuucaguguucuuaugugggcucauagcugcuugccuuguuagugaugggcaguccacuaaccuuccaggaugcacaucauggaucuggucauuaauucuuuuuuuuuuuuuuuuuuuuuuuaagauuuauuuauuuauuuuauguaaguacacuguagcuguccucagacacuccagaagagggcaucauauuuuguuauggaugguugugagccaccaugugguugcugggauuugaacucgggaccuucggaagaguagucggcgcucuuacccaccgagcuaucucgccagccccugaucauuaauucugucuaacugaaacacccauauugcccugaauuuuaguccuuaggguuauacagaguucuuuuccauuccuucucuccacccccuucuuucauuguguaugcguguacacauauuuauaugugugaguacaggcauguggcugcaucauaguuugugacuagaaauuagaggacaagcugacaccucaucuuccaccuuguuugagauagccuguucaccauugagugcaccaggccagcuggcccuugagcuucagggaauuuucugucugugcuucccauuucauuguagaagugcugggguuauauagauacauacugcuauguggcuuugugugggcucuggggaucugaacucagguccucacacugugcggcaugaguuuugcucacugagaugucuccuuaggauugcucuuuuuuugcuguugguguuccuuuauuuuugagucagggucuugcugcauaacccugcuagcuuaguacuuguuauguagccaagaauggccucaaacgcacaguaauccuccuccuccuccucagccuccugaguuguaggaucccagucugcacacaucuggcugcagccucuucuguccucuaugcgucuaaggguagcaucgucccucacucuaaggggugcuucuucaagcuaaaacugcuuucacugauuuuuaauuuauuguauguguugcagagacacggauaugaacuuuauaucuucuuaugcuuuagaugacaguaguucaaccaucuaccuucuuagucguguugccugcccuucauguugucugauacuggcucuguagaccuaucuagccucaaacucacagagaucuaccugccucuaucucccaagugcugggauuaaaggugaacagcauugugcccaggcugaccaccaccuuuuccuagcuacugagugcuugcugcuuuuuccuguguuguuuuagaacccagauggcucacucucccaagcagccaugaugcagagugcccuggccaaggaaagacgggagcugaagcaggcccagcgggaagcagagauggauucuauacccauggggcucaacaaacacuggguugaucccuugcccgaugguaagccuccagaguaaauggcuuuauuuauaugucacaguugauaccacagacacaaagugaaaauuuagccuugguuuccuuuuuguauuguagcuuuucuuuuucuuuuucuuuucuuucuuuuuuuuuuuuuuuaaagauuuauguauuuauuauauguaaguacacuaugacugucgucagacacuccagaaaagggcaucagaucucauuacagaugguugugagccaccaugugguugcugagauuugaacucaggaccuucagaaaagcaguuggugcucuuaaccacugagccaucucuccagccuguauuguagcuuuucuauauuacauuccuuuuuacaauuuauuacuucuaaaaaauuauuuuuagcuggggguuguuguugguguauacuuuuaauuccaacacuugggaugcagagccaggcagaugucuugaguuuaaggucagccugaucuacagagcacguuccaggacagcgagggcuacacagagaaacucugucucaaaaacaaacaaacaaacauaaacccaaaaaaccuuucuauguauuuaucuauuuuuuuaaguuuuugguuuuuuguauguguuuguuucuguauggugcugaacccucuggaccuguuacaggcaguuguaaguugcaugauauggaugcugggaucugaacucugguuuucuggaagaguagcaaccagcucauuugaaagaacaacaaauagucuuagucauugagccaucucuccaaagcuuuaaguuuuaaacaguugcuuaaaauaaguguuucaguaaccuuggucauuacagugacugaguuugucucuaaacaacuuuuaagacuuuuauucuaagcauaguauaguguaagggcuagagagcagucuuagugguagauugcuuauguagcauacaugaagcucuagguucaauucccagcccuggggagaaagagacuacacuaugagguggaugggguugcccaaaccuauaaucccagcacuuuggagguagaggcagaauuaagaguucgaggccaaacuggaggguuguagugggacacauuuuuaaucccagcacucgagaggcagaggcacaagggaucuuggaguuugaggccagccuugucuacagaucaagucacaggacauucaaagguacguacacagagaaacucugucuuggaaaaaaaggaaaaaaggaagaguugaaggcgaucuucagcuacauugggacaaccugggcuguguuagacccagucucaaaaacaacaccaaagggggcuggagagauggcucugagguuaagagcacugacugcucuuccagaagucuugaguuuaauucccagcaaccacaugguggcucacaaccaucuguaaugggauccaguguccucuucuggagugucugaagacagcuacaguguauucauauacaugaaaaaaacaaaacaaaaccaaaaaccaacaagaagcaaaaaguacagucuuauguauuuguguauaugcuugaauguauguaugcaugccaugugcauauggaugcccuuagaggcaagaaggggacaucagauacccuggaauuagaguuccaugcagugguaagccacuuaacaugggugccaagaacugaacuuguaucuuccaccugaguagugcauguucuuaguggcuaagcaucuuuccauaccuguuuuuguuuuuuaaauguguauggguguugugccuguauguuaucucuguguaccuugugugugccuggugcucauggaggucagaagagggcauuagauccccugagaauagaguugcaggagauugagggccaccauauagauacaccauauaguuuggguccucuguaagagcagucagugcccguuaaccacuggguaucucucuauccccuuuuguauguuuguuuaagauggggucucauuauguaguucuggguggcuuuaaacuaacuguguagcuuaggcuaauccuaaacuuggaacaguccuccugcuucagccuccuaugugcugggauggcgggugugagcugccaugacuggcuagaaccuagucuuucaaagagguuuagagaguauguggcagcagguggggaaugaacuguguuaacagcuuuacaguagacaagaccuuuggaagucuguguguuaugcugggugcccagggauggggcaggauuggcaggucagggcuuuguggaugguaucagguaucaggcuuaucuuaagugcaucauggaauguaaaaguguucuaagcauggguauggcaucaucagaggucucugggaggaguugggaagggcaagaguagaugcuucagguggaucggcaggcuuuuaugauagcaagaggagaggaucauggccuggacaugguguuaucagagaagagaaaauauuugagauguguagauuguugaauauuggauauauuaaauauaggaaguagcaguggccaaagcuagcuuccagguguccuaugagcagcagagugauggugccuuuggguaagggacagcugaggaacagguguguggggaaagugugacuggaccuguguuucaggcagacagaagacaucucagaugagguaucaggaaugcucagcagagggguguugcuggucuuugcuacuucguggguucuucuguuucucaucuuuuaucuccuguuucauccccuauggcuagcuagauaggagaggacaaagggcagggaggggagauugagauccuugagucuaauuucuuucgaguacagcuauuaacaaaacaaaaccaacccuacccucucggguacccucugaaaaguucccagaauucuaaacauugcacaaucacagaaacuaccugcagcuggcaaaaccgugccugugcuagagcaggaggcaaaucacugcuccagacaguuugaagcagccuaaguccccacaccugggauuaaacuaaaaacacauucuuauagaauuucuguguuuuuaaaggauccaaaauuccagaauucucccuacagaggggucuguguuguagagagaauucuggggcauuacgucagucuagagauggauagaacagaugaacuagcauuaaagggcuagaaauauauuuuuuuaauaaaaagaaaaucuuucagagcauguaaaaugcuugccuuguaaguacuuggaccuaguuugagcucuggagcccauguuaauaaagcugggcaugggguguguguguguguguguguguguguguguguguguguaauccagcacugaggggcagagagacgaaccugacacuugcuagccagccaguguagcucauggagcuaguuccaaaccaguaaaagacccugucucuacuguguagagggacaacaggugauggcaccugagacaccugauguuguccucuaggcucuacauacacacaugcauacucucacacauugaugcacauguguguaguaccaugauggugcacaugcaugcaagcgugcuuacacacacacauauacuacacacauacacguacaccauguauaauacacauguacacacauauacuacacacaccacauauaguacacauacacacacauauacuauacacauauacuacacaccacauauacuacacauauacacacacauacacuacaauccaccaguucucuucccauuguacccuuuaguaaaaggcucccuguggcucuuuggccucuuucacagcucacuuauuuucuuuauagauugaggugagaaagaguguuuugagaaaagguuuuacuauguagccuuggcucaaacuuacauaaauauguauuuaaagauuuauucuuauuguuuuaaguuaaauuuaagugaagugccuguguauggguauccaccccuagagucagaggugcuggauccccugguacugaaguuguuacaggcaguugugagcuauccaucuugggugcuggguccucuggaagaggagcauacuagcugucucuccugccccugagacugaaguauguuuucacagguguuuuugucaacacauuugugacauuuucauauuugagagagccaccaaaauucucucucuuuuuuuuuugaaagauuuauuuauuauauguaaguacacuguaugugucuucagacacaccagaagagggcaucagaucucauuacggaugguugugagccaccaugugguuggcugggauuugaacucaagcccuuuggaagaacagucggugcucuuaaccacugagccaucucuccagcccaccaaaauucucuuuagcuugcucauucuuuugcuccuaauucaggccacaaauuuuuggguuaaccuugaaaacauuaaagcagguggaaggaaccagguucaaagcaccacacacuguaggagguauccagagugugccagcuugagagagagaaagcagaccagcgaaggcaaaaggggaaagagguuucuuuuggagggauggagacauuguaaaauuaggugguggugauggcugcacagcuuugggaguguauuagaagccacugagcuaacacuugagaaaaaugguauauagccguagccugagacagaacuaaauuuguuuuccuuucagcggaaggcaggcagaucgcugccaacaugagggggauugggaugaugcccaacgacauuccugaguggaagaagcaugccuuugggggcaacaaagcuucuuaugggaagaagacccagaugucaauccuugagcagagagagagccugcccaucuacaaacugaaggagcagcuggugcagguaagaggccauuuuggggugagggaugggguguauauuggggugcuggagcucaaaucugaucaagcacuguucuacuaagcuauauccccagacuuucuauuauuuauuugucuguguguuugugcguuuacuuacauaugugugcgauuuaggggccauggcaugugauugggucagaggacguuuuguguguugagugucuuuaccuguacaugggucagacucaggcuuguguugaagcaucuuuagcauggagccgucucacuggcuccuuauuugaucuuuuuuaggcaugacuucguucuagguagcacaggcugaugggagcucugugucccagacgggccucaaacuaaugaugaccauccucuucccucagccucccccgggcugugaugcaguugugagcaccacaccugccaugaagauuuuuuuuaaauaggucuaaugaacuugaacuacaaauauuccugccuuaguuuagaauuauggguguguaccacuacauaguacuaggaagcaagcuggucaauauucucccaauugagcuacauuuccccagcccuuucuuuuaguuuucuaagauagucucauauauccuaguuuugccugugugugugucugcagcaugugcaugccuguugccugaagaagucagaagagagcacuaggacuacugggcuguaauguggaugcugggauuggaaaccaggucuucuaugagaguccagugcucuuaauggcugagccagcucuccagcuccuguggcaaauguuaacaaauacauuuacauuacgcuucuuucaggcugugcaugacaaucagauccuaauuguaauuggagagacagggucugggaagacaacacagaucacccaguaccuggcagaggcaggcuauacuuccaggggcaagauuggguguacccagcccagaagaguggcagcuaugucuguggccaaaagagucucagaagaguuugguuguugccuuggucaagaggugaguggucggagaagcugcugugugaaccagaagaaaaauagucccagauaauuuaucuauaaaaugagaauauuauuacaucuuuuuagauuucucccaaaggaggcagauuuucauugucaacaaauaauucaggcuaaaguccagagcagggcagaguuuaccaguggaaaccucugugaccuguaauuuccucucuaccaggacugugaaggucaguccagcuuacguuugcuucuuuguggggucuuucuuccaccauuuaaaccuuguaacacuagauuagaaagaaaaaugguggguagaaagaucccucaguauaaucagggucugucaggggugauguuaucauuagacuguguccugcugcuuaggggacucaguuccguggggcaaguuggaucuuugcuguuaggauaucuacuaagguagcuguccugugaccaacagccagcaccauucugagccguagcauuuauguauccucugaaaaguccccagcauuucaagcaucaggcacaaucguggcccugcuagaguacgaggcaaaucaucaacuuuuguggacaauuugaaguagccccauagcccacagcugggauuaaaaugaaaacauaauauuacaauauuucuguuuuuuuuuuaaagauuuauguaucuauuuauuuauuuaucuaauaugaguccacugucgcucucuucagacacaccagaagagggcaucagacccuauuacagguguuugggagccaccgugugggugcuaaaaauugaacucaggaccucuggaagagcagucagugcuccuaaccgcugaaccagcccuauuucuguauuuuuaaaagaaaccagaauucuaaaauugucacuacaggccagucuggugauuucacaaagagacccugugucuugcguuuccuucuguccugcuguaggugggcuacaccauucgauuugaggauugcaccagcccagaaacagucaucaaguacaugacagauggcaugcugcuaagagagugccugauugaccccgaucucacucaguaugccaucauuauguuggaugaagcacacgagaggaccauucacacagaugugcucuuuggauuguugaaaaagguaacuaaguaaacgcuggacuaggauuugaaugugcugugauauuuugcuguucuuuuuuaguaagcugucuuacauuucccuuuagacaguucaaaaacgacaagacaugaagcugauugucaccucagccacgcuggaugcggugaaguuuucucaguacuucuaugaagcacccaucuucacaaucccaggucgaaccuauccaguggaaauucuguacacaaaggagccggaaacagacuauuuggacgcuagccugaucacggucaugcagauccaucugacagagccgccaggugagggcacggauccucuuccucugggaguguaucuucugcuagucuugugaaacacauuugaaguuugcucuuuguaagccucaggcauguguacuuggaauagugauggaaauguuuaaaugcacuuauuugagugcagauggauugaaaccucuugguuuauuuauuuuugugguuuuugagaugggguuucucuuggcuuguuuagaguucaguguguguauuuccucuguguguguguguguugcuguuuguguuguugucaccuaucacacacacacaguuugguaaauuguaccugugguuggagcuaccaagaggcuaaagcaggaggauugcuugagcuagaaguuuagggccagccuggauaacauaauagaauucucaaaauaaaacagaucuaagccugguugcaguccuguaaucccagcuauuuacuuguggguacuaaggcagauagaucucaaguucaaggcaugccuggacaaaugagugagacucugucucaaagauuuugaaaaguggaaagagcugggaacgcggcucaguggcagaugugcacacgacucuccccucgaacacacacacacacacacacacacacacaacagagccagagacagugaaugacguuucacucucuuccuaggugacaucuugguuuucuugacuggucaggaagagaucgacacugcuugugagauccuguaugaaagaaugaagucccugggaccugaugucccagaguugaucauccucccaguguacucugcccuuccgagugagaugcagacccgaaucuuugauccagcucccccugguagcagaaagguaacauggggcugaaaugaagugguuccacauauccuuaagucaagugggguacacagccagggcuccacuugucacagccuccccagugauaggauuacguacacacgccacucugccuaccauuuuuauguggguucuagguauuaaacuuaggucuucagacuuuuaagacaaguacuuuaucaacugagcuauccccugccuuaauuuaucauuuuuaaguuuaaaaauuuuauuuuucagcugggcauggugacauguacacaucauggugcauguguggggucagaggacacuugcaggagucaguucuuuccuuccaccaucauugaagucgucaggcuugguggcuuguguuuacccacugagccauccugcuagacuccggauguauuguauuuuguauaugguucauuacuugauagacauuagguuauuuccacuuugggacacagaguacuucugcugugaacauguguuuaccaguuuucucagacguguguuucucugaguauauuuuggcaguggagauagaugggaaaauacucagugggugucaggagguagaggggugaagguaagggaaaaaccaggcauggcucucaggcuucuaacuugcauagcuggguggcacgugguucucagaguuagucaugggagaaggagcagguuugggagggacaggugggagcucuuccucugcucugugucuguggguuagacuugcuucuaagcagggccuuuguggcugugaggcagguagaugccuuucagggccagugagauacuggugugacgagagacauuuccgugccuccuagcaaggauuuuucuaagcaguuguguuuuaugagcugaaccucuggguaaaacccaguggcagagccaagcugagaguaauaaucuucuagaucagagagcgcugcacacacaaaccgugacguuccugucccucgugcuucauuuuaugacgaggaggaaagaucuaauccuccucuuguuccacauauaugaacagcccauuucguaguccagaugucucugugggagaaagaaaaaucucauuuugcggugcuacaugugaugccaggaagucugugcuuucccagggagcuagaaaauuaaaguuauaguaaucaucugcucuagacaaugguacacagcuauuuauaccaaaugagauuggcucugagcagcgauggcucuucuguuuuacagcucugaggcaccacccacuuccaaaggaacccuucagaugcgggcaccuuccccucugaccacuggggaccuggacugggguuaaaugucaggugucuagagggagauagcagauuccuugggagagaguacgaccuucuccaaacucagcucacuuuggcucugucuuucucaucuguagguggugauugccaccaacauugcagaaacaucucugaccaucgacggcaucuacuaugugguugacccuggauuugugaagcagaaaguguacaauucuaaaacagggaucgaucagcuuguggugacaccuauuucucagguauggcugugucugucauaagcuauucucaaaauucuggugagggucuuucugggauuuguuauggucccucccuccuucguucucucccuuccuuucuuuucuuuuuuuaaauuuuauuuauuuauuuauuuauuuauuuauuuauuuauuuauuuauuauauguaaguacacuguagcugucuucagacacuccagaagagggcaucagauuucguuacggaugguugugagccaccauuugguugcugggauuugaacucagaaccuuuggaagagcagucggcacacuuaaccgcugagccaucuuaccagccuucucccuucuuuucucauuuguuucaagacagggccuugccaggaucucuguaaguucuagacuagcucggucugcauagcaaguuuccaagauggcuaggcuuugcagagagaaccccuguuuuuuuuuuuuugcugggggaaaaaagaguacuucuugcguguaaccuaagcuggccuuaaauauggugccucacuuaaucuuugcccccaaaagugaacaaaagugggaugaggaaaggcuucguauguuguaugcuagcccucuguauguguuucucucaggauuaaauuuaggcccuauguauguuaggcaaacacucuaucauuuagcuauauauuuauaauccuuuuuaaaaaaagauuuauugguuuauuguuuguauaugaguauacugucacucucuucagacacacuagaagaggguaucagaucccauuacugaugguugugagccaccaugugguugcugggguuugaacucaggaccucuggaagaacaguaaauguucuuaacugcugagccaucucugcagccccuguauuuguaaucuuuagggugagacuucaaaauauaauugccccauaaauccaaaguuuuuuuuuuaaagauugccauacacauguucaguguuuguaucauugugugugcgugcaccguuguggggccccacacaccauggacgucagaagaaggcuucagauccucuagagcuggaguugcagaaggucaugaacugccuaaugggugaacucugcucucugcagucuccaagaacaugaacaugugcguacguacauacauacguacauauguacauacauacaauauuauacauaucauuuuaauguucagcucauuaaccuagcuguucuguuuccaggaacauaucaguuagauaugauuggguacaugcucaaggaacaauaauagcuguucacggaaggaugggccuggaucagccagaaggggaagcagcuuacuccagcauagaauaaccaugccauagaguacuguguggaauuaacugcugcuguguauuuauauuuaauguuguaaacgugaaacugguauauugaaggaagugagcuacaaaauaugauaaauaaaacaaggcaauuuuuguuuagaaaacacaugcuaggcauuucugggcugagccuauggcuguggcccacacugcaagccugcaggcaggauguucgcuggggcugcuuuauggggcugcuguacagauugcuguguugguggaugauggcuuuuuuuuuccuucgcuuuagacacuuuuaaguauuguguucaucuuuuauaucaggcacgccuugacuuuuauaguuugcaaaccccacaaagcucucuccauucugauacuuuaauaauaaugacuaagguucacaaagugcuuaccaaacaccaggcacuguccuagguauuucacaugcgcugacucgggacaucgucgcaccaguucucauuucccagccaggagguuagggcacagagggaggaaaggacuuccuguuagcgcacaguuggcaaagguaggguuuggaucuagaaagccuggcuucagcacaugugcucugaacagcuucuuaggacagugugucucuugugaugacgggguacuuggcuccuuguaccuucgcugacuuggagaggcaucugugggugccgugcagugccagcagugugaguguugccuggguugguugaugugacucauuguccuccaugcuucuuuuuuuuuuuuuuuuuuguggcuauuuucaagagaggguuucucuguguaguccuggcuguccugaaauuuucucuguagaccaggcuagccuugaacucagaggucuaccagccucugccuccugagugcuggcugggacuaaagcuguaggccaccauugccugguuguaacuuguacuucucaccugaaaaguugucacuguugucacugaacaccacaaacuugauuuuaaaguggcugcaaaguuacuggcgugguguccauacuuuacuuaguugacugugguuuugguuauaacuguggggcugggguuuuauuuucuguguuuguucuguucugccuugugugugccucccgggacaaccuuccuggaaguacugagaguuacugagucucucuaguguuggaaacgggccuaaagaagugcuggcucugagagguuugccuugagcucuggcggggcuuucuuucugagccucucucuuucccuaacccucaugcuuaaagucuagauuaaaauaucuuuguuaaacccuaacucugccucaugaaaagcaaacagaaaacauuugcuagucccuuccccagcagaguuccuggagagagcugccaagugauauuuuacagcugggacuuucuaugcucacccucuaggcucaagcaaagcagagagcuggccgggcugggagaacuggcccaggaaaguguuacagacuguacacggagcgugccuaccgcgaugaaaugcugaccaccaauguaccggaaauccagagaaccaaccuggccagcacagugcugucccucaagguaagaaccgcugucuuccgagaauggccuggggaagcguguacuccacagcccucuugcucagggccccucgagggaucggcccugugagugagaugcaguguguucggcaacagcucccugugcaggucuaggcuggauuugcagcuuccugugaaugcacauuuguuucuuaccauaaccagcaugauauuugguugugcuagguuuuagugaugaggcauuuucaaaaaagaaauuagacaaauaaaaucagugccaaacugcagaccaacacauuuaacccuaaacauguuagcuuucagauccaaaucuaguccuccuuugcagagugugaguguguaugucugugugugugucuguguguaugugugugugugugugugugagagagagagagagagagagagagagagagagagagagagacaaggucuugaacuugcuguauaaacuagguuggcuuugaacucagagauccacuuaccacuaccgcccaagugcugggauuaaaggcaccacauuggaugaauucugguuuuuaaaucuuuuuuuacacuuauuauuuuuaauuaagugcauguggacaugugaaugugugagaggcuggccagaggcaucgaaaucccucuggagguggaauugcagaugguugugaccugacaugauauugggaauagacgucugucagguuccagcuguccugcaggguuugcuuuucaguggucuucguucugucuuggcaggaggagccacacgaguuauuucucaacucagggcaaguccccugaugccaguccugcccuggagcccuggcacuucaccagugcagagcugucucucgguauuuguuauucauuucauguaagagaggcuaaaacagcgcuucagacaaaaagcccacugugaucccuggagggcugccagggaggccucuguggccccugacuucuccuuuggccaugugacaugggacagauuuaacugcuuggcccucuguucugugaucuugucccagaaagggaacuguuguugcuggagagauagguggagugaugcaggcaaagguacuucguacagugauugcucacauaacucuuagguuauuauucacacaauaagcaguuauuggcuaccugcugugcuucugaucacagacacuuuaugaggaguagaaagcacuccacccuucauagccacuugaauagagcaucauucagacauuucuucaccaaauuaacugacgaguguauuauauuagucccuguuuugugccauacacaugugucauacuguguuugugaaccauguuggcacugucuuuaugucccugccaccuacugugguauaaaguacuccaccagaugugcaggagacaggguagagaugcuaugcugucuuuaauuauuguaaaauaugcauaauguaaaaugcagagcuugcucucagcuuuuuuuuuuuuuuuuuggucuuauuuucuuccucuccuucuucuucuuccuccucuuccuuccuucuuguuuguuguuuuugguaaugaacuugaguguguaguccuggauggccugaaauucccuuguagacuaggcagccucagacucucacaaagaucugccuacugcugccuugagcacugguaccauagguauggacugcuacacuuggcugguguuggguuuugaaccuucagccccaagcacacugaacucucacgcccccugagcugcacuacagccauuguggcuuauuuuguuguuuauguucuuacuuugaugcagggucuugcuggucacaaacuugugauccucuacuuccagaguaccaggaguauagauguguaccauuguguuuggccaguguaaguuuuuaaguguuaauucuacaacauuaggucuagucacagcuuuguauagcuauugcacagaucuguucccagaaguaucucuuuagccaacuucccuuuuccauucucuagccuuugguaaugugugcgugugugugcacaugcaugcacacacaguuacacaaucuguuuaacauauguaagugaauuccgcaauauuuguucauucgugucuuccuaacuucacuuagcacaaugcuucagagguguaggcaggcugcaguauguguuuggauuucauggcugacuuaggguaauaccccuccauucaucugaggauuuuuuggggugucccuaccuucuggcucuugugauuucugcugcugugaacauuagaguacaaauaucugaguuccuaguuucaauauguguuuaaaaauauuuauauguguaugggugcuuugucugcaaguaugucugucucucuaccauguguaugaggugccugaggagaccagaacagggcauuggcucuccuggcacuagaguuacagauguugucagcugccccgucagugugcugccccaucagugcuggggaucaaaccccgguccucuggaagaacagucagagccaucucucucugacccuuuaauguguguguguguguguguuuuuuuuuuuuuagauuuauguauuuauuauauguaaguacacuguagcugucuucagacacuccagaagagggagucagaucucauuauggaugguugugagccaccaugugguugcugggauuugaacucaggaccuuuggaagaacagucagugcucuuuauccacugagccaucucaccagcccccuaauguguuuuuuaagauuucuuuuuuacuauguguguaugugugggugaguaugucacauagguucaggugcucacagaagccagacggucggaugcccuggaccuggagaugcaguuuguugugagccauuugaugugggugcugggaacugaccucagguucagucucuucagccuccucuggauauucuuacuucagugccuagagacagacagguugggucauagguuuaacuucuugguuuuugguuuuucgagacagggcuucucuguguaguccuggcuguccuggaacuuacuuuguaguccaggcuggccucgaacucaagagaucugccugccucugccucccgagugcgggauuaaaggcgugcaccaccacgcccggcuauguuuaacuucuuaaagcauucugauaacuauuuugccuggcuggcuugaaacuuacaaagauuggccuucuucugccuccugaguguuggaauuaaagccagagccacuguccaggcuacauuuuacuuccuuuccuuuccuuuccuuuccuuuccuuuccuuuccuuuccuuuccuuuccuuuccuuuccuuuccuuuccuuucuuucuuucucccccccccaguauguuuuacuuucuaauuugucaccaaacuacuuuccauagugacuguuucacauuccuguaagaaauguacaaaguuuccugauuuguuuuauuuguuuuuucuaucuugcuacaguagguuugacuugcauuguccuuagcagaagcuuguguguccucuuuggugaaauaucuacugaaaugucuaacuuugcucaccaccucacuuuguggacuuacugcccugcucuguuuauuuauuucgaaggaauguuuuuguuuuguuuauaaauuuguaacucuuagagcuuguauccuuguauagaagugcaggugucuuagaaggccagggcacuggauugccuauagugagaguuacagaugggugagcugccugaugauggcucugggccccgaacucuggaagaagacaaagugccucugagcugucucuccaccauggaaggaauugguuuuuaaagauuuauugccgggcagugauggcgcacaccuuuaaucccagcacuugggagguagaggcaggugaauuucugaguucgaggccagccuggucuacagagugaguuccaggacagccagggcuauacagagaaacccugacucgaaaacaaaacaaaacaaaacaaaaaauuauuuauuauguauacaguguucuucugccugcaucuaugccuguaggccauaagagggcaacagaucucauuauagaugcuuaucaugugggugcugggauugaacucaggaucccuaaaagagaagccagugcucugaaccucugagccauuucuccaacacagaaacaauaguuuuuaaguuuccuaagagggucggguaaguccuaggugccagaaugcuugcuuaccauugugaagccuuagguaccaucucuagcacugcauaacuaggcauaguggugcaugccugugauuccagcacucaggaaguggacacagaaagaaaguuuccugagaaaauacaugguuguuagugguaugagaaucuuuauguacugagaaucuggaaguuacugccucucugggcuuccuaacugcauugaagaaacagcagagaaugugacaggggaccuguuucaacugugagacucaucuuccuguugcucuguuuucuaggccauggguauuaaugaccugcuguccuuugacuucauggaugccccaccgauggaaacucugaucacggccauggagcagcuguauacacugggggcccuggacgacgagggccugcucacucgccugggccgcagggugaggggcagagggaacuuggggugcuuugggaggacgcccugaccaguuuuccaccuuguguugaggccuuggagaagcuuugaguaggauuaaauacucuuuagaagggcgguggagggggaauggagagugugagcccaggcuggccugaaacuguuuauguagccgaggaugaacuccugaucucuggccucugucuaccaagugcugagauugccggcaggcaccaccucaccaggccuggcaccaccucaccuggccuggcaccaccucaccaggcucgggauucuuuucaguuucuuuuuucuuuuuuuccuuaaagauuuauuuguuuauuuauuuuauguauaugagugcauuguagcugucuucggacacaucagaaaagggcauugcaucucauuacagaugguugugagccaccaugugguugcugggaauugaacucaggaccucugaagagcagucagugcucuuaaccucugagccaucucuccagcccucuuuucauuuucuuucaaggaauagguagaguuuauuucuacucaagguuuguuuguuuauuguuuaguauuuuuguuuuguuuuuucucuguauagcccuugcuguccuggaaaucauuuuguagaccagucuggccuugaacucauagagaucugccuaccucugccuccccguacugggauuaaaggcaucugccaccacuccuggguauuuaaauuuauuuuuuaaagugucuuuuuuuuuuuuuucaaauuuaauuuauuauuuuuuaauuuucauugguguuuugacuacaagugugaggggguuggauccccugcaacaggaguuacagacaguugugagcugucacauaggugcugggaauugaagccaggucuucaggaaaugcagcccaggcucuuaaccacugagccaucucucuagccaauuauuguuguuguuguuguuguuguuguuccccgauuauuguuauuguuauuauuagugugugagugcuggguguggucaggugccaagucuguggcguugguucucucuuuccuccuuuucaugcguucuucagauugaacucaggucaccagcuuauguggcagacacuuuuaccugucuuaccuguuuaagguuuugcuuuuuuaacuucaauuuuauauuaucacuuuaaaauauuucuuuuuaauaguaaagacuauuugcaguuaauuuuacuccagauauauuacugaaucuaaucuucauucuauuuaugauuauaauuauuauuauuauuauuuuaaaacaaguuauucuguguguagcugggauuggccuggaacuagcuaccuauauagacucaaaaacaaauuaaagguauuugcaacauucacaucaacaguagauauguucuuaggcacgaagggcuuauuuaacaaaggaaauaugugguagagacaggugccccaaaucaucauggggacauuuccucaucuauuuucuacuuccuagucaaguccaugcgcauggucuguagggaaacaguuguaauuucuucuuauuccuguagauggcagaguucccucuggagccaaugcugugcaaaaugcucaucaugucugugcaucugggcugcagcgaagagaugcuaacuaucguguccaugcugucugugcagaacgucuucuaccgacccaagguaaggugcucaaccccauguucugaugcacuggugcagugacaucagccuguucugugauguuugucggggacaaggccuacagggaaggaaugacucucugucccacugccuggcaggauaaacaggcccuugcagaucagaagaaagccaaauuccaccagacagaaggggaccaccucacccugcuggccguauacaacuccuggaagaacaacaaauucuccaacccguggugcuaugagaauuuuauucaggcucguucccuacgccgugcccaggacauucggaagcagauguuaggcauaauggacaggucagucaggaguguggugauauuaguguuuggguggucaugucuccugggucuucugucacuccgaauguauuugcacaguucuaggcaccuguguacagagaguguccaucucauuugguguaggcugucuccuccccaggcaggaguguggcuaagcagcacuucagaaacuuccuaagaggaagauaauugaauuagccaagaaaaaugcuuugcuuacaagccucuggaucauuggucugggguuggguucuugccugagccagcgucugguuucuaguuccuucauacugccugucauguccaguacuccucugagcucugaggaagguccuggugacuaacugugagcacccuaagguggaacguugagcagcuggcacccagcuuacagagcaggcucauggcgucuuugcucuuacuauccugauaggcacaagcuggacguggucuccuguggcaaauccacaguccgagugcagaaggccaucugcaguggguucuuccggaacgcugccaagaaggacccacaggaaggcuaccggacucugauagaccagcaggugguguauauccaccccuccagugcucucuucaacagacagcccgaaugguaggucacacacacacacacacacacacacacacacacacacagagggggagggagggagggagggagggagggagggagggagggagggagggagagagagagagagagagagagagagagagagcucauaagcacuccugccucugagucuccagcacccccacuucuccuuuugacuuuguauuucuagaguagcagaagcccaaauuagguacacuaacaagcuccccauuuuucuuuaguauguauuuguguguauacagguguacauuugugcauguguguggagggcagaggacagccucaggaggcauucuccuuuuaagaucaucuuaccgccuggagcacacaauuagacuagauuggcugaugagccccaggcguccucugucucugccuccucagcacugagaucacaaaugcacaucaccaugcccagcauucuguuggugcugaggguugagcuauuauugcaaggcaagcauuuuaucuacugaguugccuuuccagcccauaaacagccuuuuuuuaguuuuuuuuuuuuuuuuucucuuuuuucuuuuuuguuuuuuuuuuuuuuuugagacaugguuucucugugucuguccuggaacucacucuguagaccaggcuagccuugaacucaaaaauccgccugccucugccucccgagugcugacugggauuaaaggcgugcaccaccacugcucagcauaaacagcccuuuuaagagaaguaaaauuauaggggugaaagcagggaaagagcuuagaaaucaucuaaugagauggucuuaaaaugguuuugugggcuuuuuguuuuguuuugucuguuuguuucuagauagggucucacuguguaucucugguuggucuagaacucacuagguagaccaggguggccucaaacucagagagaucuucuugccucugccucccaauuucuuggguuuaaaggcaugcaccucuacacccagcgaugucucacacuuguaaucccagcucucaggaggcuaaagaaggagauugcccugaguuugagaccaaucuagauuauacacauggaaacccagucucgagcaaacaaaaacaggcaugagauggcucagcaagaagggugcuugcuagacgaccccaggacccacagaaagguggaagaagagaacugacuccacagagcuguccucugaucuccacuuguaugugcauguucucucucucucucucucacauacacacacacacacacauacacaccagcaugugccacuauaccuggugcuaccacugccuugcccacuugguccucagcauuccuuugcgauaaucucuguggccucucuauagaacuuggaauucuaugggagcuaucugggagagaaagcuccguuuuauuucacagaacaagaaacuggaaucuagagaagggauggggcuguuuucacuguuacucaauugguucaugccagagucgggacuagagcuggcucucugcaagcaggcuuguuuuggaaggguguaggcuugcagcaugagguguggcuucgguagucuccugagggaucaagcaggagaaaugaaagaacaaaaugucagcucaguuguggucgcccaguggaccaaacuggcuguggaguguggggucuaaucuaaggccugaguccugucugucucccacagggugguauaccacgaacuugugcugaccacaaaggaauacaugcgugaggucaccaccaucgacccccgguggcuuguggaguuugcuccggcuuucuucaaaguuucugacccaaccaagcuaagcaagcagaagaaacagcagcgccuggagccucuguacaaucgguaugaggagccgaacgccuggagaaucucccgagccuuccgccggcgcugaaagacagcugacuacuugccucuccuguaucauggcuuccugugacugaugacaagcuaguccuguggugacugaucuuaaacugagcauuuucgaagccugacucucuucauaguguaagauagaaacauuuaagcagggcuuuggccagagccuuuaauccuagcgcuugggaugcagaggccggaagaucucugaguucaagggcagccuggucuacagagcgaguuccaggacagccagggccacacagagaaacccugucuugaaaaaagccacacacacaaaagaacaaucagauaaggugugcauccugggaaaggcaagggacaugaguaacugaugcauggcagacccacaagggccugauaccccagcucugcuugcugaaggaaugaaccaugacacucguguuccaugucagccccacucucuacccacuccccagccucuguacucagauuucuaccuccuggaaauauuuauuuuuuuaaggaaacaaugguuuauuaugacuuugucuuguugggcagggcuagcuguaaggucaggcucucggccugaguucagugugguacacauggcaaggucucugacaccagaucccaggccucucuggguccagacaugaugaugcauggaccaaacuuccagucugucuuucagcaucacuagagcuagcucagccuuggcagcacauggccccagauuaaccgagucugugccagagugcuucagucuggcuccuggcgguuacagaagccgcauuggaucacaaagcucuccuugauccuuugucuccuuccugccacuguuagagugguguguuccauuuccuuuaaaacauagcaaauaacgacacaaugacagcguucccucucugucagcagaaagccagcccgccucucaucuacugcgagcuuaggggacuuugcuguggggagugacccauacccucacuccuguuaguuguuuuccuaguuccccuucugagaacuauggagggucugugcugaugggagggagacccaucauccugccaagccagacuggagcucgcugaggagcccaugggaucccuccuucagccccacguuaguaacuccuaacuguaaguuaagugcugaaucguaggccagaugccuaaagaaaaggauacggccuuuccugcccuucucccucuucauuggaggagggaugcgugucuucuauacugagcacccagaaagggcaggauugcagggcaaacuggggaugcaucuguggguauuccuucccuuugucacuucucugcugugaccccuggaucugaccucugaccgcccaucagaauagccacgccaauuacaagcccaggcuacucugaagggaaugagugucuugcugagauucggagggagaacuagccugagaaugggacuccaacccccacccccuguguguauguuugaaacugguucucacucuauagcccaagcuagcuuuggauucauggugguccuccugccucugaacugcuagguuuacaaguguacaucaccaggcugguuuuguuucuuuaggggaaaaaaauugcuucaaguauuucauuuuauauguauggguauuuugccuacacucauguccacguaccauuuauaugccauaccugguaccugcaguggccagaagaggaggauaucagacccucuggaguuggaauuagaaauguuugggagccaucacguggguacugggggugaaaaccagguccucuggaagagcagccagugcuuuuaauagcugacccaccucucuaggcucuuguaucucauucauuaguaagccaguauuuccuaguugggagcccaagagaugaugugggacuuacgcacagaacuggaaucuuccuggccacugugugcacaugugugugaagaugaagcgacagccuacggggaguuuguucccucuccccccacuauguggauguuggggacagaacucaaguauuuaggcuuguccggaaggaagcaucuuacccacugagucaucuuucugggcuaaaacauccccuucccauccccuccccacccccaccccuccguugguuuucugucucuugcucugaauuaugagucaguacauugauuucccauguuucuaggaaagaguggugccuuuuacuuguggguagcaguugggguucuauugaaccugcuuguuuuuaccugagccgaguccuggaaagcuggcucuagauccagacucugucccuccuucugucccucccguuccagagcugcuccucgguccguuucccccaccugggaguggucuuaggagaaugucugucacugccaccccacuaaagagccuacucgggaccugcugucacccccgccccuacaguugcuugcuuucuccuuuucuagucuccaaacacuuguuucugagcucag

SEQ ID NO: 6407 - RNA, 15632 nt, Mus musculus
agaaacaaccggagaagcagaggcuuuauuaaggucuggcauaagaggcaaagguggaauuaggccuggguaggccuagggcagagagccaucccuacucuuccacccaacccccccccccagcugccgcccacaugcuccugccucccagagcacagcaccaagaacacaggaccccccuguucagggcagaacccaggcagaacuuugucucccaugggggguugggagaggggagacacaggguguucugagaauccccuuggcccuguugccauaauaaacaagggaagucccuguauguccccagaauagaacacuggaucucuguggugggggugaggaacuuggccucugagcaagaccuaggcagaggccaagcugaacugaagguacaggugagccacagcgaacuucggcuacugccuuuagauuuggccugccuccacugucuuucccgcagacucugguuagcagcugagucuggccaggaguaucagaugggauaguggagcucugaccccagagacuucuacaggcaucagaaagagggccuucaccaauaccaaaucaguugauauauacacugagcaaccccaccaugucaaggggaagccacuggugccuaguaagaauauccaccucuguggccgaagggcggagcggggccagugaguucugggagguaggcaggacucucauccaagugggacaaagggacuguguccuccucacugacuggccggucaaacucagccuucagagcuggacguugauuaucugggaaggccagagagaacagggccuccggcucgcacacaaacuuguacacguagcguucgccagccaccuguggagagaggguugucaggccagacacgaacgcucugccucaguagagaauuuggagacuuuccccuucucaugggccacaaauaugcacuaggaccucuuugccucuuacacugguucuucuugaaacccacucccuucugguucuuguucacgucucaucucaaucauagcacacuugggacuauucauucauugucuagcaacuuuacaggggaaccuagggguuuacauuuucuguucucgaaaaccugcugagaaugcccgccuccccccccccccacacacacaccccaccugaccuucucuugacacacuuugaacccuuagccaccccuggccccuccuuguggccgugcuaggaccucagcccaaccuucugcaugaugccuuucucauaauaguaucgcagcgagcggcucagcuugucauaauucauggcuggccgguucuucuggauaccccagagccuggcaaccugggggacaagagacaaaaggauuuggguggagaugcaaucucagaggaaaaauagcaggggugggguggggagugggacauuugagguucuuggugcggggacaaucuaggcuagucaccagcacaaugcugacucuggcuuggcaagaacugggucaggcagacugaggacagugguggaagcaagugccaccauuucuccucucagggcuccaaaggugccggacaggaggggugggaauacguaagaccuaccucuucagguucaauuaguuuaaacuccauuccccggccuguccaagcaaugaaaugagcauuuguugggucauccagcagggccaccagaaacugccacaguuguaaggcaccccggcgcugguaggguggccccucccggaaagcuccaaucccuuccugcuugaugucuccugggaaaguggaaauaggugugauguacauaugcccuaaccaacucccccacccacccauguggcuuccccaaacucuuccccgaguguccugacuucuuccacuaaugaaaugggauuccuacaggacccaguaugugacaggagugaagaagacccugacccuccuaccaagucacuucucugaccuucaaauuuuucagggacaaugcagacaucaucugggaauggucgaagggauuuuucauagccauaaccuuguggaggaaagauggggauugcucagaucugaggguucacuguugaaaacccuagagaaugcagagagacucguagccugggugacucuuucccccauagcuaggauccugcugccuuacccaucacuccaucaccuggagaggguccagagaagcccucuggguggagguacauugaugcacauccagggacaucugggggagggaagaaaaggugacauuguaaguggcugaggugaagcaggggaggaaggccuguacacauucaaggaguuggugcugcuagccugcaauccagugaccauccuuuucccgccacuaaaucccaggggaaguucacccagagggagcugcaagcugaggcccucaguuugagggcaggggcagaggguauggguggcagcagcuggggccaggcaggcuguucucaaggcccaagauuccagggagcagcuguuuuccugugaguucaggggaaggagggggugagagaugaaucuccggggguugggaaggguuugccuaagacuuccucggaaugggcacauguccggucgucaggucagguuccaagccuaguaccuccaugccuuugugugugugugugagacagagagagagagagagaaagagagagaagaguugggguggaggugggggauguaucuauuuaaagaagaggcagugggcucuggucuguuuuuuuccucagguauaagcagguucuacuguguuccacgccauagaacugaaaccucccagcuccacuuaggaaagccacgcuucacguuccaacccuuucccgcccccuccacucccaccuaugaaugagccgcugacacccgacaccucucgggggaggaggcaggagggaggguucauucauuccuccauuuugugaauggaauucuugacuccauucaggaaagcggagggaggaggggcaagaguucaagggcaaguaacccgauccccuccggauccccuccggucuccagccuuugaaggucagcagcccugcgcaccucccuccuccagcccccaccaggcucgaaagggaagcacucguccuguucguccgcuuuccccggagugacuagggauuuguagauaagcccccuaugcuaaaauacugugggcaucgggaaaagaaaaaaucuaaaauuccagccaaccucugcagcuacuguucuguugucuaucuuucuaucuauuuaucuaucuaucuaucuaucuaucuaucuaucgacaaggucucacucuguaguucaggcuggccugaaaacucauuaugucgccuaguuuaaauuccuagccauccaccugccccuagccuccugaauacugcagcuuuuuuuuuuuuacacuagacaccaccacuccuugaugcugaugaccacuguaccuccacuucccacauugcauggguaccgcucccucauauuuugaaaucacuguggagacaaggacuagugaccgucucauguuuuuuuuuuuuacccuccaagagcauauacccuuguuccagucacuguacucuggucuuaggggguuaauuaaaacccucaaacuuaugaccgaaguaaauacccaaccuuuauuauugucaggagcuauuagggcaaggucuauaauacccugucaucuuauuugaaugcuggcuggaaaacgaucauucuuuagaauaauuuaaaaaaaaaaaaaaaguauggaccauggaaagacacaaaccuucuaggaaucuuugcuuaacuucccugcucacuggaguacuggccaccccaccuggcaaucccagaaaaacccuuccgagcccaacacccccagcccagcccaagagucucuuaccugagucguaggcgaagucugugcgcuccuguuugaucaccacccccgccccuggguaccugugcccacugaccccacccuggcuugaagcgggcuggccagccuguucguacagggggucaugguacuccugcuugaaguucugcuggggguagggugggcagggcuccgacaguugguguugauagggggcugggagagguucccggcccccucccugaggagaugugaaggaguggcacauguccacgggcugcuggaagacggagcuggaggucauggaugaggaaggaagaaaagagaaucuuccauuagcccccuugagccugucaccuguugacagggcucuggagggacaaugagacaccaucuccugguucucccagccaggucucuauagagaacuaaggaacugagcccagacugccuggcgaggcccgggucccccggugcuucagaucugucuccuuaccugugcucaccaagguacccguggccagggugggacugggaagagcuggaggcucucaggaggcucugcugcuguucugcccuggaaaagggcugcaggggcgacuguccaggggcaccgggggcgggggacuugauggcgauuugucugggggagucauaggcacuggaguugagggggagauggggaugaggggggcagagaagcuaggugaccaucuuuguaccuuucauaccccaggaagugauuauugccacugcaguggaggggccggggaauuguuuguuugguuuuuguuuuuuauuuauuuuuuuuuguuuuuguuuuugguuuuucgagacaggguuucucuguauagcccuggcuguccuggaacucacucuguagaccaggcuggccucgaacucagagauccaccugccucugccucccgagugcuggaauuuguuuuuguuuuuuuuauauaggguuucucugcaagcccugguuguccuggaacuuuaucugcaauccaggcuggccuugaacucagagauccaccugccucugcuuccugagggcuaggaauuuuuuucuuuuuaaauggugucucauggagccuaggguggccucagacccuccacguguggccaacaauaaucucaaaacuccuguuuuucacuucacagcugcugagauuacaugcaaguaaccacccugacggguuugugugguuuugacaaucaucuccagggcuuugucuguuaggcaagcacucuaucaauuuaacuacauuuccagggcccaggugaauucuuuuauuuucuccccaaaagagucuugcucuggaacucagcuucaccuggaacucuuucgggagcuacgguugaccucaaacucacagugccucuuucucaaggucacaccacccaccauaccuaagugauggguauccucucuuaaugcuggaacuggaccucucugcuugacaaucucucuccgaagcccaaagcaacugguuuaaguagggcgugggccuccagguagagacucacugggcucuugaggccauucugcccacugugugaugucuccugcuuauacucagaggaauccuugcuagugcuaccuacaggagcuaggaaaccccguuauccaacccucaccucuacaggugccucagcucaugggugcccucuccuaccccacaucucaacagagccuucgacuccugacacccuccugggcuggggcucaccuggaguaaaggcacugcucuccauggugguaggggagugguggcuuccugcugcaggacagggcggggucugugcggggacucugggguuccuucuugauccuggugguggggcuauggaaagcuacugugggguaggacagagcaaagccagaguguuacauagaagucaacagagcuccugacaccucugcuuucugaagaccgggguuacugguacagucuccucccagcucccauucuuaaacacugaaguuggaugcuuuuggaacauuuugguuacauuaugucuaguuuuauaccuuagguauuaaccuugguguuaaccaaggggaccaucuaaaagacacacacucuuagcugaggaaacacuuuccuaagagugaacaucucagaugcagggccuuuuggcuauccugaguguccuggaaaauuccaagugagggacauguuuucuuauuuggggcuaugaagguucuuugaucucgugaggagggaguuuggcuguuagcacacuugcaugucagccgaguaauaugcagaugcuccuaguuaucugugaggagcauugcccuuuucugagcccuuacugaggucucugaguccagcuacccacuguggcugagccuuggugugagugacauccuggcuuccuucaguucggucaaaugcccuggaauccacaguucuggugaccacuguuuuccauucuuguguucuuuucauuucaugggugacagcauccgagagccaucacuuaggcaguaccuaacagccgaacaccccuccucagacuuuucucuuuugguuuuuccaagucaagggaucucuguguagccuugguuucugggaacucacucuguagaccagguuggccuccaacucagagaucugccugccucugccuccugagugcugggaucauccugacuuuuuuuucuuuucuuuucuuuucuuuucuuuucuuuucuuuuuuuccuuccuuccuuuccuuucuuucuuuuuuguuuguuuuuccagacaggguuucucuguguagcccugacuguccuggaacucacucuguagaccaggcuguccucaaacucaacuccgccugccucugccucccaggugcuaggauuaaaggcgugcgccaccacugccugguuaugacauuuucuucuuuucucucucucucucucucucucucucucucucucucucucccucucccucucccucucccucucccucucucccucuuccuuucgaggucaggcuuuaccaugucccacauucacucuccagaucacaggugugggcuaccugaccugaccaggcaucauuuugcaacaaugacaccuguaacauuggggucagauuugggagaaugucccgagcauuguaggauauauuugcaguaccauuagguccauuugcaaccaacccuaaacccucuagagccacugacaaaucuuuccugggauagcaucaccagcacugaagaaaauaacagaauacugccgagccaucucaaguccccggcuuuggcugcagagaaaagcaucaguuccaggucgcauggcugagaccccagaggggaacaaaggucuucacccucuugucacuacguuggucucaguguccauauuacaggauggggagcccugaccuucacucugucuuuaggugagagcaaacugcucuccuauggaugacugucccccaugacucacuuccugucauucccucacccccaucccccacccuuguacccagcacucacuacucacaguuuucugaauggaaaucaggaacaaacugcucaucacuguccgguaccugagcugcagagagaggccagagaggugaguccaggacgugacccugcaaaguggcaacuccaggaaggcagcacugucacccugcagguuaguuccagcccugcagaggucuagagccugccuuagaccaagggugacugcaccccagggccugcacuccccagaugcagccccaugaagaccccccagggaggacucugagaacuugucugagaaaauaguuuuugccuggauguuuugucucccguccuuggagugcaaaugaacccacccuucacaguuuacaaggcuuugucaggggugggcaggccuuaagacacuguggcagccuguggaucuggaaucagaugaggagauucugaauuugggaagggacccaggagccugcacuuuaaauaccuucccagguauuuuggagacacacaagagcucuagagcuuucgaaaggcaauggaggagagaggaugugaagaggguuaaaacaggacaggaggcagguacagauacuggcucaucacugcuaaggagaagaagggccuccccagccuggaugucugaggaccaaggguggguaucucugagcuaaaggauacucaaaggacuccauagggguuuuguuguuuuguuguuguuuuuaguauagaauagagucuauuuagggcaugggauggggaguuaagagaguaguagaggcagagaaaggcagugagaaggagagaauagagauuuggaggccagccaugaccauguuggggggacuggcaggagaggaggggcaaguuggaagcaagaguuaagagcgacuccacaguuuuuguuuaccuuugccucucuaucaaggcggaggauugcagcagaaagaagaacagauacagagaaggacuuccugauugucuaagcaggacaauggagcucgugaccuaggagacuagacugucacucccuggagacugggcaauguggaaauggcaagauagaagacucagacuucagaggggcuggugaggcaugggaguugagagauagagaauauucuacaccccaguccuaugugagcaugcaggcucagaccuuggccacaggacccuguguuugccagcucaccucccccaggcccugcaguccacacagccgucaggguggacaauagaaaccaaaucacuuugcugucucgcugaugggcaauuuaaacguuugcccuuggccuccucagcucaccuuccuugccugccucuuaggcaccuuggccuccuuuagcccucaguccugcugagcuggguccuuuuuccccuccacgccccgcgcccccagccucacccuacguucuggaucucacuauguagcccaggcucaccugaaaggcaccaucuuuucugauucugccuggaaugcugguuacagauggccacccugccaggcuuaucagagaccuucuuugaccacccaaagcaaaacugucccuuuugcuuucugucucagcagguacuucccccugaccugugccuaucuuacuaauguauauuugcauguuaauuaauguucaucucuucacugggaacacaggcuuugucuucuucaggugagucucuagcacccagaacaggguccuacucagaccagauacugaaugacuguuucuuaugaauaagcauccaacgagaccuguccucaggcuggcaggagcuagggccacagacuggggagccgaaagcagugagcuccucacccaggcagccuuucccuuuccccguagcuacuccucuccacacaccagcuaccaccagaguuagcacaacaccggaaaagcucaucuuacaaggaaggauacuugggcuguggucaagugcuugcuucgaaugucagaggcacuguguguuuauagauauagcuugauaguugauuuuuaucuauuuauuuaugguggggguugaaucaaaguccuuuugaaccaccugccuuucauuuuuugagacagggucuaacuagguaccccaggcuggccuuagauucaccuuuuccugucucagcuuccuugugaucacaggccuauuugacacugcguccggcuuagaggacuguuuucuagacagagauugaggcaagggaguuuaagauccagaagucucuggcuggugagauggcucaguggguaagagcacccaacugcucuucugaagguccugaguucaaauccuagcaaccacaugguggcucacaaccauccguaaggagaucugacucccucuucuggagugucugaagacagcuacagcguacuuacauauaauaaauaaaaaaaauaaaaauaaaaaaauaaaaaauccagaagucuccaguaguuaagagccuacuuagaucaauguacuacaauucuaaaguggcuacauacaucagugaggcaaaaauagguguaaaucccaugcuuuuuagaagcccaacuauaaucacacagcagcaaucccccagauguccugauuaaagacucgccuggcucuguuagccacacugguugguucuaaguccucaaauugggcaagugcuucuauaggcuggaggugggccaggcauccauauuugcaauaaaugucccuggugaguggcucauguggaaagcaccagucaacaggaaggggaaggacacauuccuuccuucugggugucagggaccauucaaagguaacagacaaucugaagguggcaggagcaagcaggcugacagauaguucccucccuacuacuuaggcaaggagggucccgagggcaaggaaggggugcaaaacuuggcaggggguagcugacgcacucuggagccccucuugggaccucauuaacuacugguuuccagugagguaaugggcugggggcaucuccugcugacgccacugggcuagugagcccugugggucaucugaccuuuccuucugccucaggcuuuaacguuuauccagaacccccagaagagauuuccccuuaucacacagauuguaccuucaaagagaugaugcgacccucuucccaagaaugggggguaggcccuacucucugcucagcucucccaauauuggccuuuucccaaagggauacaacagggcccucagucacccagagacuaucagcaaagauagaaacagaaacagagcuucaagaguuccuggagagcaggagaaauuuuaauuacuauguuuggucuugcgcacacacaccauucauucuauuuguugacucggcuguguuuuggcugcugagccagugugacagagucugcccccagcuccacuggcacuaaaaagggacugucugggcggggacaugcagaggauuaaggcagguguggguguguguauacccaguguaaagcaugugcaagcguacacacacacacacacucacacacacacagaauauauuuagggaccaucccuccaacaggagccaggggggccccaaagauggguuccagaagaaaugguuaaguuuacaagcuaaguacagaaccaaagccuaccacgagcaagcugccauguaucccacagaagggcugucugucauucucugggguuggggacagucccacauaagcgugaaugguagcauccuugggagguucugcuuuauuguguccccaacggcuggggcgcucacacccucacccugcccccacucuggcagcuucuauauuggaaggaaccaguucucuaucuguggagggggcauuccucuccaagaaccuucuaaauggagaggaaauagaaagauggaggaggcauggaacuaggaaagacuagggagaggguugaggauuaacccuucccuugccaacagucccccccccacccccagacuccagggugcacgaacacuuucacucuaaaacaaaauacggguuaaagcacccuccauguuccccucuacgcacaggaucucuuuuuggaccuauaaauagggaggcuaaaggaccaggggagagccacccuuggaggaccauuuagcugcaauaauuuuuguggaagagcccagauccauuccuuaaaauccugauaaaagcuauacauaagccauucucuuccuagaaaaauccauuuuaucuucagauauggcgcaacccccaacaauuuuacaugcagaauagcaauaucaagaaccccaaauuauccauaagccuucugggaauuuacaggcccucccuccccaacuucauacaaaggaugaacauagcuuagucaguuuuccuaacuaccaaagagaccacagagucauuguaccucacaguucaugaaggcucccaacaaucccacaaagcaacccuccaucagauccacaaaccuuuuuuuacauaaccagccacaucuuggcucagucugcccgagccuggguuucucuguggcaucugaucccuuuuccaucaccuuaacagaucccaggcacccagaugacucuccucagcucaucauaucccucuucacccagaaaagcccagaucugauccccaagauguguaugcugcuuccaaagagccacaccaacacucaccccaaaaucucaaucagcagccgauaugccaaagccaaauccaccucucucggucucgguuuggguccagccuggucacuccaaccccaccccccaaucuucacugccccacccacacucuaagaauuugcuguaucuuuccaaauugaggcucuaggaagaaaccaagcugagagaggggagguugggcucugggccccauucuccugauguuccccaccacuggcagguuucuagaggagcucauuccucccugucaccccuuuauacucuaggggagccacugaccuggugggaagaggcaggagaggagauuggggugaugcugggauggugcagggggacaggaccccggcagcugcaucugucuccgcagagagaggagcgaguggccucagcaucccaccccccccucaggccuggccauccaucgccagcugggaaccugagcugcucccucaggaggaaggagagggaaccaaggagaucccagcccccccccuagcauuccccacccccaucuccccacccacuggauuuaaauguacagggacucccaaggcagcaguauguaacacgcguguauacgugugcgcaugccugugcgcacacgcacuugcugucacacugacacacacagacagacaggcagacagacacauggacuaucaccagacccaccaccaaggggagggucuuccauggugggguggagagaacauuuuccuuuccaugucauucaaauagaccaaaugcugccaaaaggccacccugagcccacuccuaucuaacucacaacuggggagcuggccacugugggggcccucagcugaugggcagggaggaaacccagagagccagaccaaaaucaguaacuaguugauaaaaaagaagguuuuugaaagcccauggagacccugaguucuucagcuccagaaccugaagaaggguaagccuacccaacaaagcucuacaugcaacugggagcugggcacucaggcaugcagcagaggaagaggcacacuauacccagaccuccccacccccauuccacauuuuggaggauaaacuccaugcuaaacagucauucucugccaucaucaccaccacaauaauaauaauaaauaauaauaugacaacagcaauaauuuuaugugugugaguguguguuugagacgauggccaagacagaccucaucccauuccacaaaccuacuuagugguccccuuuccuucuuauccaggcuucuccuauagagaauccugugagagguggauuggauuggugaagagguggagagcuuugaaauuccaaaagaaagguacccacaguggaagaauggggaaugaaucccuuaggaaaagaccucaagaaaaaauucacuuuugguuucuggaguauuuagaguauuaacacaaaaggaggugagagcgaagauggggaugcuaaugcuuccugaaucucagagacuguaagucaccaugccuccuuccacuggcagcccugccagcaucacccucaggcuaacuaaccucaccaaaacaccacagcuagaauccaacuaggacaucugcuccacccagcccaggcugggccacugaccccauccuggcuaggacuuacaaccaacccuccagcauacaggaaggggaacauugccuggggguggagguauucaagagggauggagggaggaccaguugccacuggaauuauaaucaaggcuauuuggggaggcagcccugaaucuucucugccaaagugccaagaaaagaaguauugaaacuuuuguuguuauuuuggcuuggucaguaaauuggcccucggaguuaggaagaagugaaaugaagagaguaaaaaaccaagcaagguuccagcaacuccagaagauagguaauaaauuacuccuuauuccucccguuucucauugcucucuuucaauaccucaacaccccaacacuacaccuaggccaggagccuccugccagacaaacucugcaaaugaaauuuucaacuaggaaaaaaaaaaaaaaaaaaaaacgggccuugggccaaaauccauucaaauaagcaaauaccccacacaauagucugauucauccccaggccuaguuauacaagccuggcuccgggcgagaaaauaaauaucgauauguguccacacugggcaccggggagagugacaugguuagggacuggagagaugggguugaaggacuccuugagacagacaagaaccccccgccccccaugucccacuucuaauuuuaggaaggaaacaaaacuacucaccuucugcgagccacgucucuuggaagugacugagguccuggaagagaucugaugggugaauauuggauuggugaagagguggcgauaauauggggaagagaccuggcgagcccggguuacagccuccccacuggugauaagggacggagaagaaugagugguuugacuuuuggggaaacguggguuggggaaguccaggauaaggcuuugggauggauguacguggauuaagcagaggggucgcaguuugucuguuucuuuaccuucugagucggaaggcggcagggagcccggguccaugagcuuucccugcgggaccaucagcgcuucgcccaagcucccauuuccgggagauuucugcuggaaggaggggggaagaaugcccccgaaucacccugaggagucuagcuugggguuggggguggggucccgggguggcucaggggccaggcgguccuggacccacugagaccccccgggagggggcugcggggcgaguaggggcggggugcggggcgggggcgggcguggaggccggcgcggcgcucacgcugcagaagguguagggcacucgcugguccaaguauccgccuuucauccuccgcuccauccggccgcucccuccggccacagggccgggcccccgcgcggaggcagagaccugggaggggggaggcaguucgcacacggucccgggagcgcugcgggggggagggggcgaucgcgaggcuuuggaucggacagcgaaacuucuccgacucgcugggaccugcgcggccgagcgccuccaccgccacuccucucccgccaaaggaggucccaccugcucccuugagcugggguuggugugucugcuuucugcagcccugcucagcccgaacuggguuacauaagacgugugugugcgugugugugugcgcgcgugugugaguguguguguguguaugugggcgcgcgcgcgcggcgcacaccauucgcacgcccauaacucaggcgcccccuccagccucgaaucccgacgccucccacccccgccccggaaugugcggaagcgggcgccgaacagagagaguguggugugugggagaugaagcggggaaaucacagacacucucccuuccuuccccuuccgcagcuucaccugagguccgggcgucugugccggagccgcggggggaugcucagcaugcccgggggaugacacaacuaagguggcggggcuaggccggagcgaggcggccugagccccggguccccagagccccggcuuguuuuccgggcgcagcagacaguugugagcccgggggagcagcugauuggugcauuuccuuugccuuggccuccguucucgcucuucccccgccccuccccaccgguucccuuuguuucauugacuuuugugaaug

SEQ ID NO: 6408 - RNA, 1564 nt, Mus musculus
guuuuuuuuuuuuuuuuuaaguucagggucauuccucaauauauaccaacuucaaggccagccagggcuauuugagacccuaucucaaaaacaaaaugaugauaagaaacagccugcuacccucucuaccggcuuagaaucguuaaccuugaaggaugagacguagacccugguggucuggaaaugagaguuuccaugagaaaagggagaguccccucucccacugaagguggcacaggcuaauugcucucugaaguuuugaaugcuccaauauaacguggaaguucacauagccacuguugagggcacaggggaaaugacacaagaugacacaccuggaaaggcucaggaagacagugagguuuaaagcucacauaggaacaucuuauuuuggaaugucagauggaagucaugaacaccugaucuccacccagcuagguauuguguuuucuuagcauucagccuguguaucccccaagaggugaccaagagauuagcucugccccaaacuguaaaucaacaaccauugcuauaaacugcuugaugaaucuaggcucggguggccagugggacaaauaggaaaucaauuggcagcuccagccagcuccuugagcuauaggagaagcccuguaauaggagaagcuggaaauaacagaagaaagaguuucuguugggggaaaaaugaagcaaagcaaagcaaaacaaagcaaaaacaaacaaacaaacaaacaaacaaacaaacaaacaaaaaccuugacaguaaaagcuggggcagucgaguggacaagguacuugaggagccugggcuccauagcuaggacuaaguaaaaaaacuggcugugguggugcagccugcaagcccagcacucugaagauggagcggcaggaggaucagaaauucaaggucauccucaauugcauuguggguuuaaauuaagccgagccugggauacaucagacuauggcucaaauauuucuaauuaauuuuuaagaagggcacgggcgcgcgugcgcacgcacacacacacacacacacacuccccacuauucccuccaaaaacaguuuccaggaauagucucuagguuuuggcagcccagggguucccuagccccgccuuagcugacugagcauauaguuguccauuauuucugacaagaacaaauauagacacucucagggagcugggggggggggcuaaguggagaaaacgaugcuuaaucugcagagagaaacugccuucccucagcagagccccgcccagcaggagccgcggccucucauaauucaaguccacacuuaauuaaaaaggggagaauccugcacuccggccaacuggcuccaguuccauucucauccuucagacugcuagcauguguccguuugucucucucuccagccaaagggaaaggaaugaaagcaaacaaacccagcaaaauccccagcuccugcaguuuucugggagggcacaucugugaauggugguucuccuagagacagagagguggagaucuacaugcacagggagagacaggacagagccaaaaaaaaaaaaaaaaaaaaaag

SEQ ID NO: 6409 - RNA, 4971 nt, Mus musculus
uaauuuuuauucuuaucugguuuuuuauuuuuuguuuuguuugaggcagagucccaaguagccccgguuaaacauguagccaaggcuauccuugaacuucuuaaugcuuuugucucuauucccaaaguccuugaacguuaucuugauugcugggaucugggugccucauccaaguccccaugagacagcccaggaaggugggcuagccuggaccacuguacuucauuguccgguagauggagggacaaggucacagcaacucugaggacguuguuacauucuugcagccucuaguucuccagcugaaaaaugcggauguaacaaugucacuuacacaccuagggcauuccggaagguuaaguacaauaagcuggacauuucucauugcaucaaaugcauaauaaaacuuugguagcagauauuuacauuacaauucauaacaguagcaaaguuacaguuaugaaguagcaaugaaaauaauuugguggcuagggguucaccacaacgugaggaaccauguuaaaggauugaagcauuaggaaagccaagaaccacugcuuuagaacauaggguggggggaguuguggaaagggugggauggagcucagagggcagagagccuaacugaaaucuucagaguuugguucucaaaacuucauaaauaagaugguguacuaaaugccuggaaucccaacaccuaggaaguggaagcaggagaaucagaaauucaagauuuuuuuuuuuuuuugcuugauaauauuccaggccaaacuggaauacaugagacccugccaauaaauaaauaaauaaauaaauaaauaaauaaauaaauaaauuuaaaaagcuaauauuccuguauugguggggacaguagacuugaauauuccagauauagugucucagaaguucuugggugggacaugugaacuucuuacaaucucuugguccuaaaccccaguugugaucaauuagcgcuucaaucggagcuguagagaugggagguaggggaagaggcuggccugggaggcuccagccauggacucugcaccccucgccauugccaguccccccaguccccagcuuuccaccuugcucuccuuggaagcugaagcugauucucugcaguaaaggaucauaaaagccgcgcgccccucccccacccugagaggucucgggagacccgcggugcaaucuuauuuugccuacccccagcccuggccagggguguugaagaccccuacuggcagggacagcugcgaacccacugcuguuuuccccuaagcugucaggcuacuacuguaaucaucuuuaauuuaugggaaugggggauuugucggugacugccuggcgggggguucaaggggagguugcgugugaccagcuuggcuaccgggaagcugucucgcugccugggaguagcacugggugcccugcgucccggcgcccccauccucaaaggaccaagcagagccuuugucagccccugcaucuuucagccuccuucaacgucuggcccugugucucuccuggcucgaauucuccccacugaggucugaucgccauugcccugcacaacuacccaaaccuucauuauuccuaucuccccccuccccucucucuccucuacccuccuccuuaucuguccccuuccuacagagccacaccuaguacuggcauccccacacauugugccuucuuuccucccugacuuugccauguugcccugguucccuugcccauaaucuacauauuuuaauauccaggucaaaaaccaaguuccugaucauauuuucucccuguuuaaaaccuauagcuauaauuguacacagcaucauuucaugacagcuacugucaggaagcuucgacuuugcacaccucaaaucccagcagagaggaggguggcaaagcugagaccagccugagcuagggaaagcugugucaaaacaaacaggguagcuucagacuguaguaugguuuuaggaccugagcugauuuucuggcuguagcuugcaaugucauagaggcuugacuaagaugucuuaacgugguugaucuuuugagaaaucuuucuucuucuugugguccaaaacacagagcauaaaaucuggcaccuuuacaguucugaaacgaccuuuuauagcagccaaccacagacugacugucgagaacagauuuccagaacuguuucaucuugcaaaaacagagcuucucuuuggaaccgguccccaaaccccuggcagcugccugccucuccguaagaguuuggguguuauagguaucucucucauacacagacucagagcuguugucuuguuacuggcuuauuccacucugaggccaggacuggugucagguccauacuucccgaaccagucaguccucaaagucucgaugauauuguagcgcacgauggggauuucuuccuuuuaaggcugaaauguauuccguugugugcuugcacugcauuuccuuaucuguccaucuguugauggacacuaggcugcugcuucccucuccaggcaggugugaauaccuccuucaggaaaugggugaacacacaucucuuugagcuuguucccacuuuuuaaauuucagauguuuaccuacagcuguaacuacuaacuauucuauauuuaguuaaaagauguguguguguguguguguguguguguguguguguaccuguaucuauauguaaaacagccagaagagggugucaguucccucagaccuagaguuccagguguuugcaugaugcuuggcuuauuauccugaggcuggaauccacacuucagucccccugauugcacagcaaguacucuuaacagcugagccaucucuccggucccuagguuuaauuuucugaggacccuccauacuguuuguuuuagcaggaguuccauucugcaguuccccucauaguguaucaugaggguuccgguuccuucacaucuuagccaguccguuuuauuuucugguuuuguuuguuuggaaaccucccucccuguguguggguuggggcuggggcacaggggugucacagaagcaaagcuggaggauaacucgcuggaguuagcucacuccuugaccauguggguccagggggugaaagugucuuuacccacugugcgucucucuccccuguuuguuuuugcuuuuguugucuauauucuggggguuauaccaaagaagacauggccaaauccaaaggcguagagaguugcccugugggacaauuauauuucuaggaguugcauuuaggucuuaaccuauauaguucauuucuauuuggugugaggaaaggauucgguaucauagguaaggacucagcaccguguguguguguguguguguguguguguguguguagccuccccagcacuauuuguugcagaguuguccauuucccauuguguagccuuggccaccuauugacgauuaacaucuggccucccugacccacuugucugucuuuauuucaguugguuaccauagcuuuacaauguuuugaaauuggaaggcccaaggcucccaguuuuguuuccuucugaagauuagcuuggcuauuuggaguccuuugauguuccauuuucauaaggauuuaagauucguuacgauccguuuaaggucugaaauguuggguuuugaugggggcuacuauguugaauuugcuacagugcucugcauaguguggaugcuucuaacacuauugagcacacgguaucuucuuccaucucaaacccagaaccuccagcaagaaagaagccuuggggcccuaaguggccagugugggaggaagaagcagcucucuauguugccagggucccucugggugucccuugccucuuaguuacgguugcugccacuguuccuccucagauacgcagacugggguccagagaggcccucuggccucaacccugucucaacucagaggcuugagugcaaaucuugcaccugcucagacgccuggccgucauacccacaaagcucuagaaugaguggguuucugcugaguguucagacaagaaggccuaaagagccuggagaaauuccagcaggccagccaaggggcuaccuuggggcugccugcugucuuggcaggguagggcucaggaguugucauucuggcuugaauaaaucagggacaccugggugcagacaggcaugcccaauuuagaagcagaucuuaguccuugcaagcccagagguagguagccccuuacccuagguuucuucuuugcccacacacuggcccuucuuauccaucucugugccucuggccuggacacauccaguccuugacuguuucacaguauuuuccuguccucuuuguucucaguguagaggaacuguguaggcaguggcccuugguccugaagcccccacacuuccuuuggugacagugaaugaugacgucugaaauguaaaaacacaaagcccagcgcagccugugccuucccaguuaucucagaggcugcuguucccugagcuggggauguagcucagcgguaaaaaugcucaccugggucugcucucuagaaacacacacgugggugggguggacauauacacgcaugcgcgcgcgcgcacgcacugaugcuccaccucuguugcuagcacacuccucccuucagcagcucacuguaccucuuugggcucuucuagaauccccacagccucuccugaccugguccuccucucuccaacacgacugcccacacucacuacuccaccccagcagggacucuuggugaagacuacccuggcaccagccauucccauuccagaaggaccagcuacccugucccugcuguaaauucccguucccccacuacugggcuuccugucucuucacgcaccugcagaaccaugauggggucuggacauugggaugguguagcaccuggugaaagaguuaagcugagcccaggaagccaggaaggucucggaugugaacaccagcuagcu

SEQ ID NO: 6410 - RNA, 1837 nt, Mus musculus
uuuuuuuuuuuuuuuuuuuuuuuuuuggcccagaaugaagugaccauagccaaguuguguaccucagucuuuaguuuccaagcggcucucuugcucaauacaaugugcauuucaaaauaacacuguagaguugacagaacugguucauguguuaugagagaggaaaagagaggaaagaacaaaacaaaacaaaacaccacaaaccaaaaacaucugggcuagccaggcaugauugcaaugucuacaggcccaguucaugagaggcagagacaggaagaccgccgaaaggucaaggauagcauggucuacguaucgagacuccagccagggcuacggucccaagauccuagguuuuggauuuugggcuuugguuuuugagacaggguuucucuguguagcccuggcuguccuggaacucgcucuguagaccaggcuggccucaaacuuagagaucugccugacucugccuuugagggcugggacgaaugccaccacugcccaacuaagauuccauuaaaaaaaaaaaaaguucaagauaauuaagaguugccagcucguuaaagcuaaguagaagcagucucaggccugcugcuugaggcuguucuuggcuuggaccugaaaucugcccccaacaguguccaagugcacaugacuuugagccaucuccagagaaggaagugaaaauuguggcuccccagucgauugggacacagucucucuuugucuagguaacacauggugacacauagcauugaacucuccacucugaggguggguuucccucccccugccucuucuggguuggucaccccauaggacagccacaggacagucacuagcaccuacuggaaaccucuuugugggaacaugaagaaagagccuuugggagauuccuggcuuuccauuagggcugaaaguacaacgguucuugguuggcuuugccucguguuuauaaaacuagcuacuauucuucagguaaaauaccgauguuguggaaaagccaaccccguggcugcccgugaguagggggugggguugggaauccuggauaguguucuauccauggaaagugguggaauaggaauuaaggguguuccccccccccccaaccucuuccucagacccagccacuuucuaugacuuauaaacauccagguaaaaauuacaaacauaaaaaugguuucucuucucaaucuucuaaagucugccugccuuuuccagggguaggucuguuucuuugcuguucuauugucuugagagcacagacuaacacuuaccaaaugagggaacucuuggcccauacuaaggcucuucugggcuccagcacucuuaaguuauuuuaagaauucucacuuggccuuuagcacacccgccacccccaaguggguguggauaaugccauggccagcagggggcacuguugaggcgggugccuuuccaccuuaaguugcuuauaguauuuaagaugcuaaauguuuuaaucaagagaagcacugaucuuauaauacgaggauaagagauuuucucacaggaaauugucuuuuucauaauucuuuuacaggcuuuguccugaucguagcauagagagaauagcuggauauuuaacuuguauuccauuuuccucugccagcguuagguuaacuccguaaaaagugauucaguggaccgaagaggcucagagggcaggggaugguggggugaggcagagcacugucaccugccaggcaugggagguccugccauccgggaggaaaaggaaaguuuagccucuagucuaccaccaguguuaacgcacucuaaaguuguaaccaaaauaaaugucuuacauuacaaagac

SEQ ID NO: 6411 - RNA, 1864 nt, Mus musculus
aacccuggucacauagggcuggucauccuuuuuuuuuuuuuuuuuuuuuuuuuuuggcccagaaugaagugaccauagccaaguuguguaccucagucuuuaguuuccaagcggcucucuugcucaauacaaugugcauuucaaaauaacacuguagaguugacagaacugguucauguguuaugagagaggaaaagagaggaaagaacaaaacaaaacaaaacaccacaaaccaaaaacaucugggcuagccaggcaugauugcaaugucuacaggcccaguucaugagaggcagagacaggaagaccgccgaaaggucaaggauagcauggucuacguaucgagacuccagccagggcuacggucccaagauccuagguuuuggauuuugggcuuugguuuuugagacaggguuucucuguguagcccuggcuguccuggaacucgcucuguagaccaggcuggccucaaacuuagagaucugccugacucugccuuugagggcugggacgaaugccaccacugcccaacuaagauuccauuaaaaaaaaaaaaaguucaagauaauuaagaguugccagcucguuaaagcuaaguagaagcagucucaggccugcugcuugaggcuguucuuggcuuggaccugaaaucugcccccaacaguguccaagugcacaugacuuugagccaucuccagagaaggaagugaaaauuguggcuccccagucgauugggacacagucucucuuugucuagguaacacauggugacacauagcauugaacucuccacucugaggguggguuucccucccccugccucuucuggguuggucaccccauaggacagccacaggacagucacuagcaccuacuggaaaccucuuugugggaacaugaagaaagagccuuugggagauuccuggcuuuccauuagggcugaaaguacaacgguucuugguuggcuuugccucguguuuauaaaacuagcuacuauucuucagguaaaauaccgauguuguggaaaagccaaccccguggcugcccgugaguagggggugggguugggaauccuggauaguguucuauccauggaaagugguggaauaggaauuaaggguguuccccccccccccaaccucuuccucagacccagccacuuucuaugacuuauaaacauccagguaaaaauuacaaacauaaaaaugguuucucuucucaaucuucuaaagucugccugccuuuuccagggguaggucuguuucuuugcuguucuauugucuugagagcacagacuaacacuuaccaaaugagggaacucuuggcccauacuaaggcucuucugggcuccagcacucuuaaguuauuuuaagaauucucacuuggccuuuagcacacccgccacccccaaguggguguggauaaugccauggccagcagggggcacuguugaggcgggugccuuuccaccuuaaguugcuuauaguauuuaagaugcuaaauguuuuaaucaagagaagcacugaucuuauaauacgaggauaagagauuuucucacaggaaauugucuuuuucauaauucuuuuacaggcuuuguccugaucguagcauagagagaauagcuggauauuuaacuuguauuccauuuuccucugccagcguuagguuaacuccguaaaaagugauucaguggaccgaagaggcucagagggcaggggaugguggggugaggcagagcacugucaccugccaggcaugggagguccugccauccgggaggaaaaggaaaguuuagccucuagucuaccaccaguguuaacgcacucuaaaguuguaaccaaaauaaaugucuuacauuacaaag

SEQ ID NO: 6412 - RNA, 1159 nt, Mus musculus
auuuugugcgaaauuugcuuuuuauuuagggacagggaaaugaacacacacagcccuccagucuggguguccgagacaccgagauaugaagugcccucuucuuaaaccaaacaugcaagugaagucgguguaguuaacacaucucgcaggaggccuugggggagucuucaccacugguccaaaccuucuggccugcaggaggaaaaggaaaugaauugaauaggaaggcaggguuguaagugaugggggcaggccacacuccagggcaugaguggggagggguguuuucuaccgagaccugaaggggagguucucgcugucgcugucgucugugaagagcaguuuggagaacagagcugcggggacaucucuuuuuccauaccugggggcgggaccacaaagggggcguggucaggccuccagguggaucuggggagaggaagcaaccccgguggcugggguccacccgccugcccucuccagcgcucaccgcugccgggugaccagguugagguaguggcgcagggaggcguaguagcggcucagcuccuccggggaggcgucuucgccgggagccucugguuuggcaggguaggcguccaccagggcucccagacaggcgagcaggauuagcagcauugcgaccgugacgggccaaggccugcgcaccgccaccaucuaggaggaaagcuuuggugggugggucauucugaaccuggauccuccaaggcgggaggcgucgggcccacgucucaauaaucuguuugucccaaccacaggauucaccuagucuucuaccgccuugcaccaucucuagccucaguuuccccaucugucagacagcuguaaguccugcuugccuccccacucccgcuaauacgcaaagagguagaugagggaagaaagcugcgaugacacccgagugccccaccggcuucuccaucucaccucagcuaaacccugcccacccagcucgcaaccacucagucccaguuuccagagacccgaccucaguuuccccacaaaauaucaugauaccagacuauuccugaucccagucacucacagcagcuacagcuuccgaagcaagaugagcaggaggagauggaaggugggagaagcucgaaggcucgacagcuacugaacuccguggccucug

SEQ ID NO: 6413 - RNA, 632 nt, Mus musculus
gggguuuucuacuuccgggucaaagccauggcgguggcaaauucaaguccagucaauccaguggucuucuucgaugucagcauuggcggccaggaaguuggucgcaugaaaaucgagcucuuugcagacguggugccuaagacggcagagaacuuuaggcaauucugcaccggagaguucagaaaagauggcguuccgauaggauacaaaggaagcaccuuccacagggucauaaaggauuucaugauucaggguggagauuuuguuaauggcgauggcacuggagucgccaguauuuaccgggguccauuugcggaugaaaauuuuaaacuuagacacucugcuccaggccugcuuuccauggcaaacaguggucccaguacaaauggcugccaguucuuuaucacguguucuaagugugauuggcuggauggaaagcauguaguguuuggaaaaaucauugacggacuucuagugaugaggaagaucgaguuccaggcuccuuugggaaagagaguucaagcuuggacccauucauuaaccugcccagcacuuacugggauuuuggcucugauccugaugcccacugaauaaaauuccacuucuuggcaaaaaaaaaaaaaaaaaaaaaa

SEQ ID NO: 6414 - RNA, 1421 nt, Mus musculus
uauuuauuuauguauuuauuuauuuauuuauuauauguaaguacacuguagcugucuucagacacuccagaagagggcaucagaucuuguuacagaugguugugagccaccaugugguugcugggauuugaacucuggaccuucagaagaggaaucgggugcucuuaccaacugagccaucucaccagccccccaauguacauuuuaaaaagaaauuaagauacagaagcucuuuagagauggcucaguuagcaaaaugcuuguugcaguauuaagggaaucugaguuuggaacacgguggaggugcaugccuaaaaucccagcauggggguaggggugaagacacuaagauccuaggaugggggggguggggggauggggggaauggcacugagacugugucucagaaacaaucaaaauaauaggaaaggauaaggaguggggagagaaggagagccgccacucuuagggcugaggaguccgccaugggaggcuuuugcuuuguuggaaggucaagucgcuguucauauauauuguauucauguagaggcuggccuuccguaaguaggaagcagcugggacccaguggccccagguccaugagcuugguguuaaucauucacucggguauaccugggucccauuggcugccuggggacacagcccucuaggugggagcccagccaguaucugucagggauaaugggguuacauugaugacacuuccugaacugaacggguagguggacacucaggaauccccuaguccgaggaagggggcagcagcccugucuccagggaccuccagucugggacaaagaugaagggcacuagaucaggaagaggaagagauguuuggaagggagagcucucagaugcagaacagccaggagggaagggcagcuuauugaaggcuggagacccugaagucagggaggaguuuuagggugaaaguuauagcucaagggauaggcccagcuccuccggggaccuugagaaguguaugugacaggggcgcaguggcuggguguacagaggaaagagaaaaacggcucuaggggguccacaucaugaaugugugcaugcaugcugcaugccugugugugugugugugugugugugugugugugugugugugugugugugugugaacacaggugccagugccacacacagaccugaccagccuuacagcacugccugucuaguuuucuaaguuggagaauggaaauaccaaugaggaaagacccaaaggucagacucuccucccacuccagacucccgggccaguauguguggguguguugaagggacaguuuccaggaaagggucaacacacucacccagcagccucuggauuuuuuuuuccuucauggcuacgacccagaaucucucacauauaccacaggacugcaccccca

SEQ ID NO: 6415 - RNA, 4563 nt, Mus musculus
uaaaauuuuuauguaugugaguacacugucacuguuuucagacacaucagaucccguuacagaugguugugagccaccaugugguggcugggaauugagcucagguccuguggaagagcugcuaagccauuucuccagccccuucucuguguaaacagguaaauaugccauugcuguuagcugggauuuucauccuuaugggcaguguguguguguguguguguguguguguguguguguguguguguacagugacaggcaaccauauacuuuguagaggaggacuccugaccuaggaguagaagagccccucuagggguugcugauccccacgugaggaggcaguaggagugcuuacccucagguccuuccauccaggaauccucuggucccugguccuuaagcacuuguucccagaggauuacuaucuuuaaaaggagucuuaaaacaucaacuggggguuuagcucagcaguagagcacuugccuagaaaggcccaggcccuaggugcuauaucugguauugaaaaaagaucaccccaugcccugaaguccuugcuguaauuaaacuuuucuuagaugguuuuugagacaagugugacucagacaagcauuugcgguuuaaucaaggccuccugaagaauuuugagacccaaaugaguggcagaccaggcaggcuuagaugcuauguaagacaauggagccucaagacagcccagaggccauggaaacuggccugcccuuaagguuaccuuagguagagcucugaaggcaaucccagccccguuucccaggcuggacauugaaggccgucugguuugacuuuggagccgaguccuuagcuggcuucacuuccguguuuguucugcuccggggccccugagcagacgaugcugcuaugcugcugcagcuucuuccccucagcugccuggggucacccccagcaggcauggcuuuugguccauccuggcugucccaggguuuacagggcccgcgauggugggucagcugccugggucagaagcugguuugcagaaagaguccggcagccccuuggcaugauugacuaguucguaggagucucggaugucggccaggccgaaccagaagaagauccacugcuuguuggagaagcuaccgucacugugcuugaaguaccugggcguggaggcaaaggggucagcuuuggaaugaggcuggugcucacugcucacucuggguuuucaggauaguugccuacuccaggaugccccaccaggaccagaugccuguucuuuuaucuuagcaggaacagaaagaguggcucaugaagccuauauugccauuucccccaaacagcagcccagguucaggcaaguuagguaauuugccaggaucucacagcuaggaaggugagauuagggacauuccugccuaucccccaccccccacucccugccuaguguagcaaaggagcugugguccuuugucacccucuagugaguggacgcugagggugugguugcugaauggaagggguggguguuccuuagagacacagaccaggaguuaggagcuuggcaacaaagccugagaagagcugggucaaagcuuaucagaauccuaauagcgugccacuggcuuugcagaaaugugggguugaagaaugucacuaggugaccuugacucuagaggagccucggccuugaucucacagagauccaccugucucugccuccugagcgcuuuucucugacagugaaaggagggaaugcccagcuacgcugcuggugaaccccggggcauggcugguugggcuuaccagggauugaugggauuggugacccuugagcgccagaacaacguuugcaggucucuccgaaggcauucccacagcaucuguccagaaccuuggcccuggcggcuggagcucaccacaaauuuguccagauauggggugcccccuaguacagguuccacugucagaauggcugccgcguuguaccuggcacagcgggagagcggcagguuaggaccucuccuguccuccuaaagcugccuccccacccuggcucaggaccuuggguccugcccucuggggccccggaggcucaccccucagagacauagaucgagugcaaccgagggcgcagugacuccagauagucuucucggagcuucuugccgaagcuggcguugacuagguucacuaggcggcccugguccaggcuguccagguugcgcacucgcagcauccgcucagcauuuuuaaacagggugccacagccugggagauuggaaagagcgcguagguugggccagagucagguccaccgcuaggugcgcuuucugcccaucucccuaguucucaaguucuuuauuccaguuuccacugucugaguucucuugccucucucaggucucccgacagcuuucagccgaggugggggcggggggaugagugggcggggcacuccugcugucccucagcugggcacugcccaguggucaccuuugggacucagcccagcccaccuucucacauaucucacccuuguuacuaaagaguuccgugagcagcgugcuagcggcuguaaugacugcggaggaguagugcggcaggcggcucagcacguccacgaugagccgaaucugcugccgcucuuugaugcucagccacucagcguugguaacaaggucaaggucagcgggcagguucacguugcucaggaucuaagucccaggaagaagaugaaccucuagcagauucacacccauaccaaacugagccuagcccuguggaccucuccgugaccacuuaacuuuuaucuucucugcugggaagcgcucagaucugggaaccgaggaacaccaccccccccccccccgaucuucuguuaggucuuccuacucuauuggcuugagagugacuguagccuguuauggguuuacguaggggucacagggccggggacucagucuugcuuaguguuaugacguggcacaggagaggggcgcaccuucugacuguuauuccgcaggccgccugaauuauugaggaagaugauuuuggugggcugcaaagccuuggcuagagaugcagucaccuccagcgagucaaggagcacggaacggcgcgcagccguuuccccaauggggcacaggauggggaugcuguuggauuccagacaccacugcaacaggucugucuccaccgcgacgaugccaccguagcugugggccagauguggugcuugagcgggaccagggcagggccagcagagugguccgcccucucugaggaugccggggcagguuggguugacacuaaccuggcauggggagcuggcuccgcagcgcucaguacugauccgccgccaaaaaagggcacagcaguagccgcguugugccuuaguucauccaccagcaccuugcagcucugagcaagcugcgccuuagcuucccagaaggaaagacagccagaaggugccguggggguaggcagccccagaaccaccaguggcuucauguccaugcguugcaagaaggccagggcgaaagccaggcgggauaccgccugcgggcaccggaucaccuccucaucgaccuguacagaaguggacguucagggacgcgacacugacucuaagccgccuguuccuaaucgggcuuuaggacccucagugaccacauucuacuuaggagccauugggccccacuuuuggccgacugcuccgcccuuugcccguugggucuuagccacccccuuaucuagcacuaauguuccucccucagcuccucccagcggccuuggacucugggacaccuuggggggagggguagugcgacagcucagccgacugaaccccuaacugcuuccacggugagaggccuuugucagacaucacuucuggaggcccgggcuucccagccuucuccuuagcgccaagggcgguuuucguagccuuauggcuuucuccauccccagcacuaacucaacgccucugcucuccagauucacaguuaggcaugcugagaccuacgacguacuauugaacagucaccaucucaugacagugacacgacgacaccgggaucggcuuaccuccaugacggcgaagggcuuguccaccgaaugguagcaggucuggaauugcgugagccaguggcgugcuucccccgggcuggcaccacacugguucaggaaggccuggaugucccgcugcaccagugaucugccggcgggaggcgcaggggauucgaggggcguuggaagcgguguccacgacggcuccucgaccgcaggagacuggacacgacccuuagcgcccucggcguccucugcgugagcccuggcggugcugagccggcgucccgggcuggcgcucuuugccccgcgccgccgcgcgcugccacucagucuccgugagcccccaggaccucccgggcugcgcaaccuucuggccgcugcagcagaccgcagggcuguggccacccacgccgucgccaugacgacaaccaaacccacucgucccccccacccacaggugacggucgcucuggagcgcacagcacuagggguucu

SEQ ID NO: 6416 - RNA, 3864 nt, Mus musculus
uaucauuccccgcugcuggucucccggacccggcugaggccguagcggacugcccuuucccaagauggcuucgaagauuggaucgagacgcuggaugcugcagcugaucaugcagcuggguuccgugcugcucacgcgcugccccuuuuggggcugcuucagccaacuuauguuguacgcugaaagggccgaggcgcgccggugagcgcgcccacgaagucgucgaaugcgguggggggcgguccgaccugucccaggaacuggggugcggugauguuggggcccagaagucgggauacuuagacugggaggaauugguacucaaacagguuggaagaugcucucuuucgauuguacggccauuacugauguggcggcggcuccggcagugagaaggaucucggguuuuuggggggcaguggcgauugcaggaacuuacagagguccccagauacuuacucucuauucauucuguccuccuuguucccuacacucgauccacaggaagcccgacaucccagugccuuaucuauauuucgacaugggggcagcuguguugugugcuagcuucauguccuucggagugaagcggcguugguuugcguugggcgccgcgcugcagcuagccaucagcaccuacaccgcuuacaucgggggcuauguccacuacggggacuggcuaaaggugagcacggggacucuagacgagauuuagcuaugggaaggagcugaagguuccugauguauguggugggcauguaugguacuccugaacuugaagcccgggaaaacugagguacuagguuugcagcaguuuuguggcaaucauuacagaccacagacgugucagacccauagagaccacaccgaccucccuuguagacugugaaaagggagguccagagauggaaaauggacucucccaaaaucaugccacaguguauggaagggaucgguaacccagaguuaucugauucucagaaucuuuuaaaccauuacuuuauuggugucagacuuguaaaacaaaagaggccuuggagaauaucuggucuacccaucagguuuuaugaaaugugauuaauacuagugcagaauuugugccuucaaaugcagaugcuuauaccggcuacugguagccuagaggugagguagcuuggaggcaggguccgaaaggaucagacugucagucuaguaggggaggcaggugugaacagcuaugggauagugggccuauuuguuuugcauuguuuuguuucuagacaggguuucucuguagaccaggauggcucaaacacacacauacaucugccucugucucccaagugcugguauuaaaggcauucaccgccgccaccaccaccaccacugccuggcuggcuguucuuguuuuaguugcuauagagucuauacuacauagugggaagaacccugccauuauguuucaggcuagggguggaggagauggcgaucuguggcagcuggguucugccacuuucuguaggaccauggacaguuucuuuaccccucucagcccucaguuucugccuuguguagagaauucgcucucucugcagacuacacuuggaauaggcaagaggguucaucagauagaacaggacguguagaagugggcaguucuauguucuugacaaccaagagacaugauggcaguucuugacugggguuccuuucucccuggccuuagguccguauguauucucgcacaguugccaucauuggcggcuuucuggugcuggccaguggggcuggagagcuguaccgucgaaagccccgaagccguucccugcaguccacuggccaaguguuccugggcaucuaccucauuugugugguacguugggguucucuugauuggaggcacuguaugggaguggcaugagcuuaggccuggcagaauccuggccacugggcagagcaaggccuugugaguaauuucacaaggugacuccaagagauugcccuggacagcugcugguuccuucugaagggugcuucaaguacucaauaccuggcugagggucccucauuucaacauuauugcuaccagcuagauaagaaguugaacugaccauucagucccaauguugagaacccagcaaagauuaggugauuuucucauugcuucagccucgagaggacugagagaggggacaaaaaagaggcauggugcagaucagcucuaguuguaguucugccaccuagaguugauggggguuauguaggauagucagggagaucuuccuggugcuuuagaaggccgcuguagaugagggcaaagauaggcuucaggcucuugaccuccuccuaggaaccaggaaugacauccuaugugcagaguucuguguaggcuuccguggugugcauauucacaagucugagucuccaucugacuauggagacgcacguccuuucuucagaggcuuccaggaggguaggggucagccuuaucucucagggccgagaguccccauccagagaaaggacuuggaagcccauuugacaggggcuaccuuguggguaccaccuuagguagacacucaucugcugcagucuuuuuaagauuuauuuauuuguaagauuuauuuauuuguuuuauguaaguacacugucacugucuucaucuucacacaccagagcagggcaucagauuucauuaaagaugguugugagccaccaugugguugcugggacuugaacucaggaccucuggaagagcagucaguguucuuaaccacugagccaucucuccagcccuaucugcuacagucuuaaaaggaugcugugugucucuaggccuacucgcugcagcacagcaaggaggaccggcuggcguaccugaaccaucuuccaggaggggagcugaugguccagcuguucuucgugcuuuaugggguccuggcccuggccuucuugucggguuacuaugugacgcuggccgcccagauccuggccguguuguuaccuccugucaugcugcuuaucgacggcaacgucuccuauuggcacaacacacgacgcgucgaguucuggaaccagaugaagcuacucggcgagagugugggcaucuuuggggcugccgucaucuuggcuacugauggcugaguuccacggggagagccugguuugggcacaggaggccaccgccgaaggccaccuuaccuuccuccuugcuggcccaguuguuguuuauuuaugcuucuugguuuguuuguuuacuuucuuguuuuuuuuuauuuuaauaguuacauuuuugggggggaagaugggagcccuugcgcuaaagcuucauaggguuuuguuguuguuuucuugccuguuuuaggggagagcugaggccagcugccccucccccaaguggccagggagggaggagucccugagaaaggaguaaggcagagcuggggugcagguagaaguuggggacagaggaagaucuggaaguaagcaaaugugaaaauuccuuuuggaaccugacagaugcagcuaaacuaaacagugcuuuucagacuaguguguguguguguguguguucacacaugugugucuucacauguauagaaguagcccuguaaggaggggcagaguggcuggugcuacagacgucacaugggcucuuugggggucugucugcuggggcaggaauaaucccaguucucugacucucgcucuagaguugagaacaggcagggccuggugugcucugggaugugcaagguggagcaggccugucagucagccugcugcugcaucuguucucagcuucuugguuggcuggcugaguggagcacccacccaaacaccagaccacacuguccuccgaaaauaaacauuuuauacagacau

SEQ ID NO: 6417 - RNA, 5302 nt, Mus musculus
ggccacguggggccuugaggaaacgccuucgcaaagguuuguccccuccgcuguccaguagagaggaaggccgaggaagaaagccggaggaaacaguaccagcuacggcuccaacucgcgcgugucagggacugcgggggcggggcggggcggggguggggcuugguuuagacccccggcggguagggcggggccgggggcuagaaagggugggcucuagagggccagcagguagccgcuucauuucugcuaagguuccucgacuugcacccuacaacgggcuccaggcuagaggacuccugauucaccauggaguccacgcugagcgcgggcaucauaauggcugaagcacuacagaaccggcuucccgggcuagagaauauguggcucugggucaccuuucugggcgauccuaagaaucuuuuucaguucugcuuccccgcggccuacuacgccucccgccgccugggcaucuccgugcucuggaucaccuucauugcugaguggcucaaccuugucuucaaguggugagacagagagaagccuucgggcauccugguccccuuaucccuuuggggcccugaucucccucaaguaguuaccucaaaggcaaacacuuuucuaccuauucuuauccccuuaggcccuagucuucaccucagaucucacaguucacccauccucaacuauccggaucagagaaacgacuuaaggggcguguucaacugcaaauacagucuccgccucagaccuacugauuucguaacuccaaauuuaguuguaguuggaaaucugcguuuuagcaguuauuacuagaaauguagguagccgaaaaucuucuuucuuagcugaacaucuuauucaucuauccauuuguuugacauuaaacuaggcaccaguuucauuaagauguggucccugguuuaagcucaaaagcagagucaaugcuugaagacuuacuagaaauacagacucuaaagcuccaggccagaucugcacuuuaacaagccccccacccccacccccgauuauaaugugcccaaugaaauuuagaagccacucaaugccagucacuaaagggaauccuuacccuaccugcaaggaacacuuuucuucucuccccaguacuuagucuagcuuucucauucuaagaagccaguggccccacacugcugggccuccugcagcccuugggguuuaucugggccaccguguuuguuugcuuguuuguuuuucugucuuuucggaguacagaagggaguuacucaacacugcuguugcccaggcuccccagccuugaaggaggaagcaaggaucauaaagagacauagaauaagcuaacaugacaagcuggaaagcagacaauuugucccucucccucccgcccuucuccacaagggcuuguaaagcuaaaagcgguugucuaaucauuuccuccuggccuaacugccccuaucuuaccucccucagagccugugcuuaacauccagguaacaaagccucuaauuguucuccuccuccuucauugaaagucucuccauccaaccgagaauggugguccuccugccugucuccccagugccaggaugacaaguguacuccagcaucccugaccccauccauauucauuuaauagcucuguggucagcacuggcuuccugcucucccgucuugucucuuucuggccacagcggccuccucuacgugggguuguccagaggcuagccaagcaccugcuaggccagggguguuggauuuuuuuuuuccccuuaguuuuucucaggcuucucuguacauucccucaauaccccaccccacccccaguuucacacucaaggcucccccucuauaauucaggcuggaagcaggaaacugagagcgggaacagggauaggcaaagaaaucagggaaccagggccugagaagagccaguugggcagugggagggauaagaguaggacccuugucucaaaauacauguauacuccuacacagugugucugucugucugucugucugucugucugucucuuucucccucucuccaaccucaggccuccauaucacuuuuuuuuuuuuuuuuuuuuuuaguuuuaugagacaggguuucucuguuucucuauguagcccuggcuguucuggaacucacucuguagaagaccaaguuggucucgaacucagaaaugugccugccucugccucccaagugcugggauuaaaggcgugggccaccacugccgggcuccauaucacuuuaaaaggaaaaaaaugugugcuucauugcguuccagagauuuaaaaaaaaaaaucacgguaaaguaauagcuagaaucagagugcccgucugaggccaccaagcaggcccucuagaucccaucaaaguguguguuguauggucuuguaucuugucucuuccagguuucuguuuggagacaggcccuuuuggugggugcaugaauccggguacuccacccagacuccaauccagauucaccaguucccuucuucuugugagacugguccaggugggaaaaguuccagcuuccucccaucccuggugcgguuagggucccgguaaacauuugcauauacuccagcuagggugguccaaacaggcccagccucucaguuccugguccagcaaacaaauucuggggagaucagguugagugacguggcucaugucaacuguucaccucauaaagccagagacauggcaucgggcaagagggaaugaugagccaguacuagggaaagcugccuuuacaucugaguggggaugucuugaggggucaccaugggcuucuggguuuccacucauguuuuuucaccaugaacuucuggaucucccggcaggcagccccuccggccacugcaugaucacaggcgcagcucuuuggccuguaaugacggccauuucuucucagguggcuucucggucccgcagguaugaccuuaguauggcccacuaguaggagcauucuagauuccgcaaucuccacagcauguuaguuuggaagcuggaguuguggugaccuggggguguuggcucaaacuuuugaggauuuggaugcugaggaaagucaagccguguuggacaucccuugagccacucgucucucuucuuuccagccccugggugagggugauuccuggccuggcuuauuguaccuuccuauuggcagucggccuaucucgggucuuccucuuagcacauuucccucaccaaguguugggcggccuuauuguugguaagcaacuggggcaaaaggguggcccaagagggugucuuuggcaaugggaggaccagucuaggaacuucucagcagucccagcgucuguagagccaaccuuaagguccccacuucugucuuaguuuguucuccugcugagaugaauugcaggcgagggggugggucauuuccccaaacaucuugaaacugauuuuuuuuugucccguucccuuaggugcugcccuuggcuggcuaaugagcccccggguacccauggagcgggagcuuagcuuuuauggguugacugcucuggcccucaugcugggugccagccucauguauuggacucucuuuacacugggccuagaucuuuccugguaaguccuacuuuagagucugggcagccagguccuguccuguuucacuuguaccuagguaguggauuucaguugacuauagaagcaugcauuaacuguuucuagacaagagauauggggucauaacacaugggcgcagcccccuugugagauggcuacaagccaguggcucucuggaucccaggcucuccuggcaaagacucaucuuccccacagguccaucaaccuggcuuccaaguggugugaacggcccgagugggugcacauggacagucggccuuuugccucacugagccgugacucaggaucugcccugggucugggcauugcccuccacacucccugcuaugcccagauacggcgggcgcaccuagggaauggccagaaaauagcuugcuuugugcuggccauggggcugcuggucuuccuggaauggcugggcuacccaccucagaucagccucuucuacaucuucaacuuccucaaguauacccucuggccgugccuggucuuggcccuugugcccuggguggugcacacauugagugaccaggaagcaccgcccauucgcuccucuugauguguuuugccucccuugccccaaagacaacacuccucgaccaaccaccacacucuaagagacagcccuuuuccugggcuccggagcaggcccgcucaccuugaacuucauuucugucucaugcuuugcagucuuagcucccuuuuaaagaaggaccucuguuuccaggaggcuaagccaucccccagguccccacaaagcaaaagcaacaggaggccugguggggagggggagcugcucaggaagaccccaauaaagcccuuggaacuugugaauucuuuucuugucugugcucucaucucuaccgaccucuauaaguaccaacagagccuccaccccauuccugacucuacaaagacaaaaguaaaaggggguuggaaauucugcugggaccuaccccccaccuccccgccaaggccauggcagacaagaugagauauggcagugacaguucacuggaacccagccuuccacaguaggacagaucuccugcccuggccuucagcuucucagacugaauucugggccaagagugaagaaaaggcagcauuuuggcuaggaaaggagugagaacuuuuacucccauuugcgagcccacagaucagacauuauucccagaaagcacugccacaaauaaguuuauuuacacgaagacaaaaaccauguguugggauacaaacuacugaacuaaaauccauguccagggagacaaagcaggaguggguuggcacaggauaagaucagccuacggggagagagugggaggugagcagccucugguucagugcaaggaugauacagacagcacgcaaacacacagaaaacuaauaguggugggacuccccagcucccucagcccugcucaggccccauacggacaauauggaaacagauagcugagcccuggggaugugguauaggggaagaaaaauuggccccuuaggagccauuucccaucuuugguuuccuacaggcuagaccacauucacuggaagucugugggcuccagccucuggacacaaggcuacuggaaaagauggauagcuccuaacaaccuccugcugagagcuggacucccccccccccaacaccucugggggacagggguggcu

SEQ ID NO: 6418 - RNA, 5302 nt, Mus musculus
agccaccccugucccccagagguguugggggggggggaguccagcucucagcaggagguuguuaggagcuauccaucuuuuccaguagccuuguguccagaggcuggagcccacagacuuccagugaauguggucuagccuguaggaaaccaaagaugggaaauggcuccuaaggggccaauuuuucuuccccuauaccacauccccagggcucagcuaucuguuuccauauuguccguauggggccugagcagggcugagggagcuggggagucccaccacuauuaguuuucuguguguuugcgugcugucuguaucauccuugcacugaaccagaggcugcucaccucccacucucuccccguaggcugaucuuauccugugccaacccacuccugcuuugucucccuggacauggauuuuaguucaguaguuuguaucccaacacaugguuuuugucuucguguaaauaaacuuauuuguggcagugcuuucugggaauaaugucugaucugugggcucgcaaaugggaguaaaaguucucacuccuuuccuagccaaaaugcugccuuuucuucacucuuggcccagaauucagucugagaagcugaaggccagggcaggagaucuguccuacuguggaaggcuggguuccagugaacugucacugccauaucucaucuugucugccauggccuuggcggggaggugggggguaggucccagcagaauuuccaacccccuuuuacuuuugucuuuguagagucaggaaugggguggaggcucuguugguacuuauagaggucgguagagaugagagcacagacaagaaaagaauucacaaguuccaagggcuuuauuggggucuuccugagcagcucccccuccccaccaggccuccuguugcuuuugcuuuguggggaccugggggauggcuuagccuccuggaaacagagguccuucuuuaaaagggagcuaagacugcaaagcaugagacagaaaugaaguucaaggugagcgggccugcuccggagcccaggaaaagggcugucucuuagaguguggugguuggucgaggaguguugucuuuggggcaagggaggcaaaacacaucaagaggagcgaaugggcggugcuuccuggucacucaaugugugcaccacccagggcacaagggccaagaccaggcacggccagaggguauacuugaggaaguugaagauguagaagaggcugaucugagguggguagcccagccauuccaggaagaccagcagccccauggccagcacaaagcaagcuauuuucuggccauucccuaggugcgcccgccguaucugggcauagcagggaguguggagggcaaugcccagacccagggcagauccugagucacggcucagugaggcaaaaggccgacuguccaugugcacccacucgggccguucacaccacuuggaagccagguugauggaccuguggggaagaugagucuuugccaggagagccugggauccagagagccacuggcuuguagccaucucacaagggggcugcgcccauguguuaugaccccauaucucuugucuagaaacaguuaaugcaugcuucuauagucaacugaaauccacuaccuagguacaagugaaacaggacaggaccuggcugcccagacucuaaaguaggacuuaccaggaaagaucuaggcccaguguaaagagaguccaauacaugaggcuggcacccagcaugagggccagagcagucaacccauaaaagcuaagcucccgcuccauggguacccgggggcucauuagccagccaagggcagcaccuaagggaacgggacaaaaaaaaaucaguuucaagauguuuggggaaaugacccacccccucgccugcaauucaucucagcaggagaacaaacuaagacagaaguggggaccuuaagguuggcucuacagacgcugggacugcugagaaguuccuagacugguccucccauugccaaagacacccucuugggccacccuuuugccccaguugcuuaccaacaauaaggccgcccaacacuuggugagggaaaugugcuaagaggaagacccgagauaggccgacugccaauaggaagguacaauaagccaggccaggaaucacccucacccaggggcuggaaagaagagagacgaguggcucaagggauguccaacacggcuugacuuuccucagcauccaaauccucaaaaguuugagccaacacccccaggucaccacaacuccagcuuccaaacuaacaugcuguggagauugcggaaucuagaaugcuccuacuagugggccauacuaaggucauaccugcgggaccgagaagccaccugagaagaaauggccgucauuacaggccaaagagcugcgccugugaucaugcaguggccggaggggcugccugccgggagauccagaaguucauggugaaaaaacaugaguggaaacccagaagcccauggugaccccucaagacauccccacucagauguaaaggcagcuuucccuaguacuggcucaucauucccucuugcccgaugccaugucucuggcuuuaugaggugaacaguugacaugagccacgucacucaaccugaucuccccagaauuuguuugcuggaccaggaacugagaggcugggccuguuuggaccacccuagcuggaguauaugcaaauguuuaccgggacccuaaccgcaccagggaugggaggaagcuggaacuuuucccaccuggaccagucucacaagaagaagggaacuggugaaucuggauuggagucuggguggaguacccggauucaugcacccaccaaaagggccugucuccaaacagaaaccuggaagagacaagauacaagaccauacaacacacacuuugaugggaucuagagggccugcuugguggccucagacgggcacucugauucuagcuauuacuuuaccgugauuuuuuuuuuuaaaucucuggaacgcaaugaagcacacauuuuuuuccuuuuaaagugauauggagcccggcagugguggcccacgccuuuaaucccagcacuugggaggcagaggcaggcacauuucugaguucgagaccaacuuggucuucuacagagugaguuccagaacagccagggcuacauagagaaacagagaaacccugucucauaaaacuaaaaaaaaaaaaaaaaaaaaaagugauauggaggccugagguuggagagagggagaaagagacagacagacagacagacagacagacagacacacuguguaggaguauacauguauuuugagacaaggguccuacucuuaucccucccacugcccaacuggcucuucucaggcccugguucccugauuucuuugccuaucccuguucccgcucucaguuuccugcuuccagccugaauuauagagggggagccuugagugugaaacuggggguggggugggguauugagggaauguacagagaagccugagaaaaacuaaggggaaaaaaaaaauccaacaccccuggccuagcaggugcuuggcuagccucuggacaaccccacguagaggaggccgcuguggccagaaagagacaagacgggagagcaggaagccagugcugaccacagagcuauuaaaugaauauggauggggucagggaugcuggaguacacuugucauccuggcacuggggagacaggcaggaggaccaccauucucgguuggauggagagacuuucaaugaaggaggaggagaacaauuagaggcuuuguuaccuggauguuaagcacaggcucugagggagguaagauaggggcaguuaggccaggaggaaaugauuagacaaccgcuuuuagcuuuacaagcccuuguggagaagggcgggagggagagggacaaauugucugcuuuccagcuugucauguuagcuuauucuaugucucuuuaugauccuugcuuccuccuucaaggcuggggagccugggcaacagcaguguugaguaacucccuucuguacuccgaaaagacagaaaaacaaacaagcaaacaaacacgguggcccagauaaaccccaagggcugcaggaggcccagcaguguggggccacuggcuucuuagaaugagaaagcuagacuaaguacuggggagagaagaaaaguguuccuugcagguaggguaaggauucccuuuagugacuggcauugaguggcuucuaaauuucauugggcacauuauaaucggggguggggguggggggcuuguuaaagugcagaucuggccuggagcuuuagagucuguauuucuaguaagucuucaagcauugacucugcuuuugagcuuaaaccagggaccacaucuuaaugaaacuggugccuaguuuaaugucaaacaaauggauagaugaauaagauguucagcuaagaaagaagauuuucggcuaccuacauuucuaguaauaacugcuaaaacgcagauuuccaacuacaacuaaauuuggaguuacgaaaucaguaggucugaggcggagacuguauuugcaguugaacacgccccuuaagucguuucucugauccggauaguugaggaugggugaacugugagaucugaggugaagacuagggccuaaggggauaagaauagguagaaaaguguuugccuuugagguaacuacuugagggagaucagggccccaaagggauaaggggaccaggaugcccgaaggcuucucucugucucaccacuugaagacaagguugagccacucagcaaugaaggugauccagagcacggagaugcccaggcggcgggaggcguaguaggccgcggggaagcagaacugaaaaagauucuuaggaucgcccagaaaggugacccagagccacauauucucuagcccgggaagccgguucuguagugcuucagccauuaugaugcccgcgcucagcguggacuccauggugaaucaggaguccucuagccuggagcccguuguagggugcaagucgaggaaccuuagcagaaaugaagcggcuaccugcuggcccucuagagcccacccuuucuagcccccggccccgcccuacccgccgggggucuaaaccaagccccacccccgccccgccccgcccccgcagucccugacacgcgcgaguuggagccguagcugguacuguuuccuccggcuuucuuccucggccuuccucucuacuggacagcggaggggacaaaccuuugcgaaggcguuuccucaaggccccacguggcc

SEQ ID NO: 6419 - RNA, 16311 nt, Mus musculus
uggcggcggcuuugaaagccgcucugggugcacguucuuaggcgccccucucucaguuuccgcugcggucuuaaagacgcuucucuuggaccuugcucugggaaugcgaccggacauaguucccuacucuacgucugggucgaguuggaggugaacccuugagucugacacggccgggccgacccgccggcccgagcccacggccugucguuaugguaaugccgcgucuaagccgcccgggcucuggggaggaggcguuccagccccggggaagccggacuccggguugggcuccgggcucgcuagucugcuaggacgggaucugccugguagagacugaguguagucugcagaccugggggcuagguaggaagggcgcgcaacgcgcaggagaccuugugaaagguaccucccccggacauacagaccuacagacagacagaaaaauagucaucaaucccugcgagcccaaacgucacuggcuuuuggaaucuuugcccccaaccucgugaucuuggggugacuaacauucaacucuccucucccuccuucccuuccucuccuccuccgccuccuccucuguuuuuauuuuuuugggaggaggguggguccuugaaacaggcuuucugccccuggcuauccuguaacucaguauguagauuaggcuggccucgaacucaaaguucugccuuaggcguucugggaauuaaaggcagcagcuaccaugccacacgcccucaaucccccaccaaaaacccaggcugugggugugacacucgucugagucugcuguccaggaagaagaaccguagacuggggcaguccacacucuuggcaacuuugccuuuggcuuugguccucuguagaaagaaaucacuggcuugauccucagaaacaaggguuucaggcaggguccuuucuuguguuggaccaaccuuugagauucuguugcagaauacucaggccuguuuccagaggugguguaggcaaguaaucccauccuuugggaaaggaaagggucaggaguucaaggucaggggcuggggaaguggcugagcagguaaaaggugguugucucugaugccucaguuacaucccuaggacccauaggguggaagaagccgacucccucaaguucuuuucaccuucacacccaugcaguaguguaccccacccccacuaaaucaaucauuuuuuuuauauaagauuugaaaauuaccuuuaucaacauaauaaugacuugaggccaacuugggcuacuugagacccuuaugcugacccugccuuugucucccuuagcagucgccucucuuuuacuaucuccccuuucuaggaguaguucagauaaacugugugugugcauuauauguauauauguguauauauauauauuuuuuuuuugguuuuuuuuuuuaaagaaaguauuuuuuugguuuuuuuuuuuuaaagaaaguuuuuuuuuuuuuuuuuuuugguuuuucgaggcaggguuucucuguguagcccuggcuauccuggaacucacucuguagaccagguuggccucgaacucagaaauccgccugccucugcgugcugggauuaaaggcaugcgccaccacgcccggcucgaguauuuuuaagucuuuagcuaaaucgaauuucuucucuuuucccucuuccaguacuagccagacacaccagaaacccaguauacuugagauggucacauuagagcuggggaaaagguuguagugaauacaggaugaugcugcgggcggugguuucccuccggucucaagugcuuuguuuucuuuuucagacgugugguuuucagaaguuguuuucuguggaagaggacuuugaagaugagguagggaacuguuggugaccuggacuagcaaaagaugcccugagauggagacacagccaaguucaggaccuuugaagcagucccagcaggcagcuuucaauggacauaucuuucaucuuuucuuuuuuuuuuuuuaaucuaucucaggcuaaaaguguaaauaauuguaagcaaggaccaacuuggugcuacuugcuuguauuguaguuccaguacguaagaggcugaagcaggaagguaggaacccaaggcuggcguggggcuacauagagagacucugucucagcaacaacagcauauucaucugucuuuguuugcaguauguuuccggcacacgguuucucuguguagcccuugcuguucuggaacucgcucuguagacuugacuagccuggagcucacagauguuuaccagucucugccucccagaguccugcgauugaaggccugcauugccgcugcuggcuguauucaacugucuuaaaaauaaaacaggcuagaugugguggugguguaugccuuuaauguaggcagcacucgggaguuagaggcaggcaaaucucuugaguucuaggacagccagggcuauguagagagacccugucucaaacaaaagaaaaaaaaaguccagagugugaguaaguggguccaggucccugcuuaucuuagagcccugaccuaaaugcucacgcucucaauaaaaccagguaccugaggucaccugugauuccagcauuugcuagauggaggcagaggcaucauaaguucaagguccucggccgcauagagaauucagagcuguucugggcaucaugagauccugucucaaaagaaaagaagaaaaagaaagaaaacaaacaaaaaccaaacuaacucccuaauucuaacugucaugucuuuaauuauaaaggccuuccugggagcugucuggagggugauuucauucacuuuuauaauagcaugccugaagggggaggaacguuuauagagagccgccucagggaggaggccgcacaguuagcaggaugaugugagacccgagggcaccaacuggccugugacccgggcagauagaucacuucauacuccggccucccacuuugucuucucuagaaugaagggcauuguuguguuccucucuuccuucucagaagaaaagaaauuaaaugagacacacagucaacauuuuggaaucacccucauguaaggccuaccccaugccacuuacgugagaauuucuggcagagaaacuucuucaauaagucaccuaccgcugggaggugguggcacacgacuuuaaucccagcacuugggaggcagaggcagguggauuucugaguucaaggccagccuggucuacagagugaguuccaagacagccagggcuacacagagaaacccugucucauaaauaaauaaauaaauaaauaaauaaauaaauaaauaagucacuuaccggccaagggaaccagggcaaaucccucuguucuguggccucccugggcgauuuccagccggaguuugguuuucaaaccauugagccacaucccgagcuccccccaaagaggaguuacuggguguguuguguugccgcuuguuucuagacagguucucucuggggagaaaaggcuccccuugaguuggaaaccauccugccucagccuccagaguccugggauuacaggccugugacagugagccugccuacagagguguucaagugccgucagagacaccaaaccagugucugcaguggucuucguauccagauccagugguguaguuucaucuaggacacuggacaucucuaccuugauuugccggccucugcuuccugagugcugcaugcugggauuaaaagcucacucuucacaugcagcagaacccacuuguugcuucuaagucucucucucuucucucuuucuucucucucuucucucucuuucucucuucucccucucucucauuuucuuuuuuuguaauuugauuuaugugauauucuuuuuuucuuaagaaguguuuuauguauaugaguacacuguagcuaucauuagaaacacuauuauagauggcugugagccaccuucuggguacuggaaauuaaacccaggaccucuggaagagcagucagcuuuuaacugcugagccaucucuccagccuccucaguuccucucuuaagcaaaugguguagggaugggggcucaaguggggucuaaccuuauuuuuugaccaguccaaaucucccguucuuuucuuucuuuuuuuuuuuuuuuccuagacaggguuucucuguguaaccuuggcuguccuggaacucacuuuguacaccaggcuggccucgaacucagaaauccaccuaccucugccugguucuuuccuuuuuuaauuuuuaguuuauguauacauuauguguauaucugaguguguacauguucauguggaaauuucuagaagccagaagagagcaucagaucaucuggcucggaagugacagacaguugugggucacuggacaugaguacugggaucagaacucagguacucuggaagaguagugauugcucuuaaccaccgaggcaucucuucagccucagcaagucucagacucugcauucauucuguaccuauacagagagccauuguaagaauucucugaggguucuaguaaaauaccugagugcaccugacacccagggaaguuacaggugucuguuuuugucauauagcaacuugaucuuuguggucacagacuauucaacuaccaacuuuuucugucuguuguuguaguauguuuguuuguuuuugugguuuaggguuuuuguugugguggugguggugguuuuguuuuauuuuuuucuuuuucuucaagaugguuucucuguguagcccucgcugaccuggaacuacuuuguagacuggacuggccucaaacucauagagauucuguuuuguuuuuaacaagacagagucucucagugagauugagcugaccccaaaauguguggaggaggacacuaacuccgaauccuccugcccccaggguucacugcaggggugacgaugugcuaccaccuggucuucacuggauguuugcacugccagcuuugucaagacaugucccugccuuuaacuuucaguuuggcagaugugucauuagaggcugagaaggaacuaggguccuagcaggugacagaagacgccaggguaauaauggaauccgacugagugauucugauucuucacacuuuuguuccuuaaaaauggcagaccagucucuuucuuuggcuaagugucagcucucuggagggaaggggaccagcaagccucagggugaggaggagggacuucugguccuguuguuguuguagcccugggguuugcuggaggguggccugacaauggggagcagugguggggggugggggggguggcuagucccuucuugucacuuaaucagcaguucugacucaaaauacgcucagaacaggucugcugcacuugaaggugucagucucaccuugccucccaaaugcacucaggacuuaauuuaacuugcccgagaagcuauauuuaacuugugucuauuuggcuggauccaggggcccucugucuucccgaagacuaugggugagcaugcacauggcuagagguagggccuguaccaaggguguguggccaacagaguagcugccacgguccuggguccugacugaaccuagcuggucuccuucagaggugugugaccuuguggggugccuuuggcucucggugcccuggaaugcuuuucccuugccuuccucuuggagacugaagaccccagugacuaccugaaaacagagccuuggaaugcuccugacaaagucugcuggcccccuggcucacaggaauaguaagugaugagagaugucauuguuaccucucaugccauggcuucuuacauguguaucugcacacagacauacuacacgcuuaaacaguaaagguagaagguuuuguucuuauuuauuucuuggaagcaguuuuaaauucccagaugcagagacccugccaagcccgauggugauaguccuggccuauaaucccagcacucgggaggcacagggcucaggaguuagagcucagccucagagcgacuugagcacggccagucugagcugagugagaugcugucccaggagcaggcagaguccugacgcagagguccacuuucugucucuuuguaggauuucuuaucugcuuuggagaaugcagagaaccacguuguuagugcacugcccagggaugcugggugccugagaccugucucuuccagaccacaggagacugugcagacacaauccucaagaccagugccaucauaccccaccuccaaccagucagucccaagacugugucucccucccuccagcaugcgggagaacgccaaggcuccacucagcacaggagugaugucccugagaccugccuccauuucuagcagcagcuugaguagucagcaaagaaugacgggagcaaagguguuccaagagucgucaggcccccagcccucagccgcacacucuggauauauuuuugagagccaucaacagggcauuggugacuuugaagcaccugaucaagaugaccuugacaaggcccuggcaagcauggaguucgagggagcuggcuuggagcuagaagccgacaguggagccacccagauccugccugccaagcacugugaggauccuguguuggcaaaaaaggcccgaguagcugaucugaguggaucguuacggaaggagccuaugguccacuguagaaauccauggccuuccuugagaccuacgucagccacaggcagccuuccugucccagcuacaucaugugucuccacuucccaacaaaggggcuccccugcuccugcaccucaguaucugccaguggcuggaaggaccauccgaagcagcccacagaauuaugggccgggccagccacuucagucucccagagcguggucaaguggcaaaccccguuuuucuggaccucaacguccccacggcagcucugcagcauuuugucaggggcccuugucaucccgagccccagugucuucuguugaaucuccugucagcacccccagaaauacuuccaccccaguuacucagccagcucuucagacaccuguaguuaccaaccaccugguacagcuugucacugcuaccaaccggacaccccagcagcccucccgccccuccauucgagcuaaaacccgccgcuuuccuggcccagcaggacuucugccucaccaagugagugacugguuuuccugggcucuaagauccggggaaagaagcaguagucuagucuuagaauaucuucacugucaggagacaggcaagaagaguggagagaaaggacuuacgaggccaggagagauggcucagggacggugacacaugcuuuaauccuaacucuggugaggagaugaaagcuuccugggacuuggugacuaccagucuagcauaugggggguggggguuggggggguugggagggucagcuccaagauagagacccugucucacaaaacaaaggaggagcuggagagauggcuuagcaguuagagcacuuguagcucuuacagaggaccuggguucaauucccagccgcuacgugaugauucucacaacccaggggaguggacauacuguucugcccucugugagcacaggcacauacauacaugcaggcaaaacagccacacaauaaagucauacguaguuccaaaaaguaaaaaaacaaggugccucaggccugcauaggaguacugcgucuaagguuguccucuggccuccucgugugcacauacacacacacauguauauacugcaaaaaauaaggcaaaacuauggaagucagaagucggaaggaaagaagggguggcucagagguagcacuuagcuagcagaugccaggcucugagacccagucccaacacugaucggguggagaggggcaugcccacagggguuuccuguauuagguuaaucgacaugggaaggcccacguuaguugugggaggcagcuuucccugggcugggcccuggacugaauggaaaaggguaaaguagcugagcuguuagcgagcccucagccucugcuuccccaccaugcagaccacgggacuggcugccucaggcuguugucacugccccugccaugaccgagcauacucuguuagccaagguaaaccuuuaaaaaaaaauguaaaaagugggcaggaagaguacgugacaauccaccugugaaaucgugcuugagaaacacgauuuccgacuuuuauguguuugcugaaugucuguuguuugcuagcccuggacaggaauauuuucucacuccuauuagccagagguagauacugggcaaguuguuuggaaggagagcaagcuugaagugcaguggaagaagcaggggagaaguuauauagacggugcagugcuggaaggggucuuuccccggcucccggagacacacagcucugccuggcccuugcuucuggcuuuggguggaugaccaggaggauaaagagguguauggaggcucugcaacggggagagcaggagcucuuggagaucccagaacacaucaguguggcuggggguugggggacaugaggaagccgggguuggaagugagacaguccugaggaguuuagauguagacggugguggagggaugccgucccucagaccaguuuuggucucgcugcgguaggacucuuccuuucuggugaggggauuaacgaccccugcuguugcaugcucuucccuggcccuucaagagaaaaccaaaggguggucugcucuuugcugcgaagggccucugggaaagugcucaguaacugaucacagauggcucuauuugggucgccgcccccuucagguggcacugggucuugcuccuggggcagcuccaguuuccuuacauucucaaacugauccccaaagugucucuuuaaagcugagugaggcucuugagacugcguuagaggcagugugagaugugcuaauugucccugauaguuuccugaacucauuaugcaauccagacaagacgccgcacugcacuuguaaauaccagcugcugagcuugcucucgccuucucaccccucagcacagcggggagaaucuggaggagaucaugguuuccacaccccagacuccgacucacggggcccuggcuaaauuccagacugagguaacuucuucuguguaaaucuucaccuccugggcagcauuugaaaucagggguguccuggucuugaugcuacuaggccuggaccaaggggcagguggagaaggccuuugggggaggcagcaguuuauagauggagaaugaggcauguccugacgucaugccucagccuucucuugcaucugagaacucugggcccggcucgcugcaucuuuccuuagggaagaaggguaauaagucuuaugauaucuugaggacccucucaagucucugggaacccugcugggaagacucugcccucaucuuaucucuaggagguucccucuccguggguggggccagcuucccucuucucuccuggugcucuaauugacuuacucugucuucagagccaccauugguuuugguuuucaccuuauuuuuugcugcagcuccccagggcugcccgugcacugcagguccaaaccuggcaguaaccaucuggauucaaagucguugcugauagaaggcagcugcugguuaaaaccagggcaucaaauacaacaucacugcguucaaaacagcuaggacgcuuugugagccuauaaacacaaauauaaauauguacugggagcccuuaucccuaagacuuccagacaguuagaugcauagauuaagagcccuuguugcuuuugcagugaacccuuauuggguucccagcauccacgauggguggcucacaucugccuugucacaccagcuguaggcaaucuaucgcccucuucuggccuuugagaguaccugcuugcuugggcccucauacauacccauaaaauaaauaaauaaaucuuuaaaauaaaaggauggauagcuuuuugcucuauuauaaguaaagucaggaccugauuagaaaaagaaaggaggggcuggaaagaugacucugugguuaagagcaucagcugcccuuccagaggucuggaguucaauucccagcaaucauguggugacucacaaccgucuguaauggaaucucauggccucuucuggugugucugaagacggcuacaguguacucacguacauaaaauaaagaaaaauuauaaaaaaaaaaaaaaaaaagaaaaggaaaggaaagaaaggggaaaaaaaaaggagacccuuuauucuggcugcuuagugaaagaugcagaauguagccagguuuccaaugccacuuucuguucguaacagugauugagaggcagccauucccccgcccaucccccaccccggggauccacuguuucucucccagcugucugccuugccccaguuacguauccuucccaagguagauccacuaaugcagccucccuugugcucugugguaccagauugcuaccaguucccagggaucuguggaagaggauuucgggcaggggcccuggcucaccaugaaaucugcucugggccuggacgagggagaccccaccugcuuucucuauaccuacaguauugucauggugcuacgcaagguaaggguccugagaagggagacucuacugccugguccaccacuggaagagacugugugccaccuccuaccccagcccuguccccggagggcagccugaagucccuugggucggauguacagauacagauugacacuguugaucugucuaucaggaacuccuugccuguggccugccaugguggagucggccacaaaagcagauacaaaaggaaagaaagcuaagagagaaaaaagguucuuccagcuuugggagcagugugucccaccagcugccuuccucugucaaaaggaagacuguuagcgccccuggucgccauggggaguuacgcugaggcauggcuagcucagugagugccucuccuuguaagcaggcggcccucaagcagcuccccaggaacaagguccccaauauggcggugaugaucaagucccugacucggagcacaauggaugccagugugguguuuaaggaccccacggguaaggagccgguccuggguguuucuucggcgugaccuccauugaggucuagagacgagcagccugcuucccagccaggggcucagacccuugcagugcccuugacccugagacggagaccuuacggcuuuugcaggagagaugcuuggaacggugcacagagugcuucuagagacacaccagagugagcugaggccuggcucggugcuguugcugaagcagguagggaagcccccuccaccccgguuugucuuugcuuggcggacugcccucccuccaucgcccgccaaccaaagagagaagauaaguucgagguugcuggagcugagagcaguccucuggccagugaaccguuccacucuugauggggaaaugggaauggagaguuguauuugggguggcaagugguucuguuauggcagcaaggcuaaggcagcuuggugacugcugagcuuggugcugagggcacgaagugaaaggaaaguugguacccuaaguucgacuguaccguguucccuccagacacugacuccccuuccuaacuccagauuggaguguuuucuccuucccucagaaaccacuaccugaaugugacacccaacaaccuaguccacauuuacagucuagauucuggagauggggacuuccucgagccaccucagcccuugcccaagguaaguggggcgggagagauggugacaggcagagcuccccugccugguuucucucacuucaucuuuuccuugucccuggaggcaaaggugugaaggggacguaaagagaugccuuugggaacaggagucucucugcugccccugcuccagccaccugccagacgcugaguaacaggaccuagaggagcagcugguuuccuggugaugcccgaaugccugaucacacaggcuugaucaucugagaaguuaggagucauuugagaaccagggcgagggcucccugggggugguagcagaaaaugauagagggucacaucugcgccagguggcaaugaagagaacagggaauacaaauggcucgucuggcgagcuggcccuugcucugagacucugccuccugaccucugccucuacuagcaaugcccuggagcguuagugucuguuugagcugaagaucacucuagguaguccacaggggcaagugcagagcccaggccugauccugcucacuccauccuuaggagccugaccuagaggaagauaggagaccugggucuuguccaagcucuuaauaauguuuacuaugaccuugagcaagccccaucccuuccccuguucuuuuuuaggggauuguuuuguuuuuguuuucggagacaggguuucucuguauagcccuggcuguucuggaacucacucuguagaccaggcuggccucgaacucagaaauccgccugccucugccucccaagugcugggauuaaaggcaugugccaccacugccuggcccuuccccuuuucuuguaccaucuguagaacaaguguuugacuugaugaccuccaggcccuguagagcucugauuaccucugauuaccuacuaacacuucuuccuucuccauggacgcuguggaaccuucacagucacccaccucuguaaccuucauuuuucuuuacauuuuuuucuuccuuuuuuuuuuuuaaauggaggguuuuguuggugucuuuguuuaaagguuuauuaauuuucuuuuaugugugacuguugcaaguauuuugccuacauauauucacaugcgucaugugugugcuuggugcccaugaaggugagaagacagcaucagaucuggaccugggguuauagaugguucuauagcaccauguggcugcugggaauugagccugcauccucagaaagaacaacaugugcucuuaacugcugagccaccucuccagccaucauaagagcugauuuuaaucccgggccagcuccucaacacacugguggauggccucuuaaccuucuacaaucguuauacagagucccuaaaacauuagacacugauagaauuuggaaagucuguucuaguuuaguuguuugcuguuuuggguaguugguguuucagcuuucucugucagcuugggucugggugacccugaccccugcccuauuuauucccuuuguuuuuguccugggaaucccuaccuuugaggucauuuugguagaggcacccccacccccagggauuucaggaucguuaagcgcugguaaccagauccacuguccucaggaucugggaaacucccauggaagccuccagccugauguggcugcagagcccacacggggccucagaacagcacagaacccagcgguggcauuuccagaagaggagcucucagaggcagguaaggcucauccccucgcucaacauccucuggccucgcccagcaaggcugcuuccacucagcuccaccuccugccuccggcauguuuccaaaaccagaggcaggcuccuucagcaaggcugcagaccuaguugagagcuguaccuucagcuacaggagggagcaucaccaaccccugggugcuuggcacagucucugucccauuucaaguccacccugccgguacccaaggagccauauagccauguggccagggagacugggacacaaaccugggaggcccaagagccacucucagguggagccuccauaaucccaaaccacuuucuuagcuuuugacuugagaaauucaauccugccuggccuggaggcagaaggaccgugggcauggaccucacaccaagcacauucacaguacaccaagguguaaaccacaaagcugguuuguuuagauccuacauaggaccccugugcuagaagugucuuguguugucuggaauccugcacacucuccguacaacugagccugcugcugcugaccccauagcugucagaaguugcugguggucacagagcaaguguggagaguugguugcucgcucacacugccgcccuacagggcggaagacaaauacaauuccugcagucuccugaggggcuaaccuucaccugucccuccucuucaucucaaaugguuuucucagcuggcucauauagcccagcucccacaaagcaaccucugguuuuuugagguagucucuuccuuuuuuuuuuuuuuuuuuuuuugguuuuucaagacaggguuucucuguauagcccuggcuguccuggaacucacucuguagaccaggcuggccucgaacucagaaauccgccugccucugccucccaagugcugggauuaaaggcgugcgccaccacugcccggcauggaagagucgucuaugcaguggaagccagccugguccucacuguccagcccaagcuugugucacauuccuggcaaacccuuugccuuagccuccaagcgccagccuuauaggcaagcacugccaugcccagcccacugggcaacuuuuuccuuguaagcaaauaacagcuccaccugcccugagcacagugcucaucaccuuaauuaaauugugaauccugcccaguuggccggcuccuuucccuccuuuguggcguucuugccaggccuggagcugggcucucggguguaguuuacaguuugccuuccaggccccccauccugggcuggaaguggcacuguguacuuggcagcagguagcaccuaagcaugcccaccuggugcaagcugcugcaccucuuuaaaguuggcucacccaguaaaguggguuugagugcagcagccaccuugagcugccuugggaagggcuguugaggcaaaaugagcacacaguaaauaaucgccgcugcucacagacaguguaacagucgguaaaguauuaccagggcuggcugcaucgccagcuucccguagcaccacaucugacagcuccgggcuggucagaagcuugcucucucucucuccucccuucuccucaucccccucccccucccccuccuccuccuccucuucuucauuuuaucuguuaggaggcagaccugccaugacaccugugugaaggucaaaggaugacuugugggacucaagcccucuacaagauaggucuggagucacccacuuggccaucuggccagcucuggaacggcccuguucaguucccuuuucuuuuccuuuucuuuuuguauccgggagggguuuguuuguaaacaggguuucucuguagccuuggcuguccugaaacucgcucuguagaccaagcugaccucagacucagagaccugcaugcuggucaaagguguguggcacucugccuggcuccuuucauuuuucauucugagugucugcccaggcucucucucccacugucagcccaggugggugaacugucacuccuaagaccugucccgggcuccccaccccuucaaugagaaagucacaguggggagccuccagaguccuuccugcccaacacugccucugagcaggagggaaaggagccacggaagcauagggcauuccccauuccuacuggaagggcccagggguuguauccugccuguuguugugcguagugucauagggagccagggaaagguagaccaggccacccucagacccauuggcaugggcagacugccccaggggagccaccuuucuguccuaaauggcagaggcuucagagcugaguuuugugggauccugugguugccacugaauugaccccuguccaccucccucugcagaugaccuggauggacuccugagugagcucccugaggacuucuucugugagcccagcagcuagggcugccucaagacagggcauccaccaugagcuggcagccucucugcucccagacaagcuaggugcaucugggagagaacgccagugcacuggagacagcucaagcccauggucugaugccucccauaaccaccuugaaaugccuagugaugggccagacagugggcugccuggcuuaacgacucgacgacuucuuuuggcaugggcauccuggaaaucuggccagggcuugcuccccuacauccuuaucccucuggcacauuguccuccagccaauaagaaaagugggauccucccaccccauccuaacuuucaagaggcuggacuugauuuccuuguuccuuuauuccucaauccccugccagcugaggagcccaaaggagccacaaccacagcagaggugaccuaaggccuguuguccaccagggugacugugaggugcaggcugcuguaccugguucugaaauaaagcgucccuuccucauuugccag

SEQ ID NO: 6420 - RNA, 4496 nt, Mus musculus
ggacuuccuguccuggauguuaacagcuuccgagaaaagccggaagagaucggacccuggacagaauccugaguugccagccccuccccugaccccuacggaaagagaacuacaaagacuguccuggcgaagucaaaacauuuauccuggcuuugucaggugaggcuuuccuuccccaucgaggcacaguaaccauccaaacccccuuuaaucucccaugacuccucgcguccucaagcuccgcccccucuccucugccccgccccgaaguuugagggguguggaugguuugugaccccccuaccucccgacccucgcuucuucaccugacccuaaaccaucacugucccggagagucgggcuugggcacugcgaccgaaacccggaagcuccucggcucgggggugggguggggggugcugauggacuccacugccaagggaauaggaccuuucagacgcagaaccuucaccccagaaaaaagcacggucggggacgacuccccacagugcggucaggaucguccacaggcugaggagaaagccgaggccuuggucagacagaugcagguccccuaucuggccccugcccgcggcaguuccuuguguccuccgcuuccaucugucuuugccacaguuuccuuuuguguacaucacgguuccugacacuaaccugaccaacagggguuaguuaugggagugagacguaauugcuaucauuuguuuauugaacaguguuaauuauuuuugcuucgaugauuucacgucuucuucaaaacaaccuuaugagguagguaaccauuuuaaaccccacuuuacuguugagaaagcugaggcuuugagaacguugcuggacauugcauagcuagaagaggggcuagacagugacccagaaucgcuucccugacuccagggccaaucuguguaaauaaggcuguggaaacgcuucugagaguguugguguguucuacaaauauuccuugagcagcuacugugacauugcauuaagagcuucaaacaaagagaacuacccucgguucuuaucuuccaggagucaaugaagaaauggacagguuaugaguguaaugauguuuugugggugcugugagaguagucugaugaugauaaucaccagauggauuugcccagagacagcugugaacguagauucuccaaggaaaagagacgguacuccgaggaauaugcagagagccuccaaugcuuucucagaagccgcagagagggaaaaccuucauagcacaagacagauugaaagaaggauagugggaaccguugggaaguauuuccaaauaauuucuacuugggcaaugguuuucuugaagcugucucguguagccuuaggcagccuugaacuugcuaaguaguggagacuugucuugaaccuuguauccuuaguuccuuuauuucccaaguucugggauaaccagggcauguagaacagcgguuuugcaguuauaaagccaagccuauggagacuaaagcguguaguguuucuggugacuguccuauguggcuccccagaauuugccagaacaguuuaauagacaaacaugucugcugauagucccaguacauuuguccauuugaagugaucugauccuauccuugauagaucagaguauauuuauguauuuggcucuugacaucugggcaugaaugggugugugggcaugaauggguguguggccaugaaugagauguaauccaaaggaaaucuggcaaggguggccgcacaaugcccauuaaagagucuuucuaaucugaagcuaccacugaggcugcugggugcaugcagaugugcuuggucauguguuaggaauccuagagaaacuccaagcuuaaagaagcaaaauguaagccgggcagugguggccuuuaggcccaauacuccgauaggggcaagugauuuugaagccagccuggucuauagagcgguaguuccaagacagcuagggcuacacagagaaacccugucuugaagagaagcagcaaauguuccuucuccauuauucuccaaauacaaaaacaaacaagugagcaaucagcagcugguaacaagguuaugaggcuuuucuggugacccaugcuucuuaugagcacagaaucugaaagcuagaguuucacgguaaaggcagaggggccaaggguaagucaguccuuagcuugagauugagggucuacuacuguuaggaaauuggcuggcugcccuuccuacacaacaccaagcccccauccuuuuuuccuuuuuuuuuuuuuucuuuuuuuuuuaaccccagccugccucagaaccuaaacaaaguagaaaccugacuauaagcccucaggcccuccuaaugcuaucccccuuuguuccugcagcguggacccagucagcagccaggccauggagcucucugaugucacccucauugaggguguggguaacgaggugauggugguagcaggcgugguggcgcugacucuagcccugguccuagccuggcucuccaccuauguagcagacagugguaacaaccagcugcugggcaccauugugucagcaggugacacgucuguucuccaccugggccauguggaccagcugguaaaccaaggcacuccagagccaaccgaacacccccauccaucagggggcaaugaugacaaggcugaagagaccagugacagugggggagacgccacuggagaaccuggagcuaggggagagauggagcccagccuggagcaucuccuggacauccaaggccugccuaaaaggcaagcaggccuggggagcagucgcccagaagccccgcugggguuagaugauggcuccugccucucucccagccccagccucaucaauguucgccucaaguuccucaaugacaccgaggagcuagcuguggccaggccagaggacacuguggguacccuaaaaaggugaguaggccggagagaggccaguugcucgugacuuguuccucagaugaugguuuccugaagaagcugugcauauaugugagcacaggagggauuuuaaggggaaauggagacuuccauagacagaccuucagugucuuucauguccaggccuugaucucucuagccuuauucuuuauccagucuuuccuuucauccuuguagcaaauacuucccuggacaagagagccaaaugaaguugaucuaccagggucggcugcugcaggacccagcacgcacacugaguucccugaacauuaccaacaacugcgugauccacugccaccgcucacccccaggggcagcaguuucuggccccucagccuccuugaccccaaccacugagcaaucuagccuuggugucaacgugggcagccucauggugccuguguuuguggugcucuuggguguggucugguacuuccguaucaauuaccgccaguucuucacuggaccugccacuaucuccuugguuggagucacagucuucuucagcauccugguauuugggauguauggaagauaaggacaucaggagacaaagaaaggcauggucuuccuccuucguggccucccuccuuuccuggccagagcugggcccaaggaccugggagggagggauaggaaggguaugguggguacccuguccauaggacccaggaagcagguguguggccucccuucauguccagaggguacagauaucucugcaagcacaacucagguagaaaugaggauaucaucuucccucuuuuggaaucccaaaguucacaggccaagaucagugagaagccugggcucugggucuucccuccuggcuguggcccagucucuugcaugucuguucccuaacccccaggguugcugccaggacagcucagcauggccuuagcauacuucuguaggaagccucaaguaccuuccacuccuuagaugaguguggaccuuuugaaacuaaauucacagggaugaagacugccagccagccuucccuacagcacccagcugccaccaccuccuccuugugccccuuguagcaggaauaggauauuuugcuuucuuuuaaagcacuuugcuugcucuuuuuuuguuuguuuguaaauaguccuguauagagcucagucaggaaggggaguggggcagaaggccaagcccccagcauugaggccaggccacagcugcuguuauccuaggccucuagacugcaagaguacuggcccuaauccagugcccugcccaguuccaaggaugagcucuggguauagacugcccuccccuaagcccuuagauggucaguaugaaugaauaaaaauccauuuuguggcuauggagccucuuugugacugcucugcccucagcaacauggcaaugagagugggcaggccgggcuaccaacgggaaaugcaguuuauuuacaccagcagccaugagggcagaggggaauacacagcguuuacaaaguuagcuaccuguacaggauggauuacauaugcaaaaauaaaaaucucaagacca

SEQ ID NO: 6421 - RNA, 4496 nt, Mus musculus
uggucuugagauuuuuauuuuugcauauguaauccauccuguacagguagcuaacuuuguaaacgcuguguauuccccucugcccucauggcugcugguguaaauaaacugcauuucccguugguagcccggccugcccacucucauugccauguugcugagggcagagcagucacaaagaggcuccauagccacaaaauggauuuuuauucauucauacugaccaucuaagggcuuaggggagggcagucuauacccagagcucauccuuggaacugggcagggcacuggauuagggccaguacucuugcagucuagaggccuaggauaacagcagcuguggccuggccucaaugcugggggcuuggccuucugccccacuccccuuccugacugagcucuauacaggacuauuuacaaacaaacaaaaaaagagcaagcaaagugcuuuaaaagaaagcaaaauauccuauuccugcuacaaggggcacaaggaggaggugguggcagcugggugcuguagggaaggcuggcuggcagucuucaucccugugaauuuaguuucaaaagguccacacucaucuaaggaguggaagguacuugaggcuuccuacagaaguaugcuaaggccaugcugagcuguccuggcagcaacccuggggguuagggaacagacaugcaagagacugggccacagccaggagggaagacccagagcccaggcuucucacugaucuuggccugugaacuuugggauuccaaaagagggaagaugauauccucauuucuaccugaguugugcuugcagagauaucuguacccucuggacaugaagggaggccacacaccugcuuccuggguccuauggacaggguacccaccauacccuuccuaucccucccucccagguccuugggcccagcucuggccaggaaaggagggaggccacgaaggaggaagaccaugccuuucuuugucuccugauguccuuaucuuccauacaucccaaauaccaggaugcugaagaagacugugacuccaaccaaggagauaguggcagguccagugaagaacuggcgguaauugauacggaaguaccagaccacacccaagagcaccacaaacacaggcaccaugaggcugcccacguugacaccaaggcuagauugcucagugguuggggucaaggaggcugaggggccagaaacugcugccccugggggugagcgguggcaguggaucacgcaguuguugguaauguucagggaacucagugugcgugcuggguccugcagcagccgacccugguagaucaacuucauuuggcucucuuguccagggaaguauuugcuacaaggaugaaaggaaagacuggauaaagaauaaggcuagagagaucaaggccuggacaugaaagacacugaaggucugucuauggaagucuccauuuccccuuaaaaucccuccugugcucacauauaugcacagcuucuucaggaaaccaucaucugaggaacaagucacgagcaacuggccucucuccggccuacucaccuuuuuaggguacccacaguguccucuggccuggccacagcuagcuccucggugucauugaggaacuugaggcgaacauugaugaggcuggggcugggagagaggcaggagccaucaucuaaccccagcggggcuucugggcgacugcuccccaggccugcuugccuuuuaggcaggccuuggauguccaggagaugcuccaggcugggcuccaucucuccccuagcuccagguucuccaguggcgucucccccacugucacuggucucuucagccuugucaucauugcccccugauggauggggguguucgguuggcucuggagugccuugguuuaccagcugguccacauggcccagguggagaacagacgugucaccugcugacacaauggugcccagcagcugguuguuaccacugucugcuacauagguggagagccaggcuaggaccagggcuagagucagcgccaccacgccugcuaccaccaucaccucguuacccacacccucaaugagggugacaucagagagcuccauggccuggcugcugacuggguccacgcugcaggaacaaagggggauagcauuaggagggccugagggcuuauagucagguuucuacuuuguuuagguucugaggcaggcugggguuaaaaaaaaaagaaaaaaaaaaaaaaggaaaaaaggaugggggcuugguguuguguaggaagggcagccagccaauuuccuaacaguaguagacccucaaucucaagcuaaggacugacuuacccuuggccccucugccuuuaccgugaaacucuagcuuucagauucugugcucauaagaagcaugggucaccagaaaagccucauaaccuuguuaccagcugcugauugcucacuuguuuguuuuuguauuuggagaauaauggagaaggaacauuugcugcuucucuucaagacaggguuucucuguguagcccuagcugucuuggaacuaccgcucuauagaccaggcuggcuucaaaaucacuugccccuaucggaguauugggccuaaaggccaccacugcccggcuuacauuuugcuucuuuaagcuuggaguuucucuaggauuccuaacacaugaccaagcacaucugcaugcacccagcagccucagugguagcuucagauuagaaagacucuuuaaugggcauugugcggccacccuugccagauuuccuuuggauuacaucucauucauggccacacacccauucaugcccacacacccauucaugcccagaugucaagagccaaauacauaaauauacucugaucuaucaaggauaggaucagaucacuucaaauggacaaauguacugggacuaucagcagacauguuugucuauuaaacuguucuggcaaauucuggggagccacauaggacagucaccagaaacacuacacgcuuuagucuccauaggcuuggcuuuauaacugcaaaaccgcuguucuacaugcccugguuaucccagaacuugggaaauaaaggaacuaaggauacaagguucaagacaagucuccacuacuuagcaaguucaaggcugccuaaggcuacacgagacagcuucaagaaaaccauugcccaaguagaaauuauuuggaaauacuucccaacgguucccacuauccuucuuucaaucugucuugugcuaugaagguuuucccucucugcggcuucugagaaagcauuggaggcucucugcauauuccucggaguaccgucucuuuuccuuggagaaucuacguucacagcugucucugggcaaauccaucuggugauuaucaucaucagacuacucucacagcacccacaaaacaucauuacacucauaaccuguccauuucuucauugacuccuggaagauaagaaccgaggguaguucucuuuguuugaagcucuuaaugcaaugucacaguagcugcucaaggaauauuuguagaacacaccaacacucucagaagcguuuccacagccuuauuuacacagauuggcccuggagucagggaagcgauucugggucacugucuagccccucuucuagcuaugcaauguccagcaacguucucaaagccucagcuuucucaacaguaaagugggguuuaaaaugguuaccuaccucauaagguuguuuugaagaagacgugaaaucaucgaagcaaaaauaauuaacacuguucaauaaacaaaugauagcaauuacgucucacucccauaacuaaccccuguuggucagguuagugucaggaaccgugauguacacaaaaggaaacuguggcaaagacagauggaagcggaggacacaaggaacugccgcgggcaggggccagauaggggaccugcaucugucugaccaaggccucggcuuucuccucagccuguggacgauccugaccgcacuguggggagucguccccgaccgugcuuuuuucuggggugaagguucugcgucugaaagguccuauucccuuggcaguggaguccaucagcaccccccaccccacccccgagccgaggagcuuccggguuucggucgcagugcccaagcccgacucuccgggacagugaugguuuagggucaggugaagaagcgagggucgggagguaggggggucacaaaccauccacaccccucaaacuucggggcggggcagaggagagggggcggagcuugaggacgcgaggagucaugggagauuaaaggggguuuggaugguuacugugccucgauggggaaggaaagccucaccugacaaagccaggauaaauguuuugacuucgccaggacagucuuuguaguucucuuuccguaggggucaggggaggggcuggcaacucaggauucuguccaggguccgaucucuuccggcuuuucucggaagcuguuaacauccaggacaggaagucc

SEQ ID NO: 6422 - RNA, 8983 nt, Mus musculus
cagaugcacgcgcucgggcccuucuagcaggcgcgagcagucgcugggcgcgcgaaagcgaaaggaggaagaggaagggagggcgagggcgggguguugaggaggggcgggaggaggaagaggaggagguuggagcgcgcucgcgccuggccucgcgcccgcgccgagggaggggggagaggggcgcgcgcgcgcacgcucgcguccucgcucgcuccauccauccauccuccggucgcggcacgcgcgcgcgcuccgggcucgcgccgcaccccccgcccgggagaggcgggcuggaguggggggcggggggaggggcgcgcggacggcgcgcggacugcgcgcgggcggggugaggugaggaggaggaggcggcgacgggacgagaagggaggggaaggggccauggccgcccggugaggcggcgaggcgggggggcagcccgaccccccggccccgggccccgggccccggggagaggcgaggacggaccgacggacauggggcuccggagcagccgccgucgccgccgccgccggaggacgcggcccugagaggccgccgggccccggcgcggccccccgggcggggugaguacagaacagggacgggggaggggccugcggggggcggggggcggggcccgaggcggggcuugggcccccuccccccaggucugggucagcgccccuuccccucccccagggccgacgcggaaacgcccggcuuuccccggcuucccggccgggccggggccccccggucucccccuggcuggguccuccuugggcggggcagggccggccggggagggggcgcggggccuuuguuagggagccaggccccagcccccgggacaauagagacacccucccggaauccucuccccggcccguccgggaucugggcaggcggcgaccuaguggggucgggacgcgucccacucugcuuacucucugggggucggucugucccggcccgccgccggccuaugggcggcucggcucuccuccccccagucgguaugaugcagcagcagugccgcaaggacgggagaagagccgcgacacggccugcuccccuucccagugccccuggcucauuugucaguccccaccccacucgaggccggcagcuucuuaaacucguacccacucuucaguggggccccgaacugugggcacuguuucugaauccuacggugggguuuuuggacuuuggggcucuuggagagacuuccgggcugguccugagggagggagggugcgaucuaaaagaacagguaaggggagugcccacucgcgugcguaccacggggcucuccucugcucacguucuugguggcuggaaaugcccuuugccuguaggcuucucugggcucuguuccucucguagaguggcaggcuuauuuuaagagaagacagaguggggugaagguuguaggguguuagggccauuccuacuucugguagcaguacccccccaaguggacauccuggcugaaagcagaggugacuaugacagcccuuagggaaacggggguugucuugaggagucugugcaguucuuugccacacccuguggguuugcuuugaggccuuagaguuccuucuccucccccugcugcauugcaccauggguaucaaagagggguuugaguuuuggguaccugggaugagcugcugccuccuauagaccuagagucugauuggcaaggcaguacaguucagggccugagcuuaggccugggaaggacuaggccaccucugguucucaggcccugaaggaccaucuagaccuagugaacggggccuuggggagggagacacacugaugccaggauuaagcccugggcuuggagguggggaggggagguggcagucucuggaggugucuuggacucacaccaacacccccaccuccaugugugcagccguguugccgcccgcugugcuaugagcagucagagcgccgucuccacaagaguuuacaaaugaaaauggaggaaaugucuuugucuggccuggauaacagcaaacuagaggugagggcucccccacgugugccuccgguucuuucucucaaugucucugcguccgucgcuaaaucuggcaucugugccaaaggaggaauuuggguagucagccuuguuccuuagagggaauaauaaccagcugaaagguccaaggaucugggaggaagaaggaacucaaaaaucaaggucaggaaaguggcaaagaaagcagcaugcuuggucagggccaggagauuugguuggugagaguuguucagucaagguggggugcuccccuugugaccauggaugcugguguucucuuccggggcccaggccaucgcucaggagauauaugcugaccuggucgaggauucuuguuugggauucugcuuugaaguacaccgggcuguuaaguguggcuacuucuuccuggaugauacggauccugacagcaugaaggauuuuggugagccucaggguggaaggggaguggucuagcucugcccaggaagggcuuagagcaguccuuuagaaacuguccuauuuguagagccuggagcuccugugagcuuaggcaagaauggauuuaaagagagccugggaccauaggugaggacaagaaguuaggguacccugcccgcucugaucgccacaccucuccuguccccagagaucguggaccagccuggguuggacaucuuuggacagguuuucaaccaguggaagagcaaggaguguguuugccccaauugcagccgcaguauugcugcuucccgcuuugccccccaccuggagaagugccugggaaugggucgcaacagcagccgaaucgccaaccgucggugagaaccucaugcuuccagcaccagugaugcgcaacuugugcaauugguaccgagguguagucuuauggggucacugguaggguacagaagggggggccacucuugguccucacgugcuucccuauaaauucaugugcagaugggugauauccuuuagccuugacauuuuuucuucucaacuuugggcaggauugccaauagcaacaauaugaacaagucugagagugaccaagaagacaacgaugacaucaaugacaaugacugguccuauggcucagagaagaaagguguuuugggggucuggggaaaccugggagaagcuggggugaaggaaauaguaguagaguauacauuugccauaaacugucuugaugggggaagaauguaguuuucaaaaacauauaaauauucugagaacaagagcguaaaaguaacuguguuuuuuguccuguugucccccagccaagaagagaaaaucagacaaggugagagcuggggcgagcaugggggaaauuugggugaaggacagauacccuuccuuuggggcagggauugauugcucaggucuuuugacucaagugugaggucacugggggggcaucccuggguuugggaguaaggguguguggugggcaggggagcugcagagguuuugugggcgggcgggcgggcgggaacauagccgucuuaccgggaggaacaguaaacgcuugagguuguuucuuugucaaaucuuuuuuccuucccuggguucucggcucccccuuaucauugcccuuuccccaaagcuaugguaucucccauuccagaacccuaauuccccucgaagauccaagucucuaaaacacaaaaaugguaaguggggcuagaccaacaggggugcugcuagcuauguuauuuauuacagggcuuguagugggggugagggagggccugugauccuucugucacccccacuuccucucugguuauuuucaggguucucugucuguaccucugcaucaaacacccuuccccuucuuuuuucuucuucaggggaacuuagcaacuccgauccuuuuaaggugaguagaugcugcgcuucugcgcuucucccuguuguugugaggcgguugggauuuggacgagugaggccaggaugcugacaacuacagcgcuuguagcucuuuagguccuggguguugaugcucucugugggccccgucucugugucugcgcaggcuggaggggcuuuuggaggacuacuuggaggcaggggugagcgggccugcugcuccauccgcuccuuuucuggcugcccucucuuuacuucucugacccguuuuucacuccugaccuaccucuacuucucucacaguauagcaacucaacugggaucagcuaugagacccuggguccagaggagcugcggagccugcucaccacggugcgcaacuggagaggggaggggguuugcuuugggcugggcaacggguaggacucugaaggagacagaugacauagcagcaggagccauaguuuucugugaaagugggcuuccucugagguugguuucuacguggucagucuagcguuggugcagagggaguaucuaguguuuggaccaggucuccugccccucuuuucagcuguguucuuuuuccagcaauguggagugauuucugaacauaccaagaagaugugcacaaggugagcguggaaaccugaaagggggcugggcaugggucgggguaccgcaccccuggaucugagcagugggcucccguccuuacccucccgucaucuaucuaauaggccugucuggggacccaccaucuggggauucaccacuggcucuuucccugucccucuagcuucugcuucaccugagcuccugaaguccuucccugccuugucagggucugaucauucuguccccaccaggucacuacgcugcccgcagcacacggaugaacagaggcgaaccguacggauuuauuuccuugggcccucggcguaagugaccuuuccaaaaggggggugggucagcuugcugaucucuuucccuaacgugucucuuugacuccucuuucuagcguucuuccagagguagagagcuccuuggauaacgauggcuuugacaugacugauagccaggcccucaucagccggcuucagugggacggcucuucugaucucucaccuucugauucaggcuccuccaagacuagugaaaaucagggaugggguuuagguaugccaugcacuugaucucaggcucuuggcaguggggcacccuucuccuuccucagcugcaccuucauccucugugccucuuuccucugcagguaccaacagcucugaaucacggaaaaccaagaaaaagaaaucccaucugagcuugguagggacugccucuggccugggcuccaacaagaagaaaaagccaaagccaccggcucccccaacgcccagcaucuaugaugacaucaacugacuugggugcaagggauagccuuuggcugagagagcccucucucccgacccccacccaggcagcauagccuggcauauggacagcugcugggggucugggcuugggaagcuuggugggccaggcaggcagaggauccaauuaugugccccuggggggugucaggauccucugcaacggagcaugaccccucggcgugcgggacucagaccuggacauauuaugccuuggacauaaguuugguggggagacgguuuuccuauuuauucugugaguuacuggauguccagcuaggcugggggccugaccugggcacugugccagggcacugccugcuccccaccccaggaacuggacuaagcccugccgaggggcaucguggcuacccaggcggcuuuggguuggaagcugagcccagagggggccuccccuggcugcccucagcaaugugaaagguucggugcuuggagcugaggggcagggcugcuauguccuguuugugugcagaguccuaucagauguccccauuccccggggucagcaggcacagugcugucugcuacggugggcauccagaacugccucacaggaggcagcccuuuccccucaguccccaugggccuccuuggcagcaggagcuguccuuuuguuguugggugccgggaaaggaccuccagccucuacagcuucaaggaaugggaaggggaggguaggaagagggagccuguaucagaguggcccccugcccucccugccccagggcugugagauggcccaggugagagggacggugcugcuuuauuugaaauguuucuuaccucauucccugccccaggaaggggcccagccucacccuccugggguggccccguguucucccucccauccugcccccugcccugcccugcuggggcagccugagcucccagcugcugcuugccccccacccccuuucccuugaccagcuucaguuccucucagugcucucgccucuaaagccugcccucucuccccucccuugccgcuuuuaaguuauuuauucuguacuugugguuuggggcucugaggaaaaacccuaaucuugugccucucucccuuugcuaggaguaggaugggaugagaagguagucucugcccuggguugucaguggaguuaggaggggugcucuugccccucugugggacugucaugccagagcacucaccuaccugaccuguaucccaccucccagcagguagcaucacaccuuggagcuggaagaucuggcuaugggcugauugacagggaugggguugauccugagccuaguuuucuggcucuugcuauacauguccccucuucccaggaggaggcacucccacauuggguagcuaguacccaagacugguuggacugauuuggguuagggacccagcgggcuaagggaacaaccgugcuagggcugcagcgcccugucuggaacccagucucccugggguggcgcucauuguggcugaggccugcuuacaaguugauuuuuaacccaaguauugugauuauuuuuuaaaaagucaagcuaauuuuggcaggaguuagaauaaauccuuggagccugggccccucuguccuuggcccuccauagccuucucgcuagagggggaaagaagguucucgggccggccccacuaccaagcauagcuugggaaccugcugaaggucaggggaagccggcccagguucuuaucccuuuggaguagcugcagcucaggccaacucacucugcucuccuucccaccucucccuuuucccucugguuggagggaguaguuugggaacugguuuguccacaaaaacuuccccauuguuccuuggcucacccucagggcagaacccccugcccaggcugggugagagaugggcuugguccagcagggacccugagggaacaaaccccuucuuuggggaguaugcccucccuacuguguaguugaacaggggcuaggaacuccccacucccucccucuaacagcaggcuguguggguuucaauucccauccuccccacccuggcuaggugucguccacccuguauccuaucaugugucuguguguggggggguucuguacuaauuuccauggccgguggcuuuuccuuccaugcaucacucccccccgcaugcccaggggccacccgccuggcauuaccgcaugcuggggucauugggggagggggguggggcucacgcuguccuguggucuugagauuuuuauuuuugcauauguaauccauccuguacagguagcuaacuuuguaaacgcuguguauuccccucugcccucauggcugcugguguaaauaaacugcauuucccguugguagcccggccugcccacucucauugccauguugcugagggcagagcagucacaaagaggcuccauagccacaaaauggauuuuuauucauucauacugaccaucuaagggcuuaggggagggcagucuauacccagagcucauccuuggaacugggcagggcacuggauuagggccaguacucuugcagucuagaggccuaggauaacagcagcuguggccuggccucaaugcugggggcuuggccuucugccccacuccccuuccugacugagcucuauacaggacuauuuacaaacaaacaaaaaaagagcaagcaaagugcuuuaaaagaaagcaaaauauccuauuccugcuacaaggggcacaaggaggaggugguggcagcugggugcuguagggaaggcuggcuggcagucuucaucccugugaauuuaguuucaaaagguccacacucaucuaaggaguggaagguacuugaggcuuccuacagaaguaugcuaaggccaugcugagcuguccuggcagcaacccuggggguuagggaacagacaugcaagagacugggccacagccaggagggaagacccagagcccaggcuucucacugaucuuggccugugaacuuugggauuccaaaagagggaagaugauauccucauuucuaccugaguugugcuugcagagauaucuguacccucuggacaugaagggaggccacacaccugcuuccuggguccuauggacaggguacccaccauacccuuccuaucccucccucccagguccuugggcccagcucuggccaggaaaggagggaggccacgaaggaggaagaccaugccuuucuuugucuccugauguccuuaucuuccauacaucccaaauaccaggaugcugaagaagacugugacuccaaccaaggagauaguggcagguccagugaagaacuggcgguaauugauacggaaguaccagaccacacccaagagcaccacaaacacaggcaccaugaggcugcccacguugacaccaaggcuagauugcucagugguuggggucaaggaggcugaggggccagaaacugcugccccugggggugagcgguggcaguggaucacgcaguuguugguaauguucagggaacucagugugcgugcuggguccugcagcagccgacccugguagaucaacuucauuuggcucucuuguccagggaaguauuugcuacaaggaugaaaggaaagacuggauaaagaauaaggcuagagagaucaaggccuggacaugaaa

SEQ ID NO: 6423 - RNA, 14916 nt, Mus musculus
gucaaaccuugguuuuucacuuuauuauacaaaaaaaaaaaaaaaaaggggaaaacaaaaccuccacagugggccuugaucugggacagucacgucuaagccgcucccgugguacaaauucaaguguggugguuguugaaaccuacaaaagacuccuuaaauauuagaaaaaaggagaagggucccagugcugaaauauauccugggcaaccucugacagcaccaacaugucccacccccacagcccuaccucuaagaauuuuccaauacuugcagugggaggaacacauguccuguucaaaguuguuucuaagugaaaacgcauuucacucaaguguaacaguccaggguguucaaacaaggagauggaguucucugcaagcccucucaggaacuuaaaacccugguacuaaauuuuagaauaaggacagugugugugugugugugugugugugugugugcgugcgcgcgcgcugagggcaggggguggggugggagggaaucuucucuuuaggaaucuccaucacacaguccaggcaaaugucuuugcuuucaagagggacuggcagcugggcugcagccuacuuucuguggagagccuacuucccaccucuggcuuucauuuaagaagcaaaacccaauagcacgaacaaaaauucuggccaacauaguaaaacugauaaucaccacagguaaaggugacuaggauuucaccgucaagggacugacccucuucagaaggucccaaacugcuggcaagcaguuagaggagcaguugcagagagcaucuucugcauacagggguggcggcaggaaagagggagcagaccugagaacucaaaggaaauggggauggccagaggacacggggcaaggcaggaagaacuuccugaagcccagggcaccagagaaaagcuuuaaggcucaugccaugguuugccccucccacuuuccugcuggacagcacagaccugcagcagcucagggacauggccuuggcaggggcaaacuaguauaggaagcaucagguggugucccugaaccccacaauggaagauggcagggaggggcagccuugguuuguuccugcuagggacaccaucucccaggccucuaccgacccuuuuuccagauucaaagagacaggcucuagacacacacacacacacacacacacacacacacacacacacacacacacucuucucucucucuccuauccacaggcgcagucaugcuguaucgcucgcucacgugugugcacaucacacacacagccucacacacacacacacacacacacacacacacacacacacagccucacacacauucuaugcauaccuagaccuuuuuuuuuuuuuuaagucucaauccaccccaucccaggcccucccagucccagaaaugacaacagagacggcagccgagaucgguaggaaacgucucguugacagcucagagcuuaaaaaaaaaauauauacacacauauauaaaaaaacacucugccccucccccacgaacggguccaggcagcuccuuccugcaggggcagggaagagggacagggccacugccugcuuucuugaaggcagcacccuugucucccuccaguucaaugugggggguccagguagcaagcccaucugggaaggaaaggccccccgaacauccaccuugcugcaggcugcagguguggaggucucaccaaacucuuuaagacucucucccacccccaaacuccccaguccauuguccaugccggaacugcaaaugcagaagaggggcagggugggcccguccagcgcuggcucagucugaugguugcugucccuggagaacccuggagcugaggcuccaaggcugcagaguccuagcuugggcucaugcagccuccuaccccccacugauuuaaaaaacaaaaaagaaagaaagaaagaaaguggggaagucuggaggguacgggacagaacacagggagagacaaagguugucaaagguugucaguuggggagaugagcucugcaggggcucucuccuuggcugccugccugccugccugccugggguggaggcugagccucaguuggagucagaauccgaagaguccccugaggaugaagagcuggagcuacugcccucagacucguugucuucauccucaucgucgucaucuucgucaucuucaucgucgucgucaucaucauucugggagaauaaagaccccaccgucaccguguguguggcccuccuggugaucuacaacaacccucccucccaccacgccuccugcccaccucauccccauccucgcuuucaucuucacugcuggacucagaagaguccccgccauccucagaagagucaccguucucaucaucuuccucuuccuccuccuccucgucguccuccuccuccucaucgucauccuccucggacuccugggagguguggagacgcaucagcagccagauacacccaccuugccagccacccacccaccuugcaggggugccuuaccgacuuggacugcagggugguccggcuagacuugggguuugggccucggagcuuggucauguucuuacguuucugacagaaaggaugggaagggggcugaagugagucccagccccugcagagucccuccagccucccccuccacugccuugugcuccugcuuacauuggagauguauucuuuguaugcugcgcgguccuggggagacaggcucuggggagaaagaacugggaauaagaucaaccccauccuacagcuggcugcauacgccgacguccacugggcagagcucccacauaccuuaucuuuacacucagucuccuaaacuuugggucccugcagaaagcuuuuaggggcucagaacauaacuccugauucugaacacugaaccaagucaguuuucauagcaaugcccuacccccaacugccguuuccaaaugguagcccuguaccuagggcuucuuuaacugcaaagcaugcccccccccaaugacucacgaggucaaccccaccuggaccccagucuuugaaaugacgacgaagacugacaaaauucuugaacacugaauuccugccaucccucugggucuuugguuagccuaucugagugacagguaauucucccuggacaaaugugaccauucaagcacagcaguggagacugccagccuagccaggcccuacaagucuccugguccuugcuugaacgaagagcacccagucuacacaaacugucuacuauguaaccuuggcaaaugacuugauaccuuggcuugcuuagcuuuaaaaaaugucaguacccacugccccgcaggacuucccagucccugcaggcacucccuuccaaggugccuuuguccucucucucaccuugacccagagguccaagugcaccuuguacugccucuguugcuccuccgccagcuucuuauagugcuccuucuggcucugggagaugcgcugccagcggcugccaaucuccaccaugcgcuccuucagcggcaggugauuuagcuccccauuggacagcagcuccugggagaacuucugguaaccguuccugcagcguggggugacagggacagucaggguccuaagggagccgccuucuaagcccugucuacaccauaggucccagccucaggcuuacauaggagguuucuuggguucucccuggaacuucaucuucuuggaagaguuuguagcagcuggaggggcccgcaucucacuuaacucucucuguggagagagacggagaggucacacccacacccgcacuccccaccccacuggcgggggagaucucaacucggcagagauuaaggcaggaggagcuagagcugguagugguagcuagcugggauccauagcaggacucuucucaaaacaacugcuggacaagucacugcaccaagagggucguuucaaaaauguucccugaaauggaaguagucccgucccgccccccccccccccccccgccaaaaucacccaagaggcuaguaccuugacgcccaccuagccuaugccaggccggaaguuaagagacuggcucagggucuuaaacaaagcuggcccuccuggcccaucauggaggcagguggcccaaccccuucccaccucauaucguuuuuggucuucugcugccuucuuaauccacaucagcuucuccuucuucuccauguuguuccaagucaucuccauggcuuucaaggcuuucacccggucauucuaagguacaaacccaggauaucaguuaugggagggggucuguugcuagagaccauaaaccgauccuuccccacucuccgcuaccuugaagcgggccagauagucuccgaugacacucugcugccagaucuccucagcccucuugggcgacuccggcagcuugccccuaucuucacgcuccccgcccggcuuccucucagacugcgccuucagcgcagccucccgggccuuguauuuagccuauagaaaaagcaaggauguuaacauucgggccaccccuagggggcgcgcuaagcccacccagcauucguugccggcucccuguugaggagggcggguccggcagaagccgugggcagcagugacguccaccaagcuccgccccacccauggggccgcucuccaagggagccaacaaggaagcugaaagcuucccuucuuccggcucccgccccagcaauugagcccggguacacgguacacgugugauucacuucuggugccggggagcggcuguaaccgcgcgcauggaaguggcccaggagacccuuagggaagaguaguagggggucucuccaaggcccgaccuucuucuucucggacaagucguuccacaugcgggccagaaggcgggucaguucgcuuucggagagcucaggucguuccuccuguagcugccuucgcuucuccucagagaagaugaacauagcagacacaggccgcuugggcuucucggagccacccuaagggaaguacggggaguaucggagguacaauugccacuagccuccuccugugagcggcuccauccuggcccccacccccacgggcaugggacacucaccuugccaccuuccugugaaggcuucuuggaggccggacuggugguuugcuucuuauugauguucagcaucuucuccucccccagaacccgcugcugcucuuccuccggcaagcucuagguaggaagaaggguauggggcugcagcaggcagguaggccggcuccucggacuccagaaugcgcccucugcccaccucaagguggugccuacuuaccucaaggaaccgcagcagcucuaccucauaaucuuucuuuuucuaggaaaguaaggggauucagugaguuggggucagccuccauucuccugggccagccagccucagcaggccccuagggacuggguguauguaaccuucucacccccugaagauggcagccaagaggccugacagacaggggaggcuaaacccggcccaggcugaaggcagguggcugaggcaccuguaaucagugaguuacugagcccaggcaaagcucaugcgcuaaaccccaagucaagaccccgagcucgggguggccuggcaccugcccugcgcaccuggucacauuucuugugauaggcauccuucuccuucugagagagcagcuuccauugcuggcugcauagcaccaugcgcucugugcugggcacauccuucauguuggccaugagcuccgcacaguacagggaguagcuguuccuauugaauccggaggaaggcacacccaugagcaaacgggacuggguucaaguucuucacgaacaacucccugauggcccacucgcccacccauccagggcggugcucacggaggcggcuugguaggucgcccaucgaacuuguccuugagcuggcgcucggccuuggugaggguggacuuggugaugccuuccucacugauguucagcucagggugcuucuggauauagucccgcauaaucuccugcagagggagguaggggagcggaggguaauggggugugggguuagcggggacaacauaagggggagagccgcuggggaggggaggcagggagcaaagcuggggauggccgugugucugugugucugcugugucaucugcaauaugguguccugcucugcccuagccugagaucucucgggugggaacggggcuuguaagacgguagggacagaggaaaggggcccaaaaggccccucccucaguagaaggucagggaacgacugccacgugcagaacgcuguggcacgagucagagggcaaaggcucgugaagagccggauggggaggagcgcagcggaagccuaaccucguacuccuuccgcugcuccagggccuuaugaauccauuucagccucuuuuuguccgagagcugagaccacugcuuccccagggaguccuucaccuccuucguaguggccugcaaaccaaaagccgucagacacacgcaggcagccaggggcaggggagggggggaggggcacagagggccccgccccccucgggccacaggaggucacgcaaguguccaccgcaggccaggaggguaagguggagaggcagggauccgccuuggugcgagggacaggcucacacacacacucauucgcacgccagcuggcccaggcccuguccaugcaaucccccccccuggggaggggccuccucuccugcuccccugcaccauacccagccaccaggcgcggcuccccccuugccaccgccgugugcccuccgccccuacccuuuggccagacacucacauccggccgcacuuugagauacaccuucuucucguggguguaccacaguugcuggggaguuuuggguuucucggggauguccgacuucuuggcauucuggauaaggucagggugauccucccuaaccaggggaccggagcaagggucagcaggggacaccgcuagggcagaccccagcuagcugcccaagccaagccuuuuaggccuuccugcaggagcucgguggaaguuuguggcuggcaaccugucccugccccugaaccugacacuacagucuacacaagacuuccacguuucauggacggucaguucuagucucagacaguacguuuauccuaccgcacccagugccccauagcccuccucugccuuaccugaaucgggccagguuucgcucgaacuccuguuucucccucuggaaguccugaauauauuucaucugaggggaggaggggauggagucacccaggacccaaggccuacuucacccagaucuagaaaaagccacccuccucugugacugccuugcuuccugcuaugauuuuagaugcuugguuccugugccucuagugagcuggacuuacauuaagcuuggugacuaacagccagauagugggauuuucagggagacucccagucacccaucuccauauuaagacagaaugccccagaagccaggagacaucacaucacccaguaggugaacugugacagguucggacuacccagcacuuucucuaauaccacauaacucccuugagucucguggcgcucucuggcugcugugcucccucuucccaccaucucuguggcagcugauguuggucuguccccucugggguggcuaacagcaccaggaaggcuuaauucugcuucugaagcagcagaggauauuguugaaggggcaggagaugaguucucacaacguaaaccaccucccaauaaauggccuaaaucugcaguuucuuucccauccagcaccagcucugggucuccggcauuccugucuucuuggucacuguccccuccugccuugucccuuccucugugcuccuggagccccaggcuuuuagaaaccccucccuccucuuaugccucuucccucuugcauaacauccauuucuccuuccuuccuuucucaauucugggucaagauagcacuggaaaggaccagaggcucacaacugaacuagacuccuccuuguaagaggcaccaggagcaagcaaggaggcagcucauuuccaccaugcuucccaacagaaaccagaaacagcacggccucccuagggcacccucaguccuccucagacgggaacuuaaaaggcaucucaggguucacccuccacgccucaaucaggaguacugaagugacuuaccugaaggaccagacacagccgaccggcaacaauaugacaggcccacauuagugugcccgugccuaagcuuucuccacucaaguuucucugucccucccugcuucugcuucuuagccucucucucccaccccucaggggucuggugguguguguagucacagucccaaguccucacccauggggucaauggcagcccugccaguuaaugcuacuugggcuuggguaugggccacagacagcugguuuuacccaaccaagccuaucccauuuuggauuuaacaguaagagcauaugagcucagccagauuaauucguuugacucuguguucuuugcccaccagugugcauccuucagacccuacugcccggcacugacacccuuggccucaucacccagcaucuccuccucacguuuggcucucucccaucuuuaacguguugaacucccuucaguauuuugcuucccugucuuccagggaaccccccugagcuugucuugggcuuuauccaucucugcccaggagguucggacaacguuuaccuaaaggccuacaccccugagaaucuggacaggggucuguuucuguaggaggaagcagccugaggcaaggagagaccguguacccuuguacacgggaaaacaaggucacuuaugugacgcggcagggggaagagcacuggagggcagaagagguuccaaacucaaguguguuccagcaucauuuagcuggaagccucaagcuacucagcacuccuaugccccaguccuugcucaggacaaccagucucuccccuuuccugggucucuugucuacucaaguaucaugguggguaggagaauggcugcacagauucacagggaguguggcuguuuggcugugggguacaggagcagucugaacgccuucaggguccuccccugcaauggguccugucugaccaugugugggccaggagggggauagguaccccggugaccuccaaaacaacuacacuguuguguugaccccuccacacgcccaauauggagucccuuuugucucucuaaggccuauccccaccccgcugaccuucccacaccagcugcccccuccugcaaguauaacuacccuccccacaccugagcccccccuccccccaccuucuucuucucuggaaguuccuuguauuucuuagacaggaucuuagucagguccagguugcucaucuccggguggagcuucgcguacuuggcccgcuucuccaugaagaagcggaaguaaggggugagagguuucuuuggaaaauccggguguuucuggaacacaggaaagcgggguuagaugccaccuauccuuuaaaccccucuucccugacgcgagcuucuccuccugguaacucaccuugagcuuuuugccuuuguaaggguuuuuaacauguuccugagcaucaaggaucaauucugucaauguacggaacuuccuuaccugggggagcaaacaggaagaaaggaauuugggaaacaucacugcauaguccagcaucccuuuacaguguuagcacugcccuccaccacacugaguucaaugaagaaaauaaagcgacaacauagauuauaggcaacuucugacccagaggcacucgcucauaucugcuacagaggcccaaguaguuggggacaaccuaagagcagucacagacugauuucaacguagcuuccaugccugcaucucauucagccccuagaguauccaaagucaccuagaagauugugguagaacugugagcacuaggcgguugcuaucgcccaggccacuuccuccccuaaggcauacauuagagcugacagaagaacacgugaaggccuucuguccaaagugacugguuugcuuuccccguuuucucugagaugaaaagcauauacacagccgggcgugguggcgcacgccuuuaaucccagcacucaggaggcaggggcaggcggauuugaggucaaggccagccuggucuacagagugaguuccaggacagccagggcuacacagagaaacccuguuucugaaggaaaaaaaaauagcauauacaauauguauuuauuuacaggagucaaaaagugggaagcacuuaccucguuagaaaucuccacccauuugagcuugcacauaucuccugaaaaauccuuaaacgcaacuuuuucccaauccaugugcgacucugugguuuugaacuuggagcugucguuggaugggagguuguucuucaugcauuccagcagagucagcauaucuuccugggaccagcggucugugacauguaagagaagucaccacaccuggcucaugcccuucucuugaucuguuccccagccucugaguucacccccuccuccccaaagccccugguugcuucucaucugaaccaguacauggcucaguccuaaaaaagaaaaauaaccgugguccuauuaaaucagggaagggacucuggaccagauaaaauaaccaccauacuuaaguuacacugggaauccugucuugcuuaccucaaagcaaucacuuuuaacaugcuaggcugccaugggccccuauuuacaguaugagauggagugggaagucuagugauuuagggccuauggacaaagggcucaucagaaagggagggaucagggaaagaacguaucuaaauguggucaggcucuaugugagugucaaacaugcaaggccugagguugaggugugaguccuaaggcucccagugaagaugucuguccagcacagcuggagaucaacaacuaaaggcagguacuccaccacucuagucacuuuaagggagaccaaagcagcauuucuggcaacugagaaaaguggaauucaaacauuagcaccauacacaguaguucugagaaaaggcaagcagguggacagaguucucagggccuuggucucuggagaaccccagaacuccaaguugacaucuuagcccaauuauuuucagcugcuaaagugcagcccagagacagcucugagccucucugcuauggaggcugggcugggggaacccuuggccaggaugcaaaagagcuccugacuuucauuugcaucugguaaccugggccgguuuccgcagaaaagggucacauggcccauaauccucucuccccugaugucucacaaacauuggcagaugcccaguuuccuacuacccuccaugucauaaacauaacacugcugacagagguggcuagggucggggcaucuauaauuccuaaggcuuggagccauaaaccacaauccccuucccuguuuuccaccugccucuagugaaaaucuccacuaaggugugauacuucaagcuaagaaaccaagaaggcuggcuuccaagagucuucccugugacccucauucauagcaagagaucguaaagacucaaguucuaagcucaaggccaaguaauuuggauuuggccaaacccccaugugacagaugcuucacuuucuaagacuuaagacugucugccagugcacagaacgaagccugagaggaaccuuuuacaaggcuggagagcucgugugugaaaaaagacaaguuugaaaagagaagcuggggacccauaccuuggccuuugggggcggccauuuccaggucugugggacaguccgcuucuccguucauucuccagcuguccagccaccuccucggucgcgcuggccgggccacccggggucaaagccaccucacccuuuugaagagacaccaaacccacuuaaggaggcugagaggaggggggcuuucuaucccacccccucacacaugggagggggcauagguccacacucucagcgagacccgaacaggaggcucauagacuucaucagugggugcaggagugagccccacucuucucuaccccagcccccagagccaggcggugccgcaugcgcccuccccugcccacgcgagagacugcucccagcucccgcgugcagcuagcucccgcccuccggccuccuucccccacccgggcaaaaaaaaaaaaaaaaaauucuccuccuccuccuccucggugagcgcccgccccggggaggccccaggcuggagggcgggggaggaagggcggguaaagggcgcgcgcgggcauggaagcgggcacgcgccucagucuccuccucccgcuuuuccccggccgguuccccccgccuccgcaacccggcggggacccggacgccgcgcagccgccgccagcccgggagcgcagcggccggaccgcccccggggacuagaucuggauucccgcugcuaccccccucccgaccucccaacgcgguccccgccuguccgggcaggcgagcagucggagaagcggccuagcuugucccccguccccgaaccacccggggccggagacgccgccgccaccacccagccaccccaacacgcacggaagaaacccggcgcagaggcgcgaccgcggcgggaacggccgccuccuccccgagccugcggcccagcccugccggcgcccccgccccggccuccggggagccgagccaagcagagggcgggaggacggcggccgcgaggcgggggcgcuucgcucaccggccccgccgcccccuccggcggccggcgagaacugcgccugucggccggagaaacgcgggcuccuccacccggggccucacuugggccucgcuuccugcccuuccuacccccggcucacggcgcccuuccccguucccugaucaucuugucuacaguucucccgguaucgccacucggcgucuaccgcagccgcggcucgcucccuagccccggccccggcgcacguccuccgccgccucgguuacccggcgcagcgcggccucugagcuccccgcuccggcggcucccuucucggcucugagcgcggcgcccucccccgcucggccgggcacagccgcaacucccucccgcggcggcagcggcuccuccuccgggcgcggcggcggcgcuggggcggcggcugcugcugcugcuguggcggcggcggcuguggcugcugccugcugcuccucgcggcgaaaagcacaaagcacagcgcccuccgccugcaggcagcccgcccgcccgcccgccggccccggccucagcucgcacaccccccgccgccgcagcagccuccgccgccggagcggggaggagggagaagggaggaggaggagcgggagggggggcgggagaagcggggcagcgagcgcguccuuccccguagagcgcacaccgacccccggggagcgagcgccagcccgcccgccucgccggcuccgcucccucccacagccugcccgggcgggcuccgcggggggcagcugggaggaggggcgggcgcuggggggacccgggcggccgaggcggaggcaaggaaggaggggagggggguggugguaguggcggcggcggcugcugcuguugcugccgccggggaaggggggggccgggacagggaagacacgcagccgcccggauggcggcggggcugcgagccgaggcgggcgagcaagcgggcggcuaaagcgaccucgccagccccgcgggggaacuagcaggcuuggccggcgcgggaggaagggagggccgaggugcggcgguggagaggguggccggcgagccucgcgggugccggcaacccugcucuggagcucucuuccaggcucucccagcuuaagcucgguuucccggccuaguccucaucugcuccucucucccgccuccgggagcgggcuagcgaccacccugguccccggagcguggcuaccggcuugggacucacgcucccggaucgcggugcgagguuucggcgccuaccucucgguucccuuaugcuccgcagaacacccgugaaacuuaaaauauauauucuuaguccccuaaacaacaaaaaccucucccgucccuccucacacccgggaaucggccaggagcugccgaccccagcggaagagucacucugggagccgguucaauccagcccggcauggcuauccaggccuucccgggcgcguggaggacggagauuggcgccgccagagagcaaccccuuucccccgaaauccgcggcaccgaggcuuacuuaccgagcaagugggugcuagugagggccgggggcgccaggcagcacggcaagcggaagagccgagccgcagcuccgcagcugccggcgcccgggcagcgagucuccagacaaagcccgagauggcgaagcggagcgacggcuaauggcgagccccacgcgccgcgcuccgcccgccccgcuccgcccgcccgcccgcccgccucggcgcagcgcagcgcagcgccgcuccgagcgcucgcccgucagagccgccuuggcgccgccgccucccgggccgccccggccucgccuggccccuccgccuccuccgggcggcucagccucaccccuucccucccaccgcucgggggcugcacgaaauuuuaaaaaaaggaauaguaaaaaaaaaaaaaaaaaauguuuuuugcuuuuuuuuuuuuuuccaaggcagauguuuuucgacauuuagcucuuuuuuggcucccagcucccacucaccugcggggccuccggcagggcugggggcgggggugcgcggggcuggagccgccgagcgcggguugaaagcuagccaagcucugcagcgcccgacccgggcguguacgccgccgccaguccccgcagagaaaucguccuccuacccccgccu

SEQ ID NO: 6424 - RNA, 1713 nt, Mus musculus
cgagguuucggcgccuaccucucgguucccuuaugcuccgcagaacacccgugaaacuuaaaauauauauucuuaguccccuaaacaacaaaaaccucucccgucccuccucacacccgggaaucggccaggagcugccgaccccagcggaagagucacucugggagccgguucaauccagcccggcauggcuauccaggccuucccgggcgcguggaggacggagauuggcgccgccagagagcaaccccuuucccccgaaauccgcggcaccgaggcuuacuuaccgagcaagugggugcuagugagggccgggggcgccaggcagcacggcaagcggaagagccgagccgcagcuccgcagcugccggcgcccgggcagcgagucuccagacaaagcccgagauggcgaagcggagcgacggcuaauggcgagccccacgcgccgcgcuccgcccgccccgcuccgcccgcccgcccgcccgccucggcgcagcgcagcgcagcgccgcuccgagcgcucgcccgucagagccgccuuggcgccgccgccucccgggccgccccggccucgccuggccccuccgccuccuccgggcggcucagccucaccccuucccucccaccgcucgggggcugcacgaaauuuuaaaaaaaggaauaguaaaaaaaaaaaaaaaaaauguuuuuugcuuuuuuuuuuuuuuccaaggcagauguuuuucgacauuuagcucuuuuuuggcucccagcucccacucaccugcggggccuccggcagggcugggggcgggggugcgcggggcuggagccgccgagcgcggguugaaagcuagccaagcucugcagcgcccgacccgggcguguacgccgccgccaguccccgcagagaaaucguccuccuacccccgccuccaucgcucugcguuucucuuccaaucagccggucgcuuggcggcuccuccagucuccggccaagccagcugccuagagcgagcuccacuccaucugcuugcccgacuccucgcucuccugucggggcgggcaaggcagcuugaggccggagggggaucugugagggauccugccugcucccucucccauugcuccauccuugcugucuccugccuccuccucuccugcguuuuuccaacucuccccugucgccacuggugugugucugugugcgcagguuuucucucucucucuuuuuuuuuuuuuuuuuauugcuuugcuuuugcaacccugaagcuaaagcgggaugggggcgaaggggaauguuacaaaaaagaaaaagggaaaaaaaaaagccuccuagguuugcaacguaugaaaauacccgggaaguaccccgccucguuugggucucggugcccggcgagggccuuccggauuucagagccagucuuggguuguucucgaugucccccaucuucaccggccguaugauccgaggaguuaagaacaaaaaguucaccccugugucguaguagggugucagugggaguuggggagguuuuucaagaagcagcggaacggccaucccuuuacccugggcuucaguaacuaggccgcgaccgggguagggguuuagagcaaaaucccagcgcguuugugcgaaagagcuggaagggggaagucggaaccgggaacggagcuucgugcgucucccccucggucucugcuuccaguugccugcaagcucccccuuua

SEQ ID NO: 6425 - RNA, 10391 nt, Mus musculus
cggccgaggaggggggacgggcgacugggggagggggugacgagcuccggcucagcaccucggagagcucccuccccggccuuguuuugcuccggaaucgcugccgggggagggagcaaaggggccggccuuaggcgucgaggccgagggauggcagugaagaagacgaagggcccccgggggcagacggcccagccgugauccugcgaggcgggccggggcgccgggugggguggggggcagcgggcggcgacagcaguggccgcacaucuggauggaagcgagcuuuguccagaccaccauggcucuggggcugcccuccaagaaagcaucuucccgcaacgugaucguggagcgcaggaaccugaucaccgugugcaggugggcgccgcuggcggucgggguggggugaugagagagguugaagcaggcugagaaaucuaaggguugagcaugcccaugaggaugcucugcagacacugagaaaaggcagggcagggaggaccgcgcucucuauccuuccuaggcccggaaccgggaggcgggcuggaaugucugguccuuauucuuggcuaagccaggccuaugcccagacugggguuugggggaugaagagaguuuaauuggcacugcaguuuccugugagaaccaggaagugacauuguguaugagaggggggaggagggaggauggcuggcucucuuccuggcagugggggcagggugggcaaagggagcucaaugggguugggggugaauguccuccaaguccccucugccaccccugccugcuuagcgucuuggaguggagcuuuccuaagagacuuuacuaugcucaacccuucauaaagcaaugaugguguuucuagguagcagcagccuguggcuggaccaauugugcacaaaggcccugaacccauccaaugaaggucgagagcacuaccccgcuguagggagcacccaaggccuaauugcagaaacuggggccccaaguaaagacugggagcccagaucccuaaaucccugaggguggggcaguugcagggcuaggaaaauucuccucuuucuuggacaccggaaaguaauccuucccacuucaaggcugcagugacucacccugccugcccugcccugaggccagaaagccaccagcugugcaggcucucucccaagcccccaccuguccuugccacucccucugggaucuccaugccagcugccuucuccaccugcagccuccauguccaauggggugcuucgucuuggcucuuagugcuccugggugugggaccgaguuguccuuucuugccagucccacuugcgugaacauaaaccacagcccuguuccuucuucccgaaaucaugcccaccugaugcccagucuccgguuacccaggguuccuuuggagucuggacacauacccagccauguugucucugugucagagcaccccuuugccagugucucgaaagucugugcacaucaccucugugaggaggaggcugggaugugcaucugugaccuagccggaagcacuuacugccuucauauuccaaaccugccaguguggugucaagagauuucugcccuugggaccauacuugggcucaagcuuuugcaucaguucuuagcugggcaacccuguggccgucucccuccuauccacacucugagccuuuggugcuuuuucuuagguuuuacaucuuagguguaaaaccacuccaaagaaugugucguggugugccgcguuagauacuagcuagugccuggcacacagaaucagcucuauuucaaugacauccuucuggccccucucuugguucuuggcaaucuaggcccaucuuuuucuugccugccaggagagcuggggcuuagugugugggaaaaggagagagagccacuggaccugagccagagaaagagagguucaagggacuuagagguagcucagagucgggggacaaggaauaguuuaagggcucgggggcaugacaaauucuccaaaucccgagggacccugcugccucauuacugucacgugguucuccucuagcucccagcagcucccuuuagcagacugcuggcuccccugggcccuggccucccugucuccaugguaaccccagcaguuauccuccuccuaaccagguccacaccaugggguuccuagaggcucugaccagcuuucagcaucuccaaggacagauagcagacgcugccaugcucaccaagccccaggccucuacugaagucugacccagaugaccacaaauugguggugugcauaacaaagcccagaaaauggccuuaucgcagucgcaggcucucucuuuccuggccaggccagccuugccuccucaccuggccugugcccaggaaucaauacacucucaccuucucccacccuugucugggaucugaaccaaaguugaaaggggcgagugcugguauuucuguuugcacccaaggaaaaaggcuuugaauccagcagccugcuuaucccuagcacaggcuaacgcugaccugucugcucuugggcuccauccccugauaagcccaagggaaggugacagagaggggcuccugguugugcuguuuacuugaaagccuuaguagccaauacuucaugacugggggcuucuaaaguagagggcagaggucacucagagcuuguuuguuuguuuguuuguuuaagacagggucucucuauguaguccuggcuguccuggaauauacuguguagaccaagcaggccuagacuuacagauccuccugccucugucucuugaguguugggaucagauaaggcgugugccaucaugccaggcuaccuuuuuuuuuuuuaagauuacauuuauuuaucuguuuguuuauuuguuugugugagcaugugccacggugugaauguggaagucauaggacagcugaugggagugggcuaucuccuuccaccguguagguuuugggauugaacucugguccaugggcuguggggcaugugccuuuauccacggagccagcucacuggccaagccucaguaauuagagcagccacuaggaagucguaagacagagcagaaagagccaaggauggagaaugggccaacuauuugccuuuucucauguuacaugacugaucauuccaucucuggagccuuuagccuccuuaccugugauauggggcagguugucaugagaggacucguuuccagggguuuuggcgaggacacacauaugaaauauaguucuggacacagugcauggcuugguuaaacauggauagaauaaaagcacagacugaaguuccuccuguaucccagggcacccggcuccugcucugucuccagaagcagagugguaaugagaugugaggagcugcgcacccucucccuguuccgcuccacugcauagauggcaaauggagacucuagcauaaggaugguagaggaugccggaggcugaagcagggcugcagagggcggugggggcugcuuggcuccaaccccucugccucaccugccuccuuuggauaccuuccuuccugagaaaccagugucugggcccccuggauccuuuccagggaccucuugccagaguuccuucccacccaauguaugucagacccacacccugcguucugcccccacaccccaagcuccacacugccuagcucugggcagcuggcgugugggugggcuagcugagaagagaggggaggagggaggucccagagcugaguguccaccuggucacgaaugcaugccuacauuccugcaugcacauucugguacaggugacccgaccccuccacccccagagaggagaguucauuccaacacuauugaaagauucuuugggagccuggguccaaacuuggcuucugaugccugguugacccucgauucacacauuugaaaaaugccaccugaagggugguagggacaaaggucuagggacuauccccuagcucuugcugucuuucugccacccucccucuccucccuccuagccuggaaccuuucgccuccgcuaguuucaccucccccacccccaugacacccaugccccucaugaccucuucucgggcgguuccucagacacccuuccuccucugcugcccuguuugacccucccucuccucuccccuccccugccccccacccacccagguucucugugaaaacccugcuagagaaguacacagcagaacccauugaugacucuuccgaggaguuuguuaauuucgcagccauuuuagagcagauccucagccaccgauuuaaagguaggccauccaucaccuaccccuuccaaccccagccuguggcgcccagcuacuaucccgggcucuaauaaccuugauggauuucuaacccccauuccugguccuggaccccauucugggcuguacauagaaacgagagcauagaaagcauaguguugggagacuggggagaggguggugugcccacagcuccaucgcugugcaugcagcacuuccucugucucucugucucucucugcugucgagcuucggcucaagcuugggguggggggggcuggggcuaggggaggcauuaccugugugucugguggcuuaggcuuaugcaugcaaguguuuugugacauggaccuuuuccaaacucccugguaucgcugaguccccucccugcccuggcucagcuugugccccagcagggccagcgagcugguucagcucagauggacaacggggcuucugggacuacauccggcuggccugcagcaaagugcccaacaacugugugagcagcauugagaacauggagaacaucagcacagcuagagccaaggugaggggccauaacgggaacaccccugauccccgcccuggacagaggggcccuuugcccacagcacuccgaauggggaccauaccagagggacagauaggucccuuugggacaguuaaaggugaucgauccaugcuuuucagggccgggcguggauccggguggcccugauggagaagcguaugucggaauacaucaccacagcucuucgggacaaccgaacuaccaggucagaccucuuaggcagcagcaugcucauucguugccuaagccuuaaguccccacagcaaacuucaauaccuggacuacaaguuccggcaugcagugauaguuggcuucucgaagaugacaugguuacuggacuacagaggccucagucacaugccauuuuacuuggccuuaugccaggaccuacaacacauagcccugccagcucugcaaacaaaggcagucacucuguucuuggaucccaguguucagagcuucagugcuuagagugggguuugcugagaaguuggguccugccgaucagagaucacggggcagaaugcuucugugugggaguggggagcuacugugggucucccucccccaucugauuuuuuuuuuuuuauaauacauuuuaucccuaacccaucuuauuucagagacaauugucuuuugaggaccucauuuacuguaugugugacaagcacuaagacuaagauuuacucccugauuuauaggauugaggugacccuauagugcuuugauagggguugcuuagccuagagaacagaaccguguuucuuguaaggaaacaggcauugugaugggggcugggucaggugcuaguuccagugagguacugagccggaaggagucuccuuccuccggguaaaguuuguaauaaguaagccaggcagagaaauccuggguggagggacacuccuugggagucucagcuuucuccucccugcagacgguucuaugacuccggagccaucaugcugcgggaggaagccacuguccucacugggaugcugaucgggcucagcgccaucgacuucagguggggucugcuuggcgguggugaaggggacuuucucacccacaacuguccaacgccccucauucccuccccccaccccuguggcucuucugccccagcuucugucuaaagggcgaaguucuggaugggaagacaccgguggucaucgauuacacacccuaccuaaaauucacccaaaggugagcagcccgguuauugcggugggugaggagauggguaccggaagggcgcugagugucauccuggugucacugcccaagggucggaguuggggugcuaguggggcgaggcggugcguagccggccccacccacugcucccgcuccuaagcuacgacuaccugacggaugaggaggagaggcacagugccgagagcagcaccagcgaggacaacucaccagagcaccccuaccugccucucgucaccgaugaagacaguugguacaacaaguggcacaagauggaacagaaguuucgcauugucuacgcacagaaggugcgcggggcgaggcgcggggagcugggcgcggugggggcagggccuggggcugggacuccagcugggaccccuuugggcguccgggcugagccggcgccccgcagggauaccuggaggagcuggugcggcugcgcgagucgcagcugaaggacuuggaggcggagaaccggcggcugcagcugcagcuggaggaggccgcggcacaaaaucagcgugagaagcgggagcuggaaggcgugauccuggagcugcaggagcagcugugagcccgccucccgcccugaccccugggaaccccaacaugacuccauuggcugggaucgcuuuucugaugacacccaauucgcaucagccuacccaucccauccccuuucccaagaucccguggagguugccaaacauuaccugccccccacauuaagaucccccgcagcuuccaauacccaucagcuagagacaccagccauuccucacacgacuuuagcagccuucaguuuuaucgugugccacccccauuauuaaggccucugauaggcaucacacacacacccccacccccaaucuggaacauuuccucccugaaccugacccagcuagcuaacacgaaucccaccccuucaagaguacccacccuuuccauucuccucccuacaucaccccaacugacuucuaaaaacuccaucaugagugcacuaauccuggccaccacaaacauggccuuagauccuagugccauaauuccagacuugggccauccucccugagcagcacagauccccauuuuuaccacucaaguuuccguccuaagcccugccccuaccuuugcugagucucgcuucccucucccagccaggccugaucccccucccccucccaggacaggucugauccccggugaccaugccccccuggcccaggguuccaaggagcucaccacaucccuagucaaccaguggcccucccugagcacacuucauaggcccgagggugccagcaacuccaagcuauaucggagguaagccucaaccaagugcuguccccauaccccagucccaggaaguggggccuggagcugcgggucacucccugcacuuuucuguucugcuguagacacagcuucaugagcacggagccgcugucugcagaggccagccugagcucagacucccagcgccugggagaggccaagagggacgaggaacccuggggccccaucggugagcacaccccacacacacucacccaccuuggcacuucagaaaagggauagggccccuguagucaggccguggcugaaccccuuauucucucaacucuuccuguacuuauacaccaauaaggagcuuggcuugagguuucaaaacaaaagugcaaauucgggccccaccucuucuaccuguaaacgaggucaaucucugcacuuggcugacucagauucccaucuguaaaauagggauguugguaaagagccuccagagugcacguauggagagggcgcaacggcuuucuagugucaugacacuagacacauguugcuggcucugcccacacacacacugugaacggcuugccugaccaauguuuuccccuuucuuuggcugccaggaagcucagaaccaaauuaguggcucccucugagcgaaugcccaggacuucaacgcaugcauuuuguguugaccccuccuugguuacucccuuccuaguuucuuccccuaugccuggaccuccugccuuuuuuuuuuuuaaauacauagauauauauuauauuguauuggauaacucgacuuugagacgaggcaggcuuuggacauguaacucaccacacuguguuugugacugugugugucuccccaccagacugugagcuccgugagggcagggaccaugucuuguccauucucuguauccccagagugugaaauagagcaaaugcucacugugugcuuaauaaauggacaaagaaaggcugaaccuuggggagacagagacauaaacugaugguuuaugacacagugucucaagcccugugcaaggaauguucaaucaagguuuaauuaaaaaugacagaugcuccagaagaggccacguccccugggggugacuggagaacugccccccuucugcccacccacgaggaccuccuccccacauacaacacaggcugguuggcccggccuuacccgcccucucucccuagggaaggaccccacgcccuccaugcugggccucugcggcucccuggccuccauccccagcugcaagucccuggcaagcuucaaauccaacgaaugccuggugagcgacagcccugagggcagcccggcgcucagccccagcugaggagcaccaagggcaacaccagccccaccugccaggggccauggacaacugccaccuuaugagucccccaacccaggccacccuucaagaacaccaccaaccuagccucgggucucuagggaaagaugacccaagccucuuuccugcuucagcuuccugccaaggaggcaggagcugcaugggaagugguggggccacgagggacacccagauuacagauccucaguccccuggggacagcgcuccauucugguggcucugaaggcugccugguuccuucugauuucuuccacaccugccucaggagcaggugguccagcccuggcauuccugcugcccugccucuggucuaacccuguguacccucugaagucacccuuccuugguaccuauguggggagagauuaggcaaauaaaaaccagaggacugaagugguuucaucuguuggagagugggguaagggcucccuaacaggucuguuaaccaagguacacaugccaggaggaugugcccugggggaccacauggggccaucauucagggugugggcugagugggagggggcuccggauucuguacaucugcaggugcuuucuggaucugacccuucuaagacuugcucucaccccaacacagugggccccacaugaaaggcccuuacuaccuaccagacaggcaccuuucacccagaucugucuggguacccccuaaggugggaagcuuuuaagacaaggucucuggauggccuggagcucaguauguaggccaggcaggcuucagaucugcucgccaugaacucucggggccaccauaccuguagaugccagcuuuuuguugcuguugguuuuuuuuuuuuuugugaagauagaauuuggcuguguaguccuggcuggcuugguauuggaggcacuccuccugccucagccucccaagugaaggaauaacaggugugggccacugugucugacuggggacccccaaacgugcacacguaccccaagacacuacagccacagcugugcacagaagaccaucaucuuuagacaaggaaugaauggggccaagauacugccuggcccaagcuccucgggccaagcuauaacaaacauggggauacaaaaaagggcgaucaucagauuuggucuugaauucgggaggcgggagaggggcaauccugggaagggaaacagcaggaauccaggucugaggacagccugggugacuggacugggagggaaggcacuuggcucagucuccugaucccacccgugcaagagccgguugcuccccgacuuucagcggcccagaggcugcuccugguugagccucuggaagaagcuuuugccaaacucguaagugcugaucaugauggcacaggagggugcagccuugaugauccuggggaggaagccugugauggaaagacagaccacagugagggguccagguccccucacacacacagcauggauauguaucauauaugcagugcauucacagagacagaccugcaaagaguccccuggugccagauucagcccggauucugcgaagcaggagccagguggaguccacucugggcggcuucacugcagaugcaaggcccggcucaguagggcucagcucaggccccugccugcccucuccccucaccagcccagcuuaccu

SEQ ID NO: 6426 - RNA, 851 nt, Mus musculus
ucuuuugaggaccucauuuacuguaugugugacaagcacuaagacuaagauuuacucccugauuuauaggauugaggugacccuauagugcuuugauagggguugcuuagccuagagaacagaaccguguuucuuguaaggaaacaggcauugugaugggggcugggucaggugcuaguuccagugagguacugagccggaaggagucuccuuccuccggguaaaguuuguaauaaguaagccaggcagagaaauccuggguggagggacacuccuugggagucucagcuuucuccucccugcagacgguucuaugacuccggagccaucaugcugcgggaggaagccacuguccucacugggaugcugaucgggcucagcgccaucgacuucagguggggucugcuuggcgguggugaaggggacuuucucacccacaacuguccaacgccccucauucccuccccccaccccuguggcucuucugccccagcuucugucuaaagggcgaaguucuggaugggaagacaccgguggucaucgauuacacacccuaccuaaaauucacccaaaggugagcagcccgguuauugcggugggugaggagauggguaccggaagggcgcugagugucauccuggugucacugcccaagggucggaguuggggugcuaguggggcgaggcggugcguagccggccccacccacugcucccgcuccuaagcuacgacuaccugacggaugaggaggagaggcacagugccgagagcagcaccagcgaggacaacucaccagagcaccccuaccugccucucgucaccgaugaagacaguugguacaacaaguggca

SEQ ID NO: 6427 - RNA, 6566 nt, Mus musculus
ugcaaggaauguucaaucaagguuuaauuaaaaaugacagaugcuccagaagaggccacguccccugggggugacuggagaacugccccccuucugcccacccacgaggaccuccuccccacauacaacacaggcugguuggcccggccuuacccgcccucucucccuagggaaggaccccacgcccuccaugcugggccucugcggcucccuggccuccauccccagcugcaagucccuggcaagcuucaaauccaacgaaugccuggugagcgacagcccugagggcagcccggcgcucagccccagcugaggagcaccaagggcaacaccagccccaccugccaggggccauggacaacugccaccuuaugagucccccaacccaggccacccuucaagaacaccaccaaccuagccucgggucucuagggaaagaugacccaagccucuuuccugcuucagcuuccugccaaggaggcaggagcugcaugggaagugguggggccacgagggacacccagauuacagauccucaguccccuggggacagcgcuccauucugguggcucugaaggcugccugguuccuucugauuucuuccacaccugccucaggagcaggugguccagcccuggcauuccugcugcccugccucuggucuaacccuguguacccucugaagucacccuuccuugguaccuauguggggagagauuaggcaaauaaaaaccagaggacugaagugguuucaucuguuggagagugggguaagggcucccuaacaggucuguuaaccaagguacacaugccaggaggaugugcccugggggaccacauggggccaucauucagggugugggcugagugggagggggcuccggauucuguacaucugcaggugcuuucuggaucugacccuucuaagacuugcucucaccccaacacagugggccccacaugaaaggcccuuacuaccuaccagacaggcaccuuucacccagaucugucuggguacccccuaaggugggaagcuuuuaagacaaggucucuggauggccuggagcucaguauguaggccaggcaggcuucagaucugcucgccaugaacucucggggccaccauaccuguagaugccagcuuuuuguugcuguugguuuuuuuuuuuuuugugaagauagaauuuggcuguguaguccuggcuggcuugguauuggaggcacuccuccugccucagccucccaagugaaggaauaacaggugugggccacugugucugacuggggacccccaaacgugcacacguaccccaagacacuacagccacagcugugcacagaagaccaucaucuuuagacaaggaaugaauggggccaagauacugccuggcccaagcuccucgggccaagcuauaacaaacauggggauacaaaaaagggcgaucaucagauuuggucuugaauucgggaggcgggagaggggcaauccugggaagggaaacagcaggaauccaggucugaggacagccugggugacuggacugggagggaaggcacuuggcucagucuccugaucccacccgugcaagagccgguugcuccccgacuuucagcggcccagaggcugcuccugguugagccucuggaagaagcuuuugccaaacucguaagugcugaucaugauggcacaggagggugcagccuugaugauccuggggaggaagccugugauggaaagacagaccacagugagggguccagguccccucacacacacagcauggauauguaucauauaugcagugcauucacagagacagaccugcaaagaguccccuggugccagauucagcccggauucugcgaagcaggagccagguggaguccacucugggcggcuucacugcagaugcaaggcccggcucaguagggcucagcucaggccccugccugcccucuccccucaccagcccagcuuaccucucacagccuccaccgcucccagugacaucugucgcugugucuucaccacaucgaaggguaggguaaggguggcagccaccuggucaggugaggacagggcucagcuccauucccaagcccugagagggacuaacgcaucucaagggcggcugaggaaagcacacaggcucccuggcaggcauugcaauguucuguaggucaccucugguggcccuacccccagggcagucaacucaccauuccugagaugccaccggccacgaagcugaugcccaccgaugucuggucuuuuggucucaguccgcucagccagcucuucaccaacucguaguugaaccaguacagagcuugagaaggagauacacacucauuaaauggggggggcagggaggugggcuccagacuucucaccccucacccccacagccacaccaucccaggugcaggcuugccugcucucaaccagguccuccucacgacuuaggucaggaaaaccuaggcaaaacccuaggucccugcuagaccuguccuuauauaaugagggacccaagguucagggaagugauuaugacuucacggccauuuuaguaacgaaggagggacuugguuaaacauuaccaagagcccuuuacccuaggcccugaccccgagcgccuaccugagaaggggacaucucgaagagcugugggaccccagcccagccacagagagcgccagccacccugagucaccgcagcuugaacagaggaagccagcucacgguaugacacaugcugagccugcagcuugguccgcacgagcuccaaggggcugacaacugucacggugcccacuaaggaggcgaggguugguaagacagcagaaagaggucaggccaaagaggucaugcauucaaacccagcugcugccccagggccugaggguuuaacauacucccccacccccaggcuagcaagaggcugggacugggacccagaaggucaaugguuaguugugcucacuucgggcgagggcaccagccaccaugggugcguagaggucagaggucaaggacugaccacacaggaaggccuugaguuggucguaagcagugaaguagauagcaguagcuggcacggucaucacccugggaguauggagaggccaggaaaaucacuuaagggcucccaaaccucucaagcacccccuucccuacccagccaugacuaggguacucacaggguggcugggaggccgcuccacaggguccuagugcccucaugccgcacaaucuucacaaaggcauccugaccaagccagcaggcagcccagggaaagaagacagagaugaacaaggccugcgauggacuggcucagccucugccuagagucuugcuugaguccugagaagagccaguuagcucuacacucacaccccacuccacgccccccaacuugguucuagguggacuccuaguccaccccuuaaaccuuaaggaaguggauggacguuggugcuacacaucuuuagucucagcacucgggagguggagaagguggaucucugggagcuugaggccagccuggucuauuacaagaagaacccuaucuaccacuaccccccacacacacacaaaccuaaacaaacaaaccacacaaacccccacccccacccccaaaaccacaaaaagcaaagaacaaaacaauuccauaguaaagaacuuuacuaguguguauuacgcuauuagguccuguuuuugauucucagcaucaggaccaaaaagcuuucugaaggaacagccucccagguaagcccuuccuacacugaacaaccaccccauuugcuuuccauuccccacaccggcagccuagccaaauccaaaucgagucccucagagacacauugauucugcuccuuaccaaggugccagugaaccgugugggguccugaaaccagguggcacagcggguaccauuugggcacagguacaggggcuccaggacuccauugcaguauaggaggcacuucccuggggacuguagagcggaggaugcugggaaagggaacggacauuaggguggaagggccuggagccuugcugggugacauagcugggucaauauguggcuauuccagugucagaaagcugacuaauguggccucaaaguaugggggggcaggaggggaucucgagagaggguuucucuguguagcccuggcuguccuggaacucacuccauagaccaggcuggccucaaacucagaaauccgccugccucugcuucccaagugggacauuaaaggugcgcaccgugcaccaccacugcugggcucauguacuacucuaugaucauggguaacccagguacucgagggauacucaacacuucuucccugggcccucccaagggccuggggcuuggggcacucacauuugguguaggagagacuccagaaucuggagggaguugucaauucugaaacacaaaggucagcccugguggucaggaaugcagccucccccacuagaaccccaucucugggaaauccuuauuuugucaggcagcucgccuugaucugguacucaccgcugguugccgagggucucugagacugaaggcggaccuucaccacauccaggggugucacuggggaaggagguaggucugaagguuccuucaggacaccacucacccucuucuuuaucagaaccaaacugccuccaaccuuuagcccacauuaacccccagcugccccaucccccaucuccccaggucuuacugaagagggaggugaccacagccccggcuccugaggccaccauuugcugaagggggcuaaugcccccaggguccugaucauccaucuuggaauuucaauccugaaaacacacaccacagucaaauggagcuuacccccugacaaggcaggccugaguggggggaguggggagcaagcaugagcuaaggugcucugggacuuuaacgacagcgcacucaggucucauccagaguuugccucuauaaucuuuaaaaucuagaaaugugcucacuuugccgaggggaaaacuaaggcucaaagguugcugugaccuucaagguuacgucauucguuuggaaagaagcuagaauagccgucggccaaagacagugauggcuauuuucucagccacaugcuccuccagaccagaggccgaaagaucaaacaccugagccccuccacccaacaucugggcggacacaugagcgccccgggcgaggagaggucgagucgggcaccgagagaaacguguaaacaaaucugcugauagaggaagguccaccuuccuucccaagauugcuggcccucccccacacugccugccuggggccagagaggacaggccgugaggccuggauggcaggacauucucugucugccuccucucucucuuaaacacaagccgcggagauggaagcagagaccuaguaacaaacccuuucaccgagacucggccgcacuccaugcccaggcccaguaaagggguucacggagaggcccacccccuucccgcggccucgauuccccucccagccggggacccucggagaacccacuccagcccaggcccgcccaccuggcucggagccgguccuugcgccgcgccacgccaggggccuggcgggcccauagcggcuccgcggccggugcaggguccgcgcgugcccgcuucgcacagcggccgcccgggagagcggugagaccggcuccgcccccagaaggcgaagccccgccccguggccgaccggccgcgcgcacggagugcaacgagcuccgcccacucgcggcccuccucccacccccccaguuccgcccuugcgccgcggccgcgugggcgggucgccgcggccccgcgcuccuugcggccggcaggucaaggucgccgacuggacggcgcuugcacccggcuccaguagcucuccucugcccacgcccugcaggaguguuguccggggaguccagaccugcgaucgcuggaacuuuccugaccgcuuggguauugcugcuccgcguccuuuuacgaggcagcugccgcgagggucgguucuucaaggucaucagagugugggacagcaauggcaaacaucugcccacuuagcuccguggcgggaguuuacgauuuauggcgagccuguuggcuggaaucaccauccucuuuuacggaugaugaaacgggguugcaaccccagaacgcuuuaugaccugcagggcagccuugucagccgaccugcaaccugggcuagacgugguguggcccugggcaaauuuacaggaccucuuugggccgaggacacagagaacguagagcaagaaagaaaaccaguguuucgcgacagaucuuagacuguuaccacuuuuaauacuuagaaguuuuuuguuucuuucccccaagacgaucuacguaaccuuugcuggcauaguuuccaauguaggccagaaauggccucuaccaaaacuuuucauaguagguaauuacagacguagguacccccauuuuacagaaaaugaaauggacucaaguuaaaacuuuugccgcugccuuccccggugggcuugcaaacag

SEQ ID NO: 6428 - RNA, 18773 nt, Mus musculus
ggcuagaaagguggcucagugguucagccuccugcucuugcagagaacacugaaccauggguucaguucccagcacccgcacgguggcucacaacggucucuagucccagcgaauucgauggucaucccugaucuccaugggcagucagcaugcaacuggcgcacagauacagguaaagcgcucauacacauuuaaaaaaaaauuuuuuuuuaacugauugauucaauugagaccuuaaaaauggcacuguggggcuuugggucgugaucucugaaguaagaacucuggcaagccucugcaaugcaggccgacauggaaagcagauuugugaaauacgaaaggggauaaaaggacaagaagacagagaaaggggucagaaucagcuacucacaggcagaugugacaagaucccugcagaacuggcuacuuuaaaaaguugacaaacugggcgcagaccuucaaacccagcacucgggaggcagaggcaggcagaucucuguguguucaaggucaaccuggucuauguagagagccucaggacagccagggcuacaugguaagaguuugucucaaaacaaaaugaaucccuuuaaucccagcacuugggaggcagaggcaggcagauuucugaguucgaggccagccuggucuacagagugaguuccaggacagccagggcuauacagagaaaccuugucucaaaaaaccaaaauaaauaaauaaauaaauaaagaaugaaugaaugaaucaacagaaagccaaaggcuauaguagaaagcuucuggaagacuuuaaaaccuaaucagccauucauaaacgacauucgccuguccuaagggguggaaaacacuuucccuggaguaugugguacacaguacugaggguggggguagagauuuuuaagcccaggcaggcccuuucagcagucugcuaugcaagggaaaggcaaggcuacaguguugggcaggagccugucugacaagggagcuggcuccugcagcaggcaugacagguuacugugcagcccuugagcccaugccagacuaguugggcaagcuggcucugcugaugucaucagaguaacccugcagcaacagcaguacccaggaugcagaggcaggauggcucaaaggaaauauccauagauucuggaggaagugucucccauccaugacacuguauucaauguuacucuuuugaugaaaacacuaauucaggugaugaaaaucuuuccacacaggguugaaacuucuuucuauuucucugguggucuccuauccccuuagccacucaaguccaacuagcacauaccugggacaaaugaugcuggccacucaaggacccuauccauccucuauaacgggauuuuguuacauaauccuaaguuuugagggucuuaaagauuuagauacauauuguaaaaggagcagcaaauauuuuaaaaaguguauccuucauggggaaagacaccaugaccaccaccaaaaccauaauaaauaaaaaccccaaugccuagcuggagagagggcucagagguuaagagcacuggcugcucuuccagagguccugaguucaauucccagcaacaugguggcuuauaaccaccuauaaugugaucucgagcccucuucuagccugcagauauacaugcaggcagaaugcugaauacauaauaaaucuuuaaaacaaaacaaaacaaaacccaauggcagagguggucuacagcucuaugaacuguuggcgagaguuuggccauggucccugcaugggacaugaucaggaagguguggcuacagaugcaauagcggcacuaaguguuuucagugcaaccaacaacauuccugauucaguuuacaccugugccacgggagggaaauccuguuuaguaguguuugucaggacaaaaaacaaaacaaaacaaaacaaacaaaaaaaaaaacccugugucuggggaggucagagacuccagugggaaaggaacugcuguuguuuuguuaaacagaugcaaugugagugccuaugcucuguggauugcuguugcugccagccucaauuaagggaauuuucuuuugcuaauuuuuuaaauuacaugaauuguguguguguuugguuuuuuuuuuuguuuguuuguuuguuuguuuuuuguuuuuguuuuuugagacaggguuucucuguauagcccuggccccuggcuguccuggaacucacuuuguagaccaggcuggccucgaacucagaaaucugccugccucugccucacaagugcugggauuaaaggcaugugccaccaugccuggcuguguguguguuuuggagguaagagaaagacugguaagaguuauuucucuuccacuguguggguccuggggaugaaauucaggucauuauucuuaauaguaaggacauguauuccugagccaucucacuggccucuguaaaacaacuuuuuuuauguauauaaaguguaccucagagacuccuaaccacuagugaagcuccugaaaacaauuggcugccacuguaacauaguggcccaaagcuuagccuugggugaacaccuauaugauucuuuuggagguucagugaacaucauggcaaauggagcagaaagaauguaagaacuaggggaagggguagaggguuguaugguauuuuccuccaagugaaaacagucuauccuguaggaaggcuccuuaagacucaggaaggaaacaacccacaagucucaggaaguccuugaaacuuaccagauucauaaagccccuccccugccaaucuuguauuaagcaguaaggguuucugagaagaggagacucuccuaucuguaaaguugccuguaaguugugaucagagcuccaguguucgaauuuucaugaguuguccucuugugcuagagcaggcuuucagcacaauugucauccaugcccuuguaagcagccuguagccauccuccuguaagagucccugagaaacccauuggcucaccaguuuggacuuugaugguauuguaacucuguuguauuguugcuucacugucuugggugaaugaauauuggcucccuaggaacagugucacacaaguggccucuccacguggcgacagaggggcucuaagcauagaguucacaguaauucagagacauggggcugccuagcuccccacaaugaccuucacagucagaugaaaguccacaauggggaaagugccccacaugcccgcaggacucaugacacagggagggaccuccaucaccaccuaggucacugaucuuguagugaccacuuucuggagaagacucccaguguccuuagacaugauaugagggacagcaucaagaggagcugagcccugugauuugcuugguuggaguuuggguuuuucuuuuuuuccccuccuaacuuuaguggaaucagauuuuauaucacuaagcuuuuaaucagagcauuuaauuagagaaugaaucucucuguccuaaauaagugcaauuugauuauaaaaauucuugcagcuaaaugugugauggagaaagagcugacagcuuauugagaaauuacucccuggguuuguuugcaugucuauuaccucccaggcuuccuggacgccggggcagugcccuauaaacaaucaggaucagacggguaagagagccggugggaggcagggcaggggccacggcucauugggcaagagagacaucuggcugucuuaccucaacacaccuccaggcuuucgagaaagggcuguguccuuugacccugaccugcugcaauggaagaacaagagugcagcguugggucccacuagaguuccaaccugggguucauacacaccagcaagaaauccaucacuuagccauggugggcgcagugauaggcaaaaagucaacauggcugccacucauacaguccaagagagacaacagcuuaugcugggacaggaauauugaucuccugacccuguuaagugguuacuuuuccaaaggucuuuuguggcagcuccuagccuggcugcuaagcuacuccucaccucucuccagcccaggguaccacuccaguuccaauaucccuuucuuccuaaagaaggauacucuaucugaagcaggacucaaggccagagaucuuggucaagcuaggcuuggaucugacaagaggcugcaguguggaagguuuggucugcaguugguagugccauggagagugcuaugguccugaagaguuaauccacaucacugaugcgaaggcuggcgaucucugaguugaaggccaaccugguguacagagaguuccaggauagacagagaaaugggaucauagccuaaugggcuauuagcagguagggccuuuuggaaggauguaucuuuuguuuuguuuuguuuuuguuuuuuugagacaggguuucucuguguaucccuggcuguccuggaacucacuuuguagaccaggcuggccucgaacucagaaaucugccugccucugccucccaagugcuggaauuaaaggcaugcaccaccacguccagcuuggaaggauguaacuuauccccaacauacucuguucccuugcuuuuugucuguccugaaugccaagggguucagccuccuccagguccuaaaacaauggagcuagcccaacuuuuaaucccaaaauguuggaaacugagccaaaacaaaauuuuuuucuuuucagugaugucucugugugugucugugucugugugugugucuguguguguguauguauaagcuugcguggauguggaugcuaaugcuuggaagcaugaaaguagaaugagguucauguaugugguagucauaagacaacauacuagacucaguucuauccucccacauauuggcucccagggauugaacucaggucauugggcaugaugcuaaacuccauuagccauuuguauuagucaggguucucuagagucacagaacuuauagcuaguuucuauauaguaaaggaauuuauugaugacuuacagucuguaguccaauucccaacaauggucagcagcagcugugaguggaaguccaaggaucuagcacuugcucauucccgcaggguaagagagacaagagacaagagagagagagagagagagagagagacagagagagacagagacagagacagagagagagagagacagagacacggagacagagacagagacaggcagagagagacucccuucuuccaauguccuuauauggucuccaaaagaagguguagcccagauuaaaggugugugccaccacaccuuuaaucucagaugaccuugaacucaaggagaucucccugucuuaaucuucuggaauccauagccacuaugccucaagaucuccauaccaagauccagaucagaaacuucuaucucccagccuccagauuagggucacuggugagccuuccaauucuggauuauaguucauuccaaauagucaaguugacaaccaggaauagccacuacaccauuaaacucucucaccagcccgggguuuguuuuuguuguuuugagucuaacuagacuaacaagggaggcccuggagaccugcucaaaccucagucccaccuucuuuucuuuguauggcugugggucuuuuuuucugcauguaugucuaugcaucacgugugugacuucuucuucuucuuucuucuucuucuucuucuucuucuucuucuucuucuucuucuucuucuucuucuucuucuucuucuucuucuucuucuucuucuucuucuccuucuucuucuucuucuccuucuucuucuucuucuucuucuucuucuucuucuucuucuucuucuucuucuucuucuucuucuucuucuucguuaauuagcuauuuucuuuauuuacauuucaaaugcuauccccuuuccugguuccccucaacccucuggaagcccccuaucccgucccccuucccccugcuucaaugaagguguucccccacacucacccacccacuccaccuccccacccuggcaucugccucagccuucugaaugcuggaaucauagacucucccuagcacacuuggcuggcacugcauuuuaaaucagagaagcuggaggcugagaggaacccaggcuugggauucauggcaggcucuaucguuuucaggguccagagcaaaugaaaaugcagggucccuuuguuugaaaaguauuaggaacuucacgggcaggggugaaguuagggauggggugcuuguauuguguacauggaugaggacaaagcuuucauccucacuacaguggggaaaauggaauuucaagaacccucuuagagcccagugugcuugcaaguauguuugguccuggcacucgggaggaggcagagucaaguggaucucugugacuuugaggccugcuuggucugcauagugagcuccaagucagagagggcugcauagugagauucacucaaaacaaacaaacaaacaaacaaacaaacaaacaacaaaacccccauggcucuggucacuuccuugugaaggcgccccugccucagucuaucuccuuagcucaccaggccucagccuuaguguuucugggccucaguuucccucucugugaagugaggggacuguuggaccccagucuuccuuccaagcuaacuuucuggguccacccuccuccauccuagccccccaacccccaucccguccauggaagaacggugagugugugacucaguuuacacaggagguccaggguccccugucaagcuagucuuuugugcugugauucauccuaccuuguguguccuggggccagggcuggaaggccugucucaccaggaagacagaggccugggaaaggagaguaagaacugcucgugaccagugugacucaggcaagagaggcaaagugggggaugggaggcuggguugcuucugugcucucucuccagccuuggcuuugcgugguuaagcagauacagcagguaaaaccacaaauccaccaggaagaucucagcuucagauccacggugaccgcuuucugagugcgucccaagugccgcaugggucguguuuuuguuacuauugucuuuaucuuuauuucagugcaugagacauacuuaugcuaaggaaaacuuaaccuuuagaguuugguguggcaucacaugccuuccaucccagcccucagaaggcagaggcaggguucacuguggagaccagcuuaguguccauaguaaguuccaggccagccaaggcuauguacauagugagacccugucucagaaacaaucaaaugaaugcgaaauucaauuuaaacaggcauucuauaguuuuaucuggcaugccaagauccuggggguuggggaacuuccacucugguauagucacagcccuucuauugggacagagcguuaacccugacuaaaagaagcccugagggacaguugaaaaaaaaaugagggggaggcugggagaaggagaaggucaccggagggcgagcccuuacuuggccaugugcucugaaggcugcacugggcuggccuacagaaagaggggggguguauaacuuuccuggggacaccuacccuuccgucagccaaagcaggauauccuggcauuugugcagccucacgccagcgccagcauagguuuggcaucugggcaucaggcuggaaauggacaggaugcguuaauaauaaugacagagucaggacuugacauacaagugugcacaugacacggggccacacccaggcccuauuuauaaauccugaucaggcaaggggaaagauuaaaaaaaaaaaaaaaagcagaagccacaaaggaaagauugaucaguagauuuuagaugacgcaaugucacaaaacacaagugacaggcugggagacaauggcugcaaaauauguaauacccaggacauccaaacacuuugugaguaaaaggaaaacucagaaaaacaaauuagaggguaacugggcgcaucccuccauguguguguugaacaauauuaaguuuaggucagugguuucucaggagaauaaauugaccuuuaucaugggaguggggcccuccuaauccacggaaggccugaaucauacaagaugggccuggaccuucucucuaccauuagcuuuccuggggcuuaagccucccagaguacucuaagcuuuaagacagggacuugguguguguguguguggggggggcuggagagauggcucagcaguuaagagcacuggcugcucuucugaagguccugaguucaaaucccagcagccacauggaggcucacaaccaucuguaaugagaucugauguccucuucugaugcaucugaagacagcuacacuguacuuagacauaauaauaaauaaaucuuaaaaaaaaaaaaaaaagguagaccacuugccagacauacccuagcacuacacaaaaaauaaacaaacagaggcuaggaauggaggcauggcucagcaggucaagugugcucguggugugaggacuaugcacagccauugcaaugagggagggagcagagacagguauguauaccccccggggguccagggcaaccagucugguugagauggcggucuaccgguucugugggugaucagggauauaaagcugagcacaguaccacgcgccuuuaauccuagcacuugugaggcagaggcagguggaucccugugaauucuaggccaggcuggucaacagaaguuuacacagugagccucuaucucaaaaagugugauggaaagaaccgaaauccucauguguuuguugcugguggggauacaaaaugguacagccacuuuggaaaaacauucucacagucacucaaaaaguucagcacagaauuggggucacucuuaugugaccucagauuuucacagcuuuguaagaagaauggaaacguggacacacgaaaaugaauaucagugaugcuguuugcaauagccgaaacaaccaagauggccaucacuuaaugagugacauccaggagggaccagugcccugacauacagccaacaguccuuagcauggugaagcgcucgccuggaggcugugguuagccggcagacacaaagggcugcggccagaccgcucacggcuacuucuaggcagcaccuggaucagguuuugauguggcacaggggcacuuucaucgaaacugugggcuuccugggauccaugcuuggguuuucuagaaccaaguuauuuauaaaggaccuuuuuguaugcugugugacuuuugagacuucaacaaauaucugcucucuccugauagaggacacugaugucagaccaaaagcacccaauucuagcuuagugaacaccuguguuuaaugggacuacuuacgggcguguagaugauuugaagacagcuguaucaccaaaaaggcuacccaagcucaggaaagcuguaucucuagagcucccugguaacaugacacuaugaguuacuaugaguguuacccuaugagucuuguaaguuuccagauuuuccugggccuucuaaguugaccuuuccucuguacuuucuuuuucccucuaagagguuucauuucaggggaacuagcuacauaacacaccaauauuucugcuuuauagcaaaaauguuaugcuaucuuauuaugaucacuucauuauaaauauguuuuuuaguagccccagaauauaauuuuccauuuuucacaagcacuuucaaaacuaaguucuagggcuggagagacagcuuaggaaugcuuauugcucugguagaggauuugguuugcaauacucacguggggcuguaacuccagcuccagugauucaguacccucuggcccccaaaggcuccugcacacauaugauacauauaaauucaugcaugcauacauacauauauacauacaucuaacuuaaaaauuuuuuuacgaagcuuacaaaaccuaucuaaguucuaaaauaguaaccgagaagacggcaaacuggauaaaggagcucaaaucuguaaucccagcacuuaagaagcagaggcaccaggaucaaggucaggaaguucaagguuagucuaggguacaaagugagccugagaccagacagacucugucucuaaaguggggucgggggaggaggaggaggcagagccugcugguucaugucuauaaucccagcuaaagaguccaaguucaaggucuauguggguuauauagugaguucaaggcuagccuggaaaacuuagggagacuccaucucaaaauaaaaaguaaaaaaaaaaauaaaaauaaaaaugaagaggcugaucuucuauggcaagaugggaggcagagucaagaaaaucauuuggaggcuuaagggccagguaucaugaagcacacagcgcgcagaggcaaaaacagagaccuugccuuaaaaacaagguaaacgccgggcgugguggcgcaugccuuuagucccagcacuggggaggcagaggcaggcggauuucugaguucgaggccagccuggucuacaaagugaguuccaggacagccagggcuauacagagaaacccugucucgaaaaaaaccaaaaccaaaaccaaaacaaacaaacaaacaaacaagauaaacaagguaggguggugguggugguauguggcuuugaaccccagcacugaggaggcagaggcagguggaucucucuguguuugaguccagccuggucuauagagugaguuccaggcuagccagaacuccacagagaaacccuuucuugauaaacaaaaccagguggacagaucgacuguccaaauguuguucugugaaauaugcgcucccuccuucagacggaaaccagaaccucucguguuagauuagagcaaugccauuaagcuguagccccagaaguuuguucuaccuuuuuauuauuuauuucaagcgauugcguauguaagucugggggugcgcuaaugcuauggugugugugcagaagucagaagucgugguuucugggagucauuucugucuugugaaacaaaggaagcagguuuguuaagcuuuuaccugcuccccauuuuauuuccccuugaggcagugcugcgucuaggauguagcucaguugguagcacuuguagcucagcaugcucaaggcccuaggucuaaucccagcagcacagaaacuaaacacggcaaucugcacuugcaaucguggcgcuugggagaugggggcagaaaacugagaaguucugugucagcuaucuaucaagcugaagcucgucuggaacacaggaaacccugacucagagggugagcugcaauguugcugagucugguuuccaacuccugggguucagcagcaccccuuccucagccuccgcagauggcugugucucacuagaagcauaagcaauggucuguucuggggacaccuguaugaaugucauggaacaccuaugcuaacaccaucaggaugcagaaugaugcaccagucuuacacacuuucugggacuccaguguaagaagcccucacggaauuccacaacccugcaugcacuccucucuauguaagacucccacuguccugaacuguauggcugacccccauggucucuauucacccaccauaacaauuccucgaagguggggacagcugaaacaaggaaaccccuuccaucucgacagccaccagccuacuccacaggcagugccacacacuuggcuaaugcccuuaucuugaacguggcuuucaacccuugcuagaggcugucuguaaagaacaagauauaaacuacccaaggaaaggauucacugucuuucccaaucuaguuucaaguuccucugucccaccuuaucagccucuuaaaauucuuucagcuucaauuuaaugcagugcuaucaauauggauuuaaaucucuucuuccccccaguuugagccaaucuccugccuccucccuacacacaucuacagugcccgguacucgcccuugaaccuuuauuagauuuagucuaagccacucuccccauucaaaccuggggacuauuuaucuucacccucacaaccaucuuccaacugguuucgaguccuugucugccaggcgugaagagacaggaauguacaaaagucccgauccagaagcagacacccuccaguaaacgaccuugaacgcgugcccucagggcagcucuccuaacugugggugcccuuaggcaugaggugucucaucucugcaacacucugccgccagaacccaaaccagcaagcucugcccugggggaggcgggcuauguugucauaugauucucuaaucacaugaucccuagaaaugggguguggggagaaagaggaaagggaggaggaaugugaacugaguagaaaagaaacacagcauuccaggagagucccgccucuacguagacaaguaaccaauggaagcccuggaucuccgagcaauggcuaauggaaauugaggugggcgggccaucgugcggccaagcccuaguccuggagcugaccgccagaugccucccagggagcccggaccccgacgcagguaggaggacccucugcagacaaucuccccggcuacuguccagagguccagaggccugaccaggcugccugugcaauugaggguccucuggagucucagcucagagacaagagaagaccugccucuugaaacuccccuagggguuucugaugcacuaacgagguuguuuuuuucuuuucuuuuuuggaggggugggggcaguuguuguagagacaccuccccgcacccccucccccccaauaagaggcuucucuugcccagcaugucggaaagcugcaggccuuucuccaggacaggaaccaccccacucuugggccagcuccucucuuguccguacuucccaccucugucuccagguccggcucuuucucuuucggacgcugcaaguguucucugcggcggcgugcauuggguggggaucuccggcccuuggcccccagagcucaaagggguugcgagcaggaccagggcgugauggcugagucccuggguugugucagcuuuauuuccuuucuuggggggcgagagagcuaauuuccgccucuccccgccacuuuucccccgcugccucucaucuggauuggcucaccuuuuaggaaauucauuuccccucgacacucagaguuggggggugccaccuaguggaagaugucggagcuagggcuuugaaaggcuccaguucucccuagcuguguaguguagagguggccaggggcucaccacucccuagccccguugagaggaacugggucuucccuaccccuuccugguuaggagauggccucugggauguucuuugaauuaggugaaagggcacuugaaaagaccuagagaaggaaagagaaagauggcagauccuucuauguagcccaggcuggccugggauucaccuuauagcccaaguuggccuggcacuugcaacccuccuaccucagccucccaaaugcugggaucaaaagcaugccugccauguguggguggcauuuccugucuuucauagccaccaguguccaggcagagaagaauugagacacagggagcaauuucugacauagagugucacuuccaggacuaaaacccaagucucuguaccuacuuuuuaaauauuuuauuauuauuauuauuauuauuauuauuauuuuuuuuuuuuuuuuuuuuuuuugguuuuucgagacaggguuucucuguguagcccuggcuguccuggaacucacucuguagaccaggcuggccucaaaaccagaaaucugucugccucugucucccaagugcugggauuaaaggugugcaccaccaccgcccggcucccacccuguuucuauccugcuugggucaccugccagaaaaaugcucuguccuguccuguuuggaccucuggccucugggauucaggguccuucucugacaauauucagggagaccaguuggcauaugaacccagucccauaucccgucuuuuuucccugacuugauccuuaggcauggauuugaaaagugaaaguaauauuauaauuacuguuuugcauaguuguugcagagaaauacaguaaggagagggagaaagacucccuagagggucuuugaauauuguugggucauucuggguugcuggguaggccagcugggcuggggaaaggcuuauuagggaagugagaggcucgguuccuccugcugaggcagugaggcacugugcugggucuucccacuugcagcugaguuucgguuucugaggggggagagacggaggcgguccguuugaggugcccuggugaugucgggaagggcucaccaugaaguuagcuuuaaggcugauccagucucuguguccccuucccuugggugggguggggggacaguuguggguaggcgguggcuggcccauagggaagccagaccagaccccacugaccacugcacuucuguuuuuacaacuuucuccacugcucgguuucccauaugaucaugugacugaugacugucccucuccaucccccaaggcuuuugaaagcuacagguggcaguucagugccggcaguggggcuggccauccuccugugucugcugaggucuccucugccucccaguuagcccacagucccauagauaaagccacaaaagccacaugccuuccugacugccauaccccgugccccccccccccacuuacccagagucucagccguaugugaggccaugaauccacacguguucaugcccacagugugugccagcugacgcaugugcgcuugcugcacacugguaggacgcugacacaagcgacacaucugcuugcuuuccuguuggcuuguugagaagacucaaugaagccagggccuuggucagagcacaggggagugcguggccucagaguagaagguggcacagaguuuaagguggcugccaaacuuugcuuggcauuuguaggcagaccauguggguccugaugagcuggcuggccuucgcggcagggcugguagccggaacacaguguccagaugggcaguucugcccuguugccugcugccuugaccagggaggagccaacuacagcugcuguaacccucuucuggugagugccuccugccccaguuggcaccccgggccuuuugaagggcuggcuaccuuggauugaccagagcaaggcuggcacagacccuuugguugaugucaucucuucuuuccaggacacauggccuagaauaacgagccaucaucuagauggcuccugccagacccauggccacuguccugcuggcuauucuugucuucucacugugucugggacuuccagcugcugcccguucucuaaggugacagugccauuggcuuggggaguuggggugugugugugugugugugcuuaaaaucuguguuuaccucuuuccuucacucuaauagucccaagcaaaagcgucuugcucacacagaccucucuguguccauagggugugucuuguggugauggcuaccacugcugcccccagggcuuccacuguagugcagaugggaaauccugcuuccagaugucaggugcuguggggcacaggggaggggggcauguggggagggacaucggguggcaccugaagggcccaggagcccaaccgccuggguggcccugauuccagaacagaggggcaguucugagagaagaaggugacagauaaggaugccgaauuaggggucuggggacacggagaggccaugcuggagugguuuaacaccacuggaugccuuaguugucucucugcaguaggggcuaccugggagaucaccuaagcccugggacuggccacuaaaccuccuguagcuggaccagcaguuccuucuugacgguccuggugaauggccuuugcugacuagauuaauggaauucuggguucuucuauuugcagauaaccccuugggugcuguccaguguccugggagccaguuugaauguccugacucugccaccugcugcauuaugguugaugguucguggggauguugucccaugccccagguacagguguagggaaauggugacuagcggguagcgggguggaacugggaccuggggcugaugcagauggauugaggauuaucugucucuucucaggccucuugcugugaagacagagugcauugcuguccccauggggccuccugugaccugguucacacacgaugcguuucacccacgggcacccacacccuacuaaagaaguucccugcacaaaagaccaacagggcaggugaggaggcugggagccacccagccagcagcaccuggggggugaagccacauuugacucuuggaugggaaaaaguccccaccauccuggcaaccccuccacaugccucauugcucuuucagugucuuugccuuuuucugucgugugcccugaugcuaagacccagugucccgaugauucuaccugcugugagcuacccacugggaaguauggcugcuguccaaugcccaaugugagugaauggcuggauuccccugagcccauauauagucuuacaaggaggcuccaagcacugggcugaucccugagagcucuaaggcucaugcugcccccuaguggcgguuugaaauaguguacgcuaucagccuggcucgcucccuguccucacuacuggaguucagagacuuauacuugucccaaccuaggccaucugcuguuccgaccaccugcacugcugcccccaggacacuguaugugaccugauccagaguaagugccuauccaagaacuacaccacggaucuccugaccaagcugccuggauacccagguacaggaccaaacuagaccccauuucauucccucaauaaagagggguucuugucaguuauggaauggcuaucagcuggguggguuuugauggccgcauggagggaccuggcaguuguagacccucuccacuggccuugcaugaggcucacugugacuggguuagcugugugcuccguucuccgcaccuggucccacugccuuugaugauuuggucucugcccaccucacagugaaggaggugaagugcgacauggaggugagcugcccugaaggauauaccugcugccgccucaacacuggggccuggggcugcuguccauuugccaagguaccugggagcagugggcacugcaguccaagcggaaggggcagccagcuugguaccagugcuuauuggcuuugcccugucuaccuuaggccguguguugugaggaucacauucauugcugcccggcaggguuucagugucacacagagaaaggaaccugcgaaauggguauccuccaaguacccuggaugaagaaggucauagccccccuccgccugccagacccacagaucuugaagagugauacaccuugugaugacuucacuagguguccuacaaacaauaccugcugcaaacucaauucuggggacuggggcugcugucccaucccagagguaacauagaaagggaggcagcccugaggggguagagauagcaucuuggccugggcagguggguggcaagagucccguggcuuuauuucuucugcacucugucuaguccaggguggguacccagugcugugaccuguccccagcaggagaagcuaugagcuagagagguagacucccaugguccucuguagggacauucuucucugcccaccccuaggcugucugcugcucagacaaccagcauugcugcccucagggcuucacaugucuggcucagggguacugucagaagggagacacaaugguggcuggccuggagaagauaccugcccgccagacaaccccgcuccaaauuggagauaucgguugugaccagcauaccagcugcccaguagggcaaaccugcugcccaagccucaagggaaguugggccugcugccagcugccccaugugagucuccaccccaccgcccugggggaagggagcuguguucuugggauaugagugugaucccauccccucgcuccacaggcugugugcugugaggaccggcagcacuguugcccggccggguacaccugcaaugugaaggcgaggaccugugagaaggaugucgauuuuauccagccucccgugcuccugacccucggcccuaagguugggaauguggaguguggagaagggcauuucugccaugauaaccagaccuguuguaaagacagugcaggagucugggccugcugucccuaccuaaaggucagugugacccugacucuggggcuggguguggccaugggcuguauucugcccugucuaguacuuacucuccuuugacuauccagggugucugcuguagagauggacgucacuguugccccgguggcuuccacuguucagccaggggaaccaaguguuugcgaaagaagauuccucgcugggacauguuuuugagggauccggucccaagaccgcuacuguaaggaagggcuacagacuuaaggaacuccacaguccugggaacccuguuccgaggguacccacuacucaggccucccuagcgccuccuccccuaacgucuccccggccuacucauccugagucacccuaucaccaugggagguggagccucaaacuaaaaccuucuuuuauggaaagaaggcuguggccaaaagccccguaucaaacugccauuucuuccgguuucuguggaccuuguggccaggugcucuucccgagccacagguguucugugagcuugcuugugugugugugcgcgugugcguguguugcuccaauaaaguuuguacacuuucugaauaguaucuga

SEQ ID NO: 6429 - RNA, 5147 nt, Mus musculus
auuuagcacuaauuauuuuauauugauuacauaugaaaauaguuuacaucauuggauuaaauauuauuaagguucaucucacuugucuuaauauuuuuuuucuuucuguuaaacuacguggcuacuagaauauuuuaaauaucccgggugacucgaauuccuucucucugagucagcguuacucugggagcugucugcucagugagggucgggaugauucaaauaugagaugagcaucccuugguauccaggagagcuguuuccagcaacucuguggguaucaaaaucuucaggggcugaaauccuucauaucaaaaugacguucuauuuggguacagccggugcagaucuucuuggaaacgaacaaucccuccugccugcaagugccguggagguaacuguuacuguuuauggagcaaaacaaggaaagaaagguugcuuagugcugacacagucuccagaaaacaaaaaaauaaaauaaaaaauuuaaaaagcagauacacacauuuuucccucauaauauagacccaugguugguugaauacuuuguaggggagucugaggauaaaagaucuggggcgacugucauauuaagaccauggaauuaagaccagagaacuccuggaagaaggaugcugguguugcuguccuaagguccacgguguucuaaaaguccaaauaugguucuggggagaagagcagucggaaaucagaggaaggaagaggguaaagccagcaggaagcccgggcaccuggugaggccacacagcuuucagauggucuucaaggcauggaauuccagacuucccaagguggggagugauaggcugggccgugcuaggucagguggagagaggagaggggucgugaaugacauacuagccaccucugcuccgguaucugcugccucaggucuuucuucuagcccgaggggaaugcagcgcagggaugcuguaagggcuggaggaccgcucuccagacgccaucuccuguagccuuacaacugcuuccugcccaaagcucccuuccuuucuggggagucagguggccaugaaggcuucacaagcugaggcaccgcacccagcuccucaguaagcugaaggaccucagaugucuaacccacccagggccuucacagggaggcacugauaucugggagcucccugggcaggucuggggcaaggaacagaagcuucaccucacccuaagguuagggcgucaaucccagcaugccuccuuccuucccacaguuuccgcuuccaccccugaccucugcccaccccugaccucugacaacugucacuucugcccaccccucuuucugcccacccucaccccugcucauucgucaucccuucccacccucaccccugcccacccucacaucuucccacccuuaccccugcccacccucaucucugcuuaggagcucaucuuccuucucucacuaacucagcucuuuucccagacagcgcuugggaauuucugaagagaaaggaaguuuuuaacccccauaggaaagaauccccaggcuuccuggggccgcacccaccuccccucugagaguagaacugcaguugugcccuuucugauuuggggggccaggucucaaggcuaugagguuuuauugguuuuauuuugacuuuuuaaaaauuuuauuuauuuauuuauuuauuuauuuauuuaugugugugugcgcgcgcgcgcgugugcgcgcacuacauguguguacaugauggagacuggaggacaauuaugggagcugguucuuuccuaccguauggauucaagggaucaacuucuagucaucaaauuugacagcaugucuccugcucagggcuuagaggguugagagccuaucagagauugguaaaaaggagccggcucucagaugagcacauugcugugcacuguaauuccagcccuuugugugcgcuacaaagggagacccugcaucaaaacaaacagcauaguucacauagggggucucugcacuucggaagcagaggcaggaggaucaucaugaguuccagaccggcaugaagccaguacaagagcuugugucaaaaauaagagcccuauuccccaaagcagccagaccuuucuuuuuuuguucaaaaaaaaaaaaaaaaaaggccagcccauucuccaugggguuccugcugggcuuccaagucagcucugcucuuacuccuguuauaaauucuaagaaccccugacuucuccuguacuggaggcugauaugaacucagggaggcuaaucccucagcccccaccucacccccgucccugucccgucccgucccguccggacacaccccuuuauugaccaacaggaucccagaguguuguauaccucgcuccacuccucacaaagaucuuggaggccugagaauucccuccgaacauaggauuugcaacuccagcggacacuggcugucccagcgacuguguacgcccuccucgaggccugcgaaguucccaccgugccgagggcgcccccuaguggagacaagaaaaacccgucagagacguggagggaaaggggaaaacccuggaaggaagcaaugugugucaaaggcuuggagaaucaccuagcgagaccgucccucuuccucgcucuccucccucuagauugggggugagccuagucccuguccggucgaaaugugagagaucgaauguucugugcucaagcugcgaggagagaaaagcuagccguccccaguuccuccucccugccacccccacccucccuccuacccaccuccuucccaggggaucucuuauuaaaaccucuuuuccuuuggucguucuuccugauuuggagaggggauggcucaggaagggaggagggcugcggcaguguggguuugcuuugggguccuccagcuugagcaagcccagcccucccucuucuuccccaccccccacccucgagaguucuugauuuggcuccucuacgugcuuccuucuuuggcgaacuccuaggaaggcccgugucccggcaggacacggcaggaaagagcagagaggacacaaggagggaaccagagagacuccagaagguugaaggcuggaauuagggggugaggacccgcguccuucgagccuugagggacauaugcaaagaauugcuaauugcaacuaaacgaggccucggcgugggggaaggggcagcccgggcugucaggggcuaccgccucuuugagugcccggguaaggccaggccagcccgcucuucucauguaaagcagcuuuuugucugggggagccagagcuggggccaggggcuggggaaggggcccaagccuuuggcaaguuucuuguuccccagaaagggagaagggugccgaggccuccucggagugaggacgcccccucccacuaacucccccaccccugucccuucucaagcuuuuuauguggggguugauggggugcugcccagcaggagggggugggccugggauccuagcacacacacacacacacaccccuugcuaggcugugggaaaggacugagcacaaaggaaagggcuggcccagugaguugggagacagggcagcucugguccagggacguccugagcuuggaggaucuagcacuggaaccccuucuccccaaggaugucgucaggaguugcccacguguuaucugguugcccgagucuuucuccuccuagaaguagaccuucccuguuuguccgcaggagaugggguggggacaggauuuuagccugcuuccuaacagacuaugagaggagauaucuuugcuaaaaacaaaaaacaaaaaagagacuugagcugcaagcacuuaaucccagauacuaggaagacuggggcaaaagaaucacuuggccuagcaaauagaagccugcccaggcaacuuagugagacccuagccucaaaaauaaauaaguaggggcuggagagaugccucagcaguuaacagcacugacugcucuuccaaagguccugaguucaaaucccagaaaccacaugguggcucacaaccauccauaaugagaucugaugcccucuucuguugugucugaagacagugacaguguacuuacauauaauaauaaauaaaucuuuaaauaaauaaauaaagguaauaauaacaaucgugauacugaggcuucuggucuaugggaccaauacgauugaugguuuguuuuuuguucugaguuaaguucccacuauguagccuuuaacuucugauucucuugcuuuagucugcuuguuagagccuacaccaugcacuguuuaagauccuggccgcaguaguccaaaacucaggagguagagacagaaggaucucugugaguucaaggccugccugguccgcaugaguuccgggcuggccagggcuacauggagagacucuugugaagauagaaggguuuguccucauacacagguugccgggauagcucagucggucagugccugccuagcauucacaaagucccaagucugaucuccagcaccacauauaaccaggaaugguggagcuuugugaguucaaagccuaccuggucuguuggaccuucggagguccugauaccaacauggucuacauaaugaguuucaggccagccuggucuauguagagaaacccagucuggaaagaaaauacuacaaaacaagcuucuacuacuuaugcuguucccagugguggccucagagcucccauccugcagacuagagaaacagagcccagcagugaaccagccccgaagaacagacccaguucaagggcucggggagaguuggauaaaaaucacuggagagguuguuuauuuuccuaugagauguccacugguucacucaagcagggcugcuuuuccuuccuccauuuuggugcucuuugguccgucuccucaucaccauaugucacucugucugggccccucagccagguggaagaugcggacuugcaguccaccagauacccagggauucuucgucucagagugucuuuggccaaggggcucuggcaucuggccagugccuuucucccugcuagacuggcuccccacaggccccuaauccaucucacgcagcaggaagcccuuaagcucccuuuucaaugcccuuccccagccugcugugggcucugagccuuucuauaccacccu

SEQ ID NO: 6430 - RNA, 20482 nt, Mus musculus
ggggggggggggcaucccuguguaucagucuuucaagucauagauccuccaucaaagcacacagcagcaguaaaucacugucuuccuuuggaaacauuuuccaagaacggccacaacucugguaacaggaaggagauuucaagaucucucagacagaagaaagaucucaaccucuuucuaacagggaucuucuuccaaacacucgaagacugguguuucucccucaauuucccuauagauagaucuuaaaccuuuccugaaacacgagaggcacuuuuauuaaguguaccaucuaccaaaauucuaaucacaagauaauauuugcuaaacaaaguaauaacauuacccuuuaacagacauuauuuacaaggauuuuuuccuuuaauauaaaaaaguguaacuacagcaguccaauguacaaauacaaaaaaaaaauuuauacuaaaaaaacuguaccauaauacuguacauacaaaaacuguccaacaagaaugauuuaaauauaucaguucuucucuggaucuggaagacacaaccugaaaguucugcaacugcauuauugcugagaacaugugccugggaacacuguguuucccucucccgacucaucccagcuccaccuucagaguccccugaguuuggaucaugagccaacagcaucccugaagauaaccagagccaaauguuuacucaauggaagucauuauucagcaaguugcugcuuaccauaaacuaugaaaacccaaguuuuaagcccaaccaagauuaaauccagacggaggucuucccauccccugauuugcuacuaauacugcuuuuguuggacccagauuuggaccccacuuuggccuucuuuucccgaggaccauggggguuguuuuggugaugguaggccuggauugcuagguccaagcguuccugagccauucugaucucccgcugcagagucuccagaucagccgggagguguuccucguggcugccguacugcuguuccugggcaauauuggcuuuguuuugcuuguaggcaaucuuagcauuggacagcucaguguacuggaucugaucugguuugacagcaauguuauagccagggggagcagaggguguguuccaagugaaaggauaauuauaagcacccggaucaucaaguucccuccuuuuacuguuuagugagucucgaauugucccaaacccuaagugaagcaucucccaaauguuaagcaauaggcagaggccugugacaccauacauuaucagaaggaagauggucuuuucagugggucuagaaauaaagcagucuaucuuaugagggcaaggaagucugcugcacacauaaaauggguggacuuggaagccauacaggaaauacugcccuauuagaaagcccaccucaaacacaguccuggccagcagcugcaacacauagauuuucaugagcccauccucucgaauucgucgucggccaucaugcuuagguuuugguuggcucugcucuuuauuuucuuuuucgcuuucuaacuccaucucuggauacaucauaggauccucuucaugguccucuuccguuucuuccagagcccggugcuguuuccaacgcauggcauaggguuugcuccgagcugccuucuugucugccucgccaugcuccauuuuggcaaucuuaugaauagcauaucccagguacaucacagagggaguugcaaccaggaugaucuggaauacccagaagcgcacgugggagagcggggcaaaggcaucauagcagacauucucacagcccggcugcucuguguugcacacaaauuugcuuuguucaucauaguagauggacucuccuccuacagcaguuaggacaauucgaaagacaaucagcacagugagccagaucuucccuacaaaugucgaaugguuguggaucuccucuagcaggcgagucaggaagcuccaacucauggugguggaauugguuugcccugguaggugaaaaguaccaagcaggagacaucaacaaaugcuaaaaauaguuuucuauuuuuggugcccagucccaacaaauaauccaacccuaacaauguaaauucacacuaucucuaggaacacuguaaccugagaugucccacuucaagacucacaguauuagaacagauauuagaaucucacugcaccuuauagcuuugggugagacagcacccuacgaccugucugcacauacaaggucuuguuugcucuccuacuucauugauauuauuucucagaugcagcacacuguguuuuuuuacauacauuaguguguucuaggacaugcagacauugggguagcuuucugguccagucauagagcauagcaucauaaaaggggcccuuggacuggacuccauuaugaagaggcaguuuaccagaaagcuuaaguuuuaaagcagguaacaaagcauuaaaguaauuaaggaagccaagaguggugacauaugccuuuaaucccaacacuuggaaacagagacaaaggaaccucugaguucaaugccagccuggucuacaaaguuagcuccaggacagccagagauacauagugagugccucucccaaguuuuuuuuuuuuuucgaaaguaauucaugaacggaagcacugaagagaaaggaaccaugggugaccccuccccugcuagaccacagagcagaacaggcccugguuuugcuuaaguccacaaucgauuuucuuacaacaaauacuuuacacagggaagcccugugucgacauuugcuaaacugaucuaugaaagcaacaaacccaaccaguaggcagacucacuaaaaacaguuuuuuguuuguuuguuuguuuguuuuuuuacgaucuauuuauugccgggugugguggcgcacgccuuuagucccagcacucgggaggcagaggcaggcagauuucugaguucgaggccagccuggucuacaaagugaguuccaggacagccagggcuacacagagaaacucugccucgaaaaaaaaaaaucuauuuauuauuauaucuaaguacacuguagcugucuucagacacaccagaagagggugucagaucucauuauggauaguugugagccaccaugugguugcugggauuugaacucaggaccucuggaagagcagucagugcucuuaaccacugagccaucucuccagcccuguuuguuuuuagaaagaaggucucacuguguacuugugucuuuccugagacuugcuauguacagcaggcuagcccggaacucagagcucugccuccagcgugcugggacuaaaggugugcaaaugccuugcucgguuuuguauuuuguuuuucagacaguggaucaauuguugccuagacugaccuuggaacucaagucuuccgaccuuggccuugaaaugcugaaauuauauguguuugcuaccauacccaccuuuaacaacagcauuuaaaggauaauuuuauuccaagauucuuagaccuaugccuagaauccaggucacagguuaaacccuacugaaacaucugacacaaagcacaugcagguuuccaacuucucucucucccgcugcacugcagccuaugguaaaucaccaccaccggguaaguuccaacacuuaccuguucaccagaacuccuguuacccaaaaccuucuuucagauucuguacuuuguuuguugcuuucccaaauucucucuggaagagaaaaagaaaagaucuggucauaaacuuccuuccacaaaaaacaaugagucacuaacaugucacuuucaggaagaaacaaguuuucuguguccuauggaagucacucagaaugagauggaaacaggcuugacugugaauacccucuucucuccucccaaaacaagugacaagagaaauuaacagugaccucaauguuuuuaaaucaucaggcucuaugaaaaccugauaggggcuggacagaugucucagcaguuaagagcacugcucuuucaggggaccugggaucuguucccagcauccacucagaggcucacagcucuuuguuaacucuaguuccaggggaucugauaccaacuuugggccucugcaagcaccagauacgcguauacuacacauacauacauccaggcaaaauaaauaacuuaaaaauaaaagaaaaccuaauagggaaacgagucauuagugaaaauucagaacugcuggacaggguggaauauagcuuuaacaccaccagcauguggaagagcaaggcagaggcaggcagaugucuuagaguuccaggucagccaggguuaaaagugaggcccugacucaaaauaaaccaacaaagccaccaaugaacuuugcagacaccagcagaaagcaaaagcagcagcacugcggguuaaagcaggcugccgaggccccgccuccaucacagccaauacuucucacuaggguuugagcagcccagaggagcaagcuguucagcuccaacacccaacagcuggcucagucacugggacaccaccuccgcaggaggugauuuacagagccaaugccucacaaagucagagaaagaaaacaccuggacucaaaacauaaaaagugaauuugaggccaaacuggucuccagagaguuccaggauggccggcuacaaagugagacucuugucucaagacaacaaaacaggccgauaaaggagaaaucaguguccauuauuaaccucugaagagcuaaggccaugucauccacaagacaccaacucuguucacuacuaucacuuaacaaauaaacugaagacaauuccugagacaggaccugguggugcauaaccucuacucccagcacucaggaggcagaggcaggcagaucucccagaguuugaggucagcuaguuuauguaauagaauacagacucuaucucaaaaacaaaaagaaccccugaauauuccgugguaauuuaacagugacuuaggauuuuguugcuguuuuacuauggggguagggguggaggugggagaagaguuuccaaacaauaaguaaugaaacaauaaguaaaagagucauagacacagcauaugucaaaauuuacaugugaaaagcugagacaugacgcuaaacuaguaggugacaaggcagggugaucaggaggucaggaccaggggcuggagagcuggugcagugguuuagagcaggugcugcugcuuuuaggaggacuuggguuuaauuugcaguauccacauagcgucucacaaccaucuguaacuccaguuccaggggaaucaacauccucuucuggccuucccuggcgccagguguauagacuguauggagacauacaagcagggaaaacacucauacauguuuaaaagaaaaaaaaaaagaguucagaaccaggacuagguaugccuuuaaacccagcacuccagggcuacacagagaaacccugucucgaaaaaccaaaaaaauaaaaaaauaaauaaacccagcacucgggaggcagaagcaggcaggucucugaccaaggacagccuggucaacauaguaaguuccaagccaggcuacauagagaccauaccagaaaaagaaauggggcggaggaggaggcccagccugugcuacacaggaaaacccucaaagaacaaacaggcaggaggcauuacaguuaugagccagccugcugccugccuucuugcagcucacucaauaaaccguuuggguuuuuuguuuuguuuuuuuaagggaauuucaccaaaaucagcuauuaccauaggacuuugaguuaacugggcccaucacuucuucuguuauugaauacacaaguuagaauccacauguguggguaccuaugaaagccaaaagcagucccaccuccuuaagaguagugugacaggagucugggaggcuaccucggguccccuguaagacuaacacacacuguuagcugcugaccgacucuccagcccccgacauccagcuguuuacauggguacuuguaucuucacgagucugcagcaagggcucuaacccacacgagccaucucugcagccuugaggguuuauagcuaugaaaauauuucccaucaguuuugcauuucagacaauaacccaacuuuuuugguggaagaaacuguaagauauaaaacagccauuuuuaacacaccaacaauugagucuugugcacuacuuaaaacugaaaccuuagaaaugcugagccaggcacaggauggagguugcagcucggacgguagagugcuggcccagcacacacaaagcccugaucggauccccacaccaaacaaauggggcaugaugucacauuacauuuaacuuagcauuugggauauggaggcaggagaauccgggguauguuuaaguucaaggccagccugggaugcaugagacccuggaaaggacggugagagaaaaggagagagugcugaaacaguugagccuuacuuucuuuccauagacuuuuucuaggauuacagcaucauguaucuacauccugaaguuuaugcucuugaccacaaaaugucugagagaagagaaucuugguuuuugguccuauauauaaaaugcacacaaauuauuucaucuuuuuucuuaaucuguagaggugagauucaccaacaauguaagacaaaacuaccacacgagugcucuguagagauggcuaaaagaacaacuccacaggacaacagcuccgacaugugauacagccucuguaaagcuccaguuuccaggcgaucucauguccucuucuggccuacauggucacauagcacagagugcacacauggaacacauacauucauauacauacauacacagcauucauacacaaacuuuaaaauaaaccuacacacacaucacaaccaaaaccccuuaaaaugcuuuggcuuuccauuacuuccucuuuauccugugaacccccaaguauaagaugguacuaacuggcuuggugaaauggcucaguguguaggaauaauugcugcucuuauaaaguacccagguuguucagcucccagaacccauguaguuacacacacaaccaccuguaacuccaguucugguggacccaaugucuucuucugaccuucucaggcaccaggucugcacauggcucacauauauacagcugaacacucuuauaaauaaaauuaauaaaucuagagacuggagccauagcuucuacuggcugcucuuauauaggacccagcuuugguuuccagcacccacaugguggcucacaacuacuuccaauuccaggggauccaagaccucuggggacaccagguacacauaugauacacauguauacaugcaggcaaaacauucauacauauaagaaauuuaaauuuuuuaaaaaaaauaaauaucuuucuacaauaaaaaaauggcauuaucagggcuggagagauggcucaucuguuaagagcacuggcuaaucuucuagagguuguaaguucaauucccagcaacaacaugguggcucacaaccaucuauaauggaaucugauacccucuuuuggcauguagguguacacgcagauagugcacucauauacauaaaauaaaucuauuuuuaaauggcauuaucuuacaaagaaccuuaagaauagauauauauguuugaauguauaugguuugacugugucuccucccuaaacuucacacgcuggagucuuagaauggccaaguggaagcucuauaggugcuggccucagaagggaauggugguuucuugcacucauuucuggggagagggaguuuuuaacagucugguccugagcccugagucucuccuacuuccugucuggugagaugaccugcugucacaaucuccugcugccgugcuaccucaaaagcaggugcucaccagaaccaaccagaaacuagcaccauguccuugaagcccauaacucugugcuaaaugagccaauuuucuguuuuuggaaacagguuuaucuguuguagcccuggcucuccuccaauucagagaucugcuugccucugucuccuaagugcagggauuaaagguguggacaccuugccuauauuauaaaccucauuuuugguuuagguuuggguuuuucaaaaccugguuucucuaaauagcccuggcuguccuggaacuacaggucccacagaccagggcagcuucagaaucagagauccauuugccucugcuucaugcaugcugggauuaaagacaugugccaccacugcccugcuauauaaaccugauuuuaaaaagcagccuguuucaucauuuuacucugucucuuucuauagaaaugaugugcuuauuaacuaauucuaacaucucauaaaauggguuauggauaaucuuucuaaagaacuuccaugggcuuccaaaggacuagcagaaccacaacuaauuuuuuuuaaaagaauacaacuaaaguuuaugguggcccauaagucaaaauaaucgcacacccacauacauacugaaaaaagaaucauguuugcuuauauaacaauuauuggaccagaaaccaaacaugcuauuuuuagucuguuuuccaaguaacuuaagauauaaaucuaccuuguuucucauacuacuaguagucuacuagugaguuacauuagacccaaaauucauaacauuuuucuguuauguacuauuagaaacaagcaaaaucuuggugcauucuucuguuaaacagaguucauaggauuuuucaaaauuaaguauaaagcacaugucugacaaucucagguagucuauuccugggucuccauaaacuccagagugagaauuggacaaugugugcaaguuguccaagaucaucuaaugaccgaguauccuaaagccagccagucuugcacuacgguuuggcacuuacgagugaugaccugugcuauacagcugagguguagcucaggaguaguguucacuuagcacacuaaagggccuggcuggguucccagcaucacucacauccccagcacaagagggaucacauacagguuucauguagaaaggacuucaccccaguucucccgaggagaggagaggagaggagaggagaggagaggagaggagaggagaggagaggagaggagaggagaggagaggagaggagaggagaggagaggagaggagaggaguggagaggagaggagaggagagagaagagaaaggggaaggggaacacgucuuuuccgaggcaguggcuuucguggcuggcuuaagcagaaaacagaaugguguacagaaucuagugucaggcuagaaguuaagcauuuuacuuucaaguuucaguuucucaucuuuguucacguuuuucagacacccauuuguuugguuccccggagauguuucauuuuggcuauggcuguuuaaagucauuuggcucucaaauucuuuugaggaaaaaaggucaacaauagaaaugugauuagcugccucuauuuauuuaguuagcuaguuaguuuucuuggauuuucagcaucucuugugguggacuuagcuagccuacaacuugcuuagcuccuccuuccacccccugaauaaaaagaauaguuucccaaaaacaguacaagggaaccaugggaugagcaguaacuauuguacgauguuucuuuucuuuucuuuucuuuuuauucuugcacuaggugcucuuccagagaacuggaauucaauuccaagcagacacaauggcucauaaccaccuguuacucugguucuagaagaucugaugccuucuucuggccacugcaggcauaagacauguaugugguacacagacauacauguagacaaaacaccuauacacacaaauuaaguaaauugaaaauuaacuuuaauauaaaguaaaagccagaugaacccaagauaguucagcaguuagcagcaguuaacagcauacccugcucuuguagagguccagaguccaauucccaauauccacaucagauacccccagcuccagaucucgcacucacauguacaacccacccagagauacacauauacacacagaauuacagauagaauaaaucuuuuuaaaaagccagacagcuuagcuaugguagcaaaguuuauaauuacagcacucaggcugcuaaagcaggacaucauuaguucaaggcaaacuugggauauaacaggauucuauguauuucuguauaucuuaauuaacacuagggggaaaaaaucuguaaaacaguaguuauucacuccuuaaauaauagacacuacauggcagagacgcugagaggagggaagccacacagaccucuaauuacccaagcuaacucgaggguuucuagagcaaggaggagcacacaaagcacagcagacucacgaguggaggacagcccagacaggcggaagcaggaggaacucagagggcagaacacuaggucaugagaaggaggcugaagguggguacagcacacaauuccauucauauaagcaccuuucuugggaugacuguggugugcacauucaaucccagcacugaggaagcaaacacagggaguucucugagcucaaagucagcaagagacacagugaaacuguuuaaaaagaaaaaacaaacaauaaaaauacuuuuuuaaaaaaaagauuuauuuauuauauguaaguacacuguagcugucuucagacaccccagaagagggcgucagaucucauuacgggugguugugagccaccaugugguugcugggauuugaacuuaggaccuucagaagagcagucaguguucuuacccgcuaagccaucucuccagcucccuaaaaauacuuuuaaagaaauuccaaacucuuaucaaucuccuuuguucuaucaaguucauuuuuuuucuucucccugaccauaucugucuuugauucuuucuuuuuuuaaagacugggucaaauguauuccaggccagaccggcgacucaauguauagcuaucuccccaucucuaccucccaaguacuagaacuaaugucagccaagaguuuuaugcaucacuggguaccgaauccaagggcuugguggaugcuaugugagagcugggccaacucggugccacacccuuagccuggcggucaauaccuuaaaauucuaauuuccuuucuaaauaaaaacaaaaucuaagauaaacuaagaugaacuaagugauugacucuugagcagaauagacuagaagccaaggacagugauuucagaaugugagccccgugcuucaggaaucaggucuuucuugcuacucacuaaggccagaggagucucaaaugccccuggagcaccacagguggcugagaacugaguugaggcccgcugcaagagcagaacaugcuauccagccccuuuccacauuuuauuuggaaauaauugaacauaaacggagacauaucaaacuaacugauuccuaagguucccauugcuuaauauuaacuuuagcauaauaaaauucauaaagccaaaaaaguacauaaaauuaaguacucuggggucaggaaggaagugauguaacagcugugacauuaacaauaacaagauguaaauuuucauagcaauauuucccagucauuucagaaaacacuacaauuuaaaaaaaaauucaagaugggcuugccaugaucccguaguauggaccaacgaucugggcaucccauaacaagagcugagcaauccacuaagagucaagccggugacucacaucccugaaugacuaugcuuuauuguguagacaaggaaucaauuacaggguuuacaaugaaguuuuguuuaacuggaacguuuuaaguggaaguuaauugcacaucagugauaauagaugccuaauaacuagcuggugacaauuucuaaaaaaaagaauuauggcagcuaacuggcaaacaguaaucuauguggcauaaacauaaaaacaacuuguuuucaaaaguguuccuggcuaugaacaacauuugagaaacacaaaauauaauuuauuaugaaucaaauuauaaaaccuccugaaaagagaggcaucugaaauguuggcucuauaaaccaacaaggaaauaaaacacaccauugugggcugaagugccaauuuacacuggcaaggagccauucugcuugaauucaagaacauucaggaaccagcuggaaaaguaugggauugcacauucacccacaaugccucuuaagugguacugucugcauucagaaaggacaguacugguacccaugucuaaaacagccuaagcuuccaucaaucaagaauucuaaaucauguucaggcuuggaaaauaaacauuuccaauauuaacuaggauuguggaaggucucacaucauacagcaauggcaacugucagcugguauaccucgugaagcaaucuuuaccaugaacugaaauaccacugggcccaguggcacacucgaggcaggggcaggacagucacuguucagucaaggacauuuggucuacacagucucucaaaaagcuacucuucaacaagaaaaacucuaaaaugccaucuuaugguggguaauacauuuguaauuauuccuaaauacagaauauuugcuauaagaaaucuuauauaacuuguuauaacccucuauaaugaaauaauauacaaugacuuugagaggguaggggugaggguagauugagacagggucuuacuaugucacuguguagcccuagcuagccuugacucucuugccucuacuuccgaaaugcuaggauucccacugugugucaaccuacauccuacauaacuuaaaaaaaaauacacacacacacacacacacacacacacacacacacacacauauauauauauauauauauacuuugaggggcuacagagauagcucagcaguuaaguuugcacucuugcagagaaugaugguucaguucccagcacccacaccacagcuuacaaccuccuguaacucaaguuccaagggaucuaaugcugugaccucugaggacucuugaacacaugugguacacauaacauacucaggcacagacacacauaaaaucaagugaauauauuuuaaaugcaguauuuguuaagcuaguaugcagugcuccucuguggcuuccacuuagcuccuuccucuagguuccuuuccuuacuucuugccaugacuuuccucagugauaaacuguuaccaggaaguguaaaaugaaauaccacccaccccagaaauacugugagacagagcccugcuaggcaugccauagccuggaaguuacaacccuaccacagcguccaaguucugggauuauaaacaugcuaucaugccugucuuaauuuuuuuuaauagcacagaauacaauauuuaaguaucuacaauuauuuagauaaaauucaaaauuaucuagacaaauucuaacaucuauaauuagacuaaaaguagauuagugguugucuaagucugugaggugggcgaugauuacuuuaggacaguaacauucuucuuagaggaacagaaguauucuuuuuuuuuuuuuuuuuuuuuuugguuuuucuagacaggguuuuucuguguagcccuggcuguccuggaacucacgcuguagaccaggcuggccucgaacucagaaaucugccuaccucuaccuccccagugcuaggauuaaaggugugugccaccacgcccggccagaaguauucuuaaauuaaccauagugauggcuauguagccugucagaugugcuagaaacauucuuuggugguuuuaguuccuucuuuuuaaaauguaggaguguuuugccugcauuuuuguuuguguaccauaugugugccuggugccugcacaggucagaaaaaggcaucagauccccuggaacuggaguuacagacgguugugagccagcaugugggugcugggauugaacucauguccucuggaagagcagaagccaucacagcagcuccagaucuugugagcuuuggagagcuggaguuccagcucauacaucuaagaauauuaaagaauaaaaauuaaaagaaaacaagugacauggaagauuuucauuauuucucaagaaagugcuuuuuaacauuuuaacucuuuagacaccaauuagauaauacggguaaauuaacaaggaaggccuacaacaaauagagaacagagauaccaccuagagagaacuaggguuucuuagcuccagcugagccagccuuuuaggcuggcauauuuuucaaaagaacucuucagccugaauuuucauaugcaaucuuucauuuuuugguaaacuuacugaguaaaauaugguaagaugaagaaauggggcuaagguacagcucagugguagugcgcuugccuaacaugcacaaagccuuauguuuaauuccagcaacagggaggggaaaaaguguacaaauacaaguacacuccuugacgauuuucacaaauuaaacagauucaugugaccaacauggggaggaagcauaaaacacuauaggaggcuugcucagcgaguagcacaagccugacaaccuacuucaaucccacgggcacgcaugguggcauauaucgguaauuccagcaugccuacacggagaugagagguggaaagagaagugucccgaagcucagaggcagugaacccaggguaagcugcacaacacaacaccaagaaagacccugccucacuaggguuaacagagaacuaacucccaaaaguuguuuuaugaccuucaucugugcaucaugccaugaaccugucuacauaauacacauauacacacacacacacacacaaaugcauaacuuaauuuucuaauuaaaaaaggggaaguuaucacaucuaauauuuguuuuguuuuuaaauugcugggcuuuuguagacagcauuucacguagucuaggcuggccucaaaccuccuaugcagccaagaaagacugaacucaccucccggccuuugccucgugcugacauuaaaggucugcgcaacauucagcccaacagugccugaaaauccacaguggcugcuguuauucuuuacugauuuucaucuaguauugaguauuuggaaggaauuuacuuuuauuugaaaaacugauuaaaacagccaccagagguuaaggauuuagaucaggagaggagagcacugcuuagcacacaggaggcugagggcuuaaucccucuacacauauacagguguuuuuuuuuaaaucaguuucaaauaugaguuccauuaaauguuuauuugcaacaugaauguuaugcaaauuuucaucuucuaaucacuuuccuucauaucaaguguucuuuuguuggaauaucaacaugccaugagauucaguuuaagcucaaugggccuauucugcaguauuaauauauaguccuagacacgcuuuuaaaaacccaaauguuacuuuacagcuuuacgacuagcuauuagaguuuaagaacacuacucuguguacagaucuccuuuuuauuuuuccuaucuuaagaaauuaugcucauauauauacaauuucaaaccuccaaaguguguguguguggagggguaaguuuccccaugaaaaacauauaaaaagcaacuagaaacaaagcuccuaauuguugagaguucuguugugguccaaauaauaaacuauuuaugcuaacaggauguggugcacaccugguggaggugaggcagugagaucagggauucagggcuaugcucaacuacauucugaguuucaugucacucuggacuauuuacuucauguaugugaguacacuguagcugucuucagacacaccagaagggggagucauacugcauuacagaugguugugagccaccaugugguugcugggauuugaccucaggaacucaguuccacugagccaucucuccaacccccuccaugguaacucuuauaaaagaaagcauuuaacuggggcuugcuuacaguuucaaagguucaguccauuaucaucagccaguguacucaaccucugaaccauuucuuuagucuuguuuuguuuuguugagauagggucucacuauguggucccugugugucuuugaacucacagagauccacuugccucugccuuccaaagugccugaauuaaaggcaagagucacauguccaauuaaaaagaaauauuuaaacugacaaaccacaacaaaacagcacuauauucauauauaagaccacuaacauacaaaaaacaguauauaaacaagguguauacaccuauaauccuuagcacuugagguuaaggcauacagaccaguucugagaccaacuugggcuguauaggggagacucuaucuuggaaaaaaacaaacaaaagaaaacgagaaaaauaugcaacauguaauaauagcaaggcuuccagguagaugcacuaaagcuuuaucaaaaguauuuuacugcacuaaacuacuacuaagaaaaaaauuagugggcagcaacuugcugaauacauaaaugaaguaauuauaagcuaggugccaaggguacugagauagcaaaaacaagauauuacucuaaauauuacagaacacacuauacaaucuaauggugucauuaacauuauacaaauaagcaauauguccuagaagaguaacuguauuuuuagucccuaggcuaaacuagaauaggaaauagguuucuuucuuucuacuuaauuuuauuuuauaaguauuuuacucauucguauaucggcaugccgcuugugugcuuggugcuugcgaggucagaagacagcauuaagauacccuugcguuggaguuauggauggcuguaaacugccgugucaaugcugggaauugaacccauguccucugcaagaacaaguguucuuacccacugaaccaucugucuagcccugaaagguuucuugacaggaguaaaggacagaguugcuucuggaguaaaggaaacagauguagugcaggcaaagacucugacugagcuuuaaacuuuuucaggaaguaggaaaaagacaaguaugacacagauacauggaauaagagaaaaugugaaagcagggcuggggguguagcucuguggcaguguuugucugucaugcccuggguucaaucucuaguauagaacagaaggaaaagaagacaacuauagggaugagcuagagguguggcuuaguuaguagagugcuucucuagcgugcaagcuguucuaggcuggaucuccagcacugucuacaccaacggggcgcuauggccuagaccagccauucuaauccuaugagcacaugggaagaaagaggcagaccgccaugagacugcagccaaucugggcuagcauuaagacccugucucgaaaagaacaacaaaaacucagaaaauaucugguaccaaagacagagaagagcuaggucuagacugagaagacgaccaagauccucagguuaaagacacggccaacaucagagaggggccgacauucugaggaccuggagcagaaucagaacucgaaaggagaggguggaaucuaaguccacauaacuaccuacucuggaugggcaauuaggaaucccagguccaagaaugaguccaaaggaauucccuaaaaauagagucuaacgccacuuaacuccagacuuccucggaagguauguuacaagucauccugagguuacaauuaauucagucacaaccaguuagauaccacaaagacacagauaaaacaggccacagaugggugagagcuaaacacuguuuagagguuagaggauaagaauacuaugugaaauuuauuucauuuccaugaggggaaaacaaauuuauucuaaaaguuugugcauguuuuccccccaaggauuuuagauaauuuccauauugcuaaacuuuuuuuuuugcacauuaaaaacacugagggggagagaagauugguccucaucuuuugucugcuccacuuccuagcugucccauacacucacuuaauggggagaagguugcugggauacagcuuagugacagagcacauacguagcccuugguacagucuccaggaccacaaaaauguuuguugaaugaacuaccuauaacccaucauucuggagagucaagcaguagggaguucaaagccacccuaggcugcauaccaaguuccagaucaacccaugccacacaaugauagccagcuucaaagaauaacauuaaaaaguaaaauguaaucuuuaaugagaucaucucacuguuguaggaaacacuuugguuaaacacauuccaugggucuguaagcuaacccuuugccaagguguacugagagccaacuccagacuuuguaaaacaagaauuuacugcuuguaugugagccaguauucaauaccuccucauccauucuuuagcaaaggaacagaacuaauaggaugaaaccaauguuuuggaaccauaacacaucagaacacauuugcagaacuuauaaugccaguuuucucuccaaaacgcccuuugccuacucugcacccgaagaucuggcaucacaaaucguuuuacccuuuaccccgaagacuguucuaauuccuuucauucugccauuacacagcccuuaagaaacucaaaguagcugcaaauaaauccugcuggccccaaacaaaaccugcaauuuuuaacaaaaacucacaauuaauuuaguuacaagcuaagcaaucaaauucguggggccuuuuuuguuucucuuuguuuugcauuuuuugcucugaaaaauaccugcaaacuguuuacaagggggaaggauuaauccccaaauuacauuauuaauccucuuccuacaguuacucauguacuacagacaaaaugauuucugccuaacagaacuaaagucuuucguuuacaaggcuuuuuguacagcgcuuucacauauauccacuuguaagggugcacaacaaaagcaauaacuuuuagacuuaagacacauacaagauaacuuauccagaauuuggucuaccuugaguuccucgauugcaccuaguguggacgagaacaaaauaaagcccgagcacaaugaaaucuguggcguugccaguccccgaggaccaaaaggaaaaugucuucaaaugacaaaaaccaaacucaucccacuucgcaaaagaaaagcaaucccaaauaauccgcaaagcggggaccggcgggggaggaccccaaauucuaaacaugggucauguaaaucuuuucaacucgaaacuccaaacgcggcagccagcccaaucacagcauuagcgccuccucucuauuuucaaucuggagacucaacgaagaacaauuaaaaaaaaaaaaaaaaaggccacagcagagcuccaaaguuuuccgaagugagaauaaagucaucucaaguaaagaaaaggcguccagcaagaggcgacgggccggguccucccgccagccccucucccgcuccgcagcgcucgaaccaaaccuccaguaaaaaaggggggaaaaagaaaccuccgagggggacagaggacccgccggagcccgcagcacgccgccgaagagcggcccaggccgucagacaaagacgagcccgcccagcgccagcccggccgggucccccaaccgccccgaggaguugcgggagcaccgccgcccgcucccggcccgcccgagccguuucccucccaauuugggaaccgcgcgccuggggacaaagagggcgggcgcgccggcggcgggacgcggguggcgacgccccucggggcucggcgggcgcuccuucccgcccugccgcccccaggaacccggcccgccgccgccgccgcuuucgaggcgccucagaguucgcccggccgcgcccggcccggggccccucaagccgccgcucacccggcggugggcgcccccgaagccgccuccuccgccgggccucggcccgucccgccggccgccgccucaugggccccgcgucgccaucaccuucgccgccucgccgccgccgccaccgccgccgccuccuucgccucagccuucaagccgaggcugaagccgcuccggccgcgcccgccgccucccucucucccgcucccgccgccgggacccgcggggaggcgccugcgcacugcgugccgcggugggggugggggcgucccgucucggccugggagcgggggcgcggcugcacgugcgccucgagugggagggggcgcccggagcgcgcggccccgcgccggcgccaacuuuccgugaccggccgcgcgcguucccgggcggucccguacgcggcggggcgcgcgguggcgggaggaccccugcgcggggagccccggugggcggcugacuucgagcgccgcgggcucauuuccuguggcgugauuccccggaggagccggccagugacagcgugauggagacacgccucaccugaguuuccagggucggaccgcagagcuccaccguuaucucgugcgcuaggucagggccuugguccagcggaucucgggaugcucauggccguucuaggcucugcucugcaguugcucgaaaaaccuccggggcuucucggccaaccauccccgccugguggaaucaugguuuuuacaggcguucugcauaguuuug

SEQ ID NO: 6431 - RNA, 5241 nt, Mus musculus
cuucuucucugggcccaagcucuccucuguuccuugggaauggggccaggcaaaggccacagaagaaaccaggccagaugccccuuccucacugggauggagguuucuggggcguucagacggccccauagcaguucccgaugcucagagcucgagggcccagucaccaggucucggcuugagucuagagcugccagccccuucacucacaugggauaauugagcacaacauccuguuuggcgagcuccagcaacauaggaucgucgaagaacuugcugaugcucacaucuucacucaggcccuguggagcagagucagacaguaggguaagcccagggucaugcagaaccuguacuugggggaggaaggcuggugaaggcugccugaggacuugugccuuuaggguacugccacagcuccucugcucccuuugggccccaggucugcuugucugaggugugcagagacugaucuuuccuccaagaggaagaagacacacaacuccuauggaaucuuggggguucagagacggcaaugguuaaaagaacacacaccuuccuacgacggguuuugaucaugaacucccgagccaggugaggagcuggcuguggcuccagcgggcgaaugacaaugcucuuguccagaggaucgccugggacaaucuggaaggcaaagagguuucagguagaugaggcagcuuccuggagaacucagagccaggagcaagaacuuucuccaggauuguaaagcauccuggacagaggggaacuggcugaaaggaccgucuaccaaagugggaggcuaggguggcuggguuuccucaccugccaaugguggaagacagacagggaaaaggccugucccugggugugagugcggagaucagucucaaagccgaaugagucgauggccgggaugaacgcuuugaugguauagagaggggagccugguaugggugcauccugagucacaugaccccugagaacgacaaaagccaaggccagaguuguauaucgacccaaaggcagggggcaaucugccuccuguccuucuuuguguauucuagcccagccaucaucaaguaagauuuaauggaacaugcucuacagagggaaugggcuuggggcucuuagcagaagccacaggagcaaccaccuaugggaggaggcaagaguggggauacugaagagaugggacccaaugacgaccccaucacugccucauuuccacacuucucccaggaaccggggggguggggaggcaggagcagcaagaagaaacuguagccacugccugugguaaagguaggagugccucagcucauuaccuccugugggaaugagaucagcaggcuucugaaguggaaagguggggagagcaaugguuggggcugcuucccaguacccuccccaacaacaggcugcucaccugcgucuggccaggacuguguaaacagcagacacacaaucugcaggagccuggaccucuacaaaguaguaaggcuccaucagacggggaguggccugugacagagcaagaaagggcuaagcuuggcgauggcugaagggcgagguucuccagaccucuggauccuucuguggccucugccuuguccuccauguaauuuucugcucagggaaccaggacagccccuauaacuccacuuaccaugaggaaggcagaguacacuacccuccuggcugugggaaugaucugaccuccaccccgguggagggguuccugggcaaccacagcauccaguaucuuaaacuugacauuccgaaucacugaaaaggagauggaaagcgcacgguggagcagcaggguaauuugcuacacugaggccauauugcagccacacaaagauaugauacagacagcucacauccagaucagcaagcccaauagcauauaggucagcaguuuaaacauuacuuagcauuugaguccggccacacugugacgugugaacauucuuacaagcguaugggcugguucugaguaacuuuuuucuggacauagacugugcucuagaaauuguauuuggaggccgggcaugguggugcacgccuuuagucccagcacucaggaggcagaggcaggcagauuucugaguucgaggccagccugguuuacagaaugaguuccagagcagccagggcuacacagagaagcccugucucaaaacaacaacaacaacaacaacaaaaaaaaaaaaaaaaaaaaaaaaaaagaaagaaaaaaagaaauuguauuuggucccacagagauuauacugcaucaauaaaccacuccaaccugaucaccucauguuaucucauguuaucugucuucaacaugcccaaagacgggcucuacccagcaauuaggauccaggucaaucuagagaugccuucauuuuggagauggggaaggagcugggggugggacagggggugagcggggaggaggcuggcccaguguaaucuuuuccugcugugucugaaagccgugaagcccuucccugugccaccgccucccauggcuagguacaggguccuggggaauggagcugcggguugaagguggacucacauucaucgcagagggguccuucccuggucccccacuggaaaccuugaacaaugcuguccuucacugagccgagaagggccuugucuaccugcagaaacauuaggucgucuuagcaggcaguguuaggaggagaaaguacggcugugagaagccaucuuucaauagggaagagggcacugcagguucuucaucuagggauaacacuuugccacaggcauccuauugguuuaccucugagggcaguguaucaucuacuaggauguuggggccuguagcaucagguccgaaggcccagauggaacgggcagccagcagaucccagucguacuuuguuuggaaaaacucucccagcuucuuucuggaggaaagaggaggagacuccuggggccacagauccugccuuucuguaagacagcggcccacucuacccacaccauagucaggacaacagcgaaagagggauggugucaggagaccaggcaaagacgccauagugugaacacuguuccaaccuguuccaggugaucuggaccacuucauucucuauguccucagcaaggcccuucucaaggggcucggcaaucauggugaucuuguuccuggucagaaaggacaggggcagugagaagguuacaggaugaguagggccaacagcacagacugcugagacagcaagagaaauggaaucuuggagcaaguucagcaaagggugucuucuuucauuucuguuuuguuuuaaaauacguaugaguuauuucacuugcauguauguaaguguaccacauguguggagugcccaaagaagccagacaagaguauuggcuacuaaggacuggaaguguaagccaccauguggcuggaaaaauguuggucccucuacaagagcaacgagugccuuuaaucauugagccaucucuccauuuaucugcuuuuucuuggaaagugcggcuggggcuggagaguggagccugccagcacagcacguguaaacaugugugaggagccauuuaaaaaaaaggaacugauguugaagcuggcauagaggcuuaugcuuugaaucucagugcuuagcaggcagaaagaucugacacuuccauguagugagcuucagaucaucuuggucuaugagagacaucaaaaaucaacucacucacacacacacacacacacacacacaccacaaacacacacacacacacacgcacaccuacacacacaccacaaacacacacauacacacacgcacauacauacacaauacacacacacacaccacaaacacacacauacacacacgcacauacauacacaauacacacacauacaccacacacacaccacacagcccccagacaaucucaagcaauuucuccugcuguagagcugaggcuggggcaggcuuggagugagugugggagaggaggaggcugucagucccaggugcccagguacauguugccagccucuaucauuuucuuucuuuuuccccaagacagggugauaugaguagccccagauggcuuagagcuugcuaugcagauggagcuggcccugaacuugcagcauuccuccugucuugccucccaagugcugggacuacagucuugagccaccaugccugauuuuuguuucuguuuuuguuguuguuuuuuaagacaggcguucacuauguagcccugacccuggaacucauaacauagaaaucuaccuggaugcaucuuaagugcugggauugaggguguguguaccaccaugucugacuuuuuuuuaaguaaagaaucuaauaggcacucaaacuugcuaugugacugaggcuggccuagaacuccugauccuccugccucuaugucccagguaaugggauugauuacaggugugugccaccacacccagcuucuuccuuugagugugugaauagguuugagugcgugcucgagcauguuuauagucauguguguacaggcugaugugggguaucuuccuucccauacacgcugcaccccucucccccuuuuugagacagacauaaugaguuccagggcagacugagcugcgguacaagacuguuacagaaaaacugaaaaagcauacaaagcaauggauuucuuccuagcauuuccccagcacacaucacuguauuuguuccuuacugcucucuggagcccccaccuccugcuuacuucuuauugggugucucagcaaagcauuugagggaggacguuucuaccacugucucacagaaugucacaacugggucagccaccuaggcaaugagaaacaauugagauaaaugucaguuuuguuggaaggacaaaguucuacugagggaauucugaugcaucccuguucucucucugcagagcauccuaugcaguucuacagcagcaggccaaagaacuguccacaucaccaccaaagaguccgggagcagcaucaggaggaagugggggcacaaacuaggcucuaaaucuagggcuuuaauuauggucuuccaagaaagcucccgccaccugccgcucacugaccaccccucagaggacgacaggaacagugcuagagaacugcaucuguccacucucaggcuccagcuccagaaguacagcugcccuguaaugcagggccgugcagacaaugucauaccaugcauggugcuaggucaagacuug

SEQ ID NO: 6432 - RNA, 7497 nt, Mus musculus
auggggucaaaauguuuuuauuauagcuuuggucagaccgggugcagcuguuccaggguuuugugggugcugggaagcuauccaaccccuaacccacuccuccccaaggcagggucacccuacaggaagcaaccgcgccaacucccugccccccuccccagacuggggcuggcuggcaggaggggggcucaguaaacaguccuauuguacacauauacagugcaggcugggaccaggaaggcaaccugccacccgggccggaacugcgugcgugcgggaagaggggagcuuuguguucagcggaggaaagacugggugguuggacgcaggcuaaggacaauucagccugggagggucggcagccuuggucaggcaauuugaaaaugaguaggggaguggauucuuguuugccucugaggggaguccaaggaugaagagccacggaugaaaaggggugcgggggggggggcucaauccgaguagaugaugaagccagagaaagugcuguauuuguugcuguugcccccgugugcuuugccuccauccagcuugaugaagaccucauccccugcguccagaugcaggaucacgcuguugcuggcauagucguaguucuggucugcauccugggcaauugcacuggcccgcaccuaagggggguaggguugggaaugggggguggaaguagggauagggauggggaguggggcagugugagaggggaaggaggugaggcagccacauggugaggaucuggggacccuaacacccagcuuuccagccauucaggaccuuggcuagcuuuuccccaucgucccacccuaccccauucuaaucauguauaacaguuuuggaagcagacauacaggagcccuggauucuagggcagaauacaucugggccggaauuugaaguccagauggaauguuacucuguaacuccugcaggucuuaccaucugccuacugccaaccucagugccuucacugguggcccagcuuggaaguucuuccuugcauagagagcuacauuguauuaccagagaugcaagaucuuccccuucuccuuaucaucccuucccuccugguucaacagagacaguguuuucaugucugucaccacccaccugcucuuaugucaaacgcauggacaaaggauacagcuuggccacauaggugauacagcuguagcaauaccagacuguuaguaggaagcucucccagagccagggucucuggucuuaucaaagcucauuccagagucccucucacuggagcacugagacuuaaggccugguaaugcucuccccuccuggaauuagagugaccucauugcccaaggccucugggaguuauagcuauguccccgugacuauugcccuggccaaaggacuuccagcccuuuaugucuuaucacaggagagcagagaggaacaagacagacagaaaggaauuggagccuucugucuucugugguccuuaucuuaaaggggagugaggacaggaggaaacgggucaagagaaguacuaacauugggauuugaagguuucauugacuuuuugaggcucugacuaguuuuaagacaucgggggagguguugguaguugaauuaucuguggauauuucugagggaacaagagaaugaaguuuuagaacauagggucucccugaguccaaggguaagaaacaggagaagagggacuagagagauggcucagugguuaagaccauugucuguucuuccagaggacccagguucaguucccagaaucuacaugacaguucacaacugucugaaacuccagcuccagggaauuguagccuucuucuggccucuguaaggcaucaggcacacaugugauguacagacauacaugcagggagaacacccauacacauaaaauauauuuuaaaaaaaaauuuaaaaauaaaaagagagagaggggagaaaagccaucccuggguuguggcuugcaguggggaaggguauuguucucaggugggcuuuugcacaguuccucucuaucgcacuguuuuucugaaggcagcuccuguagcccucuaacagaagacuaaugucuaggcugaacccaaaucgcagcuggcgaggagggagaaagggaagaggagggaagcagaaccauggagccgccuugcuaaaacagcugacucagcagcaccgcuccaccaaagggggcccaauacauuuggaugcagcccucccaguggccaguguccuucuggcccugucccucuccuuaaccucuucccacccugggcuggaaccacguggauuauaacuuggaaaacaucuaaaaauggcaggaggaaggguugaugagauagauaucucagagauaaaggugcuuacuugccaagccugauuucaguccccaggaaccuacauagcaggacagaaccgacuccuacaagcugacuuugaaucuccacaccaagaaauguuaugccuccucacaauaaauauauauacuaacauuuuaaaggugggccuggcagucaggugcacaccuuuaaucccaacacucaggaggcagaggcaggaggcaggaggcaggaggcaggaggcaggaggcaggaggcaggaggcagaggcagguggauugcugugaggucuaggccagacuggucuacaaagugaguauagucauaugucagccaaagcuacacagagaaaugcugucucagaaaaaaauaaacaaacaaggugggaggagauaaggaagagacugcuuaucuaaacccucaguuugccuagaaaaauggaucagaaauccuacccaaccacugccaccuuuacaaaagccuuaagaugauaaagaaaaaaaauuaagucuugauagggcuuuaaaacuagcagagaggagcuaagagcaagcagccagacucuguauuguucccugggccccaauccugguaguauuuauuccuacacgugcacuucauuaucuuugcuaauaaauuagcacuaauaacaauuauuuuuauuacccagauuaauuuagccuuaacucauuaaaacagugugcacuuuaauagccaaauccauuaggacacagucauccaucaacaggaaucuccuggugaugugacaggcaucagaacuauuauguuuacguuuauuauuuauucaucaccaugauuguugcuguaauuauccuaauuauccauggaagcagcaagaauuuaugcccuuccauccuuagacaguaggggauccugaaauggaacccaggggucccaauucccuacccaagauuugaggcaguugcauacagcuccucuugggagcccgagggaggaugggggaaauggagguugccauggaagccagaaagcaggcugugccuuggaucaggcgggacugccaagaggggaaacugaggcagugguuugaccaggggaacugagcugccaggguauagcugggaaaaguacuccuguccccaguccacaggucuugggugugcagguauggcucccagaagucgccagccugguucccagagcacugucggcucagaaguuuacuugguuucuucuaugccagguucuaggcuccgugcuaagaauggccccagagucuagagaauagguggaucucuguccaccuuccagaugagaagcugauccuugguggcuuucucugugugacagcccuggcuguccuggaacccauuuuguagaccaggcuggccuugaacucaccgagauccuccugccucugccugcugagugcugggauuaaaggcgugugccaccaagccugucccucaguaggucuuucuuuuuuuaacagcacaguccucaauuuauguaucugucagccuucauccuccaagcccuaauccauguguuaauacucccacccuccccauacaccccacccuagacaaaaagcauacugaccacuggcauguccucauacaaccucugccuguagccauguuuaucaguuuguguccacccugaccugugucaaccauagacacggagguagcugugggcaacucagcagccuagaucacuuuccccaggcuccuccuccuaagcacuaggaccaggagccaucagauugggaguguugacucaaagcuaucccguggaugugcaguggacugcacacaaggguccuuaggcacuaggcauguggcugacaaucccuuuuucuacucauccuguccagggaaggaccaaagcacagaucggaaaccccucugcaagcaggaaaguaggaacucaaaaccuacggaggccucugauccugaaggcacugaacguggaagguucuccccucggcccccacgcacucugcagcccggccauucuuauccucugccuaguuaaauggcuucauaccucuaagccagucuuccccuacacaugaccuucuccuuccuccucaguggugucuccugacuugguaaucagagcugccaucccuuccucucugccaagugguucugagcuaggguagggcggacccaccaccggaucucucucucagaggacacauuuggaaacaggaguugcuaggugcacccccagcccaccuuuaaugcaguguguauugaguguguuaguguaugcccaguacuauugugcccacuacauaagccauaaagucuuagaguguagauggacuaaccuacuaaccccuuggugcccaacaagcuucaaaccuuguuucuuguggagggcacagcuaacaugagggcucauugguaagauucagccagccucuuggacaaucuggaagaagucacaaaaggcuguagacuccauuguuauucuugguuauuuuguuguuguuguuguuggggggggguggucuugaguaccuguuaaugugcuaagucuuugaaacccuaaaauucccauccagugauccugcaguagccugugguccucucagcuuguuaccucuccuccauuaugcucugacagcauccuagcacugcugguagggaaggaagggauuagggaauguuuccgccuccaagggacuaaggcaagcagccccacuacaagcaccugcuaucuugggagcuuccucaugcccuauagcuggggcccugcugugacccccuguggucuaagcaaugucuaagggacuagugaccacucucaaugccagcaagccccuagucccugaagccuucacuuuggacuagcucaaacuuucuuugcagaaggaagacagucccucaaugaaggugacauugcugcaugccuuauuggugauuaauaaggggacuuguggggcugucugcaugagccuuugcuagauguuggagccucccaguuuggucaggaaccaaggacaaagaggagagacaccagaagccugauagacacaaaugggagagagucacagcaauagagaaguggggggaggugaacccagagaagagagacagagaugaauggcagauuccaguaagaaauggucaaaagacagagcaagaagaggcagacacgauaguggggacugggaggagcaggcagaagaaaaaaagaggacagacuuccacacagauaggcuuucugcccuuucuccuauccccaaacuuugcagauacccaagcaggguagugcugcagugggagggguuccgagaagaucuggagucucaauuguaggggauuccuuccagcuuccacuugccuacccucaauuuugacccuggccucagcuaaaagaagguucagucugaccacgcccccgggguggggccccuguaacccagaggugagagcgcagggagcugagaacccagggugggugguuccaaggacaccgcugugcauccgugucucagacacgugcacaccagcucccuauuuucuaggauacuggaggagcuguaccuggagacuuuaaggaggggaguuuccaucacuccgccccgccucuagaggaaacuuuuucccgggaggcgcaggauagcucuguuacucugggaaaagguggagcauuccagggggguugcaaaggguguucguucagcucgauggucccuucucuagggccagggauguacugcaguuaaggcuauugggcaacgaacucccucugccuuugugcgcaaaacauuuccugcagcccuccuccuucuucuccugagcgcacagccacucgucuuagcgcccuccggcgcggagacugcuucuccuuauccuugcccuagagcauccuugcuguucccuuaaagccagucggcgucagcuugaaucuuagcucucaagagaaaucagccugaaucagucucccacgggccaaaccccuacggaccaguucgugcgcccuagagcccugugaucugacuaguuggauuuaucuuuacgcauuuccacuccgcgggugcccuguagccucucccuuaagagcucaagcccaaggguugaagacucaggggugcccgcuaauuacaaccauucuucacaugauaguuaagggggccgcuuuagggucuccaccuacgccugcccggugugccugucgacucugauccaauacgcauucuccugggggcucccugggagcccugcccccaggucagccccacgcccccucauggcccaccuggccguucuugcagaggucugcccacauacuggugccgucgccgccgcgcaugaggacgugguaggugaaaaaguaggugccaggaauguugcauguaaacuugccgcuggccgcaucguaguuguugccuagguuggugaccacgucgucaaacuugagcaccucguaacccucaugaggguucuugaggccggcguagaaggccacgcguggcaccgugguauagguggccgugcugauggcgccgcugccucccgaacccggcaggccaggaggaccaggcuugccugguucacccuucuccccaggcggccccacaggaccuggagggccccggucuccuggaggccccggagggcccggcuugcccgugcggcccggcuuccccugggggcccugcaccagcguggagggcggaggcgcaccgcucugcucgcucagagcgucgccgccgucggaccgcgcgccggcgccggggccccgcgcgggauaggggucgcacaccaugcggcaggugcccagcaucucauaguggccguccgggccgccggagcucaccagcaccgggaugagcaccaccagcacgagcagcaucaccacgcccgcggcggcagccagcagggucuuccggccggcgcggagccuugggagagccgggccacccggccgcgccgucggggcaaugaugccggcggguaaggggcgcgggcgcgacgcccgcgcucaagggcgguccggcggggcugcgggcauggggccggggcccgggcgccgcgcugcgcugcuugcgcugcggagcccagcagccggcuccggccucgugcuucccucccgcugcgcugcccgacugaacgcggccucccgccuagcgccuagcuccucccgccuuccc

SEQ ID NO: 6433 - RNA, 1545 nt, Mus musculus
uagagccguggcacagaccuuuauuuaauaaccggugcucagagaccuaaagcagaagacuagugaguucaaggccugcagggacacacuaaugagccccuggggauaugguuuauuagaacagcacuugccuggcaugcacaaggcccuaauguccagcccaucccaacacccacaguccuggaauuuaacucucagaaacagccccaaaucuccccacgccuagggcuaggccuugcccagccuugugucuucgugcccacugcugaccaggccugcaugucucuuaacaacaggauuucccagccugguggagcagccgacuggcgagugugccaacugucccgugcuucccagcuccuaccuugccugucuucucucuccugggaagauguuccugguggggcugacgggaggcaucgccucaggcaagagcuccgucauccagguauuccaacagcugggcugugcuguaaucgacguggacgucauugcgcggcacggugagugcacagcagcguccccugugcuuccaucguuagacucugucuucuuagaguguccuggccuccgcuuacccuggagguucuucugcuuauucuucauccuccucacgauccagucguccuaaacucagcuccaucaccggcuugagggaguccuugugcucugcucugccccuucguuuauuuuggcuccaaccaaagaaagagccuuggagucccccgucagucacugggguggggagugggggacuucugaaucacuagaggcucuggaaugacccaaccucuucauaccccaguuguccagccaggguauccugcccaccggcguauaguagaggccuuuggcacugaagucuugcuggagaauggcgacaucgaccgcaagguccucggagaccugaucuucaaccagccugaccgucggcagcugcucaacuccauuacccacccugagauccgcaaggaaaugaugaaggagaccuucaaguacuuucuccgaggugagacuccagaugacccccugacagagcaggggccuuucucuguuugaggcugggccaggcuaggaguuggcugacuagaaggcuuaguggucuagcucccccugucagucacaguguggagacuccuuccuggagaguaugaggucaaauguccuguguaagcauagccaggcucuuguucuucacaccucagcuucuuguguaugcaguagggaaugucccccuagcacguccucuggucagcacuucccucugagagacaucagugaaagcaucuauacuguuggccgaaaccugucccucagucccuaaacugcugggcaggccgagcuggcuccuagcacgugcuucuguaagugcgcuccugcuguuugucccugacacacugccugccaggccaccacugugccacugcucccucugcccacccugccuggcagagccuucugccuuuccuuucugcccuuuccauuugcucccaggccagcucugaguacacuugcagagccgugaggcaccgguggcagcuuccc

SEQ ID NO: 6434 - RNA, 5376 nt, Mus musculus
cuacuggucaguagcauuuauuuauuuauugcauuuuuuuauuuauugcauuucuuuauggcauuuguuuguuuauuuauuuauuuauuaucuuuaauccuggggcuggcaagauggcucagcagucgagagcacuagcugcucuuggaggaaggaaauacagguuacuacccagcaaccacaugguggagaacagcagccuguaacucuggcuccagagagagcaggcgcccucuucuggucuuggugggcacugcacauauguuguauacauaaacucacacagguacacacacauacacauaauauaaaaauaaauuuaaaaaaauuuaaaaaccaacccuuuaguccuuugaggguuuaucccugugaucagagugagugagagguagauuucccacacauguuuuuuuuuucuaucuacauggcagcuccuuguuccauggccuuucauugagauaauugucucaacaugccaugccuuaccucccccaccccauccccaucucccagcaacauggccagcuccagucaugcuggccucugauagcagcaacugguuggauagucucuccugucucuuccuagcagcugaucagucaguggagcagauuugcaugucucucuucagcagaccuuggcugagcugaaggaguccccuuggcugggcugaagggcauuccagaguguggaagaagugagggucucugccuuuagguaucaggcugggcaggcuucuaugaucaaagccagaggucuuccugcucccugccuuacagccuugagaguagacaguaccaagaccauguauuuggcuccuaggugcuagaggcuugcuagagauccuggcugccccaggguuccugaggcagccuugcacacaggcacagccuuuuauugagccagauccugccaaccaccuggccuggcccugcuugaaucagacagaaggagagcaagacuuggguaugaaccauaugccuuggucccaggacccccagcccuggacugcagacuaaauuguucacgagagauugggagucggaggagcuagaagaacaagaugcuucaacaagaugcuuccagaugaaaaauaacaaguugaguggugggagcagugagggugaaaaacgguuuuaaaaagcuuugaagguggucagcacgguauaauaccagcacucacaagguagaggugagaggaccaggggugucuuagcguuucuauugcugugaugaaacaccaaaagcaaccuggaggggaaaggauuucuuuggcauacacuuccauauugcugcucaucuuugaaggaagucaggacaggaacguggaggcaggagcugaugcagaagcuguggaggggugcuguuuacuggcucgcuccucguggcuuguucagccugcuucacaacaugaagaacuguauucuucaugggucgaaguauuuucuaauugagguucccuccucccaggugacuuuagugcgugucaaggugaccuaaacuauccagcaccaagaguuugaggccaaucugggcuauacagugagucaggccagccuggucuauauagcuagacacugucauuaaauaaauaaaugcaagcaaaugaaaggguugcagcagugggacaaagggcugaaugagugaucggacucagcaucucacacaugggaagugcuccaccacugagcuccaccccagcuccguucccuuguauuuccuuuuauccuuuugcaugggugcguguagguguauucucauguauauggguggcauguaguuguauucuuauguauguggauggucuguaauguucucauguauguggguggcaugcaguuguauucucaucuauguggauggcacguaguuguauucucauguauguggaugguguguaguuguauucucauguauguggauggcauguaguuguauucucaucuauguggauggcguguaguuguagucucauguauguggaugcacaggugugugcauacaaguggagacccuaagcugaagucagacaccuccaggcgggucuccgguuacuguuucuuugucagaccugggaaaagccuguccuugucucccuugcugcgauuacaggugggccaccacacccacccagcucuucccuggggucuggagaugugaaccccaguacucacgguugcacggcagaugcuugcuuuaccugcugagccauuucccuagucccccacuuucccuuuugcuuuaagacggaccugguuaggaacauaguucauccaucgauagagcacucguccagcuuucgaaacgcucugguucaaccccggagcuucaaaaacaacacagaaaacugggggugcgacccaguugguaaaacgcuugccgagagugcaugaggccuugggcuugauccucagaaccccauaagccaaguguuuagaaggaagggaaguguaugaaucucugugugugugugugugugugugugugugugugugcgugugucugucuguguguaugucuaucugucucuguguaugugcaugucugucugucucugugugugugcaugcccaccugugugugugugugucugucugucuguguguaugucuaucugucucuguguaugugcaucugucugucucugugugugugugugcgugcccaccuguguguguguguguguguguguguacugucugugugugugcgugugucugucuguguguaugucuaucugucucuguguaugugcaugucugucugucucugugugugugugcgugcccaccugugugugugugucuuuccgucugucucucuuucucucugucacacacacacacucacacaaaggauagagaaaccaaguuuauaaagcaccaucaggaccaaggugauuaaaaaagaggaguggacagagguuggaagugaggccuccauagccugugaaggcucuucaggcccagguuagggaagcuggcuugaacaagaggucccugugcccugcaucgaaaugagagaaaagucugagggguguguggguaaaaggcagcccuggucacacuuucuuacucuguaccuuggcuccacugggcagcccagaaguuccuugaugggcucugcggggcccucugccagcaccccuagugugugccaggaaggagccacacccagcucgcccacccaggaggaggaggcccagcaggcagcuccaugaggucauccagaggcuggggcagaguccggugcuuagggugcccaauuggaaaccuagaaucagaaaagcagaaacacacccagcuuucuccccagggccccgugggugugggaacccagaggccagcuguacuuucacagaaaccagcccuggggguggggaagaggacagccccaugcuauacagccaaagaaacuagggcccaaaaauuccagccagugcucgcugaaacagagccuacccagacccccacaccucuggauauagucauucuguguuuaucaagauaauucagccccaaaccuaucguguucgggauucuguugaggugagcaccugccugggaccacacagucacuccagauaguagugaagugcucugcccagggcugugcucucguacagccgugagcguguagcucucuccguggccuggguggacacggaggguuacucagucacuggccuacagaagguguaguaggggagggacccauugugugacaagauugagauaaaaagcacaguccuuccugcugucucuccacccagucuggguagcaaagagugggcaggcuuagaaagugaauggaggccuguuccuggcugaguauuugauuugugugcucucucucucucucucucucucucucucucucucucucccucccucccucucuccccucucccaccucucuuucucuuuugcuuuucuuuagagagagauucucacuaaauagccaagaagcuacaaugaacaaauuccaggcuaccuuccaauuuacagcccugccucagucuccugagugcuggaauuacaggcacaggcuguucugugcaguauguuuugggggccuuuacugugccucucaauccagggggcaggauuuuccccuugcacuguccccuuccccuccccuuccuuggaagguuuugaagaugaggccuggagagggaaagggggugauugacaacuggucugugagacagauggggugauuggucugugcagguggcucugcccccuccuguucucaacauggugugcuugugggcaccagcuguggucaucaccucagcuuguuaggagagaagucgagauagccugagagcuagccugugcacccagaguaguacuggcuucccgggagccaccaacuggggaccauguacccuggggacuggguugcugauagagcucagauaugggugccgaaagggcagagggccacagcgccucagcccuccugcguucucaccgaguguuucaauccugcccugucucucugggguuucugcaaugggagagcaggcaggggucagagucuacacuggaaacaaacuggagacucagaagcagggcccaggaaggaggcaccuuggggagggacaggacagacaagaugguccccagagacuuggagacacagcuauagcuacucacccagggcacgcugggucugcuguguguggcugggauuggagugugcaccuuagugaggggaugaagggaggagagaucagaagaaaggagcggguugcuguccuaccuccuuucccucaguggaggugagcggauuaggcacuuggauguagagacgucuaugggguuggauguauguggccacccaggaggaagagggccaaugugccuugguaaccaagucuggaggagacagagccagguggucgagugggaagacagugguguggucgcugucccuucuguucucuuggcuggcagagucuagacaccagcuuccccauaccgcauguguccaaaccccuuccucaucugaaacgucucucuccacagccuuccucuuucccuucacacccuccuggaccugcggcaaguccacagccacucacagucuugugucugagccucaguacaccaggcuagcccgggguugaagcccucuccucagaguuucuuuccaccuguccccaucugagccucaucuuccacgacacccaugacuuacacgugaacgauuugguagaggcugauccaagcugugucuggggauggaaugcagaucaauccaaugugucacuggagcacugagcacaggggcaggguggucggggggaacagccaguggaguccaggaaacaugaaaacaccccaaccugagccaccccacacccau

SEQ ID NO: 6435 - RNA, 5394 nt, Mus musculus
aacuuugaagaugauuuuauccacguccccauuucagagaaggaaaaacugaagcccgaaugcagugggcgugggcaggagcgggacucgaacccuugucuuugagccccggacuccaugcucuuccccgcugcgcaguccugaccuuggcggcuccuuuucuuguugccugcagaaaagcgcgguggucgcgauggcggcggacgucgagggggacguguacgugcugguggaacaccccuucgaguacaccggcaaagacgggcgccgcaucgccauccaaccgaacgagcguuaccgacugcugcgccgcagcaccgagcacugguggcacgugcggcgggagcccgggggucgccccuucuaccuccccgcgcaguacguacgcgagcugcccgcgcucggcgacccugccccggccccgcagccuuccguaccgcagcagcgccccgcagucccggaaccucuggccuacgacuaccgcuucgugagcaccccggugggcgccgauggguccucugccgagccccggggccgcgccagcucccuguguggcccugcacgacagcgcaccgguggccagcgcaacagccuggcuccgggagggcccgccugccuuuacgugcggcccgcggcgccugugcgaccggcgcagucccuggaugacuuggcgcgcggcgguaccgcgcccccugccggccuccucggcagcgcgggccacuucaaggccuccagcguggcgggcuccuggguuuguccccggccccuggcgccuagcgacucggagaaugucuacgaggccauuccggacuugcgcugcccuccgcgggcagagagcccaaagcagguaggucgcugcgagcgagggggccggagggaggucacaguccagcagagucuagaugcuuuuuuuuuuuuuaacugaggccacuggaugucccuccaccucacuuauuaaguauucacguuuucaugcaaaaugcaaaugagcuugauuacuacagaguucugccccaaagcccgcggggauguuaacuaaccuauguccgaauaacggaugcaugcgccgaauaacguuccuaaaacgccaccugcucgguaaggaacaguuuggagagguggacucucuucuucccuagaaacuuaggguggagguugggucagaugagaugguggaugugaaagucagacaucugcuucucuuuagcauagcuuccaauauuucaguuccuuaaacaaaaacaaaaacaaaauuucuuaaugggcuuguuucaaguuuaguuauggugaggucuuuuucucuuucggaauccgauuguguuaaucugagacacuggaaacagcauuucuaacacucuuuauagccucggaaucuucuuucucaguccuguccucuggagccuuuaagggagggacagccugcgggggguggggggagggagaagggaugcuuccaaaugauucacaucugccacccgcuguggcauuauccacagcucccuuccucucucaggcacugagucccgggugagagcccgggugcgagcccgugggccaacuacuuuggccuugccccugcuaggguuccuccuagcagaguucagguucugaggcuacugaaacccgaauuugacucugcugggucaucugccacgugaugacgagcucgguguccucguauguaaacaauacccaaagaauaaaguaguugugaaccuuaaacgcagugaggcguggaagcacuuggagccagcgggugcacguagaguaacuaggguuccauccgcuguucgcugcagcccugagccucugcgcucagguuuccgcggaucaucccucccccuugugggcacugcggagaacaacacucagcgggcuugagugucugcagcagaucaauggucguccucauuacccaccagcuagcuggucaggcgccuguggucuauagauggcuaaacguucgcgcucgguucccuggcgcccuugagcaggcugucuuccucuagggaacucccgggccuuuccagauugugaguccuaguaauguugggaaugugucugcugcccccacgagcgagcuccuuccuggcugugggaauggcaccuuugugcuugaguuccccagcgucuggccaagggcuuucuuccacuguauuaagaagcgaggagcugcaaccccaccacuccugacccagcacuauguaagucuccaagggcagcuauagcuacccaagcucugggaccagagaaagggaauccucaucuccaccccagcuuccagaaucgccugagaaauuuucccaauccagaaaucccccaggguuccugaccagcaguaccucccccguuccuccucgcgcucccagcaagcucccuguugccaguaguuuggagauaccucugaagguggacuguuacagacacaaaagggaaccaugaagucugccagagaucuggaugcaggacaaagaggcugcugccugucucuaaugaacucguuggcuucaacugaguacucagcaucucugguccuguuugcuccggaguauaacaauagcacauucucuguuguggcucuccccccggacacucuguccccagcaaacugcaaggauggcuuguuuguucucccuugggaaggaaaucucacccuugcccuuccuugucccaggcaacaugggaaggaauuuccuggaaggugauccuggcuguuuuccaaagaguauaggugugcgcuugcacauacacacacacacacacacacacacacacacacgcccuugcucauacucccauucccacuccccacccucauagcuacucacagccuccagccacaaucucccaagucuauuugcuucaacacccccaccccuccacccacuccucuuccaucuaccuccucuacccccccaaccuuuccaccucccacccccucuacccucaccccgugagccugcagaccuaaggaaugaugguagcacaacggccugggagggauagacgccccugccacacacuguucaggcuguauggagcuauggcgagggugcuguagagcaagggcagaggagagacauggacaggcccuuaugggggucucguaguccugucuuagcccaccauuugugcuagcugugauaucuaccaucaggcaggacuuugugggaauuccaaguuauccugaagccaccggaagguucucgguagggaauggaaugggcuugagaaggacuccugggcuggggaagaacgguuuggccgaguccugguuucccgcucauacugguauggccaguggugcugcuuacagaggccuuggaggggacguggaggggaacaggugggguguaccuggacagaguugucaaaaguaugaaaagaggaauucaagaggaaaggaagggaccacggaggacaagcaggggccugaaagccaaggugacugcgcacaagucaaaggcaacaggacauuauccgacacggcccucagaaggcuggcuuguggagggauugcagaagacagaaggcugugggucaggggcugaaggguguagguggaaagagcaggcagcuggcaacagcuugguagcuaaaggaaagagaugcucuggucaguuggaagggugaacagauuacaucaucccaaagucuacgugaauggaggaggccagaucgagagagcaagcgggaaaggccaaaucaggaggaggggcugaucagauaggaguccuggaagaagggcgugacugggaacgggagcaaaggugugggccacgaggugucacggggugaaagggcaucugccugucacauaccaguucaagccuuagggcaggucacucagcagacacaaagaagagggagcuuggaccauauuuggcauuuuauguucacagcucauacaaguaccucacacugcaccuggugugcguuggucaugcagcugaacacgagcugaagacaguccccaggggcuagcaguccuauguccucucacucagaggccugcacaugcacacacagcucaggcuagugucuagcagcucagaaggcagcguagaaugccccucugccuucaaagcgaacaggaucauaaagaaagugaguuccgaucagaccccacccuugccgccaaguuuaaucucagcaaggugguccucagaggugcccagccuuguuccccugggccaaaacaguggaagcagaagacaagcaaaacacucucuucugagcacagcacacugcccagccagggacccuccagcccccaccgccuucuuuaagggcacagggucgaggugggggguuagguagccugugccccugacaggguuagggccacacaagagaccaagcagcaauguggccucugaggcccugucuguaaucccagcuaacucagaaggcugaggcaggaggaacccauuuucaagagcaccuugggcuauagagucaguuaaaggccagccugguccacacagucucuuaaaguaaugagugaaaagaaagccagggugccuaaaaugagucuggguucaguccccagcauuguccuuccccuguggccucuggccucccuagcuaggagauuucgggguguggucaaaccacccacccuaaccuuggagguaggaaggcccagggaacagauggucuagggcccgccccugcugccugggcauuggucacuggcaggacagguuccaggccuuguuggaacuuaugcaaacagccccagaggcauugcuucugagcucagacagagccuggacugagacccccccagagcccucauuucucccaccucagccggcaggaacugugugagugaucccuccuggguacugagagugggggugggguggggugagaaggacuugccucccucccaaauucccccaccugaucccucccuguccuguauacuuccugggacgacugccucagggacggacucaaccaaccaugugcucugaaaagcuagggaucaguaaacgcaaggagcgaggaggccgagauaaggacauccaaugagccgcccccggccccgaggcacccagccgaucccuagcucaggcagcuagcugcucaccaggcuucuucacaccuauccggaucuuuuccaccccucugcagccccaggaccuggucucggggucugguuuaagggagaguaggaagaacagaucuucccauccccccgccccccuucuuuaccucaccuaccugggcuccuacucacugacuucaccccugcaagcuggcgggggguggggggggcacccugucuucuuuagauccuagggggcugaagccuugcucacucuccgucucuguuucccuucauccagucuuaaagcuggagcuccugcggcuuccaucuaucug

SEQ ID NO: 6436 - RNA, 576 nt, Mus musculus
ccuggcucuaagugcucugggguagccagaggguucagggguucaggagaggagagcagagcagagcgcauccccacgccccuacaugccucagggcugugaccaucaacuugaaaacaauuccaggauguggccaucagacccaagagccucuugagggcaacccuacuccugggaagcccuuugggugcugcaguguccugcugggcagggugaaaacucaagaaaugcuaugaacucaaggcuuugugagacuaaggguggugaagcucugcaggcagcuuuggggcaaauucuccucucucugcagcccaaggauggcaccucuccacagauggagcuuggagcucucugguuucuagccuacucuacccugcaggguaagggggcauggggaugaggugggcaaggucauggccuuccugagcagggaaggcucaaagugcugacagugcuggugcuggucacccccugcuccugcugugcuguacucacagcuauuagguaagccaagagcuccaacagagggagggacgcuuuacaggugagaacgugaggaguggagggaaagguggc

SEQ ID NO: 6437 - RNA, 2407 nt, Mus musculus
guggucauacccagaagccuaacccugaguucauggcuacgaaugcugugguccacaugcucaugggggcucagcagcagcagauggggaaguaaagggcagaaacugacuagcgucggguuuuaaaguagaaaggucagcaggagcagucaucccagucccuaguaaauagugggagacagugaugaccaauucuggguacccgagugaggggacgggccacgugagaggcuguucugacucugccauuccagugguggugucuuagagccccuccuuccagcuguuagugagagcugcugagccgcugcugaggcugcuguaguccagagagggaguggagaggggaccacagugacaacaagcucaguucuugucacuaaagcggugcuucucagccuuggccacuuccuggaggauuuuuuuuuuuuaaguuuaggggucaguuccaagaagcucugaguuaccuggugugggacagagccuggguucuuuuggaauuucucagaggcucuccugggagggcucacagugccuucccaguguggugcacuguuaaccccaucuagcuucagagauuagcccuaguccuccagccagaggacaagguaacacagaguccccacaacugagggaccaugucucucaacagcugucccaguagggacauuuacuaggucgggcuuuuccagagaugauagccaauaacgggcuuggaggagaugaagagccaaaggggcugagaagagcagggugucugucacguuaauacgcucuaacuagccuuuggcugcaggaaacagacaccuguugggagggcuugcugcccauccccuaccccauccccaccccaucccugcaccccaucccuugcagcugccuggagcccaggaagagcuggcugcccuuaagacacagagaggcuugaggcagagcugauugcgugguggguguuaacuugucagagauacgggugugggcggugcaggaagacauugauuucucucaucaccaauauggcaacaggugucaugugggcagagcccacccuguagccuccccacacuuuuaagaggaguuuucuguguccgggacaugcugacacauguugacacaugcugacacaugcugacacaugacacagggugagagaggcaaggaguagaugcccucugugggagggcagggcaaccucagagccacgggaccucugcagaugugaauuugggaaagauaaaaguuuuagagaugaaaccucagucuccccgugcuggucaaguucuguuguuacaguuagagugugcauucgguguccacagcaauuuaagacgagaaaccauuucuuuuuccacuuguggcagaaagcagccuuuuaccacagucuagggacuccagaagacccucaguuggccacgccaaaagcugaauuucagaacaagagcuguagucaucucugauaagaagacacgggaauauaaguguuaaggucacucuuacuugcacuugguuaaagauggggacccccugggaaacccagugaaggaaaaagcucacacccagcauugccaccuucuaacauaaagucgacuuaaggggcggaagagugguuacucucuauagagcacgagcugcugcucuugcgaaggacccagguuccggucuuagaaugcacauuguuucacacaacccucuguagcuccaguucaggggauccagugcccucuucuggcuucacaugcaugugcaugcaugugcacacauaugcccccgcccccagaaaaaacagucauacauauaaaaccaugaaguccguuuaagcugugaaugguaaugaaggccugaaucucagcacuugggaggcagaggcaaaagggccaucaagaggccaacuuaauuauuagauaguauggggcggcaauuagaugccaggcacuuggggcagcguugccugggauccagagggacaggacuagguaaguaggcucucuugaaggguacugcagugggcuggagacugaggcagggaccuaggcagauaggaggaguggguuuaguguucagugaacuggcuuuagggggcacugagcaaagaagagggagggaagcuggggagggggacacaggaugggaguaggugcagguggagguaccaugucauucuggaacccaaaaggguagggaagggccuaagucauuccugaauuucaagcuguuaggaccacacuaccuaggaaggaguguacuguggcucuacaagucuccucaggagcacccaguagccaggucucaccaacuccaaccuagugaagucaccauccccaaccuugacuuucaucugcugagucuguuuccugucuguauaaugggcuaauaaagacacucccuaaggaaggcucacacaccugca

SEQ ID NO: 6438 - RNA, 689 nt, Mus musculus
guuuacgcuucuaauaccaaagcuaauuauuccuuguuuacauaaaagguuuggccucuaauuggggccaaguggcggcggcggcuggcuuuucaaaacugaucucgcccgccuguuggucucaccgccuuccggcgccccaccucaguccagguagcguuuaaucaaacugccaggcgucccgacgccucccccaaagcaacacuggccuucugaucacuccucccacccaggauaguguccaucgagaccuuucagcaugauacccgcucgcagugggucugauguuuagauucgcagcaguggguugugccacaugccuccgucccacagcaagagggcaguuugugucccagugugcaaggaaauauggggcugagacagugggauuugaugaaggcaguggggugagguuccaggaagauguacccgcgucccgguacccugugggcaggcgguggguccuggccacuuuugcgcacguccuagcaggugcggggugggcggccggaaggcgcaaggccgcgguccuccgcggcucccgaggguucgagcgccgccccccgccgcgcgcccgcugcggucgccgcgcaauucacacgcccucuggccgccgccucccggggaucgcgcugcccggcgccggggcugggggcgcggcccggccgcgggagccgcccguugcuacg

SEQ ID NO: 6439 - RNA, 7181 nt, Mus musculus
cgaacucuuucacuggaguaaccugcuuauugccaucaucacugccaaucagcccgcuagucagcauuuccugaguuccaggaggacucaacaagcccuguucuggaagaugucagcaggaggcaucaaauauauuuguggaauccagaggacgccuccuccuuagaggguuccuaugcacagcacagcaagaucccugaugagccuacaacagugaguggaaguuguugagcuuugcuaggucuguuuauuuauuuuuuccuuucuaaauucacugugccauggaacugugccuucccugccccuugucccagacaucuggaggacaagaauucaauagaacgucaacuccuuugucuuggauuuugaaacaagacacaggcuuccccuuccucugccucugcuuuuguuuuaagacagggucuuauguggcggagucuggucuugaaccccugaucccugucuucuacauccugaguacagugcugauuaaaggcauggggcaccaagcccagauucuuuuaaaaaauaugaucuugcuuuguagcccaggcuagccuuaaacucacuauguagcccagguuggccugaaacuugcaguacuccuuuagucuuagccucuggagugcuaggguggcaggcugugccaccaccgggacaggcuuucacguaugauauauugggguguucucuauaaguagugucuaacccauaguuaaaagaugauuuugacuaugagcuuaagagucaucaguuucuagguucuggaaauaauucuaaaaugucacguagucucuacucuuacauuuguuuauuuauuguauaaguagacaugagugugugugugugagacauacaugucuucccacgaguauggaaaucagagaacaaccgagaacuggcucccacagcugcccucgaaucucuauaagcauaugguacguccuggcaccuugugggucuucaggauggaauuuacaucguuaagcuuguugguaaguagcuuuacccacugagccaucucaaaaguccaaaugccuuuaagauuguagaaucuuaaagucaugaaugucccugccauucugcgggcuccaaagggcuccagaggaguuccacacauggacucugccugacccugacugagaggagggccucuagggaacuggaagacaugcuuuacugcuacagucaaaacaggggagagagccgggcgugguggcgcacgccuuuaaucccagcacucgggaggcagaggcaggcagauuucugaguucgaggccagucuagucuacaaaguggguuccaggacagccagggcuauacagagaaacaggggagagguuauugggccauuagcuaccucuacagagguagcugucaccuuucaaaugugacaagcugucuguugaucaggcagguggacuuagugucucugcaccaggaggacacacuccagccucgccucuuccggaggacaaugugggaaccacagcaagagugugccuuucagagcagaccuaacuggauucugaacuugacuccauccauuguuuaaucuggaggucuaucacaagguugauuuacugcucugaggcucaguuuucucaucugcaaaguggggcuaauuaagccuauuucagagagcugggaauguucuagacugugaaugucaauaucaaucauaagccucuucaaaaugagugaugcugcuacccacucuaugccguaugccugccaaucucccguggccuggugggccacgguggauacaucaaguggcagagagccaaucagggcagaaagcacagguggguguuggugacaugcacaacugcgagggcaagcgugaaaggaacacgugcuaccagaggcugagggcaggggcuggggagggggcgucggcccaggcguggguuuagugguuauccuggaaucucagggugcaggagucaaggccagaagcuugugacaguguccacagccuggaggguaccaggggaggagugagggagcguaaaccacagaccuuuaaguugaggaacccgacugacuggccucccgggcaggccggcugcagguugcuugccaggagguuccugaaggcuagccucuuuggugcccuuucccacagaggggcccugggucugggccuuuugcuccucuccggggacccccaccacuguagccccuuccaaauccuguuccuucggcgugcuggcuuugauuuccacguggaacgugaacucaggggcagccucgugcccuuccuccaugggccccgugccaggcccuucgggcugugaggccugggucucugcggagacuuuggagaagaaaucagcaggaagugggacggaacccucaguugggagcccaggcacgcuggcggucuccccgcagacagagccggagccggccugaggggcugcccugccaggggucagggaggccugggagggaggggaauccugggaugauucauccacggugagaucuucauccaccucuuccucacuccccagccugucuuggccccagccuuccuucugagguggcccucgccgcagcagcucagaggccggguggcuuuucucuauguccucaggucuuguucccgaagguugacauguagccucucugaggccuuguggcaggaggggagccccagacaugcuagacaccuguuggcggguccagucugagguccccaaaucuggggccuggccuucacgacgcccugguucgacaagcaaacuuugugagaaaaucucgaccuucuccgguucuguguggagauacccagcagagggaaguuucagaaugggcaggcacuccugggcccguucuggucccugauccuggaugggcuccugaggaccagcuaguggaggaggggcugggcgggugggaggaggcuucaggggacagcgggugacugccaaggccagagcaucugacugguucucgccuagaguggcagugagacccccagaaacuucugugcucaguccaagcuggacuugaacaccaccccgcuccuccuuagaagccucuugggcaucucccucugcuggcugggaacucucaccuccucaggguuugaagaggcagugauggcaaaugguuaucaagaguaaagauacuguuuuaaaggauaccauagcacuugccauaaaaaaagacugggacuccccuaacagaccucucucagacccagcucauugcuuuuguuuacuuggaauaaaugcucucuuggucugucugccucuagcuugcuuaauacccucucugggcuucaguuuucuuguccguaaaagggagacuuggacuuggugagcucugaggucccucugguguuuuuggcuggcccagagccugcuggcaccucuuuggcuguucagcaugugauugcgggcucaccuaccauugcccuuagaagauucugggcuccagaugcucuuggcugaguuaugacaguggccugccucucugccucugucuaucucugucuaucucucuucucucugaagaggugaaaccagcgggugccauaaaucacccagccucuagcccugcucugacagauuugaaaaaugcccaagcuaugaggguagggauggagccuugguuaagaggccaccucauuacuccugugcauggaagagcagcacauuuauagcucugaaaucauuuuucaugggcugccuuuugccucaggggaagcaggagcacuggggcucuggcucugacugggcucugacugcucaccccgcacccuauccaacaucucaucgaaucuaagcauauuguuguguccucccccaccaaaaaaaacccaaaacaaacaaaccugggaucagucaugugauagucauguggaacccucucuaggguauuugacugugcccugagaaugcugggaguggaguagggaguccacugugagguccguaacaagcauccccugguucuguuugauugcuugcuugugacagcaucuccuggaccugaggcuggcccaacucacuauguggccaaggaugaccuugaacuccugaucuuccaggagcugagguuacaggcaugugccaccacacuuaacauaacugaacuuucugaacagccuaccugguccccauaaaauaucccaaucaucugcccaauuuucuuuaauaaaaccaguaaccauaaaggccuuggggacauagaaacuggauaaggggcaggaaggagaggggaggaccuguguauacacauguguguaacucuggacacacauaaguauuauuuaugcacacuauaccucugucucuaacucagugggacccaccaacaaaggacccaauucugcccuggcccuccuucuuuauggcaggaugaguucacaguuacauucaauuaugcucccaguauuaaggcuaucacauggccacugaucaaugaaugcauuccgcauacaccagcuacugucuggaaaaaaaaacccuccaauuucuccuccuucucaggaaacuuauugaggccuuuggucuguuucaagaaguaggaaaccagcaugggucugggcuacugagcaccggcuggcucacaggccagaggccaagacagccauggacuaugaugccacccaacagauuugguccucuacugacuucaagaaaauguucccuaggccgggcaguggugagcacuugggaggcagagguaggugagcuggaggcuagcccugguuuacagagagugaguuccaggacagccaagaaugcacagaaaaacccugucuugaaaacaaacaaacaaacauaaccuucaccccucaaaaaaaaaaaaaaaaaaaaaaaaggccaggcaugguggcgcacgccuuuaaucccagcacuugggaggcagaggcaggcagauuucugaguucgaggccaggcuggucuacaaagugaguuccaggacagccagggcuacacagagaaacacugucuggaaaaaccaaaaaaaaaaaaaaaaaaaaaaaaagaaaagaaagaaagaaagaacaaaagcaaagaaagaaagaaagaaaaaacaaaagcaaagaaagaaagaaagaaagaaagaaagaaagaaaagacuuccuagaaauuauuuuugacugggguguccuggagucugauguacuguaauaucuucaaagacuccauuuaaguugagacaaggccccaaauguauacaguaagcauacaccauaagcauacuuugcugugugugcauacuggugaggaaccuaagcauaauuaaagcucauaggaggaggagcugggcugggaggaccacccacgcggcuccccggggacuguaaaguacucaguaaauaugaagcaggggccaggaugcagcucgguuaacgcuuacccaguccacaagaagcucugaguuuggucacagaaucuuguaaacgggguguggcagcacaugccucuaaccacagcauucccaagaagguggaaguaggagggucaaagaucaaggucauccuugaauacaaauggaggccagcuggggcugggaggaucuuaucucaaaacaaaacuguuuuuuaagugcagacucucugggagugguggaggggcaguaaggcaaaugucaggguaaacacaggaccaugaccaaaagucucccccaaguccuccucagcagucuaguguccaaguuaccuaaaggaugauuaacucuugaggucagugaggcagagcccuuuacaggcggccagcaccgcuaaacaaaagacaaaucccuugucaccuuaucgagcaaaggacaccaccccccagcuccucugccaucuaucuguaugucuggcugcuacacaggacacucucaaguucauuuauccagaaaaauggaagaaaacaaagccagcucuugcucuaugucagagaucuccaguuccuaagacucucuaagguuaaaaaaaauuuuuuuuuuuuuuuaaagcguaucugugacccacagcugcagaaagcuacuucuccugaacacaacaauuuaguuccugagaagaaaauccuaauaaggugugaagacugcagagaaggaaguucgaaugacaagugcauuggugaugugauugacaggccacagggcacccugugggagcgucacccacuggccucauccccgggcuaggcaugaccugaaccaggaugguauaagaaaacgcugucugugucuacagaggccaacuuugauauuggcaacuccuucgggucuccugaacuugugcccuaggaccuggcgcuaagaugucuuuucaagguagagcccacugagugcucccaucucccuccucccaaucugagucccaaagucgauuugggccacugaccuugagucacaugcccagcggcuugguccuccugguucggggugucuccgaugccugcuucuucggcugguccgaggcagcaaagggagaggacagaagggagacuguuauuucuuguugcaacccaugcucucuguaccuguguuccucgugugugugcacaugggcacccugcagggccagcugcaguguuuugcuccucugcaauggccacggcuagggacaguggugaugacaugugccuaaacaaaauccauagcacucacgugccuuccaggugacugcgaccgaggaggaaagagcuuuuccauagggguccaggguccugaugccuugccuggcuccacaaagaugccagaacuuaggggcucacagaugagucacaguggcacugccugcucuggccagcacuuugggaggacugggguucagggagagauuauuuuugaugguguguacccagaagccauccccuguccagcuucucugagccucuauuauuggaaaccuuaaggagggacuaggguuugucuuguaggaggauggugaaggccugaagacaggaaggagaugcuccaagcugcuaugcuccuucucuuuaaaccuugccacacaucacuccuaaaaacagcacuaccugggacuggagagauggcucauggcuaagcgguuaaaaauacugacugcccuuccaaaggucucgaguucaauucccagcaaccacauggcggcucacaaccaucuguaaugagaucugaugcuuucuucugaugugucugaagacagcuacaguguauucacauacauauaauaaauacauuua

SEQ ID NO: 6440 - RNA, 48099 nt, Mus musculus
cgacucaccucggcucuuuccgaccucuuucgggcuuuuccgucuuguucucguuucucucucuccacuucggcuauuuccgugucucgcucggaagagcucggcagccacucggccucccccaucccccgguaacggucgcuggugaguuuaaaugagccggggcuggccgggcuggagccgcuacggggggggccugaggcacugcagaaagugggucugagccucaaggaugacggugcugcaggaaccuguccagguaaugcuagccccugcuccgaggccuggcgccaagccugggucgcaaagcgaacagcgaguucgcggccugcugcggccuaggcccggcuucucccgccucccuuucggcgagcccugccggucucucggcagucccgaugccucacccgcggccucagccgagguuagccggguucccgcuugacuucucgcccccugugcgagcuggguucggcgggagucacucguuuuccgucgggacuggcguccggccauccuccucccccugguagucgcgggcccugccugcggugggagaccaggggcucagauggagucccggggaccggcacagaagcgcuuuuugagccgagcuuaguaggauuucacaguaguggggcaaguuuguuggcauuuucuugguuuuguuuuacgugagauggucgagagaagaagguagaauccuuauaauccuuauuuuugguacuaguuuuugucucgguagcacuuucucguccacgguaguucucauucagugaauuucccaccggacaaugacgaucugagaagggaacuccccuuuucaggcccagugcugcggugcaaacacccaagcaggggagugggcgaaagggcaggucuggauuuucauuaccgcgguuugggucaaggggcauuuaucaugcagguuuagaaggugcuuaggaaauuagaaauaauaauugcuuucccauccauuucaauauccguccauuccugaaagcacaucagaguauggguugacguacacgguguuguugucauugaagaaacccuauuggguuuugaagugugugaugcagcgccaagucauuuuccccccugccagaucugaagaaacugaaccuuuuguccguuggugguuggugauggaccagguuugggagauuuucauccuacuguaugaucuuugacaugauagaaagaauuggccuccauuaguuacugucauuaagcuaugaacuuuauuuugaaguuauaaagcaaaccgauuuuagaaauugugaauccccuuagguaagucugugacaacaaaugguaaaugcuucuaauucgucaguacaacauuuccuuaauuucucaucccagcguaaaacaccauuuucccuacuuuggccuuguuuccagcuguuuacauggugacagcuauuaguauuugaauuucuauaacucaggauuauaacuucugaacuuacaaaacugcauuucuuucccaugucucuucuaguguagagagccuuguaaggcccuuuugaggccuaucaugaaauuaagcagauaaagaggguuauucauaugucucuuuuuauuucagauuguaguuugaucuuaaugauucuuuugcauuucaugaccgaaaagacuucuaaaauguuaugguaguuguaaugagagcauguaaaccacuguuuacuaauuuuacuuuauauaaaagcaggagagaaucaaaauauuguuuuugcuagaugggacccaaaguguuuccuguguuuucuucgcuguuagcaauaacacacuuaauaucacuaagacuaaagaguaaaauuuaccucccuuuccuccauaauagguuuuaggguaauggucugaggagguaaggauuuggguuguaauuuauaguauggcaaggaggcaagaagauucggaguucagggucauucaucuucugcuguguagcaaguucaaggccagugugggcugcuugagacccugucucaaaaaaccccaaagcaacaaaaaacaaaaaugacaaccuugaccaggaaugcugccgaaaaugggcaagaaauaagagauaguaagauaguuguuuuuuuagaacaguacuuguuccauguauuggggaaaaaauaguguugaaauuuuuuucuuugcuuucuuccugguguuuccagguauaagaaaaaguggguagaaauaaauaaugauuacaugugaguuucuacuuuucuuccuccuuuaaaguuuuuacauggaauaaccaguguuaugugccaagcagauuuaaauauaagccccuucccacgucagcucuuagagaagaacuauuacuuuguauuugacucuuuacaaaaacuuuugcauauuacaaggcaaagauuuauuucguggcuuggucucacuguguaguccuggcugggauuaaagccauguaccacauuacuaauuugggugccuguaaaaguuuauuuaauaaaauagggagcauuuuuguuuauacgauguucugucuaacauuuauuuauuuauugugugugcauaugugaaccuuggugacaagcaucuuuaccaccugagccauuucaccagcccugauguugcuguaagcggcguguuauagagauacgucaccugauaaaacgauaucaauuauuuuugcaaguaaagccucacauaaguauugaauggaaauaagacuuuugaaaaugauuuuacuauggaaaaaucuggcuugguagccugcaucugaagccccuauacuugggaagcagaggcaggaagguaagaaguucaaggccagccuugaacaaggacgcggaagguccuaucucaaaaaacaaaacagagucauaccgugauuuggguacuagguacauaucacucuuuuagaguuugauaaaauaguaggaaguucuuuuggcuugagauuacauuuccccaagaagcauauaagauugauucacagaguguaugugagagguauagugagauagaccaaaaccacugccuugggcugaaggcagcuaagugggaugagaaagaaguagauaaagguuuuagagauagaaauucaagaaacuacuuggagaguagaacuguucaaacauuggcaaggagggaggguggcuuccuaggguuaguuucaaaaaugacuggcugggcaugguggcacacgccuuuuaucucaacacuugggagguccaagcggguggaucucaguucaaggucaggcuagucuacuuaguaaguucaggcuagccagagcuucaucaaaauaagacaaaacucaauaacuccuaaaaacuaaaauuaaccccucagaaaaaugaaaaauguuuuucugucugaucagauuggguuuggguuuaguguauuaauaaugaaucuugggcuggcuuugugcccucuuuguagccuaggcuagcgucuaauuuucuaucuugucucugccucugaagugcugucugcaagagauuuuucaauaaagaacuauguaaugaaagcaauguguuggggauauuaaucuaauuuuauugauaagaaagaaaagacaagaguuagauacauagauagaugaguaggaugaaccagccagugguaauguggacuguguuuuuaaguuuggcaggauuaacuuuuuggagaaaguggaguggguuaugugugugaaggagcauuucuuuaccacaugucucuaccauuggugcuagccaaaaaggccuccuaccagucauggcuaaauguggggucagggaaccaccuagauaaagaacugguggaaccuaaggaucagagcuggguauggcuacaacaugccuguaaucccaucaccugggagauagaggcaaagggguggagaauucaaggccugccucagcuauguuguaaguuugagaucagacuaggcaaaaggagacccugucucaaaagcagaaauuuaaaaagaaaacaaccaauucaaugaguaaaagcuaggguugcugaaguagaaauuagauucuguuguauaaaaugaaaauucuacaaugauacuuuuuguuaagguucuuuucucucucccuccuuuccucccuuucucauaccuuuuguugaugaaacuuuucuuauuuuuucuuuuugucaaauacaaaaccaaacaauuuauagcaguucaaauuaaaucugaguacacuguacauuuuaaauacuugaacugggugugaugguuacacgcuuggacucccuggacuuggaaaacagaagcagggccuugaauucaaggccagguuaagccgguuagagacccugucuuaaaauacauaaauaaaauuauauuucagcaaguugugauggugcaagccuguaauccuggugcucuagaggcagaggcaagaaaaggaguugaaagguguucuaccacacagccgacaccuccauuucaggucucuuccuuaguuuacuagcccauguuuacucuugagaaugccuuuuguuaagaucuguuuguguguuuaucuaugcacauggccccaaguguuugcaggugcucuuggaggccagaagaagguauuggaccaccuggagcuggagugacagggagcugugagcugucccaugugggugcucuaacugaacuuaguuccucaggaagaaagagcagcaagcacuuuuaacuacugagccaucucuccagcucccuuuuuuuuuuuuuuuuuuauaguaaguuuccucuuucuaguccauguuuaacauaaaagacacagccuuuccuccaucucuucucaugguagcugugagaauuuccaccuaaucuauacuuuuuuuuccuguaaacucuucuuaauaaagcuauccucaggcuugagaaacaaggccaauucccuauucccaccccccaaaaacuuuaguaauccgaguagauggugggaccagggagaagacucaggagaugagugaugugugaggaccugagaucgcuaacaaacauacagaaagccagguauggccgagcugccuagcugaaagaaaggguguguguguguguguguguguguguguguguguguguguucuguuuaaucagagagacccugucucaagaaauaaggcagaacagagaaauaaaccggauauccuucucuggccucugcacaguugugcacaucugcacacaugcacacauaucccuacacaugugcauacaguaguguacagcuaaaaaauagugaacagcaacugaggaagauagccgacguggaccucaggccuccuugcacacgugaauagauuacucagugcacacaaagaauacaucacaaguaacaaucugcagcuccgugcucuugcuuuaucuucucaaugaauacagcccaggacuaagucauuaguuuccgcaguggaaugucuccuaagcauuuuguuggaaaggaagaaggaaagaaugcugcuguuugacuuccuaacuucgccuuagcaacuugucacccaucuggcuuuaaucuguagaacuguugcccugggugcuguuuucggggaggccuacaccaucuguuggacagggugaugaguuuagcuuuguguucaucaucggcuacuagucuguagugaugagaacagaccauuucacaucccaucgcccuggugagaugcaugucacucaggcauggaggguuaacagcacauaggggauggcccaucuccuugcuggugcuuaugagggauugggguucugcgcaaagcuucuuguguucuucuccucuuccuccuuuuccuccuccuuaauuucuuuauuuugggcacaagaucuuacuauuauuugccccaagucugccugguucuauuuagcuccugugauuaaggcucagaaaugacuugaucacaugauuaauacagagcaaucguccucaucugccuggguuuagauauggaggucauucucuauauagagaacauucaagagauaacugcugagucaggcuaaaaugaacuuccuucguccucuuguuuucugagugauauuuuggcagauuguuauauaauccaaacaguaaaguucuuuaaggagaacaucugcaguuaucacauuauauuuuacuauuguaugauauauuuuauacauuaucuaccaccaaaaccugaaucuucaugacagaauuagaaaauagaaaaacaauuagcuuucuguuucauaacgauguccacauccaguccuuccuccucuuuuuauauuuugccuuuuuguucauuucuucauguaauacuguaucuacuuggacauuuauuuauaugcauacaucuauuauuggcuagauuucauaaaugacagaaacauguuuuuuucugagauuguaugaacuuaauauuauauauuuuacaauauugcauaaauacauaauauuuuaguauaaugcuuagguccauccauuuuccuguaguuuuuguaaacuuuauuuuuuuagaacaaaguaguauuccauuuuuguuuguuuguuuuguuuuguauucguuuuuauauauaccaacuacauaaaauuccauauauaccaaauuuucauuaucuguuuaucuguugguggaaaacuugguugguuccaguaauuucuuuuucuuuuuacaguaaaaagaauuucgagccgggcgugguggcgcaugccuuuaaucccagcacuugagaggcagaggcaggcagauuucugagucccaggacagccagggcuacacagagaaacccuguuucgaaaaacaaaaacaaacaaacaaacaaacaaacaaagaauuucauuuuuauuuacaaauauguagcacuucaucuaagaguggguacuugugguauuuuuauauccacgcuggcaugucaauugcugguguuauuuuucaugucuuguuuauguagucauauuguugacgucuuuuuuuuuucacuuggauauuuuauuugcauuucaaauguuauccccuuucucaguuuccccccuccaggaaaccccccauuccaucccccuuuucccccaccucuaugaggguguuccucuuuuuaagaaggacugaagcacccacauguuggcuuuccuucuugagcuucauguggucugugaauuguaucuuggguauuccgagcuuaucagugaaugcauaccauguguguuucuuuugugauuggguuaccucaggaugauauuuucuaguuccauuugcuuuuuuuuuuuuuuuuuuuuuuuugguuuuucgagacaggguuucucuguagcccuggcuguccuggaacucacuuuguagccuggccucaaacucagaaauccuccugccucugccucccgauugcugggauuaaaggcgugcgccaccacccuggcccuguaccacauuuucuguauccauuccucuguugaagggcaucuggggucuuuucagcuucuggcuauuauaaauaagagugauuucuuuauauccaauaaaacaacaauaaacacagggugcagauaccuaccuguggaaggguauagcauucucuggauagcccaguagugaguagcugagucuacaaugucuauauuaaguugcagucuaccaaugugaauaaaguuucuuuacauuuguugucaaagauuugucgaugacagucauucugacugucaaaaacugucuguucaguucauuagcccauuuguuaacugguaguuuaugguauuuaaauuuuggauauuagcuccuuguccuaaguggagcugguaaggauuuucucuuauacugugagcuguuaaugccacggauuguuuccuuugcuguauagaaacaugaauuuucauguaguugaaaauguaggggaaaaaaaaaaaaaagaguagccgggcgugguggcgcacgccuuuaaucccagcacuugggaggcagagacaggcggauuucugaguucgaggccagccuggucuacaaaaugaguuccaggacagccaagacuauacagagaaacccugucucgaaaaaccaaaaaaaaaaaaaaaaaaaaaaaaagaaagaaaauguaguaccaacccacguguugagcuuggagucaguuccugugcuguugguauuccacuuaaaauaccaacacugguguucuugccagccacaguggcacucagcaggcagagacagguggaucucugaguuuaaggucagccugguguauagagcgaguuccaggacagccaguacuauacagagaaaccuuaucucaaaaaaguucuuaccuacccaguauauuuaacgguauucucuguauuuucuucuaaaaguuucagguuuuaaguuaaggucuuugauccacuuuacauugauuuuuuuuuuuaaugcaggugaaaaauaaaaaucuaauuuguucucuguggaaagaaauccaguuguaccaucacuguuuguugacuagaccauuuuuuuucuccaaggaugcuuuugccuccuuguuuccauguaggcuagauagcagugacuguguaguuagagagaaagagggugaagggaagaguguucuuguuuuauccaacucagguugacagccuuagaacaagugcuguuaucugcugagccggaucuaacuuguuuuguauggaaucagggucauguagccaacgcgacaggugugagauccugauguuuaaugggugaaugauguuucuaacaguagugagcugaguaguaugaagacacauaugacgcucgagaccagaaaguccugcacugucuucuagguguguaaagaucacaccacugucggccugaaggcugacuuaacucuugcuagauuuuagccccuuucuuuucuuuuucauuucuuucuuucuuucuuucuuucuuucuuucuuucuuuuuuucugagacaggcucucuggugauccuaaacuuugcaaguuagcuggcuggcuagcuaguuggccugugagcccugaaauguaccagcuguuuuggaauuugaagccugcaccacuaugucccacccccucuucuuuuuucacauggauucuggggaugaaacucuguccuuguauuugccaggcaggugcuuuaccagcugaccaucuccccagcccugcacagagguuucuuguuuuuguuugagacagguuucauguagccuaggcuagucuugaacucaauccuccugccuccuucuacuaaguuucugggguuacaaacauaagcuaccacaccuggcuacaaaaaauuugaagacugaaaauauauugaauuuuaagugaauaauagagaauuuuucuaguuucagaccaaugcaucugaaauccuguuaaaggaaaauuaaaaugaaauugauuugaacaucuaaaaagagcuugugcuuuauucuguagauauuuauuuuguaaacucuggcuuuccaugagaauaauuugaggaggaaagaagugugaugguaucagaaagacaacacugacaguggcuagaacacauugcaguuacagcuaugugcuaggaacuccuguucuucccuguaguuuuuaauuggggggacaguguguggacaugagugcagaugccuguggaggguagaggcgccucccaaacugauguuacaaguaguugugagccuguggaugugggugcuggaaauuuaacuccauuccuuugcaagagcagaacaagcucuuaauugcugagccacaucuccaguccuugacucuucuuuuaaaugaagaaacacacugagcacuguacaaaauauaaauaaauagauugucuuccugcaagagucauuguucaagacacagcugguucagggauuugaacccaaguccuuggcaguugucuuguguucccaggggugauaguuguuuaaagaagguaauacugaaacgggaugauuacagcacagcuuucagguaggaggauugcaggacuaccgaggacacuguuuauacauuuaaaggagucuucuccuucuccacagucuugugugcuugaccucaucucucaugucuucucagcaaggacugguuccuggacaagaaacaaacauaaacaaaauuauacacauauacaaaaaugacauaauggaagcuauuauuuugcaugauuagaaaaugaacucuugauuguuuggguugcuuuuauagaggaccuggguuugauuucccagcaccauaugaugacucacagucuucuguaacuuccaguuuucaggauccagugccuucuuuugacuucccuggguuuuaggcacauacauauauuuaagcaaaacacucauacauauaaaguuaauguaauuuuuuuucuuuuaagugaacuuuaaggcguuggagaaaugacuugguaaggugcuccccacaccugagaacuugagugugacuccuagcaucuaugucaaaagucaaguguggcagcacacaccuguacuuccagugugagaaagaaaauacgacugaucccucugguuugaugaccagcccuagcuggaucaugaauuccagaccgagaaauccugucucaaaaaacuaaaguggagggugauugaggacacuacccuacaucgaucucuggcaucugugugcaaggagaaguaaacuuugaggacugaggcuauugcuuaguugguagagugcuugccuggcaugcacugaguccuugguucaacuccagcaccguguaccacgguaaggguacaggucugugaucuugcacuugggucacagacagaaggucugaaguucauccucagcugagcagugaguuuauagccggcuugagauguaagagucucugucucagaaagccagacacaagcuggaaagccaauccauccuaucccucaguggauuuuaguuuaagcugguaauaagacaaaauaaaauucaagaggaggcuuuuuuuaggauaauaauaaauugcaugagauaauguauacauguauacauuauauauguguugugucauauuaccuuacuauugucaagcugaaaauacuguuaugucuguacaaugagacgucuuuuggggaggcucguuuuucucuuuuuuuuaugcucugaacuaguagcuuggcucaaaaacaauuauguggaaacuuuaagggaaaguuuuuuaaggagugaaaauuuuguuauggacuaaaguuuguuuucuuuuauuugagucagggucuuucuauuucuggcuggccuagaauuuacucuguagaccagacuggcuuggaacucucagagaucuuccugccucugucucccgagugcuagaaucaaaggcauguccucuggcccuaaucucgcuuuguuuaugagcuguucuguaaauuguuuagauucacugaccaguagucacuuaagaccuccccaauguggacugcauucgaaucacuagugcagcuguuaacuugugcaccugugaucugguaugauuaaaagccauuucuucucuguccuuacagaagacacuguuaauacaguugucuucaaaauacaaaagagaaaggaauuucuaggauuggagaggaacucuuguucuugcagaggucuagguucuguucccaacacccacagggcagcuagcucacaauuaucugaaacucaaauuccaagggauccaaaagccuacacugaccaacuuggccaccaagcaugcauaugguauacagacaugcaugcagaugaaacacccagcacuuaaauaaaucuaagaaacauuuuucuuuuaaaaaggaacuccuuugguugguaacuuugcccuuuuaaucauuuaaaccaauucugcaaaaauuuauuagaagucuauuauacacacacacaguagguuccugugaacuauaucaguacgucuuauaggaagagaguauuuauaaaucucagauuguauacauuucaguauauauuuaaauuauaccaaaccuuaaguauauaccagguuuucaauacauauuuuuacuauaugugccuuuauuggggaggucuguaguuuucacaagauuucuaaaagaguguaaguagguuuggugaugguggcgcacgccuuuaaccccagcacucugaagcagagacaggcagaucucugaguuugaggcuagccuggucuacagaccaaguuccaggacaggcagggcuacacagagaaaccccaucuugaaaaacaaaaccaaaaauaacaacaaaaaguguauacaaaaagcaagaguuuuacuuuaguauuuaguacacuauggguuuuacacauggguguugugguuuuaucacuuaaauuaguaauucugggauggaaagaugguucacuugcuaaaugcacaucuaggcagaggcagguuacacucugaguuugagggcagucuggucuauauagugaauucaaagccaggcaggacuacauggugagacccugucucaaaaaaaggaguggaaggaagaagaaagagugggcuagagaugagcaguagugagucuugucagaaucuggagggagaaucagaaaacaauauucacacaaaguauuacgguuaugcucugaguagauaaguauguugcuaucuauuacaggcagauucuguaagaaggaauagagucugguaauagcauguggauaaauuagcggcaaauaugguagaacauuuuaugagggcucuagauguuccugcacagcauauauucaguacuuuuuaaauggcuuuaaauguggcagaauccuagaguaauccaacaaagcuuucuaacaguccuguuuucauuuaguggccucaucucaucuuuaguucccaaacaauaaaagauccucuagcccuaaugagucccguuaguguggucugauaaucaguaauauaaauauuacuuuccaugagguugaguauuacugaauugaucuguaugaaaguguuuuaaaauaaucauguucaacugcuggcagagaaauauauucaaacacgcacgcacacacacacacacacacacacacacacacacacauauauaugcauacacauacacacauacauauagauggaggagggcugagaagagaagaggcuaacucucccuggcaugggcacacuaucuucucaguccccuuauuuauuauuuuuuaaauagcuuuuuuuccuuauaaaauuaguaaaaacuuaaaaucugucucacacaaaggagugugaggaagagaaggaugaaugggcuaggaagaaguuaguauauauugaauuauuuuaaacuagguuuaggagaugagcaaguuauuggugaagaaaagggguauauagaaguguagaaaagccgggcagugguggugcacaccuuuaaucccagcaccugggaggcagaggcaggcagauuucugaguucgaggccagccuggucuacagagugaguuccaggacagcuggggcuauacagagaaacccugucucaaaaauccaaaaaaaaaaaaaaaagaaguguagaagauuggauucauguagggauuaagaguaaauauauauuagaagccuacagugagaaacuuuauguagcacacuggauuuacuguuuuaucacuuaaauuagugaaauugggcuguaaaaauggcucacuugauaagaacacuugccucucucauagagagccaggcuugguucccagcacuugcaucuggacucugauaacuaccuucaagggaucugucccgccccagccucagcagcugucugcacacauacguaaggcacagaaagagauagagagagagauaagagugaccugagcaggugggaugccucaucaguuagcaaacuugcugcugagcccagugaccugaguaaguucccuugggcccacaugguaggagagaaguuaucuuugaccuccuucccgcgcgcacaugcccaccugcuacacacacaugcacauaccaaaguaaauaaauaaaugaagaaauaauacaaacaaauuccgaguacuaacuugaauauuauguucaagacggugccagagucacuguguguauauuuaugugcuucucuacuuacaggcugcuauauggcaagcgcuaaaccacuaugcuuaccgagaugcaguuuuccucgcagaacgacuauaugcagaagguuugugaucuauucauuuguauagaaccagaaaugaauaaaauagauggaauuccaucacuuugugacuagcaagguucuuucuucauucuuugucuuuaacuuuuuucuuauuuuuaauuauguguauauauauguguguauggauacuucuuaaaaauaguguccucaaagaccaaaggcaucaaauccccuagaguuaaaagaguugugagccucccaaauguguuugaaaucucaacuccauguucuuaauugcucagcuaucccuccaacuccucuguguguguguguguguguguguguguguguguuuguguguguuuguguguguguguguguguguguguguguaucugugugugugugugagugugcgcgcacgugugccugggugcgcccacuccugugguguuugaguauggcagaaaacagggcaaccuugguggguauuuuuccucuggcaccuuuuacuugucuuuuugagaugauuugucaguagccugaaaccugucaaguagguuaggcugucuugcuacugagccgcagaauucucccuccaccucgucaguacuggaauuauaagcaugugccagcuuuuucauaggguccuaagaagcaagaacauuuuacugacuucucagcuauuuuguuuuuguuuugacacaaguuuucuguaucucauacuggccuuaaacucucaacuguccuuccgcugucucccaaguucugggaugagggacaagagacaccaugccugucuuguuuuuuuuuccuccagaaaauauuuuuacuguuuuuuuucuuuauuauuauacauaaguacacuguagcugucuucagacacaccagaaaagggcaucagauuccauguugugagccaccaugugguugcugggauuugaacucaggaccuucagaagagcagucagugcucuuaccggcugagccaucucgccagccccuguuuguuuguuuuaaugagcuggacaugugcuaugaccuguguggaugucagaaaauaacuugaguuguuucuuuucuuccuccaugugggguccaggaauuuaguucagguccucaggcuuggcaguaagcguuguuaccaacugagccaucucccagaccauguguuaauauuucuguccguuuuaauguagaaacauuuuucaccacagaaauuagguuuauuuucccuucauaguaaaauucaacuuccgucuuccuaagaggacucuuaaaaauccuaucuaaaagaaggugcuuuccuagcgggcugcuuaaggguagaggguguguguguguguguguguguguuugcauugcuuacauauuuacagaaaauggaaugucuuuaucauauugauaccuuaguucuuauaauagagagauagaugaucaggaacuggcaaacuggcucuuuucucuucuuuucuuuucuuuucuuuuuuuuuuuuuuuuuggucuauccugacuggucuggaacuuaaugucuuuguuucagcccacugagcgcugagauuacagauguggaccgccaaccuuaccucuucuaucaacaacugauuucuccauaauucaaauuugaauuaauaauuguuuugaauuaaaugucaaugacaugcuaaauuuuuuuguuacuuaacuuguuugcuggcagacugacuaguagcuaauuaucuucucuucuuuucuuuuucaugucauaguacauucagaagaagccuuguuuuuacuggcaaccuguuacuaccgcucaggaaaggcuuauaaagcauauagacucuugaaaggacacaguuguaccaccccacaguguaaauaccugcuugcaaaauguuguguugaccucagcaaguaaguauuacagucuacguuaucuaguuugcuuagacuuucauuggauuuuggauaaaauucuuccaacauuaaacucuugacuucccuuuacucucuuuugaguaacaguugaaguguuugccccagggacgaagguguuaauuuggucauggaaagauuuuauuauaauggugauaaauaacaauucuuuuuuggugcuggagaucuuuaacccugggcuucauauaagcuagacacucacucuuacacagggcuauggcgcagugggaaaacacuugccuagcauguauguggcuuuggguucaauuccugggacugucaaacagaaccagcuaagcuacauuguaagucccaaaauacaauuuaagagaaguuuaaguuguaacuaauucuuuccagcuuccaaagugagccuuagucucauuuccucugccuuggcuuucaugaucaggcaauuuaaauaagccuagaauaagccaugacaguucacaaagguaggucauauaugguguucuuuugagaucauuggagaauuacugcccaucucuaccacuagaaguaagggacguaccaaaguuucacuaccguuaaaacagucaucugaccauauuccagaucugguagcagguagaacuacagauuaaauucuggcaaauguauucaucuacagaugaaauacuggcaaaagugucugaacagguauuuagcccauauaugucuuggguuuuuuguuuguuauuuguuuugucuugguuuucuugagguuguuguuuuucuagacaggguuucucuguauaguccugacuguccuggaacuugcucuguagaccaggcuggcuucaaacucagacaucaaccuaccucugccucccaagugcugggauuaaaggcgugugccaccacagcagggcucuauauguguguguguugcuuauagauuguauauagagguuacagguaaguuucauuaaauuaucauguaaguagcuaugcuauuugucuagcaacuaacuuuauuuaaggguuguugugguaaauauuauuuggggguuucuaccccgcuguagaucauuuaguucccaaauaaaauacacaauaaucuuuauaguaagccuuaauuaaggcacuagagcuggacagauaucaacccucuaugcuauuuugucuacuucucauuaaucccgagguaucacuugccauguucccccuugagcccucaucaccauauacucaugauccauggcaccuuccuucggcucugccccuucucuucugcccagcgcaggcuguaagcaucuuuauuaaccagucagugguaacuuuggggacaagguuuauacaauaaaagcuaguauuccuugcucaucuuggagcaaccagaucuugggguacagaauuuagcauuugaauacaaguggcaccagaucaagcucuauaaaggguaauugaauuagcuauuuauuacuagauuauuuaaaaauccaaaaauuuugcuggacauguaauggaacaugccuuuaauccuagcgcuuggaaaacagaagcagguggauuucuugugaguucaaggccaaucuggucuacauaguuccagaacauccagggcuauguagaaucucucucucucucucuucccccaccccaacaaagauuucaauguugaaaucuuaaaaaucaacuucuuaaugaaaagaagaaaacaaguaccacugagguuggaagauauuuacaggacgcuguguauuagguaauuacacauaauggggcuagcagagagguuuuagcuggucagugcacuugcugacaagcacugccaaaccuuacaaccugagcugauccucugaugaaugagcuaagagagaacccagccugcaagcuguccucugacugccacagguacugccaugacuugugcacgcuccccaguaaaucuuaucacuuguaauaaaagggauucuuuuuuuuuuuaaagauuuauuuuauguacaugaguacacuguagcugucuucagacacaccagaagaggacauaguauccuacuacagaugguugugagccaccaugugguugcugggaauugaacucaagaccucuggaagaacagucagugcucuuaaccacugagccaucucuccagccccccccccuuuuuuuuuucuugaaugcaauuuaguauuugguguuugagaagaacaauugucuuuugaauccauccaucuuauuguagaaacauuguucagccuaguaaugagguuuauuuacccucaguguaaaaagucuggugugguaaugcauaccuuuaauuacagcacuaaggaggcagggguagguagaucucugugaguuugugacccaccuggucuacagagcaaauuccaggccagcugggcccugucucuuuuaaaagauauagaucuuugugugugugugugagagagagagagagagagagagagagagagaucucuauaaauauauauaaguacauagauauauaauuauauauuauaugugauauauauauauauauaauugugucugugagagauugcuccgcaguuaagagcacuggcugcccuuuuaaaggacuugaguucaguuacuagcacauaccgucuguaacuucaguuccaaagaaugugauugauacucuuuuuuuuuuuuuuaaagauuuauuuauuuuauguauauaaguacaguauagccgucuucagauacaccagaagagggcaucagaucccauuacagaugguugugagcaaccaugugguugcugggaauugaacucagcaccucuagaagaacgauuaaagauaaugaaagauagcuucaugaagugcuuuuuauacugacauuaaaauaaauuuuuauuuuaaaggcuugcagaaggggaacagaucuuaucugguggaguguuuaauaagcagaaaagccaugacgaccuugucacugaguuuggagauucagcuugcuucacucuuuccuuguugggacauguguauugguaagugcaagugacucaagaccuccaggaagaguccccuguauagacgugcucugcacugugcccauuuugauauugauguuuacagacacagcuggcuuuguaguuccuaaccuuucccaucaugaccucauuacauuuguuaaauaguaaggaugcugaucccauuuuacccgcuacuuagccuaguuagugauaacagcuguagcagcucuagcaaguucuaaucacugaggaaagugagugguuucuuuuccuuaauauuaaaugccauugcgucuucuuagagucuugaaggcagguuucaguaaugcaaauuaaguauuaauuauuuucuuccaauauaguaaccuuugaaguguguaacaagaauuuuuaccauacaugaacucagaauuaguauauaauaguaacauggauccuguuuuuuaaaaaauacuuuugaaauugagaaaaauagaaaauauucaaaacugccuguagagauauuuuugcauguaauaaaugcaaaaugacaugauguuauacauuaugagagaagugauuaaagccuauuuccuccaaaaaaaagaaggaaggaaggaaggaagggaaggaagaaaaagaagaaagaaagaaagaaagaaagaaagaaagaaagaaagaacuuuuuaaaaaaguagccagguauggugguguaucccuuuauucucagcacucagaaagcagaguuuaaggccagccuugucuauguggugaguucuggaccauucaggcaugcauaaugugauucugucucaaacaauaaguaaacuuaaaaugaccuuuugugaccuuaucugguuaaacagggaguuauuuucaggugaugucaaaucauucauaccacauuugugagcuagacuaagaaaggcuagaaucuuuacuuacuuaaaauuggaguugaaagccaggcugucgcggugcacaucuuuagucccagcacuugagaggcugaggcaggugaaugaaucucuugaguuccaauacagccaaggcuacacagagaaacugucucaaaaauagaaaaaaaacaaaaacaaagcaaacccaugaagugggugcuaucauccaguaucauccagcuaugauuauuacugcgagcacaguauacacuugguccugggacuauaagaggaaauaacucacauuguguaauggagaaggaagaaacaguagaucagauuuuuauuauuucauugaaagguauccuaagguuugggcaguauuuuggccacgugagagaaugcugguuuuaauugauuaggaauaaaagacuccgugacagcccggcgugguggcgcacaccuuuaaucccagcacucgggaggcagaggcaggcggauuucugaguucgaggccagccuggucuacaaagugaguuccaggacagccagggcuauacagagaaacccugucucaaaaaaaaaaaaaaaagacuccgugacagagccccugcccagccuggugcugcagcuguggguuccauucucagugccguguggggaggggaggaacagaagguaccuggaagagagcugagagcaaagagucauuucuuuuauauaaggugacuucucaaagaaauagauguuugagggcaauaaaugauuuacagggagugaugggggagggucgaaaaauaaaaaucuuaagggaaaauacagaaauucuuuuaaaauaugauuagguuagauagaaaaauauucauguuuuagaauuuucaaaagcaaaucuaagauagucacaggagcuuaggucaguccucagacauugagauuucacugggguuuucguuuuauugaacuuauuuucuguguauagcauguuugcacuaaagccaggcuccccuguugguuaccuuucuacaucauucuaccuuacuucuucucucugacucacucagcauggcggucagcagaucgcauccauccucugacuucaccuuccacagcacugagcuuacagacccacuauggucacacuuggcuuuuuacaugggugcugagguuugagcucagguccuugugcuugugccauggccccuguaguuuucuuuuccuuaaccuuggauuaauauuaauuaauucauguuaauacccauggauugauuugcuacuuauaacuuauugcuuuuagagaguuagaauuuaaggaagcaucaaaaagagugcuguaaagauuuauauaaaguuuaccugguuuuuauaucaaaaauuguaagaaaagcuauggggcuuauaguuuguuuaauccauuguuucucuccacagcaagacagaucggcuugccaaagggucagaauguuaccaaaagagccuuaguuuaaauccuuuccucuggucucccuuugaaucguuaugugaaauagguaagcucgcggggugccgggagggcucuucuuccucuuuccuucucuuuucuuuuuuucuccuuuuuguuuguuuuguuuuguauuuuuugaguccagguuuucucuguguagcuguggcuguccuggaaccuacucuauaggccaggcugaccuugaacucauagagaucuccuaccucugccuuccaagugcugggacuaaaggaguucaccacgccuccuggcaagaggaucuuaaguuuacugccagcuuaagcugcauucagcuucaaggccaggcgagcuuacaggccacucuaucucagaacaaaucuuaauucacucagguuuucagguuggacagcaggcaccuucaaccacuaaaccuugcuggccuugauuggugauauuuaaaauuuauaauuuaguuuauuuuccaaauguacaucuuuaaggguuuacauccacaauaaauuaaugauugggcuuuagcgaggugagauugggugcauaagugggcaggagaauuuugaaacuccaaggcuuuauuugcaccuaauuauguguacuugaaaagaaauuaucccucagaggcaagguuuuuguuuugucuuuugcuuuuuacaggugagaagccagauccugaccaaacauuuaaauuaacaucucuacagaauuuuagcaguugucuucccaacacuuguacaacucuaguaucuaaucacaguuuaucucacagacagccugagacaguccuuacagaaacaccccaagacacaauuguaaguguguuucuucuauguucaaaguguucuaaaagcccacaagaaugauuggaacuaaacaguguaucauaagugacauaguagaaaauuucuguuucaggaauuaaacagacugaauuuagaaucuuccaauucaaaguacuccuugaauacagauuccuccgugucuuacauugauucaacuguaauuucaccagauaacgucccccuuggaccugguacugccauauuaucuaaacagguucaaaauaaaccaaaaacuggucgaaguuuauuaggaggaccaacugcucuuagcccauuaaccccaagguaagucacacaagauauuguaaaauguauucuaauauauaaaugaucuuuagugaauccuauuaugaauaauauaaguuaauuuaaacagcaucuucucuaaucaguaugacagaguggcauucuguuuucagaaaaggaaguaaaaaaagccacaauacaucuauaaaauuuuugaguuaaaauuaaaagagugagaguguagcucaguugguugaauauuccuauagugugcacaagguucaggcuugauucucagcacucuguaaacugggcaagguuucaaaugcauguaauuuuaguacuugggaaguggaggcaggaaggccugaaguucaaguucauccucaacugugaguuagaaagucaaagcuuaugauaugucaugaucuuucucaaaauaaaauuaagcagaggaaaaauauuaaagcuuuuaaauaugcaccaguuaguauauguauuaaaagauacaaucuugagcugggugugguggcauacgccuuaaucccaggacucgggaggcagaggcaggcagauuuugaguuccaaggccagccuggucuacagagugaguuccaggauagccagggcuauacagagaaaucccugucucgaaaaaccaaaauaaagggggggggguacaaucuuuauggcugugcaucuacagauagcaaucccuccacuuguacguuugguugguuauggcagcauuuccaguucucuuuucuaaaacaugaaggaggaguugacacuuaucauuggaaaauauguugucaaaauuauuaaaaguauauuauauguguauacaauaacacaucaaacauaucaaaacuaucaaacaaaacucaugaaagaauagacuauaaauggagucucaaggccagaaagcuauuaaaauagcaugaccaggagauugguuaggguaucugcagagaccaauggguaacuguaucaauaauuauuaaguaauuaccaauauucucuaggacauugucuaaauuguuccaaaaauuggaguucaugucaucauuuguauccuagcuuuuaaacaggcagucacaaaucaguagccacuguucucuucagguccuuguccugucucugugguucuggggggguggagcccucuacauucacagcucauguuaaaucugccccuuagguccucucugcccuggagacugacuugccauucucuuccuuuuagaccuucuaauuuaaguauacugcugcuuuguauaugccuugaugacuuuuugacaccuugauuucaaccucuucucaguuuugggauuuugccauuagaaaccccaaguccuggagauggauccuauuuacaaaacuacacuaauacaccuucuguaauugauguggcacccaccggagcaccuacaaaaaagguauuuucuguguaaaauauaguuuggguauugauuaaagauauguauuuaaaacuacaaucuauuaagguaauuucaagagaauccagcuuaauauaaucacuacuuccuuagaguuacugacagaccaccgaagaauguccuuaucguacauagccuaucgccucuaucagacucguggauguuggcuuuuucaacuuacacaucuaguucuuuuccauaucuaguuauauaaguguccauaagcuaaauuaagauuguuucugucacguugaacaauuaugucagaagaggcaagcagaagguuuuuuuuucuucuccuuccaugcaagcagaaaaaaaaauuagaaaaaguaggaagagcuggugaugcaaagcagcaucuuuaucguuuaggaagggagcaggcggacucuuuuuaaucucuuuaguuaauuauuuuacuaagugcaaaaggaauaguauaaaaucuugcuguuucauauucuuuauauuuagcaaauuaauacauaaauauugaaaauaauagcugucuuaaaaauuuuaauacaauaucgugacagugaugauuguauugggguggcaugagcuguccugagcucuccacgggaaaguguagacaggagcaccguagugucuuuccgccauugcagugcaaucuauaaucacaaaccuuagacuuuuuguguuuuacagucuguugcaagaaugggccaaacuggaacaaagucugucuucucacagaguggaaauagucgagaggucacaccaguacuuguugcacaaacacaaaguucuggcccacaaacaagguauuuauuauggugucuauuuugucaaaguaauguauaugcuccuuaaauuauuuuguucauagacacuuaaccuucagagcaaguacacauagauuucuuucuuuuuguagcguuuauuuauuuguggaguuuuuugggggguggagggugggaauaagguuucucugcauagcccuggcuguagaccaggcuggccucaaauucaggccugucucuaccucccuagugcuagaaauaaagacaugcaccaccacagcuguuuguuuuacuuuugaggcagagucuguauuauauaguccuuggcugcccuggaacucacucuauaggccaagcugagguguggcgccucugccuuccaagugcugagauuuaaagugugugccagaaugcacagcaaauacagauuucauucucucugcacacuggucauaaaauugaacuucagauacagucgccuuaaaacugucaccguuacagucuuaacuaucuuaaaggagucaacauaccuguaauguuagggucuaaucaggaacacagcuagcagacugugguugccuagggucuuguuauaagaauuacuugacugagugguucacaugggguuuuuuuguuuuacagggcaggcaguuauuacugcuugcuugugaaagagugaguacgugggcuuggcagguacucaucugaaccccagcacuaaggguguaggcaggaggaugcagagaacucacuuccaucuggccuggccuugugcacuuagagggugcauaugugugcacacgccuuuaaacuggguagaaaggaguaaaaggaagccaucuguuuccuggcucagugcuuaagaaugucaccugcuccugcagagagggcuaggguuggguccuguggugggcuacaaguguguaacuccagcuucagggaagcggaugcccuccucuggccuuugcacgcuucugcacguguaaaucuuagcuuuagaaacguugaccagaacaggugauacaaagguugaugucacuugucagguuggcaggguuuagaaucacaagugacggguugucuagaguaggcugcccugugggcaugucugaaaggcuuuccuaauagggauaguugaggugggaagacccacuugaauauagaugcuacugguuugugggcugggcuuuggauugaaccagagagaaggaauugaacacagcucucugcuucuuggcuaugaaugccaaguggcuagcguucuagagcuuaugcugcuaugacaucuccuaaccccaccauaaucuacuugugaccuaaaauaaaauucuuugucucugagguugcuuugccaaguguucagaaaccaagauggauaacuaguagaauuacccauucuuuaugaagaauuuagucuaugagcuuccugccgucccccuuuuauauaggguaucauguauccuaggauggcugcaaacuugcuauguaucuugagaaugaccuuaaacuacuaauccaccugccuccaccuccaaagagcugggauuacaaucagugcaacauaaccaaguucaaaccuagaguucaaaucuagagcuuugugaauacugaggaggcacccugccaucucagacccauucauugcugacucuucuuguuuucuguuugaaacagggucucguaauaccccuuacccaagucuuaauuagaucauuuuaagguuuaaauuuacuauguuuucuguuuguucuauucuguuuuugagacaagguauuuauuuuagauuguccaugacuugagaaccaucugucugucucgacuucccuugguauagggauugcaggcauuauuacuaccacgcccaacuaaguugaauugcauucuaagaauagaauucuuggugcuggagagauggcccagugguuaacacuugcuauucuugcaaaggaccuggcuucacuucccagcacccacuuugggugacuuacaacugccuguaacugcaguuuuaaggacugaugcccucuucuagcuaccuguggugcacauauauauauggaggcacuuguacauauucauaaaauaaaauaaaucuugguguagaaguacacaccuuuaaucucagcacuugguagacagucgcaagcaaaucucugaguucacggacagcuugcacuauauaaugaguuccaggacagccagaguuacauaguuagauccugucacuagauuaaauaaaccaaaucuuaaaaauggaauuaacucuuagcuaagcgugguggcaugcaccuuuaauuccagcacucaggagacagagacagacagauuuuuggguucaaggucauauuagaacauagagaacuccaggccaaaaagggauauauaguaagaccuuuuauuuaaaaaaaaaaaaaguuacauuugggacagaccaauggcuuagcaguuuagaggacuuucugcucuuguagaggaccgccauucaguuuccagcacccacauggugguucaccauagccuguaacuguaucuguaauuccaggggauacagugcucuuuucuggcuucuauaggcacuaggcuugcuugugguacacucauguaggcaaaacauucauagccaugaaaauaaaauuuuaaaguagaauucuuaugguuugcauuucaaguaaauuugugcgcaaguaaugaucaugguaucgucuaaguagaauaaaccuuuaauuauuaguuuauaauugaauuuguuuauucuaguaauuuuguuuaguuuuguaauauuuauuguuuauugacagguaccacauuuaagugauucauguccaacuuuuuuauuuaacauuuuguaguugccaacgugugcucuagacaauugccuauauauguuguuauuguggugggugggugugugugugugauguucaugcuaguacuugcaaguacacucagaccaaaaaagauagcagcaucgccuggaacuagacuuaguggccguuaugagccaccuaacauggacacuaggaacaaagcuugagcccucugggagagcaucaaguccucuuacccaggcaacuugucccucuagccuggaaagguuuuaaauccuaagucuucauagagacccaaagaaacuaaccaaaagaccaguuuuagaguauuuaugaugaaugcauauuucaguaaagcagaauuaagaaaauaggcaauggucauaagccaaauguuaaaaaaaaguuuuuguuuuuuuaguacaacaccucagguauugagccccacuaucacaucucccccaaacgcauugccucggagaaguucccgccuuuucacuagugacaguucuacaaccaagguaaagauuucugccuauuuauuuaaaacuuccuaugcugaaauuucuuuuuuuuuuuuuuuuugaaauuucuauucauucauaacuucaucucaaauaaauaaaggguuuuguuuuaauuuuuuuagagagcucauuauauacaucaugcuggucugaacauugccaucuuccugccuuccuuaccuucugggguucugggauuacagggaugcaccaccacgcugaacuaaauaauuuauuuggagaaccuagcuauaauuuuugugauucuccuuggucauugguaaauaggucagucuugaaaugaccaaaucauuuaaaaugauuaaaaauguuaguggcuuuuuucaggaaguagacuggaggaaagaugcaacaauuuaaauguaguacaaaaggauuucuuaguucuagaagaauaauucugucucauaacuguuaugguugguugcacaaaugccuuugguaaauuacauagcucauauauacacaugcaaaagaauucauuuaaaacugggaaaugucuaugggguuugugcuuuauaucuuaucacugaggaaagaaugagugggcauuuggucuuguuacuaucuuucuagaauaauguuuuuaaaguuaaaaagcaaagaugugaggggggaccuuuuuugucuugaucugcugacugacaugaauaauuaguuaccuuugagugauuuugugcuuugauauaaugugaugguagugcuuugauauaauuaguauugcguugucuuauuuuuaaguaauaaaugagaaugugauacacuuucagaaaagaucugcccuuaguacagacugaccucagucacuauuaguugggcaaugcagugacucuuggcaugcugguucauuccuguaauuccaagauuugggaggguaaagcaagauugcuucaaguuccaggccaaaaaguaagacccugucucaaaacaaaaaauaagcaaaaaaauugguuuugaagacuuguuuuuauaaaauuucugaugagaaaaacaaaaagacuaaugaggacuaugcauuucuuuucuguguaguacuuguaggaaauguuaauggagacaucuagaagaacgaguaugauaagcguggaauuuuauuccuuuuuacaggagaauagcaaaaaguuaaaaaugaaguuuccaccuaaaaucccuaacagaaaaacaaaaaguaaaacuaauaaaggaggacuaacucagcccagcauaaacgauagucuggaaauuacaaaacuggacuccucuaucauuucagaagggaaaauaaccacagucacaccucagauccaggcauuuaaccuacaaaaggcagcagcaggucuguuuguaaaugcuuacuguacuuccuguguuucuacuuuuauuuuauacuuucuuugauuacguuucuucaugccuuuauuguuuuuagauuaauacuggcauuaaaaauuguuuuaauggauauuuuuauguuuuaaaauuugucuuuuaccuauuucuauggauaugcuuauccucaaagaaguccaaguagagcaugaaucccauggaacaggaauuguagaugguugugagcugccauguaauacugggaacuggacaaaaaaugcuuuuaacaacugagcccccuuaaauaaauuuuuuaacuuaauuacauuuuauuuuauuucauuuggagagaaagagugagcauguguaugaacauuaugugggaucucagggaucaagcgcaggucuucaggcaagaaccucuaacuacaaagcaaucuugucagcccaaauacuggaauuuuuuaaaaaggaauaauuuguaguuagcaguuuuagaaaaccaaacuuguauguauuucuccuuuguuuaucauguuguuuucuccuagaagguuugaugagccuucuucgugaaaugggaaaagguuauuuagcuuuguguucauacaacugcaaagaagcuaucaauauuuugagccaucuaccuucucaucacuacaguacugguuggguccuaugccagauuggacgggcuuauuuugaacuuucagaauacaugcagguaaguauacaaagauacauauauccuucuagaauuaauuuaacuuucaugcuuaaggcuggaucauaaaggcuaauauuuacuaauuuauuauauaauguuuauauaauuauuuuccuaguauguauaauugucuuaguuaggauuacuauugcuguggugaaacaccacaaccagaagcaagcuggggaggaaagaaaggcuuuauguugcucacaauucaucaucaaaaguagugagaguccuggagagauggcucagcucagcgguuaagagcacuggcugcucuucuagagguccugaguucaauucccagcacucaugcaccgaugcccucuucuggugugucugaagacagcaagaguguacuuauauacauaaaauaaguaaaucuuaaaaaaauaaauaaauaaaagcagugaucaggaacucagauaaggcaggaaccuggaggcaggagcugaugcggaggagggaugcugcuuacuggcuugauccucgugcucagccuguuuucuuacagaacccaggacuaccaacucacggaugguacugcucacaaugggcugggcucuccccuaucgaucacuaauuaugaaaaugccauucagacauucagaggaucuuccggagguguuuccucaguugagguucuauuuuuucuuucagaguuauaaauaaaauuauuucuuauauugagauaauuuaaacuuaguaggcuuucuugaaaaggauuuuagaggaucaaguuaauacaaauucuuucuacaguuguguacagaauuauacacugcgggcuggugagauggcucagugguuaagagcaccgacugcucuuccgaagguccugaguucaaaucccagcaaccacaugguggcucacaaccaucuguaacgagaucugacacccucuuccggagugucugaagacagccacaguguacucacauauaauaaauaaauaaaucuuaaaaaaaaaaagaauuaugcgcugaucugaauuuagugugcuuuauaaacuuaaggcuaugaagaggaauauauugaagauacaauguccuaauaacaagguucuuuauuuuuucuuuucaccugguagcucuggcuggccuggaaccugcuauauagaccaggcucaucucccuaaugcugggauuaaaggcauacaccaccauaccuggaugguuuuguuuuugagauagggucucaugcaggcaggcuguccuugaacucuaagacaggauuacucaaacuccugauucucuucccuucccucuuagauugugggauuacaggugucugcuaccaucccugauuuaugaacccguggaggaguugaauccagggcuccauacauucuaagccaaccuuuccaacugagagggagcucuaucaucagucauucaacuuaauucauugguuucuuuuuuguucucauaggucauaaucacuuguggaguuuaguuugguuuuuuggggggguuuuaggguuuuuguuuuauuuguguuugguggggggauugagaaagguuuuucuguuuaaccuuagguggccuuauacucaaagaucccccugccucugccucugccucccaagugcugggacuaaacacacguguugccaccaccaggcuuuuuauuuuauccuggaaacaaguuccugcuauguaguccuggcccaccuugaguucacuacauggcccaggcuggccuuagcuugcuaggccuguuacuuugaauucaguccuagcugauaauugauuuuauagcuucugaaauuuuugaagccaaaagguauuugugucucuaauuucuuuguuauauaaccuauuucuuuuagaagcacucacaacuuuuaaagagauuugaggggcuuauaaaacagcggacugauucuacauggcagaucacuguguuuggggcuuuguaaauguccuuucccggggcuggagguaacucagcagcuaacagcacuugcuguacuugaggucccguugucagcacccaguugggucacgguagucuguaacucaaucuccagggcuuugaugggcucuucuggccucucagguacccacauacauaaaagcaaauaacaguucuucccuuaguuucugucaucuucauuaaauacaacccaaacauuccuuauucugaacuacaacuuugaacauuuugaacuuacuaaggugucaaaacuaggugacacaaaaaugugaaguuuuuauagaguuuauaagaaacacaguucuagaaacuguaaauauuuucagagagaaaaaagugaccuggggggggaggcauagaaaggguuaguggguacuguccauccagcagcauggugcuuggugcuguucauuauucagugugccauacaguuggcagccauucaccuuuuuagccucuaaaaguuucagcuaagcuuuugaguaauuucauuuucuuucuuucuuucucucccucccccuccccuugucccucccucccucucucucucucucuuuucacaauuauaccuuauguaaguguuugcauguauguauguguaccacacaugcaccugauaccagagaggacauuggauucccuggaacugcaguucuagguaguuauaagcugccaaccaaugccagguccucuacaaggcagccaguauucuuuauccgguugcuccauccccaucuuugucuuuuuuuuuuuuaaauagaaauuucuuuucaggcuucaugccuuuuuuuuguuuguuuguuuuuuaaagaauuauuuauuucauguauacgaacgaguacacugucacucucuucagacacacaagaagagggcaucagaucacauuacagaugguugugagccaccaugugguugcugggaauugaacucaagaccuuugggagagcagucagugcucuuaaccacuaagccaucucuccagccccaggcuuuaugucuuuaaaccuaguuaaaaugcaggaccuaggcuaacugaaguaugauugccuccguauuugaaaucucacaacgauuucucuuguuucucacucucauaauuauagcagacauucaguccugggaagacaguagcggcacugcaccagccuguacggacacuuucacuuacuugugcuuuaauuuuaggcugaaagaauauucucagagguuagaaggauugagaguuucagaguugaaggaauggagaucuacucuacaacacucuggcaucuucagaaagacguugcucuuucaguucuuucaaaagauuuaacagacauggauaagaauucaccagagguaugcuaccaguaauuuguuuauauagucauuuagcuuuuacuuguuuaauuuuugggugcagugcuggucuggaacccaguacuaaggguaugcuaggcacauaauccuuaacucugaguuaacauccuugaccccagcauagcuuuugaucaucagaacaaaucuaguccuguaucacuuaaugauauauucugacaaguguguuguuagguaauuuugucauuuucacaaagcgucauaagauacaauuacacaagaguucaguuacucuuuacugcacagcaaauuugauacuaacucugggcuucaugagauugucucagagaagacucaccucacacaugcaaaaaagucaugcuuggugauucaugauuguaaccucaguucuuggaaggccuguccagacaacaaaacgggacacuugaucuucagaaaaaacaaaacagauucugugugagggagcacauauaugccauagugaguauauuuggauuuuaagggauaacauuuggccauccauuuuuuuccuuaaauuauguggacuccaaagauuuaacucuaggucaucaggcaucacugagagucaucuugcuggcccuuaauugccagcaagacaauuuuuaagacauagaguugacucauguacuaaucuuacaaguauuucaggacaucucaaacauauuuagugaggguuuauuugaaggucuuuguuuuucagaauuuugcuauuuugccuuggcuguucuuuaauucuugagccucccauucggaucucccacagccaaauuauaggcauucaccuggcuuuuagugauacuuuugugaaaugcacauaaacauggauucaaauugcuguucucaucuggccuccgcagacuccacaagugcacaaacucacagacacaaauacuaauacuaaucuaucaucuuuaaaaaaaaaaaaaaaaaaaaaaaacaggcccaguaagauaacuucagaaggugcuugugggccuggugagacgaugggucagcaggugagaguuugcugugcacacccggcgcucugaguuggguuucaagaagccauaguggaaggaauaaacagcuuccuggaacuguucucuugagccaguugugacgccacacaccuuuaaucccacacucaggagcagaggcaggcaaaucuccaaguuccaagccauccuggugucugucuagugagugaguuccaggacagacaggacuccacagagaaacucuuaucaaagaaaaacacugcccugaccugcacauguggcuuuguauaugaguaagagguuuuaaaaagagaaaauggucgucaggaauuucaauuucuucaguucuucuaaauaaaaucugaggccugauuuuaguuauagaauugguuuuguuaaaaaggaaaauaaaaguuuuuucagagagaugacuuaauggguaaaaauggcugugcuaggaugagauccugaaucugaaccugcggagcccacagaaaugccaagcaguguaaagaaacugcugcggucccagcgccucccuccgcggggaggagagggcagcagagacugcaaaccccugcaagcucgcaggcggcuagccuacugcacacacaaacaacacugagccugccucaaacaaggacagcaaggauccacaugcaccacacaguuucuuaggucaaaauaaauucaaauacaaaaaauuuaaauccuaaguuuuuacuuuugacaauaauuuucuuuauagggcauaaaaaguuugaacugauuggguuuuguuucuguuuugucaggccuggugugcugcagggaauuguuucagucuacaacgagagcaugauauagcaauuaaauucuuccaaagagcuauccaggucgauccaaauuacgcuuacgccuauacucuauuaggacaugaguuuguguuaacugaagaacuagauaaagcauuagcauguuuucgaaaugcuauaagaguaaaucccagacauuacaaugcaugguaagugaagagacaaagucuuacuaaagaucauuuuauuuauuucauuuaauuuguuugcauguguguauuguguauguauaggcucugugggccacaacacacauggagguuagaacauaaugucaaggguugguccuucuccagggaugaucugggcuugccagguuuggcaacaggcgccuuuacccacuuuuuuucuuuauaagauuuuuuuuuaauagguaugccuguaaugcuuuuauauguguguguauuauguauugccacauacaugccugaugucuuaguuaggguuacuauugcugcaacaaauaucauugccaaaaagcaaguagggaagaaggggcuuauuugacuuacacuucaauauuacuguuaauuuucagaggaagucaggaacaggaacugaguaggauccuggagguagaagcugaugcuugccucuuaccagacauaaagcccuggauccuauucuagccccugaaccauauauacugauaagguuuaaugguuuaugcuguaaucccaguacuggugagguagaaacagggaucagaaguucgggguugccagguagugguggcaaaaguuaauccuagcaacuugcgcggcagagguagguggauuucuaaguucaaggccagccuggucuacaaagugagcuccaggacagccagggcuacacagagaaaaccccaucuugaaacaaaacaaaacaaaaagguuaggguuaucuuuggcaacauagugaauuggagaccagccccucuagacugcauuuauuuccucucuuaaauaaauaguucacagaccaaacauuuaugaauaauaaaacauaaagaaaucauaggaaagaucaaagucuguaguauauuaauauaugugugaacaugucuaaauguagguaaagucuaaaaaauuuagaaaggagccaagaaaaaguacuauuagguaauaagaaaaagggcagaguuugggcaaaaggauauaugaguugaggaagcagauauaagacuuauauuuuucuguuucaacuuguaaguuguuuguuguuguucuguuugguuuuuugcgguggauguguggauuccacuuccuuuauaaaccaagagccauuuuuaacuuuacaaaugauacgauauuccuuugagacggugauuaugaaaaguuggucuuucuuuuuuaaucuuaugaaccauuagcccaauagaaacuaaaaauaggggcuggugagauggcucagcagguaagagcaccgacugcuguuccgaagguccugaguucaauucccagcaaccacaugguggcucacaagcacuccucguaaugagaucugacacccucuucuggugugucugaagacagcuacaguguacuuaugucuaauaauaaauaaauaaaucuuuaaaaagaaaaaagaaacuaaacauagucagugaauggauuuguuacauucacccaggugagaguggcacauaccuuuagucccagcccuggggaggcagaggcaggccaggcggaucuuugaguuugaggcuagccuagucuacaggaugaguuccaggacaaccaggguuacacagagcagcccuguauuaaaaaaacaaaacaaaaauguucuggaagaagaguuuuucuaaccugcaauccccacuccauuuuuucuuuuguuuaaaccacccuauuaaaguauuuuauuuaauauguaaguuauauugcuguauaaacaauuugggucuacauacaauaaaauaugauguagagaaagaaauagauugaguuuccagaaccagacagccuuaguggaacaugcaauuauuucccagcuauuugggaggagacuggaagauugcuugagccagaaauugaggacaaguuuaggcauauuaaaaaaauaauaauuuaggcugggcagugguguugugccccuuuagucccagcacuggggagccagaggcaggcagaucucugugaggcaguauagccagggccacacagagaaacccugucuaaaaaaaaaaagaaaagaaaagaaaagaaaagggaauaauuuagcaaagugcuugcuacauauauaaucacugcaggaauuggcuguucugucuacauuagaguggugaguuucaagauguggcuucuuuucucuaucauaguuuugccuguuuggguaauuuacuguuuacacuuauaaaaauguaucuucuaaaauguuucauugauuauuauuauaacuaauauuuuuuguccauuauuuuuucccauuguguauugaaaugccagauacccaaacugucuuauuauaugaagccaaaacuuguguccuuaaaaucauacuuucuuauaauuucagguaugguuuaggaaugauuuauuacaagcaagagaaguucagccucgcagaaaugcauuuccagaaagcacuugauaucaacccucagaguucaguuuuacuuugccacauuggaguaguaaguaauuuuguaaacauugcuguuaccucccuauuaagaguuuaggugacuuaaugguugcugccuuggagagucaacugucuuguuacugaagcagggucucaagagucuuugcagcuuagccagagccuucgacuuaucguggggaaaucugccucugccucauggggcucaggagccauagauuuagucuuaaaacugagcacccucccaccuacagccuaacacuucuuagagggaggaggaggagcaggugacucacacugaaggucauucucaucaaacaaagcaaguuuaaggccagcucggagcuacugugaggcuccagauccagagaggaggagcugggggaagucccuguguuuguauacucuuucuauuuguuuuuuguuuuguuuuggugugugugugugugugugucucagaugauguuuuguuucguuacuuaacugaugcccagagaagccaaaggcaucaggucuccugaagcuggaguuauagacaguugugagccaccugacaugagugcugggaccaaacaagcugcacuuagacaaaagcauugaccgucuuuccagugacucauuuuggguuuuguuuuguuuugagacaguuuuacauacuccaggcuguaagguguaauugagugacacgggauucaugaacaaguucuuugaacacagguuaauauuuagagggucauaauaauccuuuaaaaguguguuaucugcuuuucuugugaaggguaaaaccaaguuuuacuuuuagacuucaugguaauuaucugcuguaaagaucaaaucauggggcuggagaaguggcucagugguuaagcagaggacccaaguuugguaccuagcaucuacuucaggcagcucacaaccgccuguaauuccagcuccacacacacacacacacacacacacacacacacacacacacacacacacacacacacacacacacacacacacacacacaaguaauucagaaucaaucuuuuuuaaaauauugaaucaugaguaucauccucggcuuccacugguggguuagaagucugaggaccuagguuuuaauccuguaagaaauuauuuaacaucucuggaguucaggaugguuuuucgagacaggguuucucuguauagcucuggcuguccuggaacucacucuguagaccaggcuggccucgaacucagagauccgccugccucugccuuccaagugcugggauuaaaggcgugcgccaccaccgcccggcacaggaugcuuuuuuaaaaaauuauuuuuuggggggagagucaggggacagucacauugguucuuguucuaccuuacaugggugcauggguucugggaauugaacuaugauuaaggucuucacccacagaugaguuuuucuggcccucagugcucuuugaaauggagcacuugcuagacuuagaaaaaauuacagauaauauguuaaucacuuugugucuaaucuuucuguugcugugauaaaauaccaagaccaaggcaacuuggaaaguguuuaauuuggcuacaguuucaggggauuaaaguucagggugguggagcaaaggaacaaaagaaacugggauggacuggucuuuugaaaccucuaagccugcccucagugacacccccuccaacaagaccaggucucccaauccuauccaaacagcccuaccaguacucaaacaugaaucguucuuguucuaaacaacacagguaguaaugaauuacuuaggacacuuaaaccccuguagacaauccaguuagauuacacagccugauugcuaaaaguuuuaucuucaaaacuuagauauagacuuguaagcucuuuaaguuaggacagaugauagagugcuuuauuugacaauuauaauggacuggauguuaauuauauauuauaguuuguuaucuauacaauuguuaugguuauguucaauuuauaucuaagagaagagguuuuuggguuuguuuuuuaauuuggacagaaaaagugagauagauucuaaugcuugucuuauuuuggcucccaaaaagcugugcuuccagcccugagagucacugcccccugcuggcuucaguugauaauaaagaauugccauacauccaauggcugggcuggaagacagaggcaggacuuuuagauuccacaggcaaggggcugggagaaagagaggagagaaucacagggcaggagaaaaaugaaacuuaagggccugccgacgugcaagaauccaggaaaguggcccuagaggucacuuccccaggugggucugagguagcagaggugaaauauagauuuuaaaagauauuaacucgggaauaccggagggcggcguuugcuagccucagggaaauuuagaagugccauugagcuucuagccauuaagcuucaagccauugacuaacccuugagcuggcuagucaaggcauaucaaaugaacugugucuuucauuugagaauccagagggcucugacagguggcuacaagagcgaccugcugggagccaaagccaauucuucgccacagguuuaaauuaucggcuuucuucauuaauaucaagacgagucuuuauuucuuacagguucagcaugcacuaaagaagucugagaaggcuuuggauacccuaaacaaagccauuguuaucgaucccaagaacccucuaugcaaauuucacagagccucgguuuuauuugcaaaugaaaaauacaaggugagauuuauaucaguuucuuccacacuguauuaugucucuuuaaaaaaaaaacaaaaacagucugaagagauggcucagcaguuaagagcauugacccuucuagagguccugaguucaaaucccagcaaccacuugguggcucacaaccaucuguaaugagaucugacacccucuucuggugugucugaagcaguuucaguguacucacauauaauaaauaagucuuuaaaaaaaaaauaaaacaaacuucaaggccagccuggcuuacauagugaguuccuagauagccagggcuacauagagagaucuugucucaaaaaaaacaaaaauuaaaagccacauguuauuaaugugggggauuuuuauuuuuggaaacuguuuccuauuuuuuaaaggccauggggugggguguaguuucauuuuuuuucaugaauugcuccuaugaaaugagguauaauucuaacacuugggaggcucagacaggaauauugccauuaaguuuacuuuagcugcagagugguccggauccauuuuaagcuacagagugauauucugucucaaaaaacaaaguagcagugccacccagagaggacuggugugggguucagacauguguauggaguccauggcuaguaaggcucuuuuaugcaccacagaauugucuuaaagacuugaagcauccuccuagcaugcucacugucacucugggaggugucagcucagugauggguguuuguccugaaugcacaaggcucuggcugcaagucaccgcuuccaaaaagagggaagaaaagauauuuauugaguaucugcuaucugucagguacuaggaaaacagugguaaauaaugccaucacauuuccugccuuaagaauuuuaauauaguaccccuuaaaguguggaaaauaaauacaaagaaaauugagugacaaaaagauaugaagugacaugaauuuuuuugauaauuuauucaaucauaaaugaugaacauauaaauuuauuuauuugaaucuccguuuccuguuugaauaaauuuagauucuuacuaaauaaagaggaguaaaaacuaagcuggguguauuaguacacaccuaaucccagggcaggggagaagaaagcaagagggucacaaauucagggcuaggcuagaucaaaugagaccuagucuuuaaagagaaguaggaaaacaggguggggagggggaggucaggugguagagcacccaccuagcaggugcagaggccuggcuggguucagugucaaacagcaccaaaguccuguguauuuuauaccugcaguaucagcacuggggaaguaaaaggaaaaaauaaauuaguuaauuaagaaauguuauuuguagccggguagugcauuuguagcugggcggugguguucaaggccagccuggucuacagagugaguuccaggacagccagugcuacacagagaaacccugucucaggaaaaaaaccaaaaaaaaaaaaaaaaaaacgggguggggggaagagaggcacugucgcugucuucagacacaccagaagagggcaucagaucccauuacucaggaccucugaaacagcaaucaguguucuuauucacugugccaucucuccacccuuaacauugauuuguuuaaaucuauauauugaauauuuguuuuuaacucuguguggugccugacugcauuuguuuggucagaauuguauaaaaguuugcuccucuaaguuuguucucugcuuuuuucagucugcuuuacaagaacucgaggaacugaagcagauuguccccaaagagucccucguuuacuuccuaauaggaaagguaaaaguuaugcugcagcuuguaacaaauacuaaauuauuuuucuuaacuuuuuaaaauauuuguuuguuucuauugccaggcagcaguggugcaugccuuuaauccuagcaguggggggcagaagcagguucuaggauagccuagacugcagagcaaguuucagagcagccagugcugcacagagaaagguuccaagaacuaaacuuagaucuucuggaagagcaacaagcaguuuuaacuguugaacuaucucuccaaccucaacaacuauuaaauuuugaaaaauacuauauguauuauauauacaguccuugcucuguagacuaagcuguucugggacucagaaacgcaccugucucugccucccuaaugauaggauucaaggcauguacuuagcaaaauuccuggacuaagagcccugggggccagggggauggauuuagcaguagcaauuaaaaagacgauguucuagcugggccugguggugugucccugugauccaagcacuuggaaugcuaaggcagaucuacuaaugaacugcacagucucucacuauguagccauggacaucuugucuuacaagaccaaauguggaccuaagggcaaucucaaaugccuauguuuucagauguccuugaccuggauccaggcucugugucuuguaccuauaaucucaggacuggcacaagcaggaaguucucaguucaaggucagccugagcuacauaaugagacacugcaguucauuaguagaucauguaccuggcaugcauaaggcuguauaaaugaaaggcacucaagcagcuucgguaguccuugcuucugugcucaggguuccaguuggugagguuuacuggaaacuccuaccugaaaaauaauggcaaggaauucugaacccaacuccugauuguauaaagaauacuuaaaugugaagucauguguuggagaaaagcauccucccaccugaaugggcuuguacuucaaagaucagaagccugauuuaugguuuaagauuuuacagguaaagaauugagugcuccuguuuuuuagguuuacaagaaguugggucaaacucaucucgccuugaugaauuucucuugggcuauggauuuagauccuaaaggagccaauaaucagauuaaagaggcaauugacaagcgcuaccuuccagaugaugaggagccaauaacccaggaggaacagaucagugaguauccuacagaggcuccauagcauucagaaagcuacaguggcuuuuacacuuuccaaacuggcauuuucuuuacagaaaaugagauuacuucuaaauguaauuacuccuaaauccggugugcuguguggccuugaaccucagcucugugguggcaguugcuuacauucuaguuaguccuggacaaauccaaaagucuaggugugugauuaguacauacuuacuaauauuuauauaaauacuaagagaauuggaaguuuucugagguaaauucugauuagcuuuugcuccauaaaauuuagugaacaucucauaaguaaaauuuacaauccugguacugcucuuuuaaagagaagguuauaguccacauuucuuuaugcugucaggaacugucugcaaaguuaagucacugguuaggaguuagcagaaauguuagccuuuuuugauguuguuguuacuauaucuauuuuuaugucucagagacaaggccuggguuuuaucccagacuuuauaaaucagaugcagugcuacaugugccuguaauccuagcaugggaggugaaugcagggaggagcaucagcaguggaaagauaaccuuggcuacauaguaaguucaaguucagcuugagcuacaugagaugcuguccccaaagaacuauuuauuaucaauauuuuuuaaaguuaaauacagcaaguuaacuuccaggcaugcuaugagacguagaacuaauauugcacgcccuuagucccagcacuggggagcagaggcggguggaucucugaguuuaagagaccaguggucuacacagugaguuccaggacaggcuacauaagaaaacuccauuuugaaaaaccacagaaagagaggagcuagagaaaggaccgaaggagcugaaggagcuugcagcgccauaggaggaacaacaagaugaaccaaccaaugcccucagagcucccagggacuaaaccaccaaccagaauacacauggagggacccauggcuccagcugcauaugcagcagaggauggcuuuguuggacaucaaugggagcacugagaaggcucgaugcccuaguguaggggaaugccgggacugggaagcagaaguggauggguuggugagcaagggggcuggggggaggggggaaauaggggguuuucggaggagaaacuaggaaaggggauaacauuugaaguguaaauaaauauccaacaaaaaauaaauaaacaugggcuuaaugcagaagaaauaaagauuugaaaaaaguaaaaaagaaaaagaaaaaccaggggaggggcguggggaaugaacuugaaaugcuuuuuuaagauaacauuuggaauuguauggucuggggggucucaucucugaauguaaugaaauucuccuuaguuuugugaaccaagaaguuauacuugucccuauaccuuauguuuuuguuccauuugugcaguggggacagaugaaucccaggagagcagcaugacagaugcagaugacacacaacuucaugcggcggaaagugacgaauuuuaacuuguggaagucagacucugacugugcuagugcugacaugucccugucccuccauacacugagucucaacucuugagccgccauugccgucauucgucaccuagaccaugagugugccacuuucauuggacccugacuguacacagaauggaaggcagugcgauacuuagcugcuaacaagacuggcucuuuuaccaguaugaaugacaauuugggggaggggugaggaacuuuucuuuuuucuuuaaucucuucaguuggaaaucuaucauggaaggaagaguuauguuuuaucuugaaggaaccauuagauacggaaauggugaugaaccagaauuucuuggucauuuuuccaaaauuguuuuuuauuugguucuauuccugauaaacagaguaacuggccuucauuucuaggucuucgagaaugguguuagcaagugccagauggaacaauaaaagacauugccuauaacagaguaaaguucauugccaaggaacauagcuuaccuuaagcuuggagucucuccuauaagcaaaugcagugggccuguucggacucauacggaggagucaaauaucccuccauacaguguacacuuauucuuggcaagaaugcuuuaaugucuaaccaagaauuuuaauuuauucgucuugcuucaaaguguugaucauuguugucuugguauugcaaacuuuaaaauuggucuugacgauacuggcuuuacuccuugagcucugggaucgccuucaacacucagagaugguagcgugguucccugaugaaaagccaagcaggcccuuaauaaccacuguguuuaccagaagagucaguaugagaacacuaaagagaaaccuucgagaucaugauagagaagccuuaauacagcuggagcugucccuaaccgugugucugccucucucccaggagugcaagcacgcauggugaccucuguugagugccguucuuucagcucucuacuucguaauugucaguagugugagucacugcaacuugucaugggcguaauuaauuggguuuaaaauacugaacauuuuuaaccuaggaaaaaguuucuuaugaaagagacaaauucucuccugaguucaucauaauauggguuuguguguuuggggacuggccacaauuuuaaagaucuaauuaugcguauaaaaaugggaauuauuggaauuucacaauaacagauuuaaacagucuuaaauuguguaucuccuuuauuguaauguauugaaaauuuuagagaaaccuuaguuaacauuuuauuaagugccaaugucagaauauaacagauuauaguuucuuaugggugacaggccugcaguucuuauuuuggaauguuugaugaaggaaaaccucuccuacuggucacuuguauauguaagucaagcugugaaaauaagguggauuacagacgauguggaagaauguuuuagccuguagacucagucauuuucugucaguuacuuaaccuucucauccagaugugaauuagacacagaccaucauaaagucaaagucuuggguuagguauuaggugccagggaaacauuuuaaaauaauuuacugacuaaaucuauguaugugccguuuaaaaaaauaauaauuuaugugcaaaaggaaaauugggaauaaaugaccaucauaaaaaauucccauaggcuagcacuucaauucuaacagauauuccauuuuauuauucauuaguuguguaaaguuuaauuuucauuucuuuuauuuuuuuaauuggcaaaucguaagccagcuauauacauauauauauuacauuaucagaucuagaguuucauagcaagcuuuacccugaguucuguugcagaccuagaaaaugcuaagcucagagcauaauuuacugaaguguaauuaucuuuuuuuuuuuuaguaggaguuuauguccugugccagagggacuucuggugcugauuuuaagacaaaggauaggggaugguuguggcguggcuggcuggaaggcacucagacacuuggccugcuuucacaguuuccucacaccugcuuuuaacagcauuuagaugcggaagccuuauuuccacauaguaacugcuucuugggucucuuucuuuuucuuugugucuuuccuuuccuuugcuuuuuuuuuuucccacagaauagggaucagauaaacaaacacauuuugguaagcaaguuguuuguuucaaauuucagagcuugcuuugaagggacuuaagaauccuaaguaccuccuugucuuugucacaccuacacauaaggacacagauacagauacacacacucacacacacguacauuagagcauugggguuuuuuuuuccuucguggaaaugguuauuauuacugcaccaggaugaauauuuuuuuuuucaagagaacagaugguacucaaaauaaggaaaggucucuuaacucuuucuguauuucguuacuuaacaauuuuuuauuuuacccaagaacugcaaguaacauuugaaccaugcugcuguuguaccuuaauaacucagugaucaccaguguuuaguccauuaaaaacacucuuuucgaagaaaacaguuucgaagucucugauuagccagaguacacuaugggucuucacugagaaaaacgaaggcccauuuucuuugggaaaaccugggaaaaugcaagugugggugugccauguguguucuauuugcauugaaacaauguacuuuugugucgucuuuuuugcuuuuccugacuuauuucagaaauuguauagucuuuggggggaaagucuucucuguuaauauauuuacaguucauuaaaggauauggaaaauccaaauaaauuacuuuugaaagcaguuuauaaucaagguguuaaagcuauguaaaagcugugucaucugcauuuuuauacugagccacagcagcauagugaugacagaucacauuuuauguucuacaagagccuaggacaauguuucucuaauuuuuacuuacacuuuuuaauauauaauauauuaaaguucauacccuuuuuaguauuauuuggaauuucaaaauaaauacuaugacaaaaaaau

SEQ ID NO: 6441 - RNA, 62905 nt, Mus musculus
ccucccuucuucccuccccuccgcaggaaaagcagcugcgggugccaggcucgccguggcgcgcgcgcggcgugaagggcggcggacaggaugcgagcgcaguggccgggacaacucugggccgcucugcuggcgcugggggcgcuggcgggcguuguuguuggaggugagcgagucgggugcgcgaaaugccguaggacccugggaacccggagcuaggacugagaagcagaggugcggggggcggauccuucuucccguggccucgagggcgcaucgcugguggcggagauccuggccuggcccgggaagcagaggaaagauggagauccgcugggccgucccggugcgcuggcagaaggaugcagcucaccugcuugggugggugugugcgcucuggguugccccuuucucuggagugcgcaggacaaucuucuggccgccccacuccuuaaggaggagcagggauucgggcuccgucccuucuggggccgaccucucacccaacacucccugacugugugcugggagucagcacagagguccuuggggcugacuuugucucuccugcgugugucccacaacaucagcugccugcaucgucagcuuucaggcccacuaacgcugcagggaaggggagucauccaguccgcagagccuaggggagcgggagggggugguugcuggaggucagcuggagcaaguaaaacccgcaguugugugugugugugugugugcacauguguguaauacagucucauauauuucaggauaccucacacucuguguaguccagggugaccuugcacuucagauuccccugugccucuacuaaggagugcuaggacuauagacaugcaccaccccucaggguuuauaugcugcagggagucgaacccagggucuccucauggcaggcaagcacuuuauuaauugagcuacaucuccagacccagauggacuauuuguuaaagguaaacuuuauuaaguugacuuugaaguuaaguaaucuaaaaaaagauuuugguggcugccuuccugacccuuguacggugguacagaugaacauagacaugggacagggaaagggaaagggguuucaguagagaacugauauuugucuuuuguggcagaagcuuccaagcgaaagaugaaaacuguggucuuuagccuacauugaacaagcuuugucaccacagaacaggaaccaggcucucuagcauucugcccuggagauauuagagucucugucagcugcugguagccguugauggggaauggggaaauccuccaggaaagcugauguuucuaacagauaggcuaacuuucgugaauuuaaaaccuuuuaaacauuucgacuuaauuuuuuaauuggcaugucaugacaggcccugcuucuguacagcgugaaaguguccucacagauaacagauacacugaacaaaagauagcuaguacucuuuguguuaggcaauuuccaguuccccucagcuauuuugagauuuuacuuaaaacacuuugugguuuguuuguaucuauaacuuucacauugacuucugagugucaucaucaccaccucaggauagaaagagauccuguuuaaaaaaauagaagugauauuucugaagagugacacucagguugucuuuuggucucugcccagggacaauuguauaugagcaugcauguacaugugcaugcguguacacaugguauacacaccaaacaaacaaacaaacaaacaaacaacggauccuuuaggauaucuguucacagauuuguugugauuggaauaaucuagggaggcgauggcuugugccaagcuagccucaggcucccucugagaggauguagaguccuguugaggggcagaagccucuagagcauccugugcaagaggugucugucauacucacaugccaucucaguguugguggcagaguugcaaacaucacuaggucccuggggaagcaggcaguguggugacuuuggggacacacagaacagggucggagugaggugccacagaagggccuucagaguaggagggguaggagauucugcucugaggagacgcugacuuucaguuucuaacuacaaaaguaauccuuuuagcuucaucuaaauacuuuguuguauuuaaaacaaggcguccuuguaucgcaguggguauucuaaccuaauuaggucagcuaggaugaggugcuugguucucuagaguccgcauucugggaacuguccaacuaaagcucucuucaggaauccgcagggccaggagagaugaggaaaggcuuuuugcuggggaagagggacagcugggguuuaagcaagcgggauguggguuugauucuuagcuuugccccugauugaccaugccaucuuguuaaauuaccuaauaucuuaguugggcuuccucaccuguaaaguggagaaaaauagugccucucguuggcagacuaaaugagacaaaggcucaaaugaaguguuccaugcguggugauugcuguugcuauuaagcugucuacuauggacugcgggccagagcuguugcugcuucgugcauuggugcgguccaggcucccagcugagaauucagcucucacagccucugaauucagcucauuccucugugguagcuuggcauauuucagcccuuuggguccuccaagaaucuacagagaagacccaggaggagagauguccacacauucauuuuuuuuuuugagucuuaacuuugcauagagauggagggcgguaaaauccauacauaagacuucagucucuacagggagagcaaaauguauauuuugcucagcacugugcccagugcuuggcacacaggcaacaaaaaaauuuauguagggcuugguauaaaaaggcaccuagaggugaugucucuuuacuuggagaaauauaauauuuacauauuuauagucucggguguucuaccugaacagugugugugugagagagaauauauguuugugagaaugucucucugugugugaauauaugugagagugugugucugugugugugagaguguguguaugugugugaauguguaucucugugugagagugugucugugugugagagugugucucucugagugugaauuguuauguuugaguauauguguguauguaucucugugugugaguauauguaugugagugugugugaguguacguauguauguaaguguauaugagugugugucuauguuugaauauaugcaugugaguaugcaugaguguggaugaguguacaugagugugugaaugagugugugucuaugugugaguguauguauguaugugaguguguguguguguguguuuugcugagaauggaacccaggguuuugugcacaauaaaugugcuucacuacuaaacuacaaccccaaucuuuugaauccuugcacugauguccguccucugaccagaggaugacagaacacagggguccucugaagugucucccuuuucccugucuuuggagggaaucacuagaauaaucuuuucuguucuuccccucaaguucuugagcacgagggcaaaggugagacguggcauuuguggcuuggaagagcauccaaugggacaaggaggcagugcagcgaggagagggaucugaaugggacucuagaauucccgacgaaaacucuuccuuugcaguucuccacccuccuuggcuucucuguuuaucauugccuccagcugcaggaauccugcccuuguuggcagaaacagucaggaggcaugcccacaggaaccgcaagucaugaaucagcagacagauaauuaacugggcaaggagugugugugugugugugugugugugugacugagcagcuucaggaauaaaccacuugguuuguccuuagccucugugcugcccacagaguggccugcuguaucucaccaucuccuccucucccuucucuccaaguggaaagggucaugugccuacugcaaacucaggccacuaguggauaugaaccuaagaucuggagaugaugcugucuaaggcuucuuuucuuuggaaacuaccagaauuuauuagaacuugagacuauguagcauaaugauaagaacuuacccuucucucuaggcacaccauguccccagaaaacuuccacuucuuuuaaggggcuaggauuggggccuagagaucuggcuagcaguuaagagcacucgaucuugcagaggagcuggguucaggucucagaacccacauaguugauugccaauugucuguaacuucaauuucaggggaccugacacuuucuucugagccuuaggcacugcauacauaaauacauacaugcagucaaaauacuuggacauauaaaauaaaaaguauaucucuuuuaaaaggaguguugggcuagagagaugguucagugcuuaagagcauuuaauacucguucaggggacuugggaucacuuuuuagcacccgcaggagacaguuuccaaccaucugcaauuccaguccuuggauguacaugcugcacacaaacucauauagacacacacacacacacaaaugaaaauguaccaugggguuuagcauccucaguguguaauucuguguauuuugguaaagacaaauuaucaccgccauauugaaaauagagaguauuuuugguauuccaagaaguucucuccagcuucuuuguaaaucuccuauugccacgucuggucccuggcaaucacugcucugucuccugucccuguagaucuguuuguauagaauaucacagagaagagaucacggugaguagccuuuaagucuggcuucccccuuuugggaugcacuuauuguucuucugaguuguugcuugugucaguaauuccaagagcucccuggggucguuccauccuacugcagugagauaucacccuggaugcagugcagcuaccuccaccaaaccuuggagguuccacugguguucaaucggagagacacauuugagccaugagagguuccuacuacuagguaaagaauugagagccuggugcucagcacuggggaagcagagaccgguagauugcugugaguucgaggccagccugaucugcagagcauguuccaggacagccagggcuacacagagaaacuuugcuccaaaaaagaaaaacaaaaauaaacaaacgaaagaacugaggaauuuguaacaaucucuacuugucuguuuuucuuucuuucuuucuuucuuucuuucuuucuuucuuucuuucuuucuuucuuucuuccuuccuuccuuucuuucuuucuuucuuucuuucuuucuuucuuucuuucuuucuuucuuucuauuauucuugguccuaaaagcaaccgauauuuccaaauauauuucuauuagguuuuuauauauauauauuuugguagucuguauuaugaucacuguccccuccuuccuccccacaaugacucccaauuccauccccccucccaaguuuaccucuuccuucuccuucucuguuuuucuauaacucaguaucccauaugugccaucuauauacuuaauggaugugaaaccauucacuggagagggguccaccuaccagggaccacauccuugaagaaaauucuccauucuucagaagccaucagcugucaacaguggcuaaguuaggggcggggacuugugagccagcccucgccccugcugggacuuugacugucaugaucuuguguggugaaccagaggugccgugguaugaguagagcugucccaccacaccgagaugccagugcuuuacuuuagucccacccaacaucuggcucuuacgaucuuucugccuuggcaacagauguuuuguggucuaauaggacaugucgcucuugaggucaacggacuggucaguacgccuggauccguucugcuccucacguauuugguagcaucucugaaaaaacaaaauaaaauaagacaaaacaaaacaaaacaaacccacaaaugcaaacaaagcaaaacaaguccuuagacaucacacuuugccaggagaccacugccaucccugcagcuccuuucccuggaaggccagagagaaagagugaggugcagacauguucaccauuagaccaacgucugauuugucccuauuugucccauuucugacagugcuaccagucaggaaggugguguauucuacucagaccccccaccccccauauguacagcuagcacaugugugcugauacaguuuuuucuguaguuuaacuugugcuacauacaacuuccuuuucuguagaaaaauucucaggaaaagagcacuaggccugugguuaagaacuuacgucaugcauggcuuuguggguuuuuuugucaauuagcuggaggaccaagcgagucaccuuaucuguaagccuucauccugguaucucagaggcuguggagugggugaaggggcagauuagauuuuuuuuuuuauuuuugguucaggauucucucuuuuucucucaucucuuacuagagaaguuucuccuuuaacuucucagugauuuggaacuccaugcaaagguucuuugugaagggagaaguccugagguuagaaccaggcuuguaauacugcacuagaagagcguuccgggaggcugucaaaaggcacacccaguagccacuuuauaagucccuguagucaacccucuuugcugaugaaauucuuagaggcaaaaaaucuggugugugagcucucccaucguuacaaacucugguguuaacucuccuagacuaauccuuuucuccaaguguuuugugaggacuguauuugagcaucucaccagaggcuggggagugcugagucucacaacuugggaacagagcacacuugagaacagagcacacuuugcccugagugauuccagaaggccauagggauaggcuggucaaaguuuuuguuuuuuuguuuuuuucauucucucccauuauuaucauuaauccacaaauaaaaauucuguaucugauaugcagcauaauuugaaauguaaacauugggaaauggcuaaaucaugcuauaggacacaugaauuagugcacacagauaccacuuguuucuggugagaaacuuaagcugcuuauuuacuuauuuuauuuuauuuuguuuuacuuuuuugagauacggucucuguauguagcccuggcuguccuggaacucauucuguagaccaagcugaccuugaauucugaccuuuauagaacagaaggaaaaccaagagaucuauguauauauagcauggugacuagaguuuucaacagugugucuucuacuugaaaauugcuguuuuuaaaaacagcugggcuuaguaacccacaucuuaagucccagcacuugggaggcugauuuuauuauuuuauuuuauuuuuugagacacggccucauuuaaccuauguuggucuugaacucacuuuuuaaugaggcugucuuugaacuccugaaucccccugccucuaccuccaaggugcugguauucugugugcuacuauuucugucucugauuuuaauaaauguugccaaacaaccuuccaucaaaacugauuugccuucuuaccaagauugguugguggaauuguucacaccacaaccgcuggcaccauaccauggaaaguuggggagggaugccccagaacuacaaagcuggaugccaaggucaccuccaggacaccauggagcugugcaugaaacagagcauggcacaggcacgucucuucuguacacugaaugagucaguugggggcaggguggggcugcugugaauaaaaucucccagaauucuaaaaugcagcauuugacccagauuuuaggccaugaggaagaaauguccacuuguauacugagcgacuucaggucuaagaauaucuaucuaucuaucuaucuaucuaucuaucuaucuaucuaucuaucuaucuaucuaucuaucgcuucuagaguauuagcggucuuguugacaccuucugguucugaaagaauauacguuuugagagccaauagcacucugaagaaccucuaaucaaguacagaaaagcugaaaggggguuccuaagaagugagggacucacccaaaucacaaacuaguuuagugacuggugaggucugguccugggggcuccugucuccugccagggugacuuccuucugaugucccauuguagacaaagggccugcuuauuaugaacuugagguagaggagaagagagguguauuuguggugcaggaagcaacuggauggaggaaaauggggaagaaaaugggucauugauuggacaguuaccacaugccucuuucacauauguuaccuuaccuaauccucgugcaguaaauauuaugcccuuauuugggaggcugaguugguggggaggggauaaaaauagcugucugggcuuuucagagcuugucugauaaagcuggguggcccauagaguacuguggggcagugauaaaucuugaguaggcaagugaccggguuuuaaagagagcaccagagaguugggugccacugagcucauacggucugcagaauggcaaggacuucagaccucuuggacgaacugcuuucucuugcacacccgcucugucccuccagggcuaaguguuagcuuuagaucacaguguucacaggaugggauuuuacaguccgcaucccauggcuuccuaagugaccccuuuagagacgauagccagacacggucuggcuucacuuauaaagguagggaggguccuaguggcuggaggggcccugaagcaggaagcccaauagccaaaacauaggaaccuuuucuaaaguggcugugcucacucaaaucuucccuuaguuccucaugccuaauccaucagcaaguccuuggaauagagugcaucuagagucugaccacaccauugacaccgcugcccuuucaauccaaaccguugcccggauuguuuuuaauuauaucccaaccgauccauuuuccuucuggcuucgauccugugcuugguggccaggcugagcaucuccccuucgcuucugcucagauuccuucagcaucccuacugugugaugcaggcugugcucccaauugugugcuggccccuaguucuccagucucuccucugcuucucuccuccucuuuccucugucuuccugcuauuucuucaaugggaggaggucuguccaucggacuuuguucuuuggcgaaugccuucccguuaaugucacagcaucauuauagaaugucaaccucccagaagaaccuuucuggacuguuuucuguagcugacacugcuagacuaguuuaugcaugacugcuuugccuugcuuggaagcauuugccucugcucucucucucucucucucucucucucucucucucucucucucucucucucucucucucucucucucuccuguuucuguuuuauuauugccuuccugaccaaaacaugagcaucaccggaacagggacuuguucaguucauccauguuucuccagugccugggagugcaaggcaggugcucacugaaugcuuguugagugaauaaaugaaugaaugaaugagugaaugaaugcuaggaccguugauaaauauuggcagaaaguuguauaccuaaaggaccuucucugaccuuacucaugggugaaucaaacauggcaaaguuuccaugccaagauggcuaauuguuuuuguuccaauucauggaaguaucuaaggacacacugcucaucaaaacaaugccacauauggcuguggaaaggcaaauccgcuuagaauucauuucuuuggguugucgugaccaaguccuuaaguugauggcuuaggacaucagaaacaugugucugagauucuggguagaagccaucuuugccucugcuuagcuucuaguggcccuggcacuccuugauacuccuugcuucuagcuuuuucacuccagccucugucucugaugccgcuuggcgucugccaucugcaucugucuuugugugggguuuuccuuucuuacaaagguauuggucaucuuggguuagugugcacacuaaugaccucaucuuguuuacaucucugugaccaaauaaggucacauucaaagguauuggggguuaagacagcagucagucucucucucucucucucucucucucucucucucguguauauucaaccaauaacauuuuaauauuuacucuugauggaggcaaaucacacacaauuuguauuguuaaauuucacauuuaauuggcuuggauguacuuaaagaacaauuuaaaaucugaaaccagauaccucugcucucuacugauccagcaaugacccuuggagccuuuugcuccugagggcagaagucuguucucaugagccucacacccccuuccucucccucucccuccuccuuucccucucccuuccucucccucucccucucucucucccuccccuuccccccucucucuuuccagcuuuugugcuugcacgauuccuucagcuacugagcuaccuacccuuaagagagaaauaaaaaccaaaaauguuccuugcaacuuguucuugauaacccauguauguaugcauagggccguuaccaugagcuauucuguccauugagugacccacucaggagacugcauuggaaaaucaggcaccaccugggucacccacugaccccauggaccuaagugggaagugacucaagcucaagggcagggcugaggcuccaggccagcuuuuucucuggcuggcagcgagagaucugcacaggggucauuaguguggauuguccuccauucucaccccaacuaaguccugaugcaagggcguacugccccuacauucugacauccugugucccuggacaacguguccuagacacagcccucacugaugcguuacgacuuccccuggucccaacuuguuuccuuuuugccucuguuuuuuuuuuuuccccacccuuuaucucauuucugguccugugaaccaggcugaaaggccaaaccacagccuuguaucuccacuuuccaggcaaacuucuuggcugguccugucugucuuucccagugacugucuucucucggccccuguuccuagauuggauuuugaaugcacacuccuuguucuguuuagauuuucaccucaucuugauacguuugggccccacccuugcaucucuaaccuacucuucagggcuuaauuagcuuugggccuguguccuguauacagugacuuuaaggaauugaaaaaaaaauuagcaaaacauuugucugcuguaaauagcucgaagcuaaggauaaaaaaggcaacaacaaaaccaacuccggccccagcguucauugagcacuuucuguccgccagcugucgcggucacgaaugcucauugaagcuuuacaaccaggacaguccuggucaaccuugcuuggcuucucucacacagguuuuggggagccauccauuguuuucacugacguucuggugaggaacccccacuucuccaguaagcccuucuggacugcagaggccuagaaggaauccaggcuuuaugaaugacuagaaauggagggugggaggggacccauaagcccagaagggaggggcagcugggcguagcaggcuuugaaucagcuugggcccaccucagagaccucugaugagucagucacuuucaaccaccaugcuccagggcuucuguccuuaguggcaggacucgguuggagagguuguugggggauuauuuguucuuccacugucaaccugggauucauuaacacaggacaucaagggaagaggguaagggacuuucuaaaggagcagcucagcccauucuuugaggucacuggcugcugguacccugggaggggccugcugucucuuauuucacauuuggcaaggcuuucuguuguggcuguaagucagaggcucauugggaaugcuaauuugagagugggugaauggaugaauggacaaacggauagacagggggaggguuuugaacaauaacgugggcugggcuguagaaauggcucaggaaggcaaaggugcuugccgccaagcccgacaggcugaguuugauccuuaagaccgccacgguagaaagagggaaccaacucucaggguguccucugucucacauguacuauggcacaugugcccguccauucuuucucauucucccucaaacaaaaccaauaaauguagaaaaaaagaacuugauuggacccaucccgcuuuuuauuguaacuaccucccuuuggauuuccucucuuucuagugagcauuggugguguuuauguccaggauugcucuuugcugccggucuccauggaaacuccccaaagaggggagucacugaaauaguccagguuggguucuucucagaacucuucugauccagcuguagugaagagggcucuguccaaccccaggggaacagcugugaggcuaaggucuggccagacugcccuugcagggaggauccuugggugacacagcugguuuugugggcucagaaccuggcagcuguggaaauaucagcuaccuuuccuccaguagaccuugcauuguugagaguuaacccacucaggugugcuggggacaggcuuggagccaauugccaucuugcuauuuacacacucagacucucucuuucucucucucucucucacacauucacacacacacacacacacucagacucacacucagacucacacacacucugucucucacacacacguucucacacucaugcacgcuuucauacacacuuucucucugucucucucuguugcucucucucucacacacaucacacauauccucucucucucucucaugcaaacacauacacauacauacaauacacauucucucucucucucucucucucucucacacacacacacacacaggagaauagagccaauaguuauucacgagcuugugguggugucucacuggucacauguagaauggaaaaaaagccuuugaagcaagacagcaagucagagcccagccucugagggacccuggagcuucuaaacggcgcuucaaggauuccacggccaauccaguguuuugaggagaugaaugauaucauauauuauccaaggcuccauuuacauauuauauguguaugguuaugucucuguagaucuaaaucuaaaucuagauauugaaauagaauccugcugcuugcaguguggucuaggauagcuccgauucaugacaguaaucuugcuguagcuaccugauugcuggaguuauaggugugcagcaccgagccugguucuauagguuuuauucuagaacucuguauacuguuuagaaaugagcuuguuugcagcaaaauaaaacaauuuagccccagaccuuccaguuggcgucagugcaucuuugggcugguuuaggcaggcagaucugaaggguccaccugaccuugccuugucuuccccugcucuccccaucuccucuuuucuuccuuuccuuauuuuauuuccaugcuggggaugaaacucagguccgcaagcaugcuaaacauucguuguacuacuaagcuauuuuaucagcucuuaaaauguaauuuuuaaaagaguaaaaguuacuauguucauauaaacauacagaaagaacauguaucaaagauucuaaucagcuuaaacagugugggaacugguaagguguuagaacuaguucaaagaggaauucaaagaagggcguuuuauaguuugacagucauauggaaauagauuggcuaauagauugacacaauaagcuuuaaccuuuggggcuuacauucucuaguagguggauauuguugacauuuuuguuggaugagaaucguauguguuuuucucauaaaaauagauuuacaacaucauuaucaucaucaucaauuuucuauguuaaucucuacuuguacaaaguuguuaagcauccuaaucaggucaagacacugaugcagacagauagucucugaccacggcggggcauuuucugagugugucccgcucagcuguugagauagcuagaauuuaguuauaauaaaauagauguuugacuagagggagaugagacguucuggagaugucaagaaaacacccuggcaauuaggauaauuuauuuggaaauagauuggcugguggcaaagccaaaaauaagaguuaugggcaaaggaagcccuucagaaagucgucugaggacugucaggcugugugaggaggaauggcucuaccugcuccugggugauaaagacuucccggaggcacaguaggcagagaggauuuaucugucugaggccggggacaccacgggggggggggggggacaccacuccaggagagaggcuuccacgaggcagcugccugagauucacuuccuggcugcuucucagcacuauuuugguccgcuuggcuguccuuguuccuccucccugcagucuucccccugccgcuugucaauguggggagucuucacuuuugaguggcauccugaagcauccucuuggcuuauugaauucuugcaaaaauccugagcgauaggucagccauuucauagagaggaggggagcugcucaagggugcaguauggagccuagaccuugcaucagagcgccucagaagugccacauucuuccagcccccauuagccuuccugaucucuaguucaguguccucagccuuccuaaugcugugacccuuuaauacaguuccuccugcuguggugaccuccccccaaccacaaaauuauuuuguugcuacuucauaacugacuuuacuacugugaugagucaucacaguaacaauuguacgacuguuauguaaauguuaugcuauguuuauuguaacaguaaauaucugguauguaggauaucugaugugugggcccccaaggggucaugaccccacagguugagagccaucacgcuaguucuuuugugugcauucaaugcuuaggcccucaagauagauguauuggaaagcuugacacgaguucagauagugggacauggcaauugagguuacccugcuuucauuaaagcccacaguauuuaggugucaaucuuacugcaucugagucccaggaccucuguaguagccguggcugcaguuagacaguuggagauggugcauggccuuuacgcugggccuuagcuuuucauucgcgcagugcagguauaaaaccagccacugauuaaagccuuucugucauuuacuauggggcccuugggucuucauuugcugauaaaggagugaguuucucccuacccacuuucuuuuuuguguaauagcccauguuugguaacuugcccaauggguaggguuagaguauguuuguguguaucacuugaguguuugggaaauuugggguagccggggcaggauggucacugcucugagcaaaucaggugcugauguccuugccucuuuguugcagaguccaacaucuguaccacacgaggcgugaacuccugccagcagugucuggcugugaguccugugugugccuggugcucagaugagguaaggagccuaugccuuauuugucaaugcaauaacacaacucugaccuuuaaaaggaauaugagguaguuuauccuggagccaaauguaaguggcuauggccaaggaacauagauucaaauacuggguuccaacgugauaagcacuauagugaacguuuuauaguaacagaacaaagaaggcaauaggucaagguacuuuagacacacauuggugaaccaucagaugaggugguuacagcagucaggagcgucugagguuaccucauaacaguccuagccugugggguugguggaagcuaggagucugcacauuuuagaaaggacuuuacuagucuuaagaauguuaagucaaaccuagaggugggcaauagguagcuauuuagggggauaauuuagccccaaacuauuuggugcccaaccuguagcauucaucugaucuuguugaauguucaacacagguguggcuccccacccccauccuaacuugccccagaugccuucuuucccuagauuuaggcgcuucaguguaggugcaggcacacagaaucauuuccuuccuccuaaacgcagucucuuuccccuucugagcaagacuaggugacgccuuccucaggaugcaugguggaagcuggcaaugauccuggagccuguucugcccuuccacuccagccauuuugcuugggcaucgucauuacugugauuauugcuacccuuccccagccuauacuugcuuugggcuggaacaucucauggaagaaaggcuuuacucucuaaagaagagaggcgcuagggguauagagggaugccagcucauccgacccccccccacccccagagcaaaacaaaaacaaaaaacccuaaaaacucagaagaggaauguuauguguguguuuguaugugucucugugugucuauauuucuguguauguuuauauguuuguguguauguguguguuugugaauguguguguuuguguguauguuugugucuuuauauguauguuugugugucuuuguguguguauguguguuuguguguguuugugugcauguauguguguguuuguauauauuuguauauguguguuuguguacacuuucuuaaagauccuuuuuucuucccuucucucugacagugacgccccucuaucuuccuuccuuccuucaucucuaaaguaucaauggaugagggagcacagcucaauggugaggaccagacgaugacaggaagggguuagcugugucuaggcagaggguguguugugucugagucccuagggaaugagugugucugagggaauggcuauguuuguggccgggcugggaauuuggagcuggcaagagcugauggggagguaggggaagccuguggcuggagagguucccagcaguuccagugggagugagucagcacccccagcaggugguuaccugagcugcuggccugucugcuccucagccacuagagcuacagccucugcccuauaccgcuccucaaccacccuagcuauuuccugaucuuugucugccucucuucuggauccucuggguuuccuaaaaaggcaagcuccuggucagacuggggaggaagggagcagaaggcuguguuuacccccuagaggaggggcugccagagccuccaaggccagcuccauacacagccuuggccucugcugcucagcacgggaacuguuucuaggggcagcugccuaacaucugggccagauugaucucauuuagcgaaugaaacauucucuggggcuugggggagggugagcccauuccuucuccacccccacaggugccccuccccucugggcuucacuggaggcucaaguguggcguggcugucuuccuucugguuugucauauccuccugccuccggucaccaucaugguugugucaagcuuccuuucugaggaaguuguaauucugcaacaauuccagaagaaggagugggaugccgagggugccguguuuggauaggauggcuugaaguuggacggccggagcagaggggagcagaaaggaggucccugaggaaggacuacugcuauucaagcauaguccccucucauucccgcaucuggaucuuauagggauaaaucagagcuggguucugaccagccaaagccccuccuuaggccacgugaacauauuccaugugacuagaugcaaauguggaauauuuaccaaucacuauggugaaucuuugcccucuggggcagacugggaggccagagggagggaaagaucagcuuguugaugggguggaguugggaaauggguagcaaccaggaccaaaggagaccaaagaagggagguaggaagcccgaugaaauagucccuucagaauggaauaaagugaaugccaauauuuaccaucgcuaagugagagggaggagggguggggcuggggagucugauguggggcagagugugucaagcagggaggaacccugggcuguaacuaguuaucuuuuuccugagggagcuggacuucucuugcacagggcaagcugaacuauugaaaguguuuggaucuugacuuuaaacauccaacgguggggcugggaucccugcucaucccucugccuccccugucuugacuguuucaaguggugcugauguuggcagugccucggaaaacaacugguugggcucggcuugugguccuuaaaggacagcagcuccuggguguguauagcaagcccuuggcuggguaagaggaaaacagagccaaguggaugaguggggugucuugggcccacccaccuaggguguguucuuggagagacagaggcauggguuagauaacauggacuggaguaauucgaucucucugaucagcacagcuagcagaggcaucagcuucucacagagcuagaaccuauauuuuuggcucaagugguaacauacuggauccuagaacuuucugaaaucauaagguaauuuaacaagcugggagugcuugucaaauauaaaggcucuggggauggacccugggccuauugcaacagaacagguugucaugguagcaagagggacaacauugcuacugguggaggcugggauuggacaggauggguagagguagaauugggcuugccagauaaauacagaacacccaauuccaguuggauuagauaguagauaauuuucaucuugguaggcauugcauauuuccuaaaguuggcaaucuuaagacaagaagaaaugcuaggaauugauacccaggauaccugagccagguuggaaggugggccagcucacaaacuugacaucuaagaaugaaagaggaagaagaacagguuuggguuagcaaguagaaggccccagcuggauuugcuuucugcucuguaucugcuggggauaggcucaggacacuauaauuacucugaguguguguguguguguguguguguguguguguguguguuuaucagggucucaugagcaugucugaagucucuuuauacuuauuuuuaaccuggagcauagaugucccccuugaguuuggccccaaacuuguuauuguuuaaaaaaaaaaaagaauaaaaauguauaguagggucuggcaaugcaacccaguuggagagccuguguuacaugcgugaaacccugagcucaacccagcaucgcauaaacugggcaugguggcaacaugccugcaguccugguccucaggagguagagguaagaggaucaaggucgagguagaaguucaaggcuggacuagggagauggcucaguggguaagcacuugccaugcacgcaagaggacuugaguucaaauucccagcauccugguaaaagcugggcuuggcccccguguuucugacugcaguguuggggagcagagacgaagagauccuaggagcuugcuggccagauguccuguccaaaauagucaacuucagauucacagagagaccuucuaucaaaaaauaaggugacuggggcacagcucuaaucccagcagcagugagacaaaaacaggcagaucuccgugaguuugaggucagccuggucugcguagggagcuagggcagccaggacuagaugcugagacccugccuuuaaaaaaaugaaagaaaaggaauaugucccucaucuucacaaccaacaaagcaugaaucuuaguaguuugaggcuagggagacagcucugucauagagccuagcgcauguaaauccacucccagggcuuccuccaaggagaagagcauacaguagcaguggccguuauaauggggacuggaggaaagcggcugguuuuacuuuuauuuacacuggacccccagaggguuugaguguguuugacucauacugagacuuuguguuuugaaaucaucucacagucuuauuuuagccccggcccaacccugugagacagauaucacagugaccauuauucaugcuguacuuuccuuaaagaggauuaagcgggggcugcuccuaauugcguguuucacugucccaggaaagggagguaauccaggagcggagccuggagccucccaccuccaugggugaucgcuucccccagggggcgggacuugacucauuccucuaacauccggguuuugaugggaacuagaacauucacaucaaccccuuuucuaguuuucucucucagugaccuggagauaucuguucucccaucugggcuuggggugggacuguggccaaggguguugaagauguugccuugguaucuuugggaucuuuccagagcuccaggcucucaggaagagcugggccauugagcaagccuguuagguuuuugacuuguaacgucaucgauuguaaagggagggagacagccuggucuuauuuuucaguguuuuuuuucccccccuaaggaaauuuauaggaaggguaaggacugucggcacgucugagcauucaacucucucuucuuaagacugagguuagaaaguggagugggggggggggggcggcggcuggagagauggcucagugguugggagcacugacugcucuuccagagguccugaguucaaaucccagcaaccgcaugguggcucacaaccauccuuaaugagaucugacgcccucuucugcagugcuugaagacagcuaguguacuuacauauaauaaauaaauaaauacauuaaaaaaaaggaaguggagcgaggagggccucucagaagcaguugcuccccuugcugagccugaagaucuggguggcuugcuauucuccucagaucccuggucuccccguccugguucccuccaucagccucugccuugcucuggaaagacucaggucugcuggccuccuggugacuuaaucacagccuuuuugggaggugugugggcaguuggggccagagauaagagucauggugacgaugguggugaagaugauguguguguguacaugugugaaugcauguauguauacuuuuguguauauguacaugcgugugcuuuagaaggaagagauggcuuccugagacuguaugguuuagaaggaugagagacaggcacagacagagauggguggcugaucacaaggcuuggucuguccagccguuaguucuucccagcgcuuuucuguuaggugucaggauagagguuuucucucaucgucaggcauggccuguggugucuuuuaugggacauuugucaccaagaagguuaagucuuauuccccuugugggggcuacuccucugccucauaucugaaagcugagagagaagaaagguacaggccagagccccuuucucuuucuguuugggucagguugagguguaugcguuugcguguguguguguguguguauguguguguguuugugugugugucuguaaggguggaguguguaugugguguguguguguaaaaugaugcaguguguauguauguguaugaggggugagugugcaugugugauagagugugguucguguguauguguguaugugcaugugugugaggguguaguaugugugugggggugaggaugagguguguguauguguguguauaguguguauaauguguguauguguguguguagugaguguguguguguguaguauguaugggugagaaugaggugugaguguguauguguauguguaguguguagugaguguguauguguguguagugaguauguauguguguguaguguguagugaguguguauguguguagugagaguguauguguguggagaguguauguauguguguaguguguaugggugaggaugaggugugagugcugcacuguaucacuacacacacaggccuuugugacugaucucucugcagguguccugguggccagguuaugcacaacugaacaggaaggacuuacccaucuuucccgaucuucucacagccuuaucuugcaucccagucucugaaugccuggggcauucucugcuguggcuccuccgggcacccuuccucccauucuuaacuagaaaguugaguuccucauuugugaagacccucccuagagguucuucaccugugaaaugauaaguaguaauuccagcauuaccaagcugugagcauugcagugacuuuccugaagugcuugucccaugcuguaugcagugagggcucaguaaauguuaauaguuguucuugaauauaugcauauacauauugaugauggcuuuugaauggugguaguuaggagagucugaagaccuagaaacaggggcagguaggggugugccagcuuucaggucagucccccaaccuggcaugugacggcuggacaugagcucacgcagugcugguuaaauaugccuagugucaggguacgauggaacugaaaacauccuguuguuaaccccacuuaucaaacaaaucaggaaacuaaggcucagagugacuucuguggugucacguggcuagcuagugaugaccuagaucugaggccuguuuccugauuucaguguccuuccaagaacauuucauucuugcaugugacacacagacccagacccugaggcugaggugauacauacgugucagugugguuuuuuuuuuuuuguccagugugaaggaggaagcugagagagcugccagcaccuguccucuggcacuuuuccucagcuuguggaguuuauuccuagguagauuauucaggaacuacucaacggagcaugcugacagcugacuccugcugagugccuucugcuugccugguguuauuuagccuggcauggcauuccuacgaugagagguucuucuuauuaaauagcuaauuccuucuaaaguauuuuuuuuuuuauugugguagaauacauauaacagaacuuaccaucuugaccuuucugugugcgugugguuguguguauguguggagaucuauuuugugugucuuccuuucucucuaccuuauuucuugagacucagggucucucacugaaccuggagcucaucaagauggcuaacgucgcuggucagcaagucccagggcuccuccugccucugccucccuagcucuggguuugcaggcaugugucaccauacccaggucucucuuugugugugagugugugugugugugagugugugugugugugugugugagugugaguguguguguguguguguguguguguguguguguguguguguguguuuaacacgggugcuggggauugagcucagguuucauucuugugcugcaaacacuuuccugacuggacaucuccccagccccuuccuacccauuccuuuccaccguaaccaccuuaaguguccaggugaguggcguugucuauguauaaugugaagcccucacugucaucuguccccauaacugaauuucauuaugcaaaauuagagcuuugggcucauuaaacaacucuuccuccuccuccuccuuuuccucagccccuggcagccacaaucucccuuugcgucucuaugguuuugauugcugucuguagccaagggugacuuuuccccuucaugauacagcugaaggaagugagcugugugucaugcucugguacccagucaguggugacaaugccuggagggggugggggugucagucucagccagucucagccagcucauucuugggcucuuauucuuuacccuccaccauaucugcucugucaucuuugucuuggauaaagaagggaggcaggaaacacacaaucauggaccuuauaaaacaggcagcauguaacacagcauugauaaaugguuuuaaccuugacccacagaaagaaauaccucauggacuauuacucauuauaggugccaucuuccaguaaauaaaagauuccccaaauaaugaaacuuuuauuuauauacuuggauauuuucuauucuauuuaauuauguuuuacuuaguaaacuugauuuugagacucacaaaguaaucauauuuuacaauuuggaaaauacuuguuuagcaggcuucuuacuuaauggucccucuucucuguugucaauccaugaacagacacuaagucagucuauucucccuuccugugcgugccccugaggauuaaccauggaaggaccaugacaauucuuuuaugcuagauuagcuccaaagagccagagaagcucuuggccagggggaggugacuuaccaggcaggaggcacagccgcccuagcucugauguugaccuuucccucgggcucuucucuucauagacuuugucucagggcucaccccgauguaaccugaaggagaaccugcugaaggacaauugugcuccagagucuauugaguucccagucagugaggcccagauccuggaggcuaggccacucagcagcaagggcucuggaagcagcgcccagaucacucaagucagcccucagaggauugcccuucgacuacggccaggugagcgugggugucggugugggugugggaucaucuuggggagagaccugaaaccagugggcacaggacaucaacuguugaaggucugagcgggaacuccucccgggaggggcagcacaggauaggacugggguggaaagagaaggggauggggagugggggugugugggcaggagaauggaagacaaugaaaggggucaggauugcagucagaaaaucugaguaugaacccccacccuacaacacugcuccuuguggcucugcuucccccugaugugugcuaucuaguugauagcucugauggaggaccagauaagcagaaggaugagaaaggaaguuguaagccucuuucccucagggcacaggaacugugugggagcaggcaaaguagggacagaaaagggaaugcuauuaggcuaaggggagcuuuuuggaguaucuagacuugacuugacugaaucaauaagagcuugagagagauccacucuaugcaaagaguccuuugggauguggagagaacacggugcuauuuacuuuagagacauuaccucuggucagucaggaacucauauguagccuaggcuagccuugacuuugcaguagucucucugcuucugacucgugcaugcugggaugacaggcacgcaccacuauauccagcauagugccugugcuuuacagcgucugaacugaagcaacugacaguuguaugacuuagaguauagacccuggggacccagagggucccacacauggggauuuagagauggugggaaaucauagaguggaaaagaagagguucaagaugcugcaagagggcaggagguguggaguguguguguguguguguguguguguguguguguguguguguguguguguaugugguggggagaggggaggccaccaacacuuucaagcauaauuugaucaagcaguuauuaacccuccauggaggccugcucguguauuugauccuagaagaagaggaggcaggaaaaaaacccuaacacccuucugccuuccagaugauucgaagaucuucucacuucaagugcggcagguggaggauuaccccguggacaucuacuacuugauggaccugucuuucuccaugaaggaugaucuguccagcauccagacccuggguaccaaguuggccucucagaugcgcaagcuuacuagcaaccuucggauuggcuuuggggccuucguggacaagccuguaucgccguacauguacaucuccccaccacaggcaaucaaaaaccccuguuacaaguaaggacuuucuccacaagccagugaaacaccucccccuugaucaaaggcugguccaaguccuggcucccaguuuuagcuccaggauuuuccuuuacaaguuuauguuuuuaauuucuauuucuaugcguguguuugggccuguucgcaugcaugugugccaggugaccguggaggccagaagagggugucagaucccuugggacagggguugcagguggaugugagaugggaaccaaauucuguuguucuucugggaagagcaucaagugcuuuuaccauugagccaccucucuagcaucuuucaggucauuuuguugacugcuuuaugcaagagccauagcauuugcaacuuguucccugccugggagaugggccuacuaucuggaguauugugucaauagggcucauagcugccaggggucuucuacagaagugccaccagcuuuucggcuuugucacaaaugagcagaugugagggggaggggcaagcucaaaagcagagagaagucuagaagaauaagaauguaauugugauuccagaggaauuaguucuguggucccuauuauagucaccaagggcacaaauuauacaaaguuagagugcaagaaaauuaaaucacuuuauugaacucuuuaacaguauauaaauggcuacauucucuuuauccaccuccuuuauagaaauacauuuuuuagaaaauuuauuguuuuauguguaucaguguugccugcaugcuugcuuguguaccaugugugugccuggugcugccagaggccagaagaagguauugaaugcccuggaacuggaguuauagauggcugugagccaccaggugguugcugaaauuuaaccuggguccuagguccccuggaagaucacccauccauccaucucucuagccccucaccucuuuuuuuuuuuuuuuuuuuuuuuugagacagacagagaauuuugcucuguagccuaggcuggccucacccucccacgugcuguuuacagacagaagccaacccacugggccaucucuccagcccuaguaaugauaguuuuagaucacuacucuacauagauuuacacucuucaacaaguaagccauucaauaguaaacugcaauggguugaaugugaagugggccccacaggcucacacgucugaacacuugguccccaggagguucuggggucaaaggagcucuaggaauuguacauagggucuuauguuugcugggcgagugcucuaccucugaacugcgccuccagcccugggccucuguuggcuuauguuuaguuacuuucccugcugcuaugaucaaacacuugguagaagcaacuuaagagaggaaagguauauauuggcucacgucuccgagucuguauucuaucaugacagguaaggcauggaguguguaaaguggcuuggucugugguggcaggaaccuguggcagcugcuugcuacacaccaccagggcugaacagagagcugaccuggaacaauccauccuugcacauauaacccuauguaugccagcgaggaucugugcuaaagguuuuauagccucccucaaacugugccgccccuggggaccaaguguccagacgcgugagccuguggcauccaucucacauucaaaccauagcaguuuacuagugaaugguuuacuugacaaagacuguaaaucuauguacaguagugauuuaaaacuaugauuacuacugcuggagagauggcacagugguuaaggaugccucccauucuuccagaggauccaacagaguccaguuccaguacccaggucagacgguucuuuguuguuguuguuguuuguuuguuuguuuguuuguuuuugagacaggguuucuccguguagcccuggcugauccuggaacucacucuguagaccaggcuggccucgaacucagaaauccaccugccucugccuaccaagugcugggauuaaaggcgugcaucaccacugcccagcuggucagacaguucuugagccaagccucuagcuccaacucuaggggaucuaaugcugccuucuggccuccgugggcaccugcauacacccacucucucugucucugcucucuuuuuucucuccccuccacaauuaaaaauaaaguauauuaaaaugaugauuucuaggcugacaaagcauaacuuuacuucuuaacuuuauaaaaaaauucugugggacaguucuaaacuucugccugggcuccauguucccccagaaaagacaucaguuagucggggagagcagagcaugaucuguaaauuuacuggcuaucugcuugauuguugcaguaaaacaguguuaaugauaacagccaugauagcuugagcccaacucuuguagaaccgcuuuauuuggucccacgacagcucucaggggagaagcacuaugauggcucacuauagauccugccacugggcuacaccuccagcucugacuucgauuagcuuauguauuaauugcauaucuuguugcugugaccaaacccuugauggaauacagguucagagagucuaacggagagcccaugcuugguaaauggggauccagaguuuaaucuuccugucuggcuuaauggcuuccuuucuugcccuuuuggcuaucuggggguaugguuaugaugccacagguagcuugaagggcuuuggagucuagauugucucaguaguugugauuccgugaggcaucugagugagcugugugguagagcguuuaucugguaugcaugagacuuuggguucaauccuuagcaccaacaugcacuuguguaugcacacacacagagacagacacagagauucacagacacacucacacagacacacacacacagacacacacagaggcacagagacacacagauacagguacacacacagagacacacagagacucagagacacacagacacacauacagagacacagacacacagagagagacacacacacacacacacacacacacagacacagagauucauagacacagagagacacacagacacagacacagacagacacacacagagacacacagacacagguacacacagagauacacagacacacagagacucagagacacacagauacacacagacacacauucagagacacagagacacacacacccacagacacagagaaagacacacacacacacacacagagacagagacagagacacagaaacagagacacacacagagacacacagaaacacacacacacacacagaaugagagaaugagaacuaauaugauacggccuggccuagguaugccacuggccauaucugucccucucucuuuuccugacccccguauugcccuuccaucauggcuucugcuaagaugaccucucgucucccuccaguaugaagaaugccugcuugcccauguuuggcuacaaacacgugcugacgcuaaccgaccaggugucccgcuucaaugaagaagugaagaaacagagcgugucccguaaucgagaugccccagagggcggcuuugacgccaucaugcaggcuacaguaugugaugugaguucgaaaggcaagggcugccagguggagcuggcacaaaugaaaauggggaaggaaacaguucacuuggggguuuccaguaugaugggggaugggaaccacacgggacuuugcacaguauguguaguaagucugucuuuauauccaugccgaggccacagcaaacaccgcuuuaaaccacaguagcuccagaucucucugagggagaacaucuucccacaguuucuggaacuauuucagagucaagccugggucaacuugaccucaacaaagugggcagauguuagggugggauuucuucugguugaggccagcucuguggaugcagaugggucccggucacuggaggaguuauguguggaguugaaggaggccugcuuuagcaucaugaacuaaucaaugaugugauggcucccuuaugggccagauugggaagcucuaguuuaugcuccaaggcuuggggcugaggucggucuccaggacaacuuguccagcuuuucaagcuaugccgguucuggggucuuaguuuuguauugacgacauagcugaaguugugguguuuuuuauuuauuuauuuauuuuauuuauuuacuuauuuuaaacaggaaaaaauuggcuggaggaaugacgcaucccauuugcuaguguuuaccacggaugccaagacccauauugcccuggauggaaggcuggcaggcauuguccugcccaaugaugggcacugucacauuggcaccgacaaccacuacucugccuccacuaccauggugagaugccuggccccuaccgugguccguguucacucugguagggcaagagcuuuugugugaaacuggaaacagcuuuuccugugggcaucauauggggcuuagccgaugcuugucucugcacaucccacagggacucacucauccagggucuauagacacugaccaugccuguggucagugugcacacugagucuaccgucauuagcaccagccucuuggcauccagaauggacccacgccaugugccaggcacagcuggaaagcucauguuuucccuuccucugugaauggccccuucguggaaucaugcucucacuuguaguuagggaggaaaaaaaggggaggggaaaggacaaagguuucauugaugaaauaaaaaaaaccccagagagcagagucuguugaggaaagguuaaagggcacagagucaucugguuugaaggaaagaugguccauggauaauuuaggaagauauauaagaaaacuucugaaaaguuauuuuauguguuuuaguuaaccauaguuaauuaaauaagaagaaaggagcuuaacuugaaauagaagaaauugcugugagccaugagacaauguuuaauauauaguagcacuuuggguauugggaaggaagucuugauguuuuuuuuuuccugucuugucccccccgccccccccagcuaugcauucugggcuggcuggaaggcccuuugccucguagaugugaggguacagcaaugugccgcuaugucugccuuguuuguuuuuguuguuguugguuuuuuuuguuuguuuguuuuuuugagaaagggucucucucauucuauaugcagcccaggcuggccuuuaccuugcaauccuucugccucugccuucugaguguugcgauuaggagucugagcuaccaugccuguuauuuuuuuuucuggucuggaggcugaacccaguaucuuacaguauguuagauauuaccuaacuaccaagccacuccagccuacucuguuuuuuaaagucaauaaauagaggaaccaccuguaaaugaucaaaggcaggacacuugacuggagaucucaugagcucccucacaaggucuagguuuccacggacauagucaugacucguacuguuuccuggucucuccacuuccuugguauuaaccacauccaagcugagcaaugucagacaauggguaagucagcaaacuuugacacuagucuacccagagcacugagcuggagcugugagagaugaaacagcuauaaggaccuaccuacucuuaggagguuuagaugaagagagaggauuuaucccuacacaguauuaauagcauggaacucaugauguacacuaauugggugggugacacagucaagggcuauuggcaguugaaggaggaaagcucuuagaagcugggguggucaaggagggcuuccuggaggaggugagcuuaggcuaaggaaggaggaggauuaccaagaugacagguaacaggagaaaugagccaggucagugcugaggagaagaggcaggcguaggggugagugacauuuggacagugaggcugagaucauguggcaggugaccaguagagcgagguuagggcauuugcccguaauuccacaacaguggggcccagcccauggagauguuuugagccugagcgggaaggaaggugcuugguuuuggagccaccagcccaggguucauagccgagcuucugggacuuuuuacccuuucacucaggcacugcgccauuuucuguugcuaaugauacaauagcacagacacaguaaguuggaaaagagcuuucguuuuguuuuuagaacuugugaauuugagggacagcaucuggugaugaucacggcuggcugagucccaagacucaggcgguccugaggcaggaggucagggagcaugcgugaguccggaggacagggagcaugcguguggguuucugucuucauugguuuucuuuuguuaagcuagugagauucaacucuggggccuucuaauucuccuuacuucccaaagacuuuacccuaaauaccuuagcgguguguguguguguguguguguguguguguguguccacugucucagcaucucacagggggaaaucaguuucagcucacgaaaccugagggguuugcugaagccacacccaaaccauaacacucacuuugauuaguggguaaaaucaaaguuucacauugcuuuggucauaccccaaauaagacagccucaaaggcguagaauccagggaugccugugagacgugucuauuaaccuucaccuuuuccccguuuucaggacuacccaucucuggggcugaugacugagaaacuaucccagaaaaacauuaacuugaucuuugcagugacugaaaaugucgucagccuuuaccagguaauuagggcucugggcuucucucuugucaccauaggugggaccugaccccgguggccagcuccugcuuucacuagccagggacccaaccaggaaaaaaauccuuuuaaacucauucuccaggcugcuuacauuccucccuguagccuuuucccuucaaccucucaccuauaaggaaaccuguggugguuugcaauggcggcggaggugacucaguggggggagggguagaaaaagguuuuuguuuuuuaaauaauguuucuuagauaugaaaauaugcuagaucuguuuugguaguaacaaguaagauacuucacagugcccuccaaacuuaauuuuaagacugccaguugggcgguaguggugcaugucauuaaucccagcacuugggaggcagaggcagaggcagaggcaggcagaucucuugaguuugaggcuuccuggucuacagagcaaguuccaggacagccaggguugcacagugcaaccuugucucccaaaaacaaagaaagaaagaaacaaacaaacaaccgcugccagucugacgaaggaggaccugaggaggagaccacuuucuucaggacgcuguggacaucuuugucuuccuuucuagaauuauagugagcucauuccugggaccacagugggaguccugucugaugacucaagcaacguccuccagcucauuguugaugcuuacgggguaagaaugcuggcccaggaggcccuggugcgucugcuggacgaagcuuacucaucagcgcuuuuuaaaaaaagaaguacaagagggauguuguggucuacggcagaaaacagacacauaaauuuccuucaggaaggaaauuauaucaaaaagccgugcuuggaccugugggugggagaauauuagauacaaacaauauaauagggggacugaacauaauaggaccuuaaaggugacaagaggcuucccuguagagccugaagaggagcuucauuaagagagugagagguucagagaaggagagagagagagagaaaggagagagagagagaaagagagagagagaggaagacagagauacaggacaaacuuccaugauagcagugggaggggaggcccaaggagccucuccaaugagcaaccuuuaucuccaaacccaaucuucuugcugagucuaagaccaaucccuagaacaaagggaggcuccagcucuguauacgcuuuaggaguggcgggaaguuuccaaucauaugguuugguugaacaucacacacagagaagccaggagguacuauauacauugagaacagucaagucagagcacaaauugucuuggaacucucugucccaaagacagcugcagggacucaggcuguggggucacuccuaaaggugcaggcccauguucuaacagagcucggauuugggagccaucugccauucuccuguauggucuuacugcguuuccuuuaugcucccagagguagaugguggccagccuugggaguaaugaauggcaccuucagaaaugggccagaaaggaaggccagggaggaacaggaacggcauguggggagcuuagaggaggaggaggcugcaaauggggauucgaugcccaagaaugcagcuguagggcagagugagggaaagccaggucucagccacauacaaaagaggugaccgagcauagagccuccauggcagcaacugccagguaaaccucagggcaaguccaaggccacuggcuuggcuuuguguggauggacuuggcuuuugucagugcccuaaccuuccuuuacccucuucugcucagaaaauccgcucuaaaguggagcuggaaguacgugaccugccggaagaacugucacuguccuucaaugccaccugccucaacaacgagguuaucccgggccucaagucuugugugggccucaagauuggagacacggugaggugggcuaggggagggacugaugcugagacucugaccaugggccccgagaucugugugcauccugacccuuuccagaauuagguguuaggguaguaggguugucaaucuuugcccgugaagcuucggaugcuuaagguuucuagagcugccaaggaaaccuauuauuuauuuuuucuuaaaaugucuauuuugguuuucuguguuugcacgucugauugaaagugaaaauaucucuuaaccuaucucaucacccaggguaaugcuuuucuuuucucugccacauaaaaugggggcaguauagcaucuguggacucuugcugagcacuggcuguaccagguuuuauucuggcugaugaaaauccaucagcaaguggaacaggcaaaaguuccugcccuguugagacuuaagaguguaaauauucaucuugccccuccaccccccccccacagcuuucuugauuauuacuggguuuuuuuuuaauguguacgguuauuuugccugcacguauauuuguguaucacacauguggcugguacccgaugaggcuagaauuaagugucagauuccuuugaaauagaguuacagaugguugcgaucagcuguguggauuuuaacccaggucaucuuguuaagaacagccagugcucuuaaccucugagccaucucuccaguuccccugguuuucuuugcccguucuccucuccucuaccugguccaugggagagaggaaugaaaggaaauagaucuucugguccaguucccuauaaguuuauauucuaaacucacguguucacaccacacacaccgcacccugcaauaaaaugcuauacagcaaucucucaguuugcuauugaccauuguauagcaugguguggugcaaagcaacauuuugugugccuugcuguuauuauguaacaauacuacuuaacuccagcuagcauaguuggccaaagaaaguauuccccaaaucacagguucuguccugcuugaguugguuuauuucucaggacaaaaccaguccucuauugcgugucuguaacuguccagugagauaugccacagugguauuauugcuguguuacgccaguguagcuuuuacucuauagacucaauagaauuaaggcugaggaauuccccugggcauguggauuugacagucaauuaauuuuguuguccuuggaagguuacagcauagcauuuccucuggggcugguguuacacuuaggucugaaugucaucuuuccauucaggugagcuuuaguaucgaggccaaggugcguggcugcccccaggagaaggagcagucuuucacuaucaagccugugggcuuuaaggacagccucaccguccaggugaccuucgacugugacugugccugccaggccuuugcccagccuuccagcccacgcugcaacaaugggaacgggacuuuugaguguggggugugccgcugugaccagggcuggcugggguccaugugugagugcucugaggaggauuaccgacccucucagcaggaagagugcagccccaaggagggccagcccaucugcagccagcggggagagugccucuguggccagugugucugccauagcagcgacuucggcaagaucacuggcaaguacugugagugcgaugacuucuccugcguccgcuacaaaggggagauguguuccggugaguucaggcgucuaucugcuugcucaagagccaugugugcaugcguacccauagugccuugggagcaaguggagggcgugggguuggcaaggcgggcagaacugaggguccacugaauagaaaaacagaaaugagccggggacgggagcaguccuuuucccuuuguuccuguaagcuggaacaaguaggcagagucgagaaacaccaaggggaaguaguuuaucuugcuuuucugucuucaucucucucugauaauguugcaaguuccuaguuuuuuugaacuugaggaccaacaucuuugucaucuaaaaaauaucagucucgugguaguuuacagauggaugauguuggaaauauauuguaaaacuaaugauaacuuuacuugaauuuauuuugcuaucuccagggacuuaggaaguagugguauauaugcaagccauuggagguacuuagaacaguccuugaaaacgguaugcucauguuaaacauuaccccuguuuaucaucugucuguuauuauuuguauucugucucugugcuguccaagaugguagccaccagccacaugugucuauuuaaauuaguuaagauagaaaacaugaguucagcuuuccacugggccacauguggcuaucauacuggaccauguggguacugaacauuuugacauagcagaaaguuccacaggaugguguggccauaggaauuaccuaccugcagaugaaaaguguguguguguguguguguaugggugugugugcgugcauccaugugcacaagugugcaugugugcacgagugugcacaugcguauguguugcaugugugugaaugcacauguguguauauggcuauacagacuagaggugaccauugugugucuucuucaguuacucucuaccuuacuuuuugagacagggucucccauugaccccggagcucaccaguuggcuaggcugguuggucaguaagcuccagagauccagcuguuucugcuuugaaguguugagauuacagcauauagauuugugccacugagccuggcuuuaguuuuuaaaaccugaugcuggagaucugaacucagguccucauguuuguaacacaagcugucucuccagccuggagaugagaauuuugagcccuucaaccugcaggauucugaguugucccuacugugaaauucagugcaguccugaggccuauugguaacuucaaacuggccccugagaccauuuggauguguuuccgacaaagaggagccaaaaucauggucaauauggccuuuaucugaauacucuaagggcaaauggacagccugaguuaucuucuuaggcucuggagguagguuuauguuggaguguagcuccucuuugggacagacaggcugcaggcauuugcugguugcguuggcuggacugauucauguacaggaugcugugugaucaacagaacagagucuguuuaacuguuuucuguggugaucuaagacccagguggacuucauuugcauugagguucagccaauugagcugagcgacucaggugcucacguuaacacgguggcacaugccuguaagcccagcauuacagacugucaugaggagguccaggucauccuuagcuacaucguaaguuugaggcuugucaacacccaaccacuaccaccaccaccaccaagcucaauaagaaagauaaauaugccauguaaaaacaggucccaggggaccugagagacuacucagugguuaagagcguguacuauuuuuguugauguaccucacaaacaccuguaacucuggcccuagagacucgaacaccucugaccucuaaggcaccuguacucaacguacacgccgucaccauacacaucauuuaaaaacaaucuuuaaauuuaaaacaugccccauaaacauaaaggugauaccuuugcugaucuguaacaucguucacuucagugagggaaagagauaucacuauuaaauuagugauaaaauuauuaaaugauuaauaauaauaguugauauuauuaaauuauuauaucauuauuagauuagcuaaauuaguggcaagagaucaggaccccagugaugaaaacuggcgcaugauagcaguuugaacuagggugagaggcagggguuucagcucauuuuaauauuuaccaguauuucaguuaugcuguucuaccaagggcgcacccaaaggagcaagcugggagugcuggaugaggucggccuaggcaaggccuacaggagagccucagggccccuucaccucuucugggaugauugguucaggguguggucugggggaggggucccagccagccacccacuccacagagccuuggcaauucccaccuccugaagugucgaaaugucugguccugugugcuccacuccauucccccugcggggagggaggacuccuuuggaugccacacccauuuuacugcuccucaccagggugucuggugcccauugagccucaucuuguccuugugacacuguuaucacauccuuagggacacauguucauggagugcacagcacaugugauuccugaccucucagagccaauguccugcacaucaguguucuuugaugccugccuuggggucaucacggggcaggaguguuagcugugacuuggcuccuuccuagccuguggccucuaagcaugcagguggcugccuggucacccccccccccgcaucccucccccccuccccugcgcuucaggcuuggucuuugagguugcuuguagcucuuaccugucuccccucuaccucagacagcaugcuuccucccaggcucuuucccgccugcugcacacagaugggcuuccucugugggcugggccuuaugcuguagccacaugggaggaacagguaucaacagacaauuuuacuguuuauuaauauaccaaagugucugucucaucaggagucacaaccugcuagaacccagaagugaguuguccgcagagucccuagagagagugaaucaugggugggggacucgugggcagucucauggagguaaugucugauggaucuccaaggaaggcugguucucacaggaaaggaguggaauuguaagucagucuggaagucuggcuuuucagggagaguaaccauguucccucugacugaaaccccucuuccucuucucccacucuuucauuuuuuugcucccuccucuggcuuuccuaugaacccagccuaggccucccccacccacccuuuggcuggagagguaccaacacugugacauuacuagacugugguuuccuuuuaagggcugacucugccagggccuggggucagccuacuggcuccggcuacccucuuccauuuccacucucuggcuggcccagcagauccucuugucaaagaucacuuuguuuugccucacaaaggaaacacugugggauucagguucugcggagggcuguggcuucuucugcguccugccaggccucuguggcauccuccuuucuccauccaggaaccuggcuaaaagcaagcguaguggacaagguggagcaccuacccucuggcauccccaggcccagcugcugcucgggaggguugucugauuagagcucacagcugcucuuucuuuggagcugacaggauccgccuugcguucagaaguugaccaguggaggaagguugugcaagggcaguuccgcuuccucagagugggcccugcucuguggugccacccaugcuuccaaacucaccaugggcucaggcuggaaggaguuucuauccuagaccacauaccugcugugugugugugugucucugugugugugugugucugugugugucucugugugugugugucuguguguguguguguguauguauuagcauccauguguggacaucagaggauuauucugccauuccucaggaagugucuaccuugcuuauugucucagggucucuugcuaggaccuaguuugugagcaagccccaggcaucugccugucuuugccuuccugguguuggauuuacaaauacaagccagcauacccggcuuuuuuuuuuuuuuuuuuccaaauggguucuggggauagaacucagauuuucuugaccauggcaagcccuuuacugauggaucuauuucuuaagccucaauggcuuuuauauccuuuagagagcccagucucaagacuuaaaaguauuucugguucccagcuuuucugccagccccaacuuuauuucugugggcggcuugcuucuggucucaccuuuuuuuuuuuuuuuucuuccuuaaacaaaacaaaacagauuucuaauuaauuaaugucuuucaagacaggguuucuuuguauagucuuggcuguccuggaacuagaucuauagaucauguuggccacagaaauucacaugccucugucuccugagugcugggauuaaaaggcaugugccaccaccaccuggcuauuuuuuauguugcuaaaaugauuucuuuauuuuuaguuuuaugcucauugguguuugccugcauguauaucugugugagaggauugaaucacuuggagcuggagcuacagacaauugugagcugcuggggauugaacccgggucuucagaagagcagccaguguucuuaaccacugagccaucucuccagcccccuuuauguauacagguguucugugugccugcgugucuuuacaucaugugcaugcaguaccuguggcggccagaagagggcacugcauuucccuaggaauggaguuacagacaguugcuagccacccuguagggugagggacuccaacucuagccuucuagaagagcaaucagugcuguuaacugcugagucaucucuucagcccuaauguauagccuaggcuggccuugugaucuuccuuccucugucucuuuagcauauacugugggccccccuacaaccagucuguucuaagaaacauguauuucuuucuaagggaguacuguagcugaguuguauuuacguguuugagucuugaacgaugauguaucuaugagagggcagugcaggacuacaaguguaggggcccauagugcccaaaaagacaguggguuuaucgagagcagcgggugugaucuuguuaccaucagaguauggccguguaccacccucccuccccuucuuggagugacugaugugauuuucagaccacuaucugcuccuuaucuuucuuccaauuaacagucauauuuuguuuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacuccgucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacauaucagugaauacauauugugugaguuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagauuugaaguuuuuaucauacagaucuuucaccuccuuaguuagagucacgccaagauauuuuauauuauuuguggcuacugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuuuguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaauguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauguggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaaaucugguguaauucugauaggccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcucaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuugcgggugucaggcgacucagcuggcaagguagccggggcuugaguggaguggaagggguuugugccccagaucaagcccggguagccugcuucccuauguaccgcagucucaaguuccacgcgauuggauugggguaggcgcuguguuccacucaccagaggucuuagggucccguggggagucccgugugggcccuugcggguguugggcaagacucugcugucaagguagcccggggcucgagucuccagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucuccaacagucauauuuugaauagcuguccaguucuuccugaugcagcgcucuagagaacgggccacucuuuguaggguuuaguggccgacuuuuaaaguccuguuaaaugacuacaagagcaauccagcauugugagguaaaaccugccuucaauuggccugccuucccaugccagucucccucccaguccuacacucggggaaaugauuggacccuucacagcagggcuggcagcucauugcacuacuguaauacuacagcccagggcacaguugcuguauguauguguauuuuccauggauugagauugcaagcucccuuguagcacggaucuugucuggcacgcucacugcugagucucugguauccaguaugugguacgaggucaguaaauggguguugaguacgugggugacugaaggaacacuaacugucugccuacuccauaaaagauuucaugguaauccccacuaaugauaaagcuaacgugauaagccuaucgccuaccaagaagcucagagaaacccacaauaaagcaaauggccauagaguaaggguggauguacagcagccauaguguuccaggguggggguggggggcaccugagaaggcaguuggcgccaccugaacaggucacaaaaaguuagugagaggaaggaacacuugaguugggccuuaagggugaaucgggacuuggaagugaucgcaggguuaaagggagaucuagauagaaagaacaguaugaauagaaacaggcgcccaugaaacugcagaaggcugagcccuguccagacugggcccugacucugcuggccccacggccaguuacacaaccuuucugacacuacuggguuguaagagaggguaaggacauacagaguauggcauguaggcguccaugcacuucacugucacugcugagagcaacugauggcacaggugccagugggaagauuaaacuucccugguuuuagaaaguaacauaagucucuucucuaaacgccacccccccccaagcugcccuacugugcucucauagggugacauggggccacaggacguguuagcuacauagggugacaggacguguuaauuaucucugucgcugcuacaaaguaccugagaggaaugaagguggaaagauuuguucuggcccacgguuucagaagguccagaccaugcuugcuuggucccaaacgcuuaggguggggcagcauaacagcaggcacaugagguagaagacaguggcuggcuucauggccagcuggaagcagagagagcaagccaggagucguucagggagauaucuacuguacccugcaaggacccaccccugccccccgcaguaacucauucaucuagcuaggccucgcugcuccuuuacagaaucucucaaaauagcaucaccgacuaaaaguacaagcagacgagggguguacaagaagaaggcaggcuguaucguugagacuggaugcugccgaaccguguuggcaacuucagaaaugaaucgucaauguuucuaaagcuuugcggugcaggugcaggaagaguugaucagcagaaguuuguuggaggucuuugggcucugugaggugugguggaggcuuuugaacugugugggguuauggcuaaccagauuucugcuguuuuccucuggacacucucucuccucuucuuacccggcuuuucuccuuuucucuauggcauucacgggauuuauuuagcaguguuggcccuccgcggcuguaagguaggcuauauuuguuccuugugcuuccuuggccuguugguugauuccacaggcucucagugccuuuugucuggcccuuggguacccuaccccaucuaccuguauacacagggcacgaggcuguaccauucucucaucucguuccaguacacuuuaccaucucgugcacucucccucagagccuugcuucuuaccuugcaaggugacaauuagcugguuugagaaacacaguaaugggccuugguggcugguccauuauuuuguuggugggaagggcuaacuaguucaagucagagcccuuguugaugucugaccuaacagggagaagauaaugguagugaugguuggccuuucuugucauguuggagagggaacagucaugucagaucaaaagaaggcagguguaggggcuggagaagcccuuucaccacaccacuuugucaaaguuccugaaugcccugugugggcacaggcuauggggagcucucaggucuaaggagcuggcucuaauccucagacggaugcuggcagagaaggaggaaggauucagaacagggcaagaaaaagggcaggaagucugggagauguagaucugaauaguccuuugcuuucuggguuuucgcccuuggggugccuaaacugcuguuugucucuauggguuagagcucuucgagcaaugcgcuagguccccugcucaccugcaggaucacuguuagugugguggugcgguaauuuguuaacacacucuaaacucuccggugggugcgagugccuccucuacacccgccuaaauguuguuuugaauuucagaaugaaacacaccauacacacacacacacacacacacacacacacacacacacgaagccuuauuugaauaugcccgaagccgcucaaugcaauggcugggcacuuccaaaucuccccacgacuaacacacucuccccucuauucccgaguuauuacuuacuaaaaaucuacauucuaacuuggcugccuggacccaguugggcagcucacucaggcggugcacuccagguuccuucacgugacuguuggcucucgcuucuccaacucccaagcccgaucuuccugcuucccucucuuggcgauucuccagccuccuucuucccauggucucuugcccggaaaauguaagguccugucucugucucccugcccagccauuggcugccagcaacuuuauuuaccaauaagacccaacuggaggcagacauguggauuuccaugugauuuugggagcccaguuaacacaaauaacauuagaaccaacccauagguaugguugggagaacggggaagguuaguagccugugucauggggugggcuccucaccgcuggucugcugucuccuggcucuguuuguaggccaugggcaauguaacuguggggacugcgugugugacucggacuggacuggcuacuacugcaacuguacuacacgcacugacaccugcauguccaccaaugggcugcugugcagcggccggggcaacugcgagugcggcagcugugugugcguccagccaggcuccuauggagacaccugugagaagugccccaccugcccagaugccugcuccuuuaagaagugagugaacagcgugcagagacaugggaggccgggagaaggaagggggcccuggcggagaacucccaacucuggggaucugucuuagagaacuguuugccaaauggugcuuuccuuuuucccauggggaaguuggagguggcaccagcugugcagggaccaaagcagaaccaguuggagccagcccucuuccagaguggcaucucgaagcccucugcauggggagggggaucaaauaggacauucuaacuuuccgcugcaguguucugauuucuaugggaggugcagggggcugagguucuggugggccucaggugcagggggcuugagguucuggugggccucagugaaaugggcauguuaguacagagcugccccguucggacguugaggaagcgucagucagcacaagucuauggcucugcuguugccagguucacacaggucgugcccucugagcugcgguagggcccagggcuuagaagaaagagccucaugcugagauaaugcucuguggucacugucuugaaauuuagguauguuuggacagaauuuuaauuuuucaguggacucucaaaucacgugaccaacucugaccuuaaaccucugagaauuggugggaagucaccaucaccaucaccaacaccuucaccaucaccaacaccuucaucaucgccuucaccaucaucaucaccaucaucuucaccaucccuaucaccuucaccaucaucaucaccaucacuaucaccuucgcuaucacuuucaccaucaccaucaucaucaccaucaccaucaccaucaccaucaccaucacuaucaccaucaucaacaucucugaagaaguuuaaugaagucuauuuuuugauccuauaguuccagcagucaggagccugaggcagggguuucaaaaguucaagaccagguuagguucuguucucagauccaggguuggcuggccagguccugucugaggcgaggagggccucuucauuccugaaauccaugaugccuucuggguacauggcauacauacauacauacguagagcugucccugccuggcuuuaguugcuguguccucucuccucuagggaguguguggaguguaagaaguucaaccggggaacgcuccaugaagaaaacaccugcagccgcuacugccgggaugacaucgagcaggugaaagagcugaguaagugcagcgggucugaggguucacgugcccaggauaaacccaggccacacacaguucccucaaagcucaccagcuuccuuuuuccaagguggaagagcaguugccaccugaugugcaggccugauguguagugggcaccuggcgaaggcuggcuaccugggagucuccuucguccuugcaaauguguucuggagcucacaccuccugcuaacuggagccccaggcucagcacgugcaaggacgugcaagucacauaauucuuaguuuacugcuaaaggagaggaagggaaugucuuagguuucauagaugagaaaacuaggcauacaccuguggcugccgucccuagcuuaguaggcgaguuaagcgacacugggccugguggcacacgcuugugacccugucacucaggaggcugaagcuggugggucuuuacuuugaagccagccugggcuacagcugugaguauuccaggccagccccagguacagagcaagaccagcucucaaaaaaaugauuuuaagaaaguguuaagggggcuggagacauggcugcgugguucagagcguggacuucucuuauagagggcacggguucuguucccaguaccuacaugguagcuagcaaccaucuguaacuccaguucuggaggauccagugcccucuucuggccugcauggguacugcacacacauggugcacagacauauauaugcagacaaaauacucaaaauaaaaaacagaaucuaaaaacaguguuaaguaaugcccaggccuuugcuuauagcuuguugauuugcauggaaaccuccagcuuaugaacgugaccaugucugcucucugauagcucuuuugacuuuuuggacccccucuuccuccugaaauaagaccaaaguauaaacagaggaaucaaguuucuuauuuaccaucauucuggccuguacucugugcuguuuuuuaaagacaaucuuugcugcugcucucgguauaucugauacguugucugaguugagagggaaaggguggugcccaggagaugcuaaucucugcgcagauagcaaucaccuguuaggaggggaaaugccucuucaugugagggccacaguaagacaauuucaggcacaggaguuauagggauaucagaucucugggccuuugaucgcagaagugaguugcagugaggugggugguuggggguugaauucgaagaaguguuuuuaucuugagagaccaggccugcugugaucagcagggugcaaggauacaggggaggugugggugugugggugugugugggggguggggguguggggguaggagugaggguggggggaggguuucuuugaucucacugagucuacuuuucuucaucuaugaaaaagaaacuauggcccugccuaguggggagaguuaagugacaugaaaucgacaguugcuaacagagaguaggugucuaccgaccucucuucccuuuaucugcuugcccaacgguuuucauucauuuccugaugcggcccuugccaguuuuaccugucugcauccaucgguauauggugagauacacgcaguggagaguaacuaacccacagugucucccagugaccaguaggucucuguuugaggagggcugaaacccacaagcaucaugggagucagagacaggagauggcgguagagaggcacacacagucagaaagagaagcaaaaggacuggaagggcugcacaaaccaucugggaagcacuggggaagcagccgaaggaaagagaggggaggggacgcccgaccgcagugugucaacugcuauuuuaugcuguuuaaaucucgugcaacgagguacgguggggacaucgucuuucuuucauacaugaagguggucaggguagauaggugccagugcugauagguggcagagacaggcuuugaaucagaauguacaaaugcucugauagcacgcccugcucggaggaagaaauaagaaccagaaagggccaggggggaaagaaacuucaucacggagggccagucagugcugauggccgagcucgaccuccaaccucugugucuugccuagagucaggcaguuuccccgucauacacuuugcagauguccuaugggcuggguuuggggaaaacucuuaacuuucugggguuugauuugucucucauucuccauauucucccuuugucagcggauacuggcaaaaacgccgugaauuguaccuacaagaacgaggaugacugugucgucagauuccaguacuacgaagacaccagugggagggcaguccucuaugugguggaagagccugguacgugagccccgaggccccagcccugcccuuagggagggagagacgacccugcuaggcagaaauuucuccuuguaacccuuucaaacaaaacaggccaaagagguaagggggcucuauauuaaguacuagcaggaaggugacucaccggggcuggagagggcucgcaugguuaagagcacuugcugcucuuacagaggacccgagcuuggucuccaugaccaaggucaggugguucacaucuagcacgacucucaaccuuuauaugugggcuagcgaauagaaaugggugucguccucguucugcugagcgagcccagggaaaguggucaugggcagggcagaggggagccuguggguaccugugaaggaacacacguuacggucugagcacagcuuccuacucaccccugcccuagccugggcucucagcccuuugcuguuggcucugcaccucaccucaccucuuugcuacacaaucugcuggugaucccguuggcucacaaacccaaaucauuuggcuuaggauuuugagacugggaguauagagucaucugauacgaccaaacaacccggggucgggguauggucacuuuucauauucucagccaguacauccauuuaaaaaaaaaaaaacacacauugggaaaugggauccacaggucuagcgaccuacaggugcccuuugacuucguggugcuggaaguagaaccuggggccuccugcaggugcaguauuuccacagucggacccucagucggcgggggugggggggcacaucuccuacccccuggcucugccucuccuuuuaaccaguccccaggauuuccagggacucuagcugggagcagcacaggcagcugggguccugaggugcaggaagagauuauucucuuucuccucaccaccucauggccuugcagauguuuucuuuggacgacugagucaccacagggcaguaaagagcauuuccaaauggauucagccacauggaaugggcucucuucauucuuggcuaaggcugccagaaauaacaccauggguuccgugcaauauuuaguauacacacacgaaaauaguaacuuguuuaugggaagccagaucgaucuggacuuccuauacuuuuguuuacuacaucugcccacgcuacccaggcuugucuggcuuugggucacccacuggcuaagagggaccucuagaggcaccugccucuggucuccugccucccacuccuggugaugacagacagcuuuccucuagaauuccaccuguguugcccagaccacuaugugaaaauuucacuuugagguuugagggucaggccuaucccaagcuuucaaagaauucacgguuguuuuucccagaagaacuggggcccuuugcuccugguaauuuggacacuggaaccucacaagcuccccucaggagccccuucauuaucaagagguuguaauuugguggguugggaaauggccagagugguuugugguagcgguuguuuuuguguaguauguggugagccuagggugucuguuuagagaaggugggagauggaguggaaagugggugugacuucuucuccagacucagcagcacccauacaagcaaacaccuggucucaugacacuggaggcugccagugugaggucacuuguuagacacccgagguuuaugggacgcugagcucuuuagaauagaaucagcuggcugguggauaaauaucacagcuccugucugcuuugguuauuggcuggguagaaacaaagaggucagccuccaguaggguuaugauuuuagauuacuacauuaucuuggcuggcaggcuuccugguccccauggauguggagaagggcuguugaguuuacagcucucaggguuuuaaacaucugaaccagggcaagagaugcacaugucgacgggacaauaaaugacaaggcuagguaugagacaccaccagugacgaugguggcugguguuuaucgaggagucagcuuugugccaggcacuguucugagcucuuuaaaucuauuuagcucugucauuccucaucacaagguuuugccugugaaggcuuuguccauuuuaaagauggagaaacaggaaauagacacuuagaaaaguuaguuuauugaaggccagauaagcaguguaagcauuaaagccaguauucaaacccagacagucuuggcuccugaauguccaguggcacagacccaaggucaagccacacucugccugugcuuaggggacacuggggagaggacucugguaagcagaacacuaauguucugaauauaaaagagcuagcugcucccacugcuagccaguggcugcucuacaggaauguaaguuccaggauuagcagguguagggguguguguguguguguguguguguguguuugaaugucuguguguguuagcagguguaggugugcgugugugagugcgugcguguguacaugugugugcaugcgugugcaugugugugcguguaugagugucuguguguguaaugauagggauagagcccaggcuucaugaaaaauagcaagauguucaccacuaggcuuaguuacuccccaaaucgauuuuuuauuuaaaaaauuuuguuuuugagauuuauauuuaagagcaacuugccucacuggauauguguguagcauauucauggcugggugccaguggugguuggaagagggggagucaggugaucuggagcuauagaugggucugagccaccaugaggaugcugggaauuuaaccugggcccugugcaauagcaacguguguucucagcuucggagccaucccuccacacugaauggguuagguucagccggagaaccccgauuuaggguacccagggcagaugacugcuguccuaaagauuguccuuuuuaaaaagcgacgaacuuacuguuucugauggucccaucuucaacucugaaucccucuguuccgauuucauuccugggagucucuggugauuccugcucuccgucucugccucccagagugucccaaggguccugauauccuggugguccugcugucagugaugggggccauccugcucauuggccuugcuacucugcucaucuggaagcuacucaucacuauccaugaccggaaggaauuugcuaaauuugaggaagaacgagccagagccaagugggacacagugaguggcugugcugagcuuugaguucuccggagucuuugguucaugaacccgagguuggggcaggagaugcucaguggucagccagccucgaaacugggaaauguuuugacuguucuuuuaucuguaugugcuaugaggccucccaguccucuaccuuacagugaccacauguccugaucacugagcucacacgggauacuaugacaaagggagaagcuuaauucuccaguugaggggacagggcaaaucuguaucagggacauguaacacacuguacagaaagugacauagcagagaacgucuccugagggcuaaaugcuucugacacuuuaucuccguaacagcccuuuugauggacaauauuaucauucggauccuauaguuaaggaaacugagggcagagaaguaaagcagcuugccugacaaaggaagggauggggcaauacaggaaguacuuucggagucagccucuuagaugucauggccuuacaucuguuuaccucauuuuucucuuuuccuucaaaugagaggugguagcuugcaaaccaggauccucuggagaccccagaaugcuguuuaaccugauuuaauccaaucaaacgagcaucuaaacaacaaaagccccaugcauguguguauggccaugguguguuuucagaggucaggggacagucugcaggagucagguuugccucccacguggguucugaggaccagugucagcugcaucaggcccggcagcaaccgccucugcccgcucugcccgcucugccagcucgcuaguccgucgucggaugagcauuuuucuuugagaacuguuuauuuaauuuuaaguccaacuucacuuuauuuuuccuagacaggccaagaauguacagcguuugagccgcugaggaacuucucuagauuucuugacauggaggggauguucuaaauuucuugacuaccauuaagggggauucauuuacuuuuuguuaggaaguaauuugggaaaccuggugaaggcacacaacaggucuguggguagcaacuggcccgagagaugagauaaaaacaaguuaggaauaauuucagcaaaagccgggcucuguguucugaccucaccugcuacauuuucccuucuggcucccaucgcgggcacugccuuaaugaagggaaagaaagaguagggacagaagaagaaacgggagaggcagggcaaacaguauacuagucugggacugacaaauauucuuccacccaaagugacugaauuaaaaacccuuagaaacaguggcagaccagcaauacagcaucccucuccccuccuucucuccuaucuauucccauccuaagaguugaugaguaaauguaaacauuggcugauuucugagaugacguuuaaccguuugggguaaggaagugcauggagcugaccaccguuucuccucucuucccucugcaggcaaacaacccgcuguauaaagaggccaccuccaccuucaccaauaucaccuaccgggggacuuaaugagaccaucuucagaugacgccaggaccgugggacucucugccauuauguuuacagaggacauuuguguguguguggguguguggguguaugggugggauuuggggcguggguugggcugggcuggaagaaugucaguaugugggaauguaucucucuguguguacuuaugugugugacgaguguggggaaauguguaauuuaaaacuugugaugugucucacaggcagagcuccacagccuuuguccucaggggcccuccccaaaggauucuuccugcuuagcuugagggggacucaugaugcccggcaggugcucauuaccucugagaagcuagcuugcuuugucaggccauucucccagaagagaagggcagggcugagguuccccaacccccauuccagaggaaguggugucaagucuugguucuauaccaacuuuguaauuuuccgguucuuggggcugacugucaacagcugugguagaaagugcuugacguugaagcucagcuguaucgucugugccucugcccaccucccucccuuccucaggcugaugguggaguuaggggagaaucgaguccucaagaguugccuguggcuuuugccagcaccucaguccugcuauggcucucucucucauaaggaaaguccuugucaccuggcucuuuggccuguuaagggugaggauggcaaggccacucaggggucaugcauggccuggggggugugccagcaccuccaagaucauaaucacagccauucagaauugccucauugguagcucuucccaggagauuugugaacaugugucauugugucaacaccaucucuuaccuccugcuucuacacccugauggccacagacuugugcuaugugcugagacucucucucauggucagaugcuaugggcugaggcucucucucauggucagaugcuaugggcugaggcucucucucauggucagaugcuaugugcugaggcucucugucauggucagaugcuaugggcugaggcucucugucauggucagaugcuaugggcugaggcucucugacauugucagaugcuaugggcugaggcucucucucauggucagaugcuaugggcugaggcucucucucauggucagaugcuuucuccucaggggagagugcaguggucagagcuggagguccauccccacucuccaggcuuucugcuccucuuuccgggcaccuccacacaccucauccuaugccucugugugcuugcuacacccauccaugggggugcuuguguguaucuaccucuucggugucuugugaaggagucccccgagucucccaugagucuguugaacaacgugccagggaggaguugaaaggccagucagaacugcauguguggccuguucuccugugggcuggacaaccucauuuuaucucagccuuuaaucugggaggccacaagugcaauuuuauuuuauucccuauggggacacccaaaacuaugaugaggcccgaucacucuagaggagcacguauauaaacauacuugcauuauuauauuuauaauuuuguaugaugacaaaggagagcauaaaaaaccccacacagaguguguggcaaacauucuuaguaacuugccagucaguggcugggucugcaaggggcuucccucuuccuggaagcaugugaagauggguauguggacacacugacccuuucuugaagagguuucucgacuggguucuggguucuguuggcccagcaagcaugguuugcucugcuggcauugacuuagaucuaauguuaaaaaucagugcuuaccacccagagacaagaggccuauaaacagcaucuugaugaucugagaccugaguccuggccucgggaucgcugucaaaacaccugaaaguuaauucagaaaagccauuucccccaccccucuggaguucaauauucuuuuggauuugguaacuuggaaagucuauuucaagugucacuauucuuuuuuucugaaagacagggucucauguaucccaggauggcuuugaacuugcuauguagccaagguugacuugaacuucugauccuuuuucuacacuucucaggugcuacaauuacaggcaugaguuauccugccuggcuuaugcagugcugggaauagaacccaggacaucacacaugcuaggcaagaacauuaccaacugaucuguauucccagcuuuaguaucaacauccuaagaugccgagaguaaauacgguaucaagccugcgguccagauucuguguguguauaaggaggcuggaauguugaccaguaguagaacaagcaguuaaggaauguccuggguuugauucccagcacugaaaacguguguguguguguguguguguguguguguguguguguguguguguuuuguggggggagaggugguguugcuccuguuugucuuucaguuuccagacugaaugccuuggcuuucacgagagcagaugcuauucuuagaacuugucucagcgagucucauuccuucucagacucccuucaucuuuuguuagugggugcaucugauguagcacuuaguuuuuauccaacuuguucuuucuuguucacucugcauacaguugcaucugcauaccagggaggaccuucaguaaggaguggcugauccagauguugguguggugagcaggccucgaguacaggagaaagccagcgacuguccgguugugcccuuggguuacucuuggcuuagguggugggaguacaguagagggacagggaagauggucagagauccauccuuuagcuacugaggcagaguccgugagaguagagugggguuuucuuuagagaagacuguuuagaugaggaaacuagcagggaaggaagaaaauguauuagaagagugaaaggugaguaggaaucuugacgguuucuggaaugaggcuuguggugcuugggcggcaacgccggucaggacucgggcauaucuguagcuguucucuccggaggcugaggaacagucugagugguuuccaggggaugaacaucuaaaauugugcugggaaugaaugcgcagcacagagcggcugggcccguucucuuacaggugguuucgguccagucucugucugaggacaacaggaagagacagagaaugccuggcagguagcucuguucccguucuuucccucagagacagucauucugaagcugcccacagcaacaucagagucuuuguccauuuuugguugaaauugcuuacgcgccuuccugacacccuccccaccuccucugaguuguguaacagagaauuaaaugugcuuuccaaaagaacuggccugagacuaccccauguuguuagaucuguuuuugcugggugcaaagagugucacugcuuccuuccaaagggacaacuguauaguaaaagcaagcuuccggauguaacaggauggugccugcugugggagcuggagcuggcuucugaguccagagcuuugcuauuuucaaaaugagcagguuacuacuuucuaaggcuuuauuauuauuauuauuauuauuauuauuauuauuauuauuuuaaauuggggguuauuuaggaucuuuugcaaacaaaguagaacacgucgucaauauaguccagguuuugccuguagggaucacgaguaaaaucucagugacaaaugacuugcagggccguuuacaugccaaacuucuacuuaaaauggcuagugguaaauuauaguaucaccuagaaaguuuu

SEQ ID NO: 6442 - RNA, 1892 nt, Mus musculus
cuguguacuuuuuagacacuugggaaauguugcucagauuuucauuuauuuugaaaauucugaccugggggguauagcucaaacaauagagagugcacuucccacuuggagacuguauucaauucccagcacugaaaaaaagaaaauuagaaaaaaaauagauagugaugaaaauguuaaugaaucuagacuagauuaugggcuguuugggggaaggaggugguuuuguuccuugcagagcacaaugcuaggcaaguucuccagcacugagcucuguagaccaggcuggucucgaacucgcagaucugccugccucugucucccaagugcugggauuaaaagugugacaucauuuuguuguuguuguuaacaaauggagaagccccuggaagucgucacccagagucacaguguggccugacccucgguugacgucaccucuucacugauggagagauaggcagaugagccagcccuucacucucucuuccucuaccugaggaacguguauguaccugugggaagaacagucgccucuagcgugguggugguggugaaggugggugggagaggauuguugguaagacgggagcuucagauggaggcacccagaacaccaaggagcaaagggaggcuuuuauauuuacucuuuuauuuucaaagauugacugauuuauuuuauguauaugaguacacugucacuguauucagacacaccagaagagggcaccagaucccauuacagaugguugugagccaccaugagguugcugagaauugaacucaggaccuccggaagagcagucagugcucugaaccgcugagccaucucuccagcccccuuuauauuuauucuuaaggacaucacuucaacuucucuaccucuugguacuggguguuguuuuguaugugugacugaguauggauaaaaguucaugugucuaauugugugcacauacacguguggagaccagagaacaauugaaggaguuaguuuccuucucccaccaugugaauuccagggguugaacucaagccgacaaguuuuacccuaucuccugccccgggaccucguuuuaugaggcagggucucucacugaaccuggagcucacugauuuuggcuaacuggccagcaagcuguauccuccuaauuaggguaggauuaugguaugguauguauguaguguaugcauguauauaguauauguauauauguacauauguaguauauguauguauguaguauaugcauguauguauguaguguauuauguauguagugugugcauguauguauguaguauauauguaugcauauaguguauguauguaguauauauauaguauauguauguaguguauguauguaguauaugcauguauguauguaguguauuauguauguaguguauguauugccaugcuuaacuuuuugugugagugcuuaggacccaaaccaagccucagacuuccaugguaagcacuuuacugagcaauguccccagcccagguuuguuuguuuguuuguuuguuuacuuguuugguugguugguuuugguuuuuugagacaggguuucucuuuguagcccuggcuguccuggaacucacucuguagaccaggcuggccucgaacucagaaaucugccugccucugccucccaagugcugggauuaaaggcgugugccaccacugcccggcuuguuugauuguuuuaagaaaaguucucagggacugaagagauggcucagagguuagaagcacugacuguucuuccagagguccugaguucaauucccagcaacuacauggugguucacaaccaucuguaaggagaucugaugcccucuucugguauauuugaagacagcuaaaacauacucauguacauau

SEQ ID NO: 6443 - RNA, 1892 nt, Mus musculus
auauguacaugaguauguuuuagcugucuucaaauauaccagaagagggcaucagaucuccuuacagaugguugugaaccaccauguaguugcugggaauugaacucaggaccucuggaagaacagucagugcuucuaaccucugagccaucucuucagucccugagaacuuuucuuaaaacaaucaaacaagccgggcagugguggcacacgccuuuaaucccagcacuugggaggcagaggcaggcagauuucugaguucgaggccagccuggucuacagagugaguuccaggacagccagggcuacaaagagaaacccugucucaaaaaaccaaaaccaaccaaccaaacaaguaaacaaacaaacaaacaaacaaaccugggcuggggacauugcucaguaaagugcuuaccauggaagucugaggcuugguuuggguccuaagcacucacacaaaaaguuaagcauggcaauacauacacuacauacauaauacacuacauacauacaugcauauacuacauacauacacuacauacauauacuauauauauacuacauacauacacuauaugcauacauauauacuacauacauacaugcacacacuacauacauaauacacuacauacauacaugcauauacuacauacauacauauacuacauauguacauauauacauauacuauauacaugcauacacuacauacauaccauaccauaauccuacccuaauuaggaggauacagcuugcuggccaguuagccaaaaucagugagcuccagguucagugagagacccugccucauaaaacgaggucccggggcaggagauaggguaaaacuugucggcuugaguucaaccccuggaauucacauggugggagaaggaaacuaacuccuucaauuguucucuggucuccacacguguaugugcacacaauuagacacaugaacuuuuauccauacucagucacacauacaaaacaacacccaguaccaagagguagagaaguugaagugauguccuuaagaauaaauauaaagggggcuggagagauggcucagcgguucagagcacugacugcucuuccggagguccugaguucaauucucagcaaccucaugguggcucacaaccaucuguaaugggaucuggugcccucuucuggugugucugaauacagugacaguguacucauauacauaaaauaaaucagucaaucuuugaaaauaaaagaguaaauauaaaagccucccuuugcuccuugguguucugggugccuccaucugaagcucccgucuuaccaacaauccucucccacccaccuucaccaccaccaccacgcuagaggcgacuguucuucccacagguacauacacguuccucagguagaggaagagagagugaagggcuggcucaucugccuaucucuccaucagugaagaggugacgucaaccgagggucaggccacacugugacucugggugacgacuuccaggggcuucuccauuuguuaacaacaacaacaaaaugaugucacacuuuuaaucccagcacuugggagacagaggcaggcagaucugcgaguucgagaccagccuggucuacagagcucagugcuggagaacuugccuagcauugugcucugcaaggaacaaaaccaccuccuucccccaaacagcccauaaucuagucuagauucauuaacauuuucaucacuaucuauuuuuuuucuaauuuucuuuuuuucagugcugggaauugaauacagucuccaagugggaagugcacucucuauuguuugagcuauaccccccaggucagaauuuucaaaauaaaugaaaaucugagcaacauuucccaagugucuaaaaaguacacag

SEQ ID NO: 6444 - RNA, 58813 nt, Mus musculus
ccucuccgggaggcaucacuucguccggacccggaggaggaugcgauccccucgccggcggucaucugagcacagcgcuagggcugucucugcacgcagcccugccgugcgcccuccguacucucguccuccgagcgccgcagggaugguacccauccgaccugcccucgcgcccuggccucgucaccugcugcgcugcgucuugcuucucgggggacugcgucucggccacccggcggacuccgccgccgcccuccuggguaaggcgcugccaacuuggccaacuucgggagucgggccucuugacuuuucccuccuuuuuuucucccaucuuuucugaagaagugcgugcgugcgugugugugugugugugugugugcgcgcgcacgcgugugugugcgugugugugugugugugugugugugugugugugugugugugugugacuggauuuuuuaaauucgucuccacuuuucugggagcaagggaggagaugggaggaggagcgcgccuggaggugggggaggaccugaguggaaccagauguggcaggcggcgggggaggggagccaaggcaccgcggccugggagggagagggagggcugguguccgggccacccggacccccggcgcucgccccgcgcuggucuggguaccuugauauacaaccagagagccagaggcgcauuguuucuuacucuguacgugaggggucagucuguucagcgucuggcaauggggucuuuauguuuucuuacuuggucuuuaaggacagcuuguggcagaggacuuaugcaccguucgaucguaacccuguggaacaguuuugugccaggagaaccgaaugcgcgugcgugcguguguguguguguguguguguguguguguguguguguguguguucguuucucacuuuguguguucaauucugaucaaauuggcacuucuccagaguggacagucuuuggugcaaaagaguuucuaaagauacaaaccacaacccacagaagaccaaccacacaagccccccaaacugcacccuucucuuuucuguauguuuuuuuuuguuguuguguuguuguuguuguugucgucgucgucgucguuauuuuagaacuaucugaaaugugaggucagacaggucccucgacaagaaccugaacacucauaaacauugauaggguagaucuuggggggcagaggcacucagaauuuuaaaaaaugugcuggguguugccuccacauccccuuuuuauguuuaauugggggcugggucagcggaaagggaugggacagcagcugcagcuuugugcuaggacuagagggcccccugaagagucugaggccuuugcgguggccuggugugcugugggcauuugcugaggggaaagguagggucagggugacccacaguuacauaggagccuccucugcccuucccucccaccuggaucugaagccugcauacacaggaagcaagccggagccccuuguagcuugguagcaucagcgugccccucaccucccgggguucuugccagagccuuguuccucuguauaggacacgggacugcaggauucgagggaggagggaaaggacagccaauuccaagagccuuagcuuggguuuuaacgccaggcccugggaaagagcugggccagagcgcugacuuggucuuucccccagggagcuuuugacagggggguggagaugccugaugaggggcccagucagggaggaaaaggaggcuuacagugucccugggcuuccuggucucugcuucugucccucccugcucucucagacuguccuacacacaaaaugcccaugucugggcugcuguguggccuggaucacccuccugagcccugaagaagcccagccuggauucacggagcugggagugggggugggggagagggggugggggagaggggcuuuucgcuaaagcaacugaacaggaggguaaaaaccacacaacuucccugucaccgaacaaacacagcacugaccgacccuacccugccaucuuccaugggccccucaucugggaggcugggcuagaaccugauggaaggggcaagcacucugcaaguuucaccauggggaaccuguggcucuagguagaagugcuugugggagguaggaguugaaaggcaccccaggggugggaaguggggggagggggcugggcuggcaccuuccugaucaccaagaggaaaggaagucuaguggacucuggaugaggaauggccgcucuucuuggggaucagaggugaaaggacugaaaggauucuuaacauagggugucagaauucaucuuuacuucuucugugaccccauaaaaugugcuuuugcuguguugcugguauacucucccuguguacagcacugagucaaguguuaagaguuaagaugugucucaggggaaccggaagucuuucaggaggaugacacagguugaaccgcuagugggguguaaaggcucugugggcgagugucaucucagccuggaagcaagugcuuagcauccacuuucucauucaauucugaugauaacccaaagaaguagguauugcuggacccauuuugcagaguacaaaauagagucuuaagaggagucugaugauuuauuuugggcacaucuagaaagugaaaggcugggaccaaggaugguaaaugaccagaaacaggagagaaugugguccaagggggagaggcucucuggagggagcagggagggccagaggagggagagcaggucagaaaggugucgccgccguugaauauuuuguggaagcuucuuggguuucuggaggaaaaggugaaggaaccuggucaggugccuggaaggccccaugaagaucccaccugcgggcuggcuguggagcucugacgagcuggagguuucuuacaaaaugagcuauggauuagaacagagggaucugcuauuagguggaacggugagggaaacuugggaaguccuccuguggggaaggacuucugucuaaaagucagacaaagauggcuggcauucccucugagaggugucggguuuugucucugcuaccagagcaauuggacaaaccacuguacguuuccccagcuccugaccaggcaaaaagcccugagcaccguccuccuccauaaaacuccaccuaccuggcucaagcaagcugccagggucacagugcuccuucgggguugcuguguuucguaccagguuucucuucuauucugaguuuaccugggcaaggugaugguugcacacaggggagcaggaagcuugugcucgcaccagagaaguccaaggcccacaguuggugugaccaaaaaggccugcacuucuuagggucuuugcauucguugcagguuuaagcaugaggguggggaaaguaacagcaguaaaaguuccucaaaucuccuagcccugggcagaucucaucuuagccccugggagucaaauguuagagcuguucuugguuugucaagaucgcaccacuagaaagcggugaacaggacuccguugcagaugaggccagagcaccuaaaccuagcagcaccaagccacaacaaaagcacugcagaaaucaggaccauugcaggcgagcccuacgccuacaccacccuggguguuagcuagcuuaucacugcgacucaguugucucaucuaagcaacuuauaagggaagaaggguuuauuuuggcacucgguuuagagacuucagccugaagucagcugguuccauggcccuaagccugugaggaggcagaagcuuaaccaagggucauggcgcagagaaagacagccaggaagaccgggaggcaccaaggaaacgguacacacuucaaagacaaguuuccagcgaccuacuucuuccaaccaggcucuacuuccugguugcccaauaugccauuaagaccccgucauuauaacgguucauccauuaugaucuaaucaaaagacuaacugcaaacaauguacugacgaccaagcuuuuauacccaaacagaacacccgcccacauguccucuuggaagggacagugaagaagagaguggcugggacagcucucuguugucagcgauugggcacuugguucuuguacaucuccaugggcccgcggaggcagagacuaaguucccucuuccuugcccuuggguccuugagauguuucccuccaaggaggcauuggcaaauaauugccaaaugccugaagaagccgcagccaggcaccccagcucguggagguaggaauuucauccacauagucauuuuuuuauucauucauucauucauucauucauuccucaucuuuacugacccuguacagugaugagcucaagaugacuaagaccuauucuuuuuuuuuuuuuuuuuuuuuuuuuugguuuuuuucaagacagaguuucucuguguagcccugguuguucuggaacucacucuguagaccaggcugaccucaaacucagaaaucugccugccucugccucccaagugcugggauuaaaggcgugcgccaccaccaccaccaccacugccuggcuaagaccuauucuuccaggcugugcggugguggugguggucucacauauuuaaucccagcacuccggaggcagaggcaaaaccgcuuugaguuugaggcuagccuggucuacagaguccaguuucucuguguagcccugucugucuguccuggggaaacccuguccugaaaaaccagacagaugauagauagauagauagauagauagauagauagauagauagauagauagauagauagauagauauucuuccuuugaauauaacuccuugccuggcaccuccaugggggucucccuggacuuggggggcuucaguaucacugacaggaaaaguaucuuuuuagcucuucacaagauguggagagccccuuuccuacgacugaguccuauaaaucugggugggaugggucacuggaguggugacaugggucuuagaaguugcccugagcucuguagauucuaguuacuccucaguaggcuagaggaggguuugcacagugauaucuguggcccaggaaaugcuggggacagccugcuccaaccacccaggaaacagacuggacugcuuccuccagacggcacaccaugggcugcagugggugcccuaauuguugguuccugucuacauuuagucucagggccacucuccucucucugcaccuucagaguacagcuccucagagcugcaaagaugcucugggguuaagaggaccugguuuugauucccaucacccacauggcagcucccaacugucuguagcuccagucccagggaaucuaacacuucucagggcaccgagaauauacauggugcacagacauacguguaaggcaaacacccagacuccuggaaauuagauuacauucaaaaauaaaggucuagacccuccacagacuugacccaugcuuucugaugaccucugccuacuucaguuccucuggcuguguaucacacccuccaggagacagcugugaaaccucaacuccuuuccagcacccuggccccacuccuccuccuucaccuucccggcaugcucugcuccacacuccacugccagaccuuugcucacuguaccuucuaccaaguagguccuuccuucccuuggccuaaccggcuccugagcuuuccuuuaagacucuaguaucuucaggauaccuaggagugaaaacaaccgccagaaccuuagaacagcgaagggccgugccucuuggauuucccaggaagcucgucaaagaguuguauccaggaugguugcguugguuuuuucauugcuguaacaaacaccugacacaaagaaaggaaaauuacuuuggucagcaguuucaggggaccaaccuguggucgcacagucuaguugcguugaaccugacgcaaggucaaaagucauacggaggaugugauuaaaaaccacuaccuucucggcagcuggaaaagccgagagaagagggccaggaccaggugcaacuuccuucagcaagacuccacuucuaauagguuaucaauagggugaauucagcaagaaucaauccguggguuagguuugagaccucagugucuuagcaacuccccacagcccauaagacuauaacacauggagccuugugggacacuuuagguucaagcuauauaguuucuacaaggagacucuaaacaagguuucucugacccccaagggguguuugaaagagggucauugguguggucucauguagacugaggcaggggggguagguguggucuaacuuguuuccuuucuuccucaauccucuggacuuauuaauggggaagaauccuugagaccagaauuaauuaaaagacucugcucucuccuuuugacacaugagaaaaagaacaguccaccuuguaggguauugcaugagagucgaacacaagucacaugauggaugucugagauauacauccuaugcucuugguauccuaagcuauugcuguuuuuauuacuaauaagaaaaaaaaacccugugaauaucaaggggcuuaaauaugauaagggccugggcuggagagauggcucagcaugguuaagggcacucacuguuccuuuuagaucacccaggugugguucccagcacccaugucagguggcucacaaccaucuguaguaacaguuuccaggggcaucuaguguccuuuucaggccuccaugggcaccaggcacacaugugguauccauccauacauucaggcaaacacucauccacaugagauaaaaaauaaauaaaucuacuuuaagaaaggagaaauuuguuuguuuguuugugguuuuuggcuuuuugagacaagguuccucuguguagccuuaaccuuccuggaacucauucuauagaacaggcuggucucaaaaaucacagaccccccugccucugccucugccucugccucugccucugccucugccucugccucugccucugccucugccucugccucugccucugccucugccucugccucugccucugccugagugcaggguuuuaaggccgugcacuuauuuggcucuaccuuacuuuuugaggcaaggucucuuaccgaaccugcagcucaccauuggcuaggcuugcugaccaguguccccaccccucccuccagcacuggauggcagguacaccaccacuccacagccagcuuuuuacauaggcacugggcauccaaacucaggaccccaugcuugggcagcaagcccuuuacucacugagccauguccaaagccccuggacccuuugcauuugguuccacuaaaagccaauaagcaacucaaagcccggugacuuucuaaaaguaaauuuaaaccaaacuggggaagggcuuacccgacccuaguggcccugccucccucaggccuauguuuaccacacuccccucugcaggaucucauguccuuccguacuuagggagcugcccuccagugggcugugcuaaacccaaggccaucccaggaauacugggugcugcccauaaaagccaccauaccugcuuuccucagcacccguggcaccagcuuccugcaggucugucucucucugcuuaguucauacuugagcacgcguggcgcaggcuggacguugccuucagcaagaagccuccugauuauuuacagcucccauccccccaccccaccuccagccuuugugugaccaguucucuccuaccuuucucggcaggguguucuguuugggggaagaggguccugggagucucuccaagggccuugagcaucuaagcauauacacuccugcauccaagcuaccucucagcuccuuaguccuugcacggguucagugccuaugacacgguggcauuuaggaaauaguuauugaguuggaaacaaugaaagcaagcagacaaguguuccaaagacaauaagggacguuuuagaugaugucauggucaugaaaaacagauggcaucugguuaaaugaacuguagaaaguccaacggaggaggguaguccccagaauuuagagcuuuaagcuguuguagaaauguaaugugggacacaccagaaacagcacuuugauagaaaaaugagcuuuuuacuuuugaauguaguugagacaacuggauuuuacaauuagaaagcucugggggccagcagugcaguggugggggacaugguuaguguaugugacgcucuggaugcugggagcggagauuucaguagugaaagacaugguuagcaugugaaagguccuggguucaacccucagcucugcaccucccaccggaaaaagaaaaaggaacuuuaauuucaauuugcagcuaauuauuccugaagacagucagaugauauaugcugucauguagaagguacaaagauaacgagaaauuuaauugggucuuggagcuggagagauggcucaguggcuaagagcauguacugacuguucuugcagaggacccagaaagaaagccauugaggaagacaaacaauaugaaucuguggcuugcacauguacacauguucauacacacacauguguguacacagaaacauacacacgcccaaaacaaacagucagauguucacuaguuuuaugugagauuuauaaaauacauuucauucaaugaaaaaagaaaguagcugggcagugguggugcaugcccaacacucagguagcagaggcagggggaucucugugaguuugaggccagccuggucuacauaaaguuccaauucuaggacagccaggaagggcuacacaaagaaacacugucucaaaaaacaugaaaagagaggaggaggaagacgaagaagaugaagaagaagacaaaggaggaggaggaagaagaaggaagaggaagaagaaggagaaggaggagguggaggaggaggaggagaagaaggagaaggagaaggagaaggagaaggagaaggagaaggagaaggagaaggagaaggagaagaagaagaagaagaagaagaagaagaagaagaagaagaagaagaagaagaaaagaagguaucaucacgcugcucugagaucuccaguaggaauagacacuuucauggcagcuaaaagacaccucuaaaaucccuagaaaaacgcagauaaguguauuaaagaguaagcacacaaacguuugguucugugugaaugaaugaguuccaguuucaugcagcagcuugcaaagaagaggguccaaaaggcagacuauuucucggguuauggcuacaugugaaaauaucuguacuagauaguuuugucaacuugacccaaacuaaagucaucugagaggaaggagccucaauuaggauagugucuccagaagauccaguuguagacaagcccauagagcagugggucucaacccucuggggccacagauagauaagauauccugcauacuagauguuuacauuaugauuaauaacaggcaaauuuacaguuaugaaguagcgauggaugggauaauguuaugguuggggguccccacaacaugaggaacuguguuaaagggccacagcauuaggcaggguagggaccacugcuucagguaauuuucuuaguaagugauugaugggagagguggggguuauuuuuuaguguguaguucauggauuuuccaguuguguguguuggguucuuuuuguucauuuguuuuuauuguuugugacagggugucucccgauguagccuuggcugaccuggaacucaggaacucacagagaucugcuugccucugcuuccugagugcugagguuaaagguguauggcaccccacccaacuuguacccguuugguugguuugguuugaggucucaucucacuguauaaccuggcuggcuucacagucuccguccuucugccucugccuucugagcguucagaugagagacacgugcuaccacacauagcucccacuaauuucuuuuuucauuuucuccuuguguucaguuguucuuuccuccuucccucccuccccucccccuuucuuuccagacagggucuuguuauggagacugaauucaccaugcagccuaagguggccuugaauucacaguaauucucugcauccccgucaugcaguguuuugagacuggcuccauguagcccaggcuggccugaaaaccucuuguugaagauaacccucaauccuccaguuacaggcaugcacccccaauucaugcaaugcuggcgauugauccagggccuuauguuagacaagcacucuaacaacugaaucacacccccagcccccauuaauggucuuugggggggguuuauuugccuuacacguccacaucacugcucaccauuggagaaagucagagcaggaaccccagacccuggaggcaggagcugaugcggaaaccauggaggggugcugcuuacuggcuugcucccccauaaaugguuuucaagacuguuuuaaauguagcugucaugguucuccagcguccuuuacucugaccauguugcuuggcuccucuguuuguccuggugcugcauuccugagaguucugggucagcugucuugucuacauuacuuacccacuacuggguacaucuuaaaacauuaucucggggaaagcugcauggauauguguccuuccagugugucacaaaugugacaguguguguguuccccuguuuuguguggacugacugaugacagagacaauccucggucgccacagacugcuccauucaccaggcaccuuuuccucaguguauuucguagauaauguaagggauuuaaacuacguuuguuuguuuguuuguuuguuuguuuguuaaaaagcagagaugcuuuuagcuuauagcugcaguauucacaaaaacccaaccuagucaggcagugguggcgcacgccuuuaaucccaguacucgggaggcagaggcaggcggaucucuucaaguucaaggucaaccuggucuacagagugaguuucacaacaacugauacacagaaaaacccugucucaaaacaaacaaaaagcccaaacuauuagccuccaguggaaacuccccaaguggcccucaacaauagaauggguggcuugggauuucauagggauagagggcagcuugcugaaguccauccccuccuuccuccaugugguaucugaggguggaacucagguuaccggucuugccuuuuccuguggagccgucucugaagcccaaauuaugguauaaaaaaugguuugacuuuuuuuuuccuccacaaauauuuuaaaagccaguacuuucagugaagaaugaaauagaaccaagauucuagaaugugugguuuguacuuguauauuaugugcauacccaauaaucauauuggguauuuaggggagauaagauagaaaaaugccacccaaauuuaacaguuucucguacacuaaacugaauuauauguuauuuaggagccgugauuaccguggaaggguuuuuccuuaaacacaucugcauuuuaggucaaaggguggcagcugccauucugccagcugugcagucacguuacccaagaccccagcaacccuuuuuuauuugguuuguuugcuuguuuguuuuuguuugagaugggucucacuauauagcccuggcuggccuggaacucuuuguguagaccacgcuggucuugaauucagagauccaccuaugagggucuccuggguacuggaauugaaggcaugugcuaccauguccggcuuaguuuuuuuuuuuuuuuuuuuuuccuggaaagcaucuguuuucuucaccuuuccccuuacaccauugccacccccaccccccacuuuuggguucugacuauggagcucaaguugaccccaggcuaauaacccuccugucucugacuuguuuguuuguuuuuguuuuuguuuuuuuuuuuuuuuuucgauacagaguuucucuguauagcccuggcuguccuggaacucacucuguagaccaggcuggccucaaacucagaaaucuaccugcuucugccuccaaagugcugggauuaaaggcgugcgccaccacugccuggccugccucugacuuuuaaguggcugggauuacagaucugggccauuacaccuacuuuggccuuauugauacaguuuguaaaaagcacuuuggucuccaauuugguuccuucccuaggccuucagcagcacagcuuaacaacuucagggcugcaguuaaccaacuuugaacaaaacuacaaaaugacagaaaaaaaaaucuguaccaaucacauacauguuccaggcgucaugaggacauggagaucugguauaugacugcccagcacccaguacaugcuggacagguguugcggcucacuuggaaggcagagacaacuggaccccagagcaagauggcuaguuagauuagcugaaucagugagcuccgaguucaagugagagacugucccucaacauauaagguagagaaugauccaggaagacauccaccuuuggucuacacauuccugugcauguauaugucucucucucucucucucucucucucucucucucucucucucacacacacacacacacacacacacacaugcacacacacaucuguacacacaugugcaugaauacacaugcacaccacacagauggaacaaaacuuacguuguuacuuuuaugguuuaucauugggaagggugcgagugucagggugggcacauggagacuggaggacaacuuuguggaguugguucuuccaccuuuauaugccuuuuucgagaaccucaaaagaccaccaaggagccgauucuagugccaucacacaagggucuuuauucaagccucagcucggccaacaccaucuucacugacccagcaggaccgagggagggugaagucccgagcccaguuucaagcaggcguuuauagagacaagcaaaccacggagggguuuccagcgauuagggggccauuauggaacuuguugcccuuuaaaaugauuggcuggugcugggagccaaaccaugaacuuucaaaaguaaauaucuuuagguacaacuguaacuucugcuuuccuucugauuggugguuguuaaggagugaccuggagaccagugcuagauguaggcuuggugguuaacucgaguucagccuuagguccgguucuuuaagauggagccugaacccaagauggaguuggucugaucucucaguauccugucaacauucagaaacuugcaaggcacaaaagagauagcucagcagguaagcuugcagaggaccuggguuugauucucacacccacaugguggcuaacugccauuccuaacuccaguuuccagagagucuggugcucucuucugaccucuucaggcaccaggaacaaacacaugugcuaugcugucauacuuacaaaacaaaaacaaaaacaaaacacucauaugcccgugagcugccuggugaggugccgggacuugaacucaaguccucugcaagaguagcguggcucucaaccucuuaacugcaucuccgcccuccauuucaaaaacaugucaauaauccuuucggucuuccaauugucagcaucugcauggcuuccauguucugugaggaaaggcuagcagguucucugaucccagcgcaagacccaggacgguuucuaucagcacauaagggaaggagagcaaagccgauucauccacaccuacauccggcaggacagcuucuccacacacggcuaauuacuucaaaaugugguuuuuuacauuuauuccuguauuugcauggcuucaaauucaggucacgaggcuuucacagcaaacaucuguacccacugagccuccccugccgcuccccaacaccguuauuuuuaaguuuagaugccaggugaugacgcaccccuuugaucccagcacuugggaggcagaggcaggcggaucucuucugaguuugaggccagccuggucuacagagcaaguuccaagauagccaggacuacacagagaaaucuuaucuuggaaaagaaagaggcgggggaggagggggagggagggagggagggaggggaagggggggagcauuccacaguccccaccccuuccagaagucucccuucucuccuucucccuccuccuuuccagagagaccugagggggaguccagaaguucaaagggacugaaagacaguuucuagggccccagagugccugcugggaauguagggagaagacugcaucuggacuguggguuuauuuuucuuuuaauucuuccgaagaguaaacauuuaaaucuguggccucuuuccccuuagccuuucuucuuaucccaauugcaucugcgaagccugcuucccaggcuccguguaguaggaacagaaacagauucuugccugaauauuaaggcacaguaauggcuccccugagagcugcccagguacaugacaucacuguccccacgccccauaggacaggagucaguaccuuauccaaaccacggcucacagcuccaggcagcuggcucaggguccaaggaucuaagcccagauuugaacuuggguaguccaaauucuagaauggcccucuccuguggugccuuccgggaaaagguagggaaaugucuccuaaccuugaccugguagaaacuagcaacuaguaagcaugggcaagguuuuuuguuuuguuuuauuuuuguuuguuuguuuguuuguuuugagacagugcugcucugcauaguucuggcuguccuggaacuugcacuguagaccaggcuauccucaaacucaccugccucugccucuuaaguguugggauuaaagguguguaccacuacugcccaguaagcaugaaaauaauuuuaaguaagguuuuuguuucuguguuuguuuguuuguuuguuuguuuguuuguuuuaaagauagggucuugcuagauagcccaggcugccccauaaacuugcacccauucucucccccagccuuucuagugcuggggcauuggguguacgcugcuacauccugcuguuaagauucuuaaaauucaucgggaagaagauucuaaacucccuggacuuagagccaggcugugcuuuuaaaaccaagcaaaccauccuugacauuggaucaggaacuugaccgugugaaaagcucauuacaggccaugucauguuuucuuagucauauugugcagacuuugagacaccacucaugaaaggaacguaauacaucagagagaacgggcacagagcaccgagccccuccacuccaccucuguccgccucugcuuuucucucucucuccauaagauagggaaauagaucugaaacaagcauggcuuuugaugguuuguuuugggggcacaaagucucuccucguacauaggaauucaguguccacagagaccagaggacucuggcucuucuggcguggauucacagaugguugcgacucucccugcaugcuugcugggaaccgaacuuggguccuuugcaagaacaguggccacucuuagccacuaagccaucucucugacccuccaugguuuuuuguuuuuguugauuuugcuuuuuauuaaaaauguaaagacuuagccgggcgugguggcacaugccucuaaucccaguacucgggaggcagaggcagguggauuucugaguucgaggccagccuggucuacaaagugaguuccaggacagccagggcuauacagagaaacccugucuugaaaaaccaaaaaaaaaaaaaaaaaaaaaaaaaaaaaaaaaaaaaaaaaaaaaaaaguaaagacuuauucuuguuuuauaugacuguuuuuuaaauaacacccaaaaucaaggauagaguuucucagcagucagcacagaggucaacacuggcuaauuggccccugaggaaugcugggaucacgggugugaacuagcacaagugugcugugauggguauuaauagagaccaggacacuaaagagugcuucauuauagaaauacauagcauguggucuauaagagagagagagagagagagagagagagagagagagagagaaugggagggagggagagaaugggggagggggaaggagaggggggacaaaggggagagaaagaaagagagaacaaaaggaagaaagagaaugggggagggggugagagagaugagagagagagaaaagcuagugaccccgaauaucccccagauguucagcuucucucagcuccugauuccuuggcagaccugccagcucacuggugccagcccucagagagaagcugggaauucauguguucaugagaaaucucucaaguuuuaaauguugguucacuuuucuccccacaugaagugaaggucaaacacagcuugccugcaagcuaucaguuuaaaauaccucaggagcagucugaagcucaacugaagccagucuuccuggucuccacccuaagcaaacuggacaggguggugccagccugucaucuaguccuuagaaaguuggggcaggaggauugcugggauuucaagauuagccagggcuacauagcaagacccuguuucaaacaaaaauagucacuaaauauaucaguuucaucauucaucaaauagagauaauaauuuuaccuagcucucaggguugcuaugauaauuuauaaauaaguguugcaacuaagaauucggaauucaucaagugcaugauacacacucacauaucaugcugugucucuucccacaaaugcaggcugacccuccuuuuacugggacgauccugguuuuugucuguugcacugguauaauuaguaauucucaauuucauuaucaucauugaucauacguuuucuggggacuacacagaagacucagugggucuuguagacuugcagcacaaucgugaggacccaaguucaaauccccggcacucacacuugaaaaaaguaauucagauguggcaguacccaguaccuuuugucccugggaguggacagagcuggucgccagccuggcuccagcuuuggugggggacugugucuuaagggaguaagguaagacacuucuccucagccuuucacaccguguguacccacacacgcaugcacauacaacagauacacauuuaucacacacacacucaucacaaaaacaacaguuaaauggcuauacccuaguauuuuuacacaauucgaccaguuggagcucuaacugaguaaugguacacaaauaccuguuagagcuguaacaaccaccugacccauuaaaaaaaaggccaagauucaagcugggugguagugguggugaugggcaccuuuaaucacagcacuuugggaggcagaggcaggcagaucucugaguuuaaagccagccagguuuacaaagugaguucagggcuacacagagaaacccuguguuggaaaccgaacggccaggauucaggacuggagagauggcuuagcaguuaagagcagguucuuacagaggguuagaguucauuucucaggcagcuugcaccugacuaugauucuagcuauaggaguaucuuaaaccucuggccaguuugggcaccugcauacacacacacacacacacacacauacacacacacacacaaauucuaaaggccaagagucccguguuuggauuggaccaggacuuaaccuugcugugugccacuucgauugccagcgggugauggugaaaugcauucuaagcucccaguucacauccaacagacauucaccagaaguuucugagcaaggacucugagaggccagggacagcacaagcccucaugggccaaacagccaauggaggucugugcaggcagcugugaaauucugccgucgcguucaagugguaauacuugagauacucuuaacccagaaauugaauggaauguuaauaauaucucaaaccuuaaucucucaguaacacgucauuauguuucaguauaauuagauauuucuuuggacucaguauguguaucuaaauuucucuuuuaaaaaaaaugcuauuggugugaguguguguggggugugugccugugugcuuguauguucauguuuaugugaguacccacagaggccacaagagugagaguuacaggggcuugugagucaccugacauaggugcuaggaacagaacccaagcccucugcaaaaaaguaggacuuguuuuuuggucuuuugagacaggguuucucuguguagcccuggcuguccuagaacuuguuuuguagaccaggcuggguucaaacuccuaagugcuaggauuaaaggccuguaucaccagucccggcagcaauugcucuuaaccacugagccaucucuccagaacccccccccuccccuaaaauguuuauuuagaauuccauggccacugaaacccucggguuggcccaaaagagaacuuuauucccguugguguuaugggaagcaggaggaggcuucucacauuccuaauauuuuuuuuucauagaacaagccuugguuuuuauuacguuaaaaaaagucucauauuaauuuuauuuucugacucuaugcuugugcuucaacguuucuacaaugauuuuuccacuccucaguaagggauacuauuacggggcuuugagucagccuaguuuuguuagagucuguauuuuaggaaagcuuaccacgguauggcaagugagagccuccaaacaccgucccuguaagagcaaaaaugauauuucuaguauuucaguccuugcugcccccccccacccccgaagucaaaauuaaauuuaaaggaaugaugcuuuucugaaauguguguggaugucuccaaauacguucacucagccauucauccccagcaguuaugugggugucuaaccugguauagaggccgggacucagaaauaagugauucucugaaauaauacgcucauaguucccucccacacacugauggcucccaggagccuuggagaccugccuucauagaguacuggcgguuguugggggcagauccucucaagguugccgagggcagcgcuuuggcguggauguauuucacccacgcguguccgggucugaauuccaauuuuggcccggggcagugggguuggacugugcuggccuagaaaaucauuuccugccgucaucgucacaguauccgugguugugcaagugcccucaucgggaaggaaguggcugaugggcuguuuguuuuggcugggggcucgcagauggccucuggggagagggccgggugagcugggcacagaucucagggcgccccgggcagggaccugagccaggcccucgcgggugugguaggcuccugggauggucggggaugcgggucugggucuuuagugaaggagcugauccugagaguagcaaagagagucucugcuuuuguggacucuagguggcucuaggcuuugucauggaagaugaagccugggaagggacaggcugaaaaggcauuggugaugcuuggucaugagaagacaaaagccaucagggugggccgaaugaucuccagccucccccccucccccccguuuuguuuguguuugccuuuuagagguguucguuuguguguuuguuuguuuguuuguuuuaauaaaauuguguguguguguguguguguguguguguguguacacgugugcccgcgaguguaugcagguacccuaggagaucagaagagaguaucuaucagauccuguggcucuggaguuacaggcugccuuacauggucacuggcaagugaauucugauccuauggaagagcaaugagugcucuuaaccacugauccagccuuuguguauguuuuagaacagggucuuacucuguggccccagcuggccucuuaaguaccagucaucuugccucaagccugcugagugcugagacugcagacaucugccacgacgccuggcuaagauccagucgucccaacaagccagggagagagccaggguggugaagguuuguguucccagaaaaccccaggguucaagccccaccaagacccuuuuccugggccaggacuucagauccaccggaaagcgcacagaucuaggcuucccacagucuccagcaaggucucuugcauuuaacagggagacgagaaucucacgccuacacucauucccgucaggcaucggauaacacacuugucagcccacauguuaaaccagaaggaaggacaugucuggaaaagaaggagagaggaauccaucccguggcgacugcacagcaaagggcagagcagccugugcugcgggcaaaggguuaggcaaaagcacuugaagcaauggguggcccacaguuuggacaggcaggaacugauagcugcugagcaggaggaaggagaggagagagggaaacccaccucagguuuuugguagggugaagugggguaggacugugugucucgaggggagggauggcuccacccccuugcccagagucccugugucuacaacuauaugggcacagucuagcagagggaauguagggugaacugcugggucuccagggcugaccccuuagcaaaguggagcuggcagcuucugcugacucaaggacauuuccaggcuugaccuuaaggccaauuaaaaacagcugcuucucuuggcuggcagccccugagccaggcucuggcucucccuggaaugacagccucaccucucccucuaugugaccuggggaggggacuaauaagagggaugcugaaggacugaaggccacacugcaaucuuuaggucagaucuccccccccccccacccccuagagucaccagcucuccaagagcuaagccagaugguggccggggccccaguuucagauuccagugucuggccuuugggccugcgguuccccagccuggaacacccuccuguccucgccucugcuccagcgagccuucaggauuucguagcacaugccuuucguucaacagcgauuuccugagucugcugcugcaugucaggcaccgggcucaaauuagcuccucaaccgcuuccuucagcagcaaugucuucagcuuguccuagagagcagccgguuagcuaagggcucccaccucuggcccggucugcucuggaggagucugguaagcuucaggggcagcgaggagguuucuguggagaaauaaaacccgccuugccacauugcuuuaaaacccacucucugucugugcaugggaauaaguuuccauggugauagcccggacaucugagacauggaaaggguggaccaccgcuuuggcaguaccagagagauuccugcuauacucuggugaccuggaaagccucuuuccauccaacaccuuccuuccaaccaugcagccugaauuugggcugacugguuugcacguguugauguguggcuuguaacucuugcagggauugcuucaggauguucaucucuucggcuucucuguaaacagcucaagggcagaggcccugucaucucauccacauuuaaucccccugcaguaccuaggaaaggacaggguugucaucagcauggggugagagggcuggcagauggggggagcagccagaaggguggucaggagaaugcaaggcaggguccagccuccuccaaacggaucgccauggcacugcagacccaaggaacaggccuagcaaaggcaaagggaucguggggccucagcauccugaggaggaaagugcugaagugggcucuggucccauagaucccugcaguuaccagaaaaacaggagcauaaagcagucaggcucaacacagauugcggcuguggcucagugacagagcacuugcucaguguaaaccccuggguuuaagucccuaacacagcaaaaagaaaaaaaaaagggggggaguggacaugauucugggugauuuucagcaugaagggcagagucugggagagucacggaggcuacggguggagacuggaugcccagaguucccggaaggcguuucuccuuccaguagucagcuauuuccucuuagguuacuccugaaggauacuguuggcaaccuccaucuagaaaucucuccagaaagaaaacuuucuuuauuccaggagcacgcacugacugauuggccuggucuaaguuguguugaguggccaggggcuuggaguacugucagcggucaaaagugagccuuggguccacccacagagugguggguggcuucuuauuuauauagaaagaggaggggugucagggggaaagaggagggagaagaaaggggauguucgcugggcaaacaaaaacaaaggacaagagacuauagccggcagcucauugaagcuaagaacugccaucucaguucagcacacugugaugaggacugggaucugucgcuggggccucaaggccugguaucaggccuggcaucugugaaauuucuuccuccucccuggcccuguuuuuguuuuuuaaaccaggucucauguaucuuaggcuguccuccaacuugcuauguagcugaagaagaccuccuccugccuucagcugggaucauaggugugcucuuccacguggaugauaugcuuguaugauucaaauauaugagcacugggugccguguguguuuguguguguguguguguguguaugugugugugugugugugugugugugugugugugugaugugugguguguguguguggugugugugugugugugagacuguguguguguguuugugugggacuguggguguauaugugugugugucuguguguguguugcuggcaauugaacacuggguuguguacuuguuaagccacuuauaauacaguuacaucccugauccugaaauuccucacaaacauuuguuaaauggauacaugacucacacccagccaaggcccggugcccaggucacugaggcgcuucaauuacuucugcauucauucgucccuacgcagcugcaacgugacagcuagcacugucccaggcaugagcugauucucagcaagaauacaaguagucacucugcgcugggcaggaccaucugagauccuagcaagagcaggaggcugaagucuggggaugggcauuuucacacucgacacuggcagccuguacccccaagcguguggguguacuuggguaugaaugaggcuggaggggcccuuuggggacauaagaccucugcaccuugaguccccucuugccugauccauaggagcuugaugagggcacggauucaaaggaaugggagcagcucucagcaagucugcauagucuucccucccugauuggcaguuucugcuccaccaaggcuguguccguccucucuccgagagcccuugacuuggcugagucucggagagccuccuccgggaacucucuccgccuuguucuuugcucuuuagcucucccaggccuuuguuccucaucuacgaccuguucucagucacuaacacaguagcucaugaccugcauuccugcccucugccuccagaucccgagaguccucagagcucugcccugagcugccuuucugacuccaagaaggcaacagauuccucucagacacacagccagacacuuggaauuuaagggcuugucuuucucuaacuggauuacaaaucccaagagagcaaaggcgguggugggagcugggaauuucccuggguccaucuugccugaauauucuguguacuguagcaagggcuccaagaaguuagauggaucugaacccaggacuaggguggucauaggaggccugcaaccuugucucgcgggauaggagggaacucaggucuugaagggcgcugugguugggcaucccagcuccuucucuggguuucaguuuucccuauuaucaagugaaaggggcuuggaguggucuuugcuaaccaguaugggcucuucugauucuuccauuggacaugaauuaucacaauuuaagucugacuaggauugggcuggcagacauguggucaucugucugggaacaagagaaagauacugucccucugggagcccaaaccagacagaaguuuugagacucacugucccguccuaucuccaaaaaucauguauaaaagcaagccauauuuucucucuuuuucggucccagcuaugaucacuuucauuugcugcugcugucuucccuggaguggaguggaauuuuagagaagaaaauagccaacuuggggguugugaugaugguuuaguggguaggaguguuuucuguguaagugcaaggacgugaguuuaaucuccuguguccaugaauuaaaaggaaaaaaaagagucagcucucucucucucucucucucucucucucucucucucugugugugugugugugugugugugcgcgcgcgcgcgagugugcgcaugcacacgcacucgagugcucaucauaaccccagugcuauguggggcagagauaggaggauucuccagacuuguugguucccagccuagcugguucagugagauuugucucaaggagcagagaccgauaacgcagcacauuggccuccagacauggcauauggacuccauguacccacaugcguggcauguguacacaucauagcacguucacacacagguacuugcacucacacauagguacucaaccuuaaaggaagauuaggcaggucuggaacaaauccugggccgguuguauuucacuacuccagcaaccgagggugauuugaagguguguucaucacaaaauaucacaguuaggaggguuuuauaacaagaggaauuuaugugguccuggauuuggaggccaagaagccaaagauugaggagugaagaguuuuggugucugguagugucuaauuccucccacacuauuuccucauagguuggaagggugggagagucacuuagcuccgguuggcuuugaacaucauuaaguaaccaaagaugaccuugaacugacaccccuccucucacccccugauugcaguggugggauuacaggcaugcacccaccgugccugguuuguguggugcugggaauugaacccaggacuuugugcaaacuaggcaagcacucuaccaacagagccacacccacagcccaacccuugggagucuuuuauaagggcaugaauccuauuaauuaauguuaugacucuaauaacuucagcacuucccagaggcccacacccuaacaucaucaccuccaggguuaagauuucaaaauagauguucggagagggacauaaauacgcagacuguaggagaaaggaagacucagauuaagggcagagggcccaguauaggaaguuuaacuguggcagcugccuguacuuugggaagcuccugugcaucuugccagagaccacucucuccucccucacacaaagagacaugcuuucugugcugucaggauagaggaacagggcucuaccagaccgcccaccaggcuauucuggcaggagcuuauggcacgauguauuaggaaaaccaaucuagcaguuuggaugggggagcagaacggcaggccgauugguuguauuagauaugagauuuauucauguauauacacacacuuguuacccagcaucuccuaagcacugcuaagugucagggccauacgagcuaagugucagggccacagugguggagaagccaucaggagcuuagaagcaagaggggaaacaagaaauaggacaagggggauaauaaauucugguucuagaaauggcaggcuaacuuguugaagucuaaccaugaccaagaaugcuuagagacuaagaauaaaauacagcauaugguggucugagggcacuggagaacaacuaaaaccagacagauguagagaggggaaaauaugcgaaagacaaaaugaagguggguaagauaggugacuuagcuggcaaagaugccugccaccaagccugggggucuggguucaagucccaggauccaaagaguggaaggagcacacacacacacacacacacacacacacacacacaccaacacugugugugugugugugugugugugugugauuuugugggguuuuuuuuuuuagacaggguuucucuguauagcccuggcuguccuggaacucacucuguagaccaggcuggccucgaacucagaaauccgccugccucugccucccaagugcugggauuaaaggcaugugccaccacgcccagcuugugugugugaauuuuaaaguguaauaaaaaauugaauaaaaagaaaguauauucuuaagaaagaaagaaaauuagaugaguggcguguugagcaacccugagcacgcugcccagcuugagggucuaaucggggcugcagaaguggagauaugaguuuagaguuccagaaaggcuaaagaucaacagggaaaguucuagaaagggagccaucauagaauugcuuuccacagagcucuucaaagccucaguggucccuaaguugugcauaugcaggcaaaggcuccagguccccaaguccagccagcagcagcagcuggaaggagaaguuuagguuauuuccuggacagaguucaaaacaaguacaaguuccaccagucagaggggccuggucaucaucugcaguuuucuccuaaaaucccaguacagccuucaccucaggacugagucgaaggauaagggguacacccuaagacucaaggcaugacaaaugcugaaacccagcuuccacaggaccacgugauccacugugaauguaacugccugccaaaugguacucagcauucuuuaaaggaagauucaaacccaucauauucccucucgcacaccaucuacaaggcccaacaugcaauagaacacccaugauagcggauaugaaauaaaacuuaguagacaugggggcuggagagauggcucagcuguuaugaacacuugcugcucuuccggaggacccaaguuugguucccagcacccacauggcagcucacaaccaccgguaacucuagcucuaggggauccagaauccuuuuaugguauccuuagguaccgcacgcacgggauguucaugcauacacucgggcacacaugcauacacauuaaauaaauaaaucuaaaaaaaccaauugguggauauuauccacugugacuaguagauaauaaaaauugccagaagccgggugugguggcgcaugccuuuaaucccagcacucgggaggcagaagcagguggauuucugaauuugaggccagccuggucuacaaagugagcuccaggacagccagggcuauacagagaaacccugucucgaaaaacaaacaaacaaacaaacaaaaaacaaacaaaauugccaaagccgggcgugguggugcaugccuuuaaucccagcacucgagaggcagaggcagguggauuucugaguucgaggccagccuggucuacagagugaguuccaggacagccaaggcuacacagagaaacccugucucgaaaaaccaaaaaaaaaaaaaaaaaaaaaaaaaaaaauuuuuuuaaaaaugccaaauaacauaggaaucaaguucacaaauaacucagauggaggggggaucaaaaguauugcaaaaaaauuauaaucaaaccauaaaauagaggauaacuaugguuuauugggagaucagagagaguucugaagaauauauauauucuucugaaaugugaguugucaggcgaaggaaacaaugcaagggccuugagacuggaaacuaaaugggccaaagaaaucagcacagcuugagugaagagagcucgugugaucuaaacucaggcagacaguaugacuuccguauuagaaaagucaucacucagguguuaaugugcuucgaaacacagggaucaucuuaguuacggcuuuacuugcugagauaaaacaccaugaacaaggaaaccggggaacaaagguuuauuuggcuuaggcgcccacaucauugcucaucacugaaggcagucaggacaggaacucaaggagggcaggaaccugcaggcaggagcugcggcagagcccuuggagaggugcugcuuacuggcuugcucuucauggcuugcucagccugacuucucauagaauccacaaagggcugggcccucccccaucaaucgcuaauuaagauaaugcccuacaggcucgccuacagugaucuuauggagguauuuucucaguugagguucccuccucucagacaaccuuagcuugugucaaguugacagcacgguaggacuuaguggcccauaguaaggagcuugaguuuuauuugaaaaaugaugaauugcuuuugaaggaauuuaaguaagcuauuguuucuuuuuuucucuauuacuauaagguuauucucucucucucucucucucucucucucucucucucucucucucuguauguguuuguguauuuacauggugucuuaguuaggguuuuauugcuguacacagacaccaugaccaaggcaagucuuaaaaaugacgacauuuaauugggacuggcuuauagguucagagguucaguccauuaucgucaagauggaagcauggcagcauccaggcaggcauggugcaggaggagcugagggugcuacaucuucauuugaaggcugccaggaacagacugagcauucuaaggcagcuaggaggaagaucuccaagcccacccccacagugacacacuuccuccaacaaggccacaccuucuaauagugccacucccuaggacgaacauaugcaaaccaucacacguggcaaaugcuaccagcugaaccaugugccuagcuucucacuuuuucuguauguguggugcaggaaauuuaacccaggacuuugcucacuccuccacugagguauauccccagccuuuuauuucaauauuuaaaagccaauuauauuucacauguuuagcuuucuuuaaauauauuuaguuuuaugcugcauuguuaguauuucuuuuuaguuuguuguaaguuccuuuaauuugucuaaacaugcucauacuuuuuaaauuuuuuuuuuuauucuuuaaucuuuuuuuuacagugcagucuuuaucccccuccuggucugcccucugauuguuccacaucccauaccuccucccccacuacucgucuccaagaggcugucccuaccccacaaguuccccaccccuaccccaccagaccuacccacucccuggggacuucagucucuugaggguuaggugcaucuacucucacugagucaagacccggcaguccucugcuauauauguguugggggccucauaucagcugguauaugcugccugguugguggcucagugucugagcaaucucugggguccagguuagcugagacugcuggucuuccuauaggguugcccucuucuucagcuucuuccagcuuuuccuucauucaaccacaggcaucaccuacuucuguccauugguuggguguaaauaucugcaucugacucuuucagcugcuuguugggucuuucgaaaggcagucgugcuaggccccuuuuugugagcacacauuauuagcaucaguaauagugucaggccuccccuugagcuggaucccacuuugggccugucccugaaccuccuuuuccucaggcucuucuccauuuuugacccugcaguucuuucagacaggaacaauucugggucagaguuuuugacuguggcaaccccaucccuucacuugaugcccugucuuucuacuggaggugaacucuauaaguucccucuccccacuguaggacauuucaucuaaggucccucccuuugaguccucagagucucucaccucccaagucucugguacauucuagaggguccccucaccuccuaccucccaaaguuuucuguuuccauucuuucugccggcccucagggcuucaguccuguucccccuaccaaugccugauuccccucuucccguccauguccccuuucccacccaggucccucccuuccucccucccacuccccacccccaugauugcuuucuucucccuuccaggugggauugaggcaaccucacuugggcccaucagcuuguuaaccuucuucaguucuaugaauuguauccuggguauucuguauauuuuuggcuaauaauauuuuucuuauaguauauuaauauugaugaaagcucucuuuauacuaaggaauuaacccuuugccucuaauaaguugcauguaauuuuauaacaugauuucccuuuuuauuauuugagauagggucuucuguagccaagaccaaccuugaacuccuggucuuuuugcccucaccucccaagugcuggguucacaugucugugucaccaugcuugucuaccauuugaguuugacuuugcuuuugacauuuaucuuaccuugaaaaacucaugugccauggaaaccauuccuuuuccuuuuggcuuuccgugcuccaauauuauauuaaguuuuucuagaauacguuuauaccuuuggaaggucauggugaaugcauucuaaggguuggagcacaaaaauagacagaauguagaguuuggacugaagagacugaguccaaauugcagcuccaucuuucaccagccuugggccggugcucaucaaaucucuucauccucugccucuaacucauagacauuguguaccagauccagucccaaacacuuagcuguauaucaguuauucuacuuacuaucugaaguaguuuugcgauggagaacucugucagaaagagguuaggcucuugccuaaguuacccaugcacuucacaaguuuuauccuggagugcuaguaccucgcuguuguaguuucuguugcugcuaugacaaaauaaacuuacaggaaaguucuguucacaguuccaugcuauaaucaaugacuucagggaagucaggauagcaggagcuugcagcaacuugucacaauauuaaugcaugucuguauuaagcucaguuucuccacucuuaggcccuucuggauuccuugucuaaggaauggcgccacccaucuugugugggucuucucauuuaaauuaacggaaacaagauaauuucccauagacacucacacaggccagccugaucuagauggcccucucaccgagucucucuucucaguugauucuagauugugucagagugguauuucagacuaaccaucacaguaguggauacaaacccucucuucaggcuggaaugugccauaaguguguguugugugcagaaguggcagccugagcgcaagaggagggcggugaaguguggguguuagagagacccagguuuguuuacugucugggggacacuguggaggacguugugucucuaagccacagucuuccccaucuuuuguuuucuuccuucuuucuuuucucccuugagauaccacucacauauuauaacauugauccacuuauaaugugguuaauuggguuuuagaauauucccaugagaacuuaauucuaaagcauuuucaucauuccuccuacccaagaaauaccuuaaaaauguuuuuaagcaaccauucccuauuccuauccccagacuuccacaaauccauguuaaguuuuguguuuucaucugaaacuguugugggguuagguuggaaugugugccuguauauaugugugcacaucugugucucauugacuagauuuugauaucuucaaacaaacaaacaagagacaaaaccaaaccaggcauucaagaguuguggggguaugaguguuucaguuaggaggaagggaggagagguugagaaagaucuagaaggaugaacucuaagaagcugagucugugauguagacaccuccacgaaagccuuguaaggucuucaggaagguagucaucuccuucauguucaaggcagccgaagaaccccuguggaugccugaaaccauaguuaaugccagaccuggaacacaauguguuuuuccuacaaauacacgcuggcgauaaaagcuuaauuaauaaauugggcacaguaagaaauuaaugauaagggcuggagagauggcucagcgguuaagagcaccgacugcucuuccaaagguccugaguucaaaucccagcaaccacaugguagcucacaaccauccguaaugagaucugacacccucuucugaugugucugaagacagcuacaguguacuuagauauaaaaauaaauaaauaaaucguuuuaaaaaaaagaaauucaugaugaggaaauaggacaauuauaaaaggacuuuaaugacagcuauuuaaaauuuaaggauuagccagauaguggugguguacuuuaaucccagcacucaggaggcagaggcaaaaggaugucuguuaguucaaggccagccuggucuacagagcaaguugcaggacagccagggcuacacagagaaauccuaucuaaaaauccaaaaaauccuuagggauuauuuauuucuagaaauuuuccauuuaauaucuuuggacagcaguuuuuaguagauaacugacacugaagaaaaugaagccacagauaaaggcacauguauauguauaaagcaucuguauguguauggugcccauauauguguauggugcccauguauguguaugaagcaccuguguguaugaagcacauguaugugugugaagcaccuguguguaugaagcacauguauguguauuaagcacauguauguguaugaugcccauguauguguaugaagcaccuguguguguaugaagcauuggauaugcuguguagaguuggguuugauuuuacaguggggcagaggccuggguccugcuuccagguggauguggacugaacaggaauggacugugccaccucuggguacaaggaccauagcggugccauucacucuaccuuggacgguaacagagagcaagcgauuaacacaugagacaaaugcuguccgacggccagugguuuguaguaggccuuagcaguuaucaaggccgagguaugaugacuuccuguccugccuuuccuuccagagccugaugucuuccucaucuucagccaggggaugcagggcugucuggaggcccagggugugcagguccgagucaccccagucugcaaugccagucucccugcccagcgcuggaagugggucucccggaaccgacucuucaaccugggugccacacagugccuggguacaggcuggccagucaccaacaccacaguuuccuugggcauguaugagugugacagagaggccuugagucuucgauggcagugucguacacuaggggaccaguugucccugcuucugggggcucgugcaagcaaugcauccaagccuggcacccuggagcgcggugaccagacccgcaguggccauuggaacaucuauggcagugaagaagaccuaugugcucgaccuuacuauggugaggggcaacgcaggcaagaagugccaaagugauaggucuaggauagcaaggccuuugacugaugugggcccuugacagucacuguuuaauaagaauacuuuuuaaauaauuaguaaaauuaacuucaaaggguuuaacuuacuuuuuaaaaauaauuuaaaaauaauuagugucuggugagauggcucagucaauaaagugcuugucacguaaggaugagguuaaaucccagcgucuacauagaaaagauauauguauggcagcaugccuauaaucccaacaccaggaaggcagagacaggaggauccccggguagccuugcugccucuauaagcccuagguuaaugagagaacccagggugugcuggacggugguaauucacaccuuuaauccuaccacuaggcagaggcagaggcagaggcagaggcagaggcagaggcagaggcagaggcagaggcagaggcagaggcagaggcagaggcagaggcagaggcagaggcagaggcagaggcagaggcagaggcagaggcagauagaucuaugaguuugaagccagccuggucuacagagcaaguuuuaggagugacacagagaaacacugacuuggauaauaaacaagcaaacagacagacagacagacagacagaccuauaauacauagauaacccagauggcaaaaaaaucagaagcaaacauugcaaauaaaauuauaaucccauaaaauggaggauagaugguuucuuaggaauugugaccuuugugaccuuuucuuuuauuuuuuuucuuucuccucugaaauguaaaucaucaucaggagaaggaagcauugcaaagucuugagacuggaaacaaccaaacaggggcauagaggucggugcugacaucuaguaucaacaggcacauacaugcauaugaauacauaucugcuauauggaaguacccauguaugggugugcacacaaauaaaauuaaaaauuuggggucagcaaaguggcucaguggauaaaggugucuguuacuagggaccuacaugguagaaguagcgaacuccugaaaguugcccuaucucacacacacacacacacacacacacacggacauacuacauagacucacagacucacacagacauaccacauagacucgcacacucauacacaaccacagacacaccaaauaaacgaauaaauaacuaaauguaauuaaaaauuugaagauuaaagagcaaaaaucaagaaaaauuuaaaauuagccugcaccaucccauaaaguggcagaguacacagaggcaaggguucucccugugccuagggagaguggcguuaugacaggaaacgggauggcuauggaagcuaaucugauuauucugguaaaaggcuaaugcuauaaagaggauugcgcugagccuccaguguguuaagcccaguuaagggccuuagagaggugacuuuuaagacauggcaggcauuguggcucaggcuucagcaggacaggagcacuaaggccagccuugacugcacagugcauuggaguccaaccugggcuaugucucaaagagagggggagggaaguggggcuguaagcacuuuggacugagaggagauaggagaagcagcuaagagagucacuccuuagcuguaugugucaggaugacaauagaaacgugucauuggggcuggugagauggcuucaugcaugaagguaacuuacugccaaaccugacaaccggggacccccguaguggaaggagagagccagcucccaaaaguugcaaucaauuuuuaaaaauccugauagcauauuaaaauaacuaaaagaacguaagauuacacugcuuauaaagcgggauggccuaaaguuaagugccucugccucccgcucacucuccagagcaaucuuguggcagcaccacacggguuuugcagguaguuaauggggaucuuagucgcucaagcgcuugucaccggauccaucguuggacagagaaggauuuucgcuaaggcggugaggugggauggaccuguggggcuccaggcaccaaggcauggcucucuuccccuguagaggucuacaccauccagggaaacucacacggaaagccgugcacuauccccuucaaauacgacaaccagugguuccacggcugcaccagcacuggcagagaagaugggcaccuguggugugccaccacccaggacuacggcaaagaugagcgcuggggcuucugccccaucaagagugagaagcccuggagggaggcuggugaugaggagcugggaugggggugggggagacuucagagagggcugaagaacggaugguguagcuugugggauuguggcgggacaguccgucuguggugguggcagguaacgacugugagaccuucugggacaaagaccagcugacugacagcuguuaccaguuuaacuuccaauccacacuguccuggagggaggccugggccagcugcgagcagcagggugcagacuugcugaguaucacggagauccacgagcagaccuacaucaacggugaggugaagggcagcccccuguggcugaggucugacccaugcgggggaugugggggacuccaggaagucugagaucaaccccuccuucucucaccacaagacaggacacacaccaccaccauuccugccccucacacucuuccaucuuggggcgggcagguggagagagagcgguggugggcagggauucccugucucaguaagcacucuuucugacagggcuccucacgggcuacagcuccacgcuauggauuggccuuaaugaccuggauaccaguggaggcuggcaguggucagacaacucaccccucaaguaccucaacugggagaguggugaggcauggagaccccauggacacugggcuuccuucuacccuacucuagaggugggaagucuggguuuccgcccucuucuggaauggccccauagccugugaagugccaugguaugaaaugggaacugcuuuugcccucucagguagaugaguucugguccagggcuuggugagcagaucugguuuuagucucguucacagcucuuaggcacauagaugcacccauaaacccagggccuggaagauaaguuuacauugcugauuagggaguucaguguggcaugacccagugguguaauauacaaagguggauggaggcugggcuucucuggcuaaugccgacauccggggaaguggagggagagaagagacccagaagagggcuugggagggacccaauuugagcuucccuuuccuggggugcuggcacccugccugacccacagaucagccggacaacccaggugaggagaacuguggagugauccggacugaguccucaggcggcuggcagaaccaugacugcagcaucgcccugcccuauguuugcaagaagaaacccaacgcuacggucgagcccauccagccaggugagccuggucacaaagggcuaaggacaucaggaucccagucuguucagccuuucuuauucuacagauacaaagugacuuugguucuauuaauuauucagcuagucuggaaaacuuggaaugugcccuuagucauuggguggacuuacucugggaacugugucaaaggcuggcaauauucaccaggcccgguagagacugcagccugaugggggagaggggggucacagacaccuuaauacuuagaaugcccugagcugugggcuaccaaaauauguaauagacagagcuggggugagugauugagcaccugcgagcugaggguuuuauaaaugugauguuggacuugagguuuucagauugacaguaaguuuaaaagacagaaagagggcugcggcaauagcuccguucuagaccugaaggcauccauauugaaauacaccagguguggugggagcaccuguaauugaaguucuggggaggcagagacaaaaggcucccuguggcuuacugaccuccagguuagccuacuuguuaaauuccaggacagcaagagacuauaauagcaauaauagcaacaauaacaauuagagaaugacccccaaggaaaacccuaguuugucuucuggccuccacaugcacacguuugcaccugcacgugcacacagagacagagggaggugugggaggggagcgauuccagccgugggagcugccuguuggaacugcuugucacuaagguauagaguuuagggggaagcagacaccagcccagcagcaccuggaggccuguuagcaaagcagacugggaggacccgccccagauuaacugaaucagaaccugcauuuaacaugacaccccccucccucgggugauucauaagcagggcguuugacgugagugcagaaaggcagguugcagccggucucugaagucugagugggacuggguagcccaugggaacuuucuggcuuuuaagccuaagagugucuugcucaaagguaugauugagagagguaagucugagggccuccugagagagauggaguguggggugauagacaggaccugcuuuggggacugccccuuccugacauguggccuuggcucucugggauguagaauccuuauuuucacauugagaauggaugcauuuccucuugcaaaguuaguguaaagcuggagcccugguuuggcuuggcccaaggagugucucuaaggcuggcauuucccaggcaguguaaacaacaggggcuacugugcuccggcuucuguagcugugggguugcuaaaguagagauguucacagagaaaauauggcgugccuguggagaccuccacagagaggaagacagaggggacccugcaaggacucuuuccccugucacuugucuggggaagcucuccuccagccgcaaggaccuaaacacaagucuguggcuuggauuugccuccuugcccucauucggcaccccagauguuugcagaagacccauucuaagugaauggccagucucacugugaaggacaugucauuuccaaagcaggggacacauuuccacaggacccuuucuucccucaggauccugggacuugaauagcuacuaagcucuguccugggcugcagcacagucauaacgcauuggcuaaugaagggugacugcuaucucuuacacuguggagcuccccuguccccuuucucagcccaccuugaggagucucuagucagaggcaugucuggaacaccccucaguugaccgggauggagcuggucucagaaugcuaaucuggggcagugcauagcauaggcucacauccucacuccuuccuagucagaaauccugcccgagccugauuuuguggguggcuugaugaaauuguguuuucuucugccaagacccaagugaggacuuguucgcuucaguugcccucaaacuccagucccuagcagauuaaaaccccaaggcaccucugugggugcaggggagggacuucagaagcaagaagagguguggagagggaaggagcuagugggcggcucuagaaaggggauguguccagauuuuaugggcccugcaauguuccuggcugcucuccccaccucuggucagacugggccucacuaucagccaagacuccuuucccuuguuucuuuuauccaagacugcagaggucaacacagagggggugcccuguggaccuguuugauggaggcuuuaaaugaauaaaugaaugaauaaagcauaguguccuugcgcuaaguuugauugucguagcagaaaacccuauuuacuguagauacugacuuaagaggcuggugcgucccaccacuugcucaucucucccugagagacucagucagagauggucuggcuauaucugcuauuccuggguuuuaaauauccuaaggcuauugucaugaagaaggcagaugugacagaugagacagguuagggauggcgggcgugacacacauuagauucugucugagcacuuacacgugccucuccacagaccgguggaccaaugucaagguggaaugugaccccagcuggcagcccuuccagggccacugcuaccgccugcaggccgagaagcgcagcuggcaggaguccaagagggcgugucugcggggugggggugaccuccuuagcauccacagcauggcugagcuggaguucaucaccaaacagaucaagcaaggugaggggcugcuuguccuuaguacuggguggaggcgagggucuguaugccugaucccuuccuacuuaggaagcacaaagaauuuucuuuccuucauugccggccuggggcugaccucaaggucuucucccuuuccuuucucuccugcccuccuguacuccagagguggaggagcuauggauuggccucaaugauuugaaacugcagaugaauuuugagugguccgacgggagccucgugagcuucacccacuggcaccccuuugagcccaacaacuuucgugacagccuggaggacugugucaccaucugggggccggugagacuuuccuuucucauaauagcaccaaagcacccccuccacccacaugcucccagugccucgucccccccccccccacugaaaaauaacugucuauuaucagcccugguguaccccaggccccuccuuuccacaggaucgccuggcaggguuagagccccaccuucacccccacagcuaagucaccugcaggacugggagagcuaauuuuccagaagccuuaggcaagcauggcgggcccauuuuuggucucuugccagcuguccccuccuaccagcagauggcaccagaacccaugcaauggcguagcugggcgagcaaggccacuggguuccagcccuugcccuccaggaccuuucucaguucaggguucugucuucucaagaaaucauggaugauuguugcuuugccgugccuugacucagauccggggcagggggcggggggcagggggggggaagcgggaguggaaacugaggcagaguuuugacagagaagagccccgaggccugggcagagucuccugcuuucacaugaggucccagggccuaagcagcagaucuguuugcacaaagggauucuauauaaaaauuuaaaugauucggugagcgucuuguaugugccaggagucuccugauuaaugagaugaacagaugcugugcugucaggguggggcguaaaggcagacuccaugcugacugggaggccccagggcccaauuccucgucaccaucugagauucaggucugggcacaccagccuuuucucucccagguucuucaguagucucagggaauaagaccuaugggcuuaguuugcacaguucaguuaccuaagauuauccacaguccaaaguaaccagauagagaauuucacgccugguaccugcgaaggucagaagauggcaccagauccacccagagcuggaguuagagauguugugagccaucuuguaggugcuaggaauugaaccuggguccuccggaagagcagcuaguauucccaacugcugagccaucucucccgcggccucugaacgauuuguuuuuccucuaacugcgaagccuauugaaccaacucugcucucuccauucaacagccugggacauagaaaaugaggcugcuugcuaggaaucacacagcaaguucagguucaggucuagaaaauggacuggaaaacuuggguggagugagagauuuggggugagucuucuugauccugugucguaggaaggacgcuggaacgacagucccuguaaccaguccuugccauccauuugcaagaaggcaggccggcugagccagggcgcugcggaggaggaccacggcugccggaaggugaggguguuuuugaaacuguccaagguggagucagccccaggggcucccuggguggguggggagagacggaggaaacccugcagccuugcccagcauccucuugguuucccaagagggaagguugccccuuccugaggguaugucuuugggggacagagaguggaguggggccuugggggaguagagggccccccaccccagcuccaggucucuuuccacaguugaguuugagaaagccaaauugucaagccuggucuagucacuguaggaguaggcggggcagugggcuggcucugugcaccccaguccucucucuucagugcaccagucugauggcagaguguguuuggccgucuucucuggaggagagaggccacacaguggggaaaacuuucucccuccucauccuuuagcccacugggcuccagcauuguuuuggguaaauaaggggggcugugaguugugaaggagggugaguaugugacaggccuucuccacccuacuuggcauggcccagccagugaguggucuaugggggaggcuacucauaacgcucacguugugguccucugugcagccacuccuuucugcagauccuuccccguuuuccuuuggauuaaacuccaacaaaggcccaccccuaacugagcucuccccaagaggcagggucacacuugcugcaggagagggaggaaggcuggcagggcuccagccgaggagucugggggucugugagcucggggcuuaucucuguccuggcgugaguacagugaagaggcaauuggaagccagccugggauguguguguguguggauaguguguccagggggaaacacugagagagccaggggucucugccuaggcccugcuuggcaucugagggccucccagauggcaugacagccacuucucuguuccuggugcuaacucuagagcugucucugcaccuaagguggucauuucucugguugaugcccuggccucccucccacacucccucccuccccaggagcaucccaccagacuccacucugcagagucccgagguccacccagcccucucuuuguccuccaucuguccguagcuucucagcucugguguccaaguuggaugcuauuuuuuccuaauguugauucuuuuucuuucuuucuuuuuuuuuuuuuuuucggucuuuuugagacaggguuucucuguguauuccuggcuguccuggaauucacuuuguagaccaggcuggccucgaacucagaaauccaccugccucugccccccaagugcugggauuaaaggugugugccaccacgcacggcuauaauguugauucuuuaucuuauuuuuuaauuagucaucauuacgcuugugcauauccuaugcguguguggcaugcacaugucagaaugcgcccgugcgcgcaugcgcacaaguagagagucaguucucuccuuuaaccgugggaucuguggcucgaacucagaucaguguagcaaaggccuuuuacccucugcgccaccuugccagcaccugguuauuuuauguauucuauuuccaugacuguguguguacauggguaaauucuuaugugugugugcccaugcacauguguauauguguucauguuggggccaaaggucagccuccuuauuuugagacagggucucucauuggacugggucucuccaguagguuagguuggcugagcagucgauccuccaggauccgccugccuucugcuccucaccgcugaggauaaaagcacaggcugccacaccugcuuuuuccaugggugcuggggauccgaacucagguccacgugcuugcuuagcaagcacuuuaccaacugagccaucuccucagcccgauuguuuuuguuuuguuguuuucuuucuuucuuucuuucuuucuuucuuucuuucuuucuuucuuucuuuccuuccuuccuuccuuccuuccuuccuuccuuccuuccuuccuuccuuccuuccuuccuucuuucuuucuuucuuucuuucuuucuuucuuucuuucuuucuuuucuuccuguaccaaggauugaacccaaggccccacaugugcuauaaauguguuuuuaucacugagguauauacccagcuucuugguuuaaaugcuacuuguuucucugagccacagcuuaggcagguccaucagcuacccacagcagcguuuccacccugauccaacaguuguuggucaugguagggagagcuaagaguaaccagaugcagaacuuaguaccggcauugcucucuggcaccaaaucaguccccucuguccugcacauagacaguggcauccugaugugaccccugcccaagcauuggcagguaaggguggcaucuuccucucacagacaccccucuucugcccucucucuugagccaggguuggacguggcauagcccauccugcuacuggcugggagaggaccaagugaucuacagugaugcccggcgccuguguacugaccauggcucucagcuggucaccaucaccaacagguagagaggguggacagaaguccuggccagccaucucccaugaccuggacugaugggaugauauccuggcauccugcccagagggacccagcauccuuugagccucagugugccccagacacuguauuuaagcuaucccaggguaggguaggagagggauagaugguucagguuuggacugaauggccaaggaagaguguggcaguagugggagucugguuacugugugaguucuuuggauccccguuucccugggcacauuccuggcugugcacaguacccgagcuucuggggugggguaucagccuuguggucaagggcuugugggaagccacuaguaagugccaugccuugacuggcucauuucugaagguuugagcaggccuucgucagcagccucaucuauaacugggagggcgaauacuucuggacagcccugcaagaccucaacaguacuggcuccuuccguuggcucaguggggaugaagucauauauacccauuggaaucgagaccagccuggugagcccuuaacacccuguuugacuggccuugaagcaggguggcugugguggacccagagcugugucgggacuuagggugaggccuucucggaaagcuguuccuuuguuccaugugaccugcuagcucuggagcccauggcccuccucagccccuuggcacugcuguuugccaguggggccuucucugagcccugguuucuucaucuuaaauugggauaaugagguauuccuuauagagcugaugugaggcuuaaauaucuauguagcuacggaaggggucacauaugcaaugugcucacuauuaauaucuguucaaguuucacauucauugucuuuuuucuuuuucuugagaaagggucucacuauguaguucaggcuggcucugcagcaauccuccugccuuagucccuugaauacugggauuauagguguguaccauuucaccuagcuucagucuccucuucuucuuccuccucuuccucuuccucuuccuucuccuucuccuucuuccucuuuuuuuuuuuuuuuuuuuuuuugagacaggguuucucuguguagacauggcuguccuagaacucacucuguugaagagguuggccucaagcucagacauccuccugagagcugagauuaaaggcauggacuaccacugccuggcucaguauuguucgcagcuucccuauaaccuaaugggguguauagugagauaggcucagaaaggcuaaguuuccccacacuguaaguagucauugacuaggacucugccucaugcaucccccuaccccauuugagugcugacccucccccucccccagcuugucccuguagagacaagcucuuucuccuucucaggguacagacguggaggcuguguggcucuggccacuggcagugccaugggacugugggaggugaagaacugcacaucguuccgggcucgcuacaucugccgacagagccugggcacaccggucacaccagagcugccugggccagaccccacgcccagccucacuggcuccuguccccagggcugggucucagaccccaaacuccgacacugcuauaagguggggacacccuauugguaugguggggguggggcagagggaagacaggagcucugaggaaguucaucuggggggaccuggggaccaucaugacccugaagugccagccuagauggcagaccagaguaauugccgaugaagaauuugccuguggguuccgaggcuugaucuguaguaaguguuuaguagaugugugaagaguugaggaagccagaccccagaguguucuucagaaccccaggggagcccacuaaaaagagaaucuccucguacagcaugggcaagaccguggguucugucccuaguaccucuucugggugccaagcggagguuugcauuugaaaggucuggguaaggccuggugauuugccaagcuugggagccaacgguccgguuuuuuguuuguuuguuuguuuguuuguuuguuuguuugaaauuuuaggauuugcuuuugagacauuguccugcccugcagaagucaggcuagccucagcucuuggcaggccugcuuuagccucccaagugcugauacaggcauaagcugcuauguccagcuucucuuguguagcccaggcuggccucaagcucacuaugugguugagaauaaccuugaacuucgaccuuuugccucuacuucccaaaguacuaggauugcauguaucagccacaaugccuggcuuccaaggccuuuuaauauauauguguaauauguauauauuacauauagaaacugaagcccaggggggaaaaaguccugucuucagucaguuguggcucugcuggguuuagagcccaacugaaagucuaaagaugagguccggggacucuugccaggagcugacagcggcacuugccuuccugagauagaauugucuuuagcaugaggagguggcagaugcccucuggcccacggccauagcuuagacagcuggcucugcuccugcagguguucagcucagagcggcugcaggagaagaagaguuggauccaggcccugggggucugccgggaguugggggcccagcugcugagucuggccagcuaugaggaggagcacuuuguggcccacaugcucaacaagaucuuuggguacugaaugggcgugguggccugcacuugggugggggcaggcauggcugccagauucuggguucugucacgcuuggggucagaaggcagggcauugacagugcccuuagaaggcccagcugaggcuuggaaugaccugcgucugucaaucaugccagaagcauccuguuucuuuuaaguugccaugguccccuggaaucuugguuggaugcacaggggcgacccacuuauaggagauccuguugcuaagcagugucacacagccagcaacguccuugcagacacaguucccaucucagguccaccgcccccucaauaaaccauccugagagacaaggagaaaagcugaaacuguucaggcaaagguugaggauggguccggaucccaucuuugccauggaggcucugaggacuguaauuuauggcacauggcauugugaucagucacuaucagugaaaaaaauuuuuccaaguggacccaggcucccugagaucuucauuuuggggacauuuccucccagcggucaagguuuuaucgccugacugguaacuacggcaacguguguucgccacucuuuucagcucaucacacggaugcuguucacaucccggcacccuguuccucacgcauccccaguguucucguguuggacccaugaguuaaguugugcguucaaugucacgguggguccgugaugaaacacgauccaaauccagguuuucugaguuccagauccuuacauuucucccacacccauaggcccagcaacuuccuaaauucuccaagcgaaaaagcagugcagacuccugcagacaggucaagggccagggaggcaggcuacugauuuuugaguuaagcagggcaccugcucaagcucgccuugucucuagggagggaauuucagagaaaacacacacacacacacaaauacacacacacacacacacaccacacacacacacacacacaaauacacacaccacacacacacacacacacacuacacauacacacuacacacacacaccacacacacacacacacacacacacauacacacuacacacacacacuacacacacacacacacacacacaaaccacacacacacacacacacacacacacacacacacacuacagugcuuucggacaacagguugcaaugucaacugugaaggcuucaggcaccggagacugcccgacagagagcuggcaucggccgggcgcuagacuugguccccagcugcucucaccucccuucucuuccguccccacccaagugagucagagccugagagccaugagcagcacugguuuuggauuggccugaaccgcagagacccuagagagggucacagcuggcgcuggagcgacggucuaggggugaggagccaugaggaggcaggauggggaggugggucgggcuugguuguaggugggcacccgcugggguauagcagggccugacacgggcagggguuuuggccaaugugaguagguuaaaaguaauuggguuacggacuggacacucgccaggcuuggcgguucucagcucagccugggcuucuugguuaccuguguguaaucccucucuuuccaguuuuccuaccacaauuuugcccggagccgacaugaugacgaugauauccgaggcugugcagugcuggaccuggccucccugcaguggguacccaugcagugccagacgcagcuugacuggaucugcaagaucccuagagguuggaugugguaguaaguggggcggggugggacagaugcuagacaagggcuuugaagcaaggaauuugggggaauccagcuccccucuaaccugacgcuuuuggcccuguuguuuuguagguguggaugugcgggaaccagacauuggucgacaaggugaggccccccccaggcuaccugaucccuaccuuugcccagaauaaaacuaaacaggucaccccaaaagagacucaguuagaacugagcacccacugcucuguuuucugguuuguggaaggagaaucaagccgggggccugucccagguuuaucuuugcaagccauuuguugcagcccugacuuugucccagcccagagcuuucaagggccugccuaguggccuggcaucugcucccacugcuguugcugcucccacaggccgucuggaguggguacgcuuucaggaggccgaguacaaguuuuuugagcaccacuccucgugggcgcaggcacagcgcaucugcaccugguuccaggcagaucugaccuccguucacagccaagcagaacuggacuuccuggggcaaaaccugcagaaggugggcgcgagaggcagcaaguauuaugggcugggaaaggaccaagguugaggacaggggagccgcucaccuugacccuccugucuccuuccccagcuguccucagaccaggagcagcacugguggaucggccugcacaccuuggagagugacggacgcuucaggugggagcacuagugagcagcaggugugggagggagcacacaugggggguggcuugcuguguucccaagcuagagguguuggcgcugaccaaacccagacagacagauagaccugcauuugaguucaacucugcuccucacuggcugcuuggccuugaaugauugagugauguguuucuggccuucguuuucuuaucugaagauggcaauggugagaccugucuagcuugcuuagcauucuugagacccugggauugauuucuggacuacaaaaaaaauacuucaaaacaccaacaaauguguguguguguguacauauauauucauauaugguuauaguuauauauagcuauauaguuauacagugauuauuuuagguauuuauuuauuuugagacaggcucucacuauauagccaugguuaccuauguagaccaaguuguccuugaacucagagauucccuugccucugcaucccaagggcugggauuaaagguauagucaccauacccagcuuuauuuuauuuuuaaagguuaaccauuacuguauuauuccuuuaauacugcaguauuccuuuaauuugucuuuuuccuguccugaaauucacucuguagaccaggcuggcuucaaacucacaaagaucugccugccucugacucccgagcacugggauuaaaggcaugugccgcuaccacuaccaggauuucuuuaaauaguuuuaauuuuuauugauuuuaaaauauucacauauauggcuucuauguguguguuuauacacgagugugcagauaccuacagaguccaacagaggacaccagacucccuggagugggaguuaugggugccuguaagccacccauguguguaugugugcugggaacugaacgguaguccucuggaagaacaguacacacucuuaaccgcuaagccauccaucuaaccccucaaugauggggccaguuucuaccuagauguacaauuuuuaaaaugacaaaaauccaugauuugcuccagagugcuauugcuugcauaccauguagguauucaugcagauacuaguuugucaagcuucggauggcaaaaugcuaagugacugcaucugcuaucguccaccugguuguugcuucucauucugaagacucugggggcauguugugugacaggucacagugucacuuccaauucucagucagacccacuaaaauagagcauucauguccuuaagauacaagaccuagcaaaaagcugcuggauaccacaguguucugacaacaagcaauuuuaagcccuuacuacagcaucuagcacgcacuggaugcuacaugaugguggcacucuccugucauaccuggggucacauuauaaagaaaacuggccaggacauggaccaagcauacgcuggucuacaggacucuagucagugccugccuuacgugaauuagggccuuugaggcaggaagaccagggauugguggagaucugcgcacuucuuugcuguaaggguuuucaggcgucugagagagguuagcguaugcuggguggggcuuuaaucagaggcuguaggucucuggcugcccugggcucugugcuccuucagccccauuccugguccccuucuacagcuuccagugcuguauauggaggaggcugaaucugugcucugugacucuguagguggacagaugguucuauuauaaacuucaucucuugggcaccgggaaaaccuagacccauuggcaaggacaagaaguguguauacaugacagccagacaagguaaggauaacgaggaccagagaggguguugucagcacaaagaaggggauaugguaaggguuaccuaggugggggggggggggggacuggucucuucucuuugugaacaaauccaagaagggcuauauccaaggaucaauggaugguccaugccuccaaggacacagaacuugagcucagcccauauucucagggcaugggaccaagagugcugccugcccugcccgacccuaggguaaccauucucuuuuccccuucacagaggacuggggggaccagaggugccauacggcuuugcccuacaucuguaagcgcagcaauagcucuggagagacucagccccaagacuugccaccuucagccuuaggaggcugccccuccgguuggaaccaguuccucaauaagguagggaguugggaagggacacggagagucagaggagaggaugggaacagguguuggcugagccucaggcauccccccagcuguucugccacaccuuucaucuguccgcacacaccucucugugccaaugaaagugagguuccuuggaaaguggcucaguguugguccaccagggagcaaaauuaucuaaauacuuuggugaguuuucuagaccaauaguugucaagccuuuugauaaugaacucuauuaauaaaacaaauuauugagcauucguacccaaucuguguguauauguuauuuauguauauguacaugugcaugcagauaaaauuuauaguuacuccuauacuacaaaacuaucaccacauggagucaaauaugcacaagaacagaacuaaaaacagauaaagauaaaaauaguaucuuuuaaaauucuccuauuagagccaggcaguggugguacacaccuuuaaucccaguacuuaggagguagaggcaggcagauuucugaguucaaggccagccuggucuacagagugaguuccaguacagccagggcuacacagagaaacucugucucgaaaaaaaaaaucucuauuaguaaaacaaaaauauguuugggccaugugacugaucaauuauaauaauuaauauuuaugcaauuuuaauaagaacauaugacuacauacauuucauuuucuuguuuugcagaauaaaaauccauuuauuuuucauuugauuuuauuuuuccaccgauacauaaaaacacaagaaugauagcuauucgggggaugccauguaauauuuuguacauucguacauuguauaaugcuuauauuaggguaaaugcaucuguccccugaagucauggucuuguuuuaaggaaaaccaucccaaguccuuccuucuagcuguuugacauacucaauauguucugcccugcaguuaccucacugcaggugacuuuaucguggcguuaccuuacugcacacuagcaccaaagaacuagauugcacauaaccguaccucaguacucaguggccaaccuuucccuguccccauuaugcccacugacugacucugcucucaacuuuuuuuuuuuucuuuuuggguuuuuaagacaagguuucucuguguagccuugacugucugggaacucacucuguagaccaggcuggccuagaacucacaaagauccaccugucucugccucugucuugugagugcuaggauuaaagccgugugcugccaccccuuuugagacagggucucaugcaaccuagguuauccuugaacucacuauguaugacugaacuuuugaagguccaaaugcaggaaucacagguuuaugcaguuuuaggcagugcuaggaauaggaccuagagucucugcaugccaggcaaacacuuuaccaacugagcuauaugccccaucagaaguuuauuuuuugcaugcuuaggugugguuggcacaugcauguaugugcacaggccagagguuaaccuuggguauuuccuuaauaauauauaaaccuuauauacagaggcagggucucucauguaagcccaaagcuugcugauuuggcuggucuagcuaagcagcuugcucuagacaccaucugucaccaucucccgagugcuggcaugacaaguggcccccaaacuuagagcacucacaugcgugcuggggauauaaacucugguucucaugcuuauccaguaagcacguuauccauccccacauguggacgaaaccacacuguguuucuuucuguguucaauuuuaaacauucuuucccuuaauuuuuauuuuuuuaauuuuaugccagcauguaugugugugcaccucuuaugggcaauacccauugaggccagaagagggcaugagagcccuugggacuggaguuacagacaguugugagcugcugcuguguggagcccaauccaggucuucuggggggagcagcugaugcugagccauccuuugcaguagaaccuaaagguuuucuuuuucuugacaacauuuagaaaauugucuuucuuaguguuuuaauuugggcacaaugguauauacuuguaauucagacccuggaaggcuagaggacaguggggccacaaggagaaacuucucaaaacaaaaguucaaacaacaacgaaaacucaaaaaaugaaaagugggaaggacuuagggguuuggcucauugguagagugcuugccuagcauaugugaggcccuuagucagacaggcagacagacagacagacaugugcauguuuguacaaacacucgcgcgcacacacacacacauacacauaaauaguauucaauacuagggagucugaggcaaaaagauccugaguuccaggccagcuugggcuacauagcaagacccugucucaaauaauaacaagcuccccacccaccaccacuagaaugugggcauuugugacuucugugccaggaugggaggguggggcuuuguccagggagauccagacgcccuguguaugaaagcccagagcaucagcugcugagggcuacccagcagggcuucuggguauguggacagggauguagagcuguguaucaauuccauccccugcuccacaguguuuccgaauccagggccaggacccccaggacagggugaaauggucagaggcacaguucuccugugaacagcaagaagcccagcuggucaccauugcaaaccccuuagagcaagguagggucaaccuauggggaggugcuggugucuccccacaacucgcuacagcagagcaaacaggggcuaccccaucacucuuuccuuucuucugggggacugcagcauuuaucacagccagccuccccaacgugaccuuugaccuuuggauuggccugcaugccucucagagggacuuccaguggauugaacaagaaccccugcucuauaccaacugggcaccaggagagcccucuggccccagcccugcucccaguggcaccaagccggugaggacccacaccacagugcuuuucucugucgcugucccccucuccccuaccucgcccuuccagccucagcuguccuuagauggggcagccacugagguuccccuaaguagccuuuucccccagaccagcugugcggugauccugcacagccccucagcccacuucacuggccgcugggaugaucggagcugcacagaggagacgcauggcuucaucugccagaagggcacagguacacgcagcugcuacacagagacaccccugcacuggcuagcugcucugggccgguccagaaggaaccaaacauugaaucucuuuucaggggccauagaggucccuccagagucauguaucugcuugggaagcagguggucugcggggggggggggggugugugugugugacaugcugcuaugucuagggucagaaccccugagguucaacgucaaggcaucuccagcuccuucugcauguuagcaaauagaaagcucacugauaaggauggcgacuggccauccccaguggagaccugcucugagucugaugucugguuuucccuagcuuagucucauaccugggaaugggguaaggguggauggggcagagcucggucugaguccugcccccuuucccuguagaccccucgcuaagcccauccccagcagcaacacccccugccccgggcgcugagcucuccuaucucaaccacaccuuccggcugcugcagaagccacugcgcuggaaagaugcucuccugcugugugagagccgaaaugccagccuggcacacgugcccgaucccuacacacaagccuuccucacacaggcugcacgggggcugcaaacaccacuguggaucgggcuggccagugaggaggugggcuccuaggucaagauuuugccucgcuuacccccacccuaccuucugccuugauuucacuuccuccuuccaccuugagaguauguucccuuuauucucaccuauggcuaccuaauacccagggcucacggagguauuccuggcucucagaggagccucugaauuaugugagcuggcaagaugaggagccccagcacucgggaggcugugccuacguggauguggauggaaccuggcgcaccaccagcugugauaccaagcugcagggggcaguguguggggugagcaggggugaguaccacccgugagggccaaggcuugcgcaggugcaggugguucugggaagauguucgggcuacgucuucaauucugcacuccaacagggcccccaccccgaaggauaaacuaccguggcagcuguccucagggcuuggcugacucguccuggauucccuucagggagcauugcuauucuuuccacauggaggugcuguugggccacaaggaggcgcugcagcgcugucagaaaggugggugagagcagccuagcccagauccgggacucugaggccuggagaaagaacuuccccucugccuauaggcacuuaucucaagcuccccucgcuguuuaauacacagaccauguugugucaucuacagaauaucccacgguccacaagugcugagauucacaccaucuugcacuugagcugccagagaagagugccgggguugcugugaagcgggaggggggggaaguaguuuggggggggggucuaucaccauaaggagaaucugcuuguccugacaugggcuuucuuuguguccagcuggugggacgguucuguccauucuugaugagauggagaauguguuugucugggagcaccugcagacagcugaagcccaaagucgaggugccugguugggcaugaacuucaaccccaaaggugggugcucuguguacgggaagggaagggcucaggcugcaagagggaugcuuaccacugucuccaggcuugugaaaguacagcaguggaucgugguuaucgccucccaccuagaaaccccccuuccaccuauucccauucccacaccuucccaauggguuccuuccacaggaggcacgcuggucuggcaagacaacacagcugugaacuauucuaacugggggcccccuggccugggcccuagcaugcuaagccacaacagcugcuacuggauccagagcagcagcggacuguggcgccccggggcuuguaccaacaucaccaugggaguugucugcaagcucccuagagguaagccaggaucucggucaacagcugggcccauagcuggacucacagcuggauguccagcugggucuaggguuacuugauauacaggggcaucugcuuuggccggagggcaucaaguacauuaguuugcagcaaggacugacgcagggccucaacuuuccaaaguacacauaagcccagaggacagcaagccccaucauucuauagugguuagggacaagggauggucaagcccuggacacucacguauugacucugaggccuggggauauaguccauuugguaaagucacgcaagcaccaggauccgaguuaagauucccagcaccccaauaaaaucccaacauugagugccaucaccuguaacccuaagacagaaagggagacguguauuuguguuuuauaggccccuggagcucauucaccagccaugagcugaauccauacguuguagguucagugguagacccugccucaaaacaccgagguagagaggcaucaaggaagacacagugcaauaaccuugaccucugaccucuacgcacaugcacacucacaaguaucugcuuauauucaccuauaagaacacauacauagacacacacacaccugucccaucagcuuccucauauauagaacggaaauaguagaagccagguccuagaguccugggagguucagugacucugcaaggugacauucacaaagcaguucacaggcacuuauuuaaauugugacuaugauuucugugaggacugauugugauucucuggcucucuccucuccuacaguggaagagaacagcuucuugccaucaggugaguggagggaaugagcgagccccggccugguucuuucgcuggcuccucugucccuguggucaugacuggggccugaugugaacuccccaccuccaucucagcagcccuccccgagagcccgguugcccuggugguggugcugacagcggugcugcuccuccuggccuugaugacggcagcccucauccucuaccggcgccgacagagugcggagcguggguccuucgagggggcccgcuacagucgcagcagccacucuggccccgcagaggccaccgagaagaacauucuggugucugacauggaaaugaacgaacagcaagaauagagccaagggcguggucgggguggagccaaagcgggggaggcaggggccccaagggcguggucgggguggagccagagcggguaaggcaggggccccaggucagcaggcccccaucacccaucagcccaguugucuuuggauggcaacccuugggaguugcuacugggugccgggggcauagcuugccauggggugggaguacccagccuaccauagaggcuaggcugagacuuggcagugggucauguuccccuuucccuugggccugggaucgugucaccuggaccuggaccccauggcaacuggaggcaauaugagaagggacaugagcuuauucaugucuuuuccuccccagaucccugagccuaaaccugcugaccugcagccuaggauucuuuccuaucuguaggccuggaaagccugccccgucccuugggguggcucucugucaccucuccuacucggcuacaucagcucugucuccucacccugcccucgugccuuuuuuuccacccagugccuccuucugagccauggcccugggacuugggugaucucucucucucucucucucucucucucucucauucucucucucuuucucucugggugggggucagcugaagaggcuggccaagcaucugucacuccugugccugcuggaauggaccuaggguauggcaggagggagccuagguggcucagguguacaaaccagggcaccgguguggugucugcuggaguagagauggaacuucggagagacaccuuauccacucacagggugucaucuccugcuggucaggggagggcucuguccuugaaagaguccccuguggggaccaaaauaaguucccuaaugucuccggcuucuggcucuggcuuggagagagggaagaugguuuggagggggaggggcgcuggugaggcuguaaccugggacagcaccaggugcuaccaucugguguggccuaggagaccaacucauggaaccacucagcaccuuuuuccagaggagagucccagccaggauggagagugccaguccccgugucccagugcaggacgaugugaacaaaaacucaaagcggacccucuauuguaguucuugauucucgaaaugugcuauuauuguuugucuuuuuuuuuuuuuuuuuaaagaaggaaaaagagaaaaagaauagcaaacaaauaaaaaccuuccagaggcuugagaagucagcguuugugccuccuucucugcagagucugacccccgcagcccuguagggacagauggcagcucuguccaguuguuucuguagccugccauuuugccucugagcuuuuggcucuccucaggagacaagucgucccugccuacaagcgugugaacuugggcaccugagcucauugucccaucagcuugaauagggcguagaggaucuccuaggguugggcugucggaaagaugcuuaaggauguggugaguguccuuaccaagugccucugagugcaugcaguaagcacuccauaaaugcuaacugcua

SEQ ID NO: 6445 - RNA, 19640 nt, Mus musculus
ggggcacagaggcacugagugcccagcaggaaggggccaggaagggacaggcaagguggaaagaaaggcagccugagcugcucgggugaagagagugaaggacguucuaccuccaggcaucagaguagggagagcaggggaccagcaugugcagagcuccagagaucagaggccauggcccaguagagccaugagcucgaggcuguuccguggguggcugucuagacaguccacguugaagggaggcagaggaaugccucucacggaaggaacacguucaaaccggcucaggugaggggcaagaguggggaggcgugguuaaggagcgggcacugcuuaguccccaagggcugggcuuugcugugaagaugguucucgguguuguaucucauccugcagcugcaggcaggcagaccccugugcucuggucucccucccccagccacuaggacccuuugaccuucuucuguccccugcaugcugaugggucagggauccaucccagagaacucaccagaaggcauucagccccuccccaagagcccaggaaguggcucccagggccuucuucaaagcugggccugugucagucaggaccuagccuucuccucuacuugccacuauuggcgaccucuacccaggaugcacugcugcugggauguggaggugcaacuugacuaggcugugucucccuagugcuccaugcaguuccacuaauuccaaccuccuaaccuugcaaguuagguaccacuuaacucccacuuugcaggugagaaagcugaggcacagguguuaguugaaugugaucauccagggguggagcccaacauggcgggacagggucuccaagaacagugauggugucugaucuuuccccuucccacagacugugaggacuuccgugguuuacaggagaagacagugcucaggagcgcacugguuuuguuguguuuuguugugcagcauagguuggucucagcagcuaccuuccugccugggguugcggguaggcgcccauguccagccaaguucuuuacucuuuggacucuugguacuguuuaaucgcaaaucuuaaaccuauuucuuauggcuuugccucuaggaagucaaaguccccccugucgcuguucuuaugugaacagggaccggaugacaccccucuacacuggcccugugugaggucuccuuccuacccaccaccuccccugcacacaguguauauaacguccuggcagggaugaagauuuucugaagagaugccccguguccuucccuaggcugccauguacugagacacugguccccaaugaacaagaaucccccagacaggcugaagccuggugccacccacagggagggacuugccucuucacaagauuucacacaguucugucugaaggccuugcaggagagacuggaggagccacacugaauaaaucuguuuuuaauuauuuaccacccccccaccaaguaugcacucaugugugcacacaaguguguguguucucacauaugugcauguuauguggaaugugcauguguguguuacaugguaugugcaugugggguguaugugugugugugucuguugcggugugugugcaaguggaggccagaggucagcagcaggcgucaccccucagugguuuuucgucugaaggucacugauccuccugucucugccucuggugauggaauuuacaagugagccacagcugugccuggcuggcuugcuugcuuucauuuacucuccuucccuuccucucuccuuccccccuccuucccucccucccucuauucuuucauuuucuuuucuuuguuuuuuggggacagucucucuauguaguccuggagcuugcuguguagaacaggcuggucuugaacucacagagauccuuuugccucugucuccugaguucuuucuuucuuucuuucuuucuuucuuucuuucuuucuuucuuucuuucuuucuuucuuuccuuccuuccuuccuuccuuccuuccuuccuuccuuccuuccuuccuuucucuuccuuccuuccuuccuuccuuccuucauuccucucucucucucucucucucucucucucucucucuuucuuucuuuuaauguggcucuuggggcucaagcucaggugcccaugcuugagggcaugcauuugacugacuggguuagcucccgagccccacgcuuggcucuuauuggcuucuugaugagguugcugagcuuagguuagcagcgcugucaaagugcaagcguuugcccuaacaacuccgggaacaucagcuccuggcaaggucuuccucuguacccuucuugagucuguccucugucugugcccacugaccguggcucucugccuugcagacccuccuugccucuccaauccauuucuagagugcugugagguuugcuaaaaucccaucugauuucaggaucucuuuccccaaaagccucuuuacuuguuuguggucaccucaggggacucagaagccacacuucucagagccaaguacaaaguccuuccugauguggccccugucuccuccaugucaccaggucugguuccauuccauauggaccugagagugugcuucucauaggccagcugacucugauagcuccuuccugagucagcaagggagguggcggaaugcugacacgcccuccccuacccccacaaucuuuugagacaggauuccaggaacuagccugaaaucgccucugcuucucuuuuccuagggccggaauggcagacuguuauuuguggcuuagcucaccuuuccuaucacaauaguuuuuauucuaaauagcuauucuaauuuuuuuguacuuaaaauauauuucuuuccuaaaauggugaugagaauaaaugagguauuagaaaaaaaaaauuccugagcgggccgugguggcgcacgccuuuaaucccagcacucgggaggcagaggcaggcggauuucugaguucgaggccccaauucccuuggggcuggggagauggcuccaagggcagcaaaccugaggaccuaaguucaaaucccagagccuacauaaaagcugagcgcagaggagcugagcgcagagccucugugaucccaucgcuucuacaggggagcugagaggcagcaaugggagaauccccaggagggucagccauacacacacuguggcaaagcaacaaagacggccugucucacacuagauggaaggcaagaauggccucucugcuuuuugucucuaucucugucugugauagaggcugacagcugagccuagcuggagccagggcuccaggcuuagaacccugauugcaccaugaugggccaguagaggcucuuucuuccccgugggggaggugguuguucucaguucaccuggaagcauugcucuguucuaaaaagcaccucuagaggacgcuuuugugcaggugccaggcaaaagucccaaggcaaggggacaguugcagcaacuacgauggcugggcaagagaccaggccauggcgugcuccuggggaggcagguggcagguguauaaagagggcaaaggucugaggguuccugugccagccccuuggaaagagcaggaaggauggaggaccccacagggguggcgaggccuaagacagauuugcuugggguaauucccucagcuucucacacugccuauggcuuccuugguaagggagagucugggucaagguaccuucagaugaaagauucucucugauagcgguacuugaggcaaugguuaagaggaggaggaaggaugguggugggagggagagaacauggcgaggucaaaucuuggacucaggacaacaggccuuggagggucgacaguguggccacuggaggugggaccuggcccagccucucacugcuaccucaucaccuucugcucuucuagacguagcuacaaucauggucagggaggagguugagacagagcucugucugggaauuacugacuggacuccagcccacagccugcagggggacacagccccaggucaugcuugguuccacucaaacaggucaccgaguaccccaugguguccccaguguacuggcuaguuuugugucaacucgacacaggcuggaguuaucacagagaaaggaaguucaguuggggaagugccuccaggagauccagcucuaaggcauuuuuucaauuagugaucaaggggguagguccccauguggguggugccaucucugggcugguagucuucguucuauaagagagcaggcugagcaagccaguaaggaacaucccuccauggccucugcaucagcuccugauuccugaccugcuugaguuccagucccgacuuccuuuacugaugaacagcaauguggaagaguaagcugaauaaacuuuuuccuccccaacuugcuuuuuggugaugauguuugugcaggaauagaaacccuaagacacccugggaugcagaacuuggcugagaaccaggcccugccccgacagcaucaggggcuucagggaccaaggugggaacucccagaggcuuuggacaaagugcaggagucccugcccugagguuuaugguugguagguguagaugaucagaaggcugggaccagcaucuccuccuuccuacacgugcugacacuguuggagggugugacaccucugcacucagggcuuucugccuggcuccagcuucuguguugccuuugcuguucucacugcaggcccucagugcuugaugccugccuggcuggcuggcuagggaaggaagcagggagaugggggaccugacuugggcacaaaccucucacuucuuucuuggagggaaggcugcagagugggugguaucaggcuggcugaggcccagggcuuccuguuagccccauuacuagccacaggaaugcccgggcuggguuacagggagucuggcuagggcccugccaaucacagccaaugugguuagacacagcuacacuuaaugggucuauggugauugcccuggugcccugcacauugcaguuguggggaacccagugucuuagucaggguuucuauuccugcacaaacaucacgaccaagaagcaaguuggaaaggaaaggguuuauucagcuuacacuuccauacugcuguucaucaccaaggaagucaggacuggaacucaagcaggucaggaagcaggagcugaugcagaggccauggagggauguuacuuacuggcuugcuuccccuggcuugcucuuauagaaccaagacuaccagcccagagauggucccacccacaaggggccuuucccccuugaucacuaauugagaaaaugcccuacaguuguaucucauggagacauuuccucaacugaagcuccuuucucugugauaacuccagcugugucaaguugacacaaaacuagccaguacacccaggcacacaguuuguaccuucaaccucugcucucugaugagcuguuuauaugccugucucccaucucugcauacucagcuaaguucuccaucuaggaguggcagagggcagggcagcaggcagauagccucacacaugccuggcacacaucucuccucagcccuuccugggaauucccuuccccaggcuccucacagccacaguccuacagucuccucagacagccuuccuuagcgcuggccuugggacagccaccucugcucucuggcuccugcuuuauaaccuucucgugcuugcuguguugaugcgugacaccuacgauucauccgauuagguugguguguagacguccaucugcccacgcaugaauguguguauauauggcauuugaaguuuccguucugaucuuuguucugucccacaucacuggaguuacauggaagcagggcccugucuuacugucuucuuuucagggccuagaacaaagccuggcacacagcaggugcccagugaacccauuccugaagggaggaagaagggaggagagggggaggagaacaggaaggaaagaguagagugaucccugaaagcauggucucccagugcugucacacugagggacaggaguuagacagacuccucgguaggcaguuagagagaggggacauguuugguaauaaagauggugaccugccaagguggccagcuucuuccucacccuccagacccgagacaaaaaccugacagcuuaaaacaaaggcccugugggcaucuucucccaccaccggccaacugcugauggauuggcccaacaaguucaagauguguuuacacaacaacugugggccaaucggcaacccugucuguguucugaacuggccaauccuaacuuagaggaggaaccccagcccuggagaggagacuggauuuucugguuuccagagucucuucucuguuugaagcucuuuuucucuggguguuugcugugugugcacguguuuccacggucccaauaaaucaaaagaaaaagccucaaccgcggaugcugacugucugcuccuguuuucggaguucgagaucuucccugccuucugguucuuuaaccgucagaggagcugaaccugaucaagagcccuaguugguagauaacaccaccacuuccugcucaaggcugguuccccacaggcccuagccagcgcguguccugcuccuucagggcccagcagaggaaaaccucugccugacggcacaccucgccuggucuccacauuugaguucuguaauuacagugugcuguuugucuaagucuuauuuuucucagaauggaccaaccuugggaucaaccauggaugggcaacaacucagucuuugaugucccguguccccugcccuuaguguuccugaggucucagguggcugucuuuacugcuggcucuggaagcacuguggcuggugucuugccuggcugcugcucuugcccccaugguggguuguuccaguagaugcucugauccuuccugggucucugcugucuuggucaccuucagugaccauguaucuggaagauaagcuuuucuuccauagugauucaugguucuauuuucaacuugaucacaguaaccauuauguauauccacaaccugaagggaccugaggaugcugcugccucagucucagggugguggacacaggaccugcuugcugcugcugguggccguggcugcugagcugagagcucuccaggggauauuguagggcagggcccaguuuuuggaacugauauaaauuuguuuggcucaggcauguggauucuuguaucgcuuuucacauuccucuggacucuaaggacuccagaaacacuugggagcuacaccuacacuaggcuucccuggugaaaugaacaaaaaacuaaaaacuuaccuucaaaguaaaaccaggcuggguggugguagcacacaacuuuaauuccagcacccaggaggcagaggcaggcaggucucugaauuugaagacagccuggucuacagagaguguguuccaggacagccaggguuauacagagaaaagucaauaccucucacagaugcacguguguacacgugugcacguacacacacacaaacacacacacacaagaccugguuacauuugagaaacgcuuaggaucuauucaugcuaaauuucuaagauagaaauguaacuaggaauccugguuuuccccucagcuuucugcacuggguagcccuggggagaaagaaugugccaggugggagugggucugccuuaggucuggcguccugguuaugaggacaaaauuuauucugcucggugccuuuuuuugcuccuuaaggccuuucgcucagagacccccucccugcaucgugagugugugugaguguauguguggucgucauaacucuagucuuucccauacugccacacuggcggucaggaaaugcacugugaagcagucagcuuggagacuugaaggaaugagguaggggaugauccaacaaaggacucucccaacaggagccuccccgggucuuggaaggcacuuuaagaccaacacuuaaacaagauuccauccugccaaaaucggucccuccuuuuccucccaggagcccaaauauacccagcaaacaaugagaaauggcucagcgccauguuuaguuuauaagcauguauuuauugccugcaccaccaaggaagcuguugcuuaccuuaaaaagcccauuagcuucugccagacgaaaaguuaccauaagguaauuccgguuuuugguucucucucaaccguacacuagacagcauacccacccucuaagaaggagcccccgccccaauucuggcuucuaccagugggcagcucccagcaugcugagguguuccagggacugccuucacagucaugcuuugccucacaagguaaaauaccccauuucucuccuccucuccgugagucuggccaggcauccaacaggaaagaaccuuuuguucccagcuuguaggaagucugagcuaggcucuuaucuauucguagcauuuccuggauagcgggccaggaucugcuaagcucccagccuuggucuuggcaacagucuuaaguacagaccuuggcauacaccaggucuaggacuuaaaugagaaguuggaaggacacaauuuacccuuagauuggugucucugucucucucucucucucucucucuguguguguguguguguguguguguguguguguguguguauccuggaguggaaaaaaugggaggcaaacuguaucaacaacagugucuauguggucaauguggcuggugugcagaugcggaagggcaggguuauucccagccuuccaguaaaguguaaagugccaucuccgcccacgagggcuggaagaggugacccuggguucccggagcugagcuugggcccaggccaggccugacaccuagcggccuccuggguuugggcguggagaguagcgagcgagaagcuagagaccgggaacccgggcgccgaacccgcgccgcuaaccuuccccgcacgccggucccgagccaguccggagccagucccgaagcugcuggaguucggguccugagugcgggucgguguagccgaggugcccuaccgagugccggcgccuggcgggacuuccggcgcaggugaccgucgccuccucgcgcgcgcuaccgcuuccccgccgccgccccgucuccauggcgacgccgucgcgccgaggcucguggaaccugccgagcguccggggcgcggcgcguggacgcgcgcaggccuggcggcggcgggacaagguaggcgacggggagguggggagccgaguuccgcgcggaggggcggaggggacuguggccaggugaggcagggcuucgagccgcccuuccgcgcgcaccugcccgcaccgacccggcgcugcccggcuuguccccugacgcggguguugugcugcuggcacccggcaaggcagccgggggagcgcgggccgcgucugcccgaguuagaauggggacugcuggugacuugaauucaaguccaggggccugcggcuguacuguagaacaaagugggugggaguggaccaaucugcauucgccacgacugagcucccacuguccccgcggccggucccugcgcucaggugcgggccugguggauccucuuucucuucuuccgcaucccaccguccucgggcaggauaacuaguuccuauccuggcagaacgccuggcuucgugcuuuggccuuggaagugacucaggggcggaacuucucggagagagggaucugcugccgccucugacuccuggagugguagccaggccaccucccccuuuccggucacuucucuucuuacccuuaccaccuuuccacaggcgcugcagcaccacaagucacagacacuuuugguugcccuuccuuuuuuugucuuggcaauuuucuuuaagaaaagccccaucuccgauaccugaguucuguccgcuucuuaacaaaacaaaaagcaaaguguucucaccucccuuagauaccuugauugcuccucagcacuuggaucugggaggaaaauacuggacugcuccaaccccaccccuuguaggaggagcuccuggaaccagaaguagaguugcacacagaugcccugcccugccauugucccuggguaggcagagcccagguuucuugaacuuacagacaucugaaugcugggauuaaaggccaugccaggccuugcguuccauuuucuaaucgccucacaauuaauuagaguacaagugggaauaugaaauuucagacauuaaaauuaccaccuaggucacuuguggugacaagaggcuguguuccuagaaugugggagccugaugcagggagacugaacguuuaaagccagcagaccuacagagggagaucuuggucuaacgcccccucccccgcaacaagaacuaaaggcagacuguuugacagucuuccucgcucuagaaguuuguacucuauagggggaaugaauggguuggugguggggcaggagggaucuggucaucuucauggguccguugacgucacuaugacguuuaggagauguuauuuuuguucaacugcuguuugcuuagguccuagcuagguggcaggcacugugcuaagcacuugugcauauuuuuuuuuuccauuuaaguuguccgaaguccaaugagguaggucuuaagguccccacuccaccccgcucuccuccuccccgaccccacaguugaggaggccagcuuggagaauggacaaggccucccugauggcacacaguaggaaacaguggaacacacaaaugcucccaugccuuaggugguuggcauucaugggagcccuuccuccauaaaaauaaauaaugauauuuuucaaauuucccugguguaaagacaacauacagacuggauuaaaaacauaaaccauuucaaccccuaaaguucagcucuuccauucugaaaugaagcaggcucuuuuauuuuuaacucuuggcaaguucuggugcagaggcacaccugaugcugacccuccuuccuuccuggcgcauccugggugccccgugcuaccgcucagcuucuuuuugccuuuugucucaucgugucuuaggaucuuacccaucaaggaaagcucuagucccuucccccacugcagucuuuccuaacucaguuaaagccugcugcugauggggagggcuguggccaagccagguuugcugcuucccugugcucugcucugccuccugggcuguucagcaugugcaucugguaccaguaaugagguuaggccugguugccuuuuaauaaaacacagugggcuuggagaaggagcguggugcucugcacaggucgagccccgaggguagccauguccccgugugauuacauuaagugggagccagucugcagguggccuguggagauuggggguguaucuguuugaacugucacagcccagagaucugucaccccacccugaacugaaaggaaggagaguagccauguaaggggccacacaagcaccaguuccuugcaaagcucugaacuauagugcgaugugucaagaggcugaggcagggggauaucuaguuagaagccagccuggguuacacugugagaucauguuuugagagaaaggagagggagggaaaaggagagagaacacagaucugugggggcagaggaaacccagggucaggagugaccauuuccagccugaggggugaugagcuacuguugugcucuggaaacacagaggcgagaagagccuacagagagagcagagccaggggcugcgaugcaaacacaugcuuacacgggagcaauccacaaguccucuaaagcucgcggauacaggcuugcuauggguugagcagcucuguccagagccuugggggcauccaugccccccuccugccucuuacaucaccuuguagccuuaccuucaaaggguguauuuccugaggccagucuggcucacucuguccccaggcuggcguccucgcuugucuggguguccuaccugagaguagaugggaaaugaagaugcugccucucccucccuccccuggaaccuuuuucuccagagagcugcaggcagccccugugccuggcgcucgggcagugcuggggaugagcaggggccagggagauucuccuauuuaucuggggccacuaaagcuuugacuggcuuaaguguuuggaacgugugacagugccaccuuaguuacugggcauuaggaaguucagagucacacugcuagcaggagacucagaggagagagcccaaaggugcccaucuccuguucugguggggagggccaugcagggauggcuuggguuuuuauuguccacucccuaccccccaccuuuggcagagcuggagacugaauuuaggccuugaguaugccuggcaagugcucugcccucuauggcccuuguuguaacaucagcuacuauuaauauuugucugaaagccccugccggcagggcccacaucuuuucuguggaguucuagcauuuaacauugcccgcuauaaggagcagcagccagaguagcagcuauuugcugaugguaacuuugggcauguccuuuaguuacugucuuugagcccuaacuuuaguuauugucucugugcccuaauuuucccaucagucacauuaggguagcacgcuuguuaugcccacaguauuguugaggguuaaacagagaggguacaaagugcuugguucagggugugggguucacuggcuguugggucuccacccugcuggugcauacgagcccgucucacucacucuggggugggugcagggagcacuuagacauuugcuucauagggaauuccagaaggaauuuucagugggaugguaaagccauccucucacucacucccuugugaagagacuuucucuaggguuucugcccauuucgagagaagacugacugggacagaaaaagcaggccguggcuggucaagugccugaccccugcaucccagaccugcccuuuguauuccaggaggucugaagaaggcugcucuugcucuucuuucugauggggagcuaaucagauucugucgugcuucgggcucuaaagagaugaauccaauaagggaggagugaccuggagaggaggaggaggcaggacagaagacuacaggggcacagcauucuuucucuguuggauacccgagagucucggagaagggugaagugaccuucuugccuuuaaggagcagggcaggagacauuucccucgagagcaucgugggacuaaucuagagcagaacccaagaggguaaggaaguuuugggggagccuugaggacagaggaggggguggagcugcacuuggggacaaaguagugagcaaggugccauugcccuggggugaaucugggaggcaguguaggcggcagggagcagaggaggaggcugggcaacacuaggaggaccgcaauaacagcagguguguuguuacugcaggggcggugaagcccccacauggaccuggugggaacauaguggggcugcagaaagauaauuuaggaugguguggcagcuggggugauaugacuuacaaagcuaggcguguccaggugugucaggcagauugacuagggagaggcuagcguggucugguauggcugcagagauggccgagaggaaagggauaacagagaccagggagccccugcggcgcuguguaaccuucaguggacucccugggcaggagcagagcaguccaugguuaucugggauguugugaggagaggacgcugaucuuggaugaggcugaaauguccguggggugggacucggagggaggacagaccuggcaugggauuuugcagucacauugggaacagacaaggauagcagcaagaauucagaaacaggaguuuacucuuggccagggcuucagaaagaauucccacacgacagggguagcaugaaagaaaaugucaagaauuugagaaaggggcuagccuggguucauaccagccuccgaguagugcguauuccgugaaugucgagaaccagucuccugaauauucaggguaggacggcagagcccgcuggcaggaggucggggcucagcuagagaccuacagugcaguaguguggaguuacugaaccgcugaggcagaaguguguugauguacgugcuaggccugcgcgugaggauggguuagcagaugcauggggcuguuucuacaaaaaaaaaaaaaaaaaaaaaaaaaaaaguauguggcugucagacagaacccgcgaggaugcggagggcuugcuuugucuguuuucggagaguguauuauuaacugccuugguccucuuuucaaauggaggcguugcugucagagaauugggagguggagcuggagcugaucaacuggaggagcuggggacgcaggcccaagcacagcugggccagcacgggcucuagcuaggguggggaaguggcugccacagcuccuguuggcugcugcgugcaucuucuggugcucacugcugcugggagaagcaguuggcugcggaggccaguccugccugccugucuagggaagggacaguagcuggagcucugaugucucugugcugguggcauuggugguagcuuuuguguugagucccagccauugccagcacugaggcaaagggaacagaggccagagccagccuguuccccuuccacccucuuuacuuaugggaacacuggggcaauaggagaacaugcagaagaagggcugagggcuggccugagguuggaugucaagggucucccgaugcaggcggugccuccuuaaauagcugcgugccugcugugucuuccugcacagaucgccagcaguugaguaagguagauggggacacauggguucagaaugugaggccacagugcugggaccuucgguucuggaaaccucaccugagggaggagagcacucccucccacacuugguuugggaaggaacuggaaaggagagguggggggcgggggugaugggggcuagugggcuagccuguggucugguacagugggggcagaaaggagcuauguagaacaaggggacccucucuggugcgcccaugcugacucggggugaaagagcaaagcuucuacuucucacccgggaaggacuuucccauugaccuggacaaagaaggggauuugcuugcauuuucaacacaucugucagcccuaccccagaaaaugcaggaccucugaaaauaggaacuguaaccccgggauggaggccaugcugucauuagaacucaggauguuuucaaacuugugccuucccuuauacauagaacccaggucaaguuugucugugugggaaggccuggccuccugcugauguguuccugggauguugggacucugcccaaggaugugggcaugggucuuaauggugggagagugaacagaggcgugcacggcuuaggcccugggguggaagagguggcagucccggggacaggucaugggugguuccuuuuagcuagcucucucucucucucucucucucucucucucucucucucucuugcagcuggggucucagaauggagcacaguucugcgucugucccugcugcacugccguacuauguggccuucucccagcugcugggccucacuguaguggcugugacuggugcguggcugggucuguaccgagguggcauugccugggaaagcucccugcaguuuaaugugcacccgcucugcauggucauaggcaugaucuuccuucaaggagauggugagucccguggggccagcucccucagccacucucugucccucaguuuguagcugucuuugggagaggccauguacagggauccugucccaccagacacuccuuccacuuagacaaauugaugauucuagacaagacagaugaagaaucuagggaguccagggggacugugguuggagggugauaccugcuuuccaucgguugcacugguaccugccucugguuucagcagauggcaucuccagggcuacaguugccuucuagauagagcagggccagacugggcuauuaguuaucuucaggggcagcuggaaguugggaaaagaaguagacauacaugcauguguauauuguuuccuguggaccuggcugagcuagagggucugucugucccugggguaagagccagcaggugcuuggucuaauaagcacaccaccugugggggcuagaugguagggaguggggccuaccgacagccaccucucagcagcagguccuaggaggcauccagggguaguggaaauuaggcaggaucacaugaagccuugagagcguagcaucuggcugucaagagcaguacgugccuguccaggaagguuccagaacuguacuuuguuaauggguacacagagucuggccaucaccucagugugacagcaugaugaguccuaaauacugaaucacugacuuauaucucaggccaagcaguuacucagggugcucugcagagcccugccuuugcugccccgaugguagcagagguguggcguagccucuucucauggccccugggugugcaugggguagaagaaggacucaggggaacccugaccaggaugagugcaagguccuuauggaauccugaucucuccuucaguuucugugccuggcaaaccucgaccgacaagcucuuagcauagucugcuguccagcacaggccuacacucuuacaucuuucucucacuuuccauaagcucugcugguguaccgugucuucagaagagaagccaaacgcacgaccaagaucuugcaugggcugcugcacgucuucgccuucaucaucgcccuggugggugaguuccugaacacagcguuuccuucucuaccugcugcuucaggcuccagcagcugcugcuggacacacacuguuccugcuccaagcugcuuggcuuugccccuacucuucuucucacaggcaucacaggcagggacacugggugcuggccaucaucuggcuggaccaaagcccagacguucuggcuaguguuuccucccaggccuccccucccuucccuucuccaugacuagcccuguccucacauggcccuugccucugcuccaggguugguggcuguguucgacuaccacaagaagaagggcuaugcagaccuguacagcuugcacagcuggugugggaucuuagucuuuguucuguacuuugugcaggugagucuagugcuguggcagcaagggcugggagagguaaagggagggcaaaugggguccagguguggcauguaggggcccauucuccagggggcauguccagaaaggaaaagagcagauggauuuaguugggugguuuuccgagguugaccuggguagaaucuagauucuagaggccaggguaccccagacuccuuuauuccacccaccgacuaugccuccuauuaggucccagccagcucauggcucagcagagcccucucucccuuuaguggcucguggguuucagcuucuuccuguucccuggagcuucauucucucugcggagccgcuaccgcccucagcacauuuucuuuggugccaccaucuuccucuucucugugggcacagcccuacugggccugaaggaggcccugcuguuuaaauugggguaaguguccuggagaggcagggcgccagggccuucugccuuccuggaagccucucucugagcuggcuucucacugggaggguggaagguugggcaucgggaaacccgaggcaucuuuaaggccuggacuaugauugucuuaacuggaacccuugguggcuuuucccuucacccuacccuacagguccaaguacagcacguuugaaccugagggggugcuggccaacgugcuaggcuugcugcuggucuguuuuggggugguugugcucuacaucuuggcucaggcugacuggaagcggccuucccaggcugaagagcaagcccucuccauggacuucaagacacucacggagggagacagccccaguccccagugaucgcccuccuuguccucuuggcucuguggguuuccagauaucuuuuugcucuucccugcagacacugagucucuuagguccaggagugugaguguggggcuguguuguuaguuuagugggguuccaggcuuuggaguuguucucagucucccuuccuccccuuccucucugcagcuuuugauacauccugugagcccugaguaggcucugucugccuguacccgcuguuguccguucacgugcagaaagcuugguuaggggaucuggggucaagccuggcccugaucccuauuggagcuagacaauagcuccgcccuccaugcagcagauggcugcugggccugggccugagggacuggcauggagaagucagaccgcugcuuuguguauucaacccaggaguuccagcagcuugggaagcauguguccuuggcaguagagcaagugauauuauguguaaaauaugcugguguucagaggaaggcuccccagaaagguugacucuggcucccaaaggagccuuggcguguggguuggcuacagucuuuaggccuuucuguucuuuuaaaaucccugaucauuaaauaggcuuuucguggggaaggggauuagugaucaaaacucagguaaauaccugcccugguggaggagggcaggcugcuugcucacagugagggcugcccuggcagaguaccucccuucagcaggggcuaagcccuagcuuccuucugcgggccagccugggcagacucugagagugggaggccacaccuccggaguuuuuggaagagggcugcuguuugccuuguucuccaggggggcugcugggguacccuggcuuggggugcccugucuugguugaagcagcccugagggaucaugguccucccagcccuggguccaucaucgcuggacaguaggacugaaguggaagagaggaacgggauuggucuccugcacuuagcuucaacccccuacugccuguugcguuguuagcugagucacuguuuggcuugagucuagagauauugggauuagagcacugaucuuguauucucuggcuuggcacaugcucucuucuuguuuuccuucucucggguuuuaagccucacaguuugugacacacaugguuaacuuagugaggaaaugaaugguuucugaaccuggcaguucuuuaagucacuaggcugguuuucucugucagauuucuaauaacugcgugggcccugcuucuggugaggucucuucccccagcugugguguagcucucucccugaugcucccucaccuucccucccgucucuccacuugcuaggauggugagguuugccuccaguuccaacuguauaugcuguaaggcuagggaaucuuaggaguucugucgucgguuggcacacuuguacagucaaguguuuacaucugggcgacucggccuuagacaaacucacgaguaccauuucgagucucccuugccagacuacacagagaauuagaaguuaggucugcaaugagagucuguaaacuagucuuuuugccaaaguguaugauacaugacuaaggaccaaagaaagcccccaagcagaugucugugguuucuucugucucuucugucuccugugacguacaguguguuguuggugcaacagaggaaucaauaaaugucuacagcugaccgcu

SEQ ID NO: 6446 - RNA, 22455 nt, Mus musculus
uggcuuccguuccgagagggcgggccggcaucccaaacggaaggugguagcgcugcccgagcugguuugaaacugguggucgggcccggccgagugugaguguguguagccgaggacccgcuggagggcuaggccguucuugaccgccccggccccgccuccccucggacccgcggacccaagcccggguccccgccugucuugugccccagcccgcugccucucuggccggcucugcggcccagccgccaccaugucccugcacggcaaacggaaggagaucuacaaauaugaagcgcccuggacuguguacgccaugaacuggagcgugcggccggacaagcgcuuucgccuggcgcugggcagcuucguggaagaguacaacaacaaggugaguugugccggggcucagcguguagccggcggggaacgcucgaggugggcggcagccccgguccccacaacucuccugcaaacucgccuugaccacaacaaggggguggguccucugugguccugucgcugagguugucacacucguugccucuuauuuaguuuugacagccgggggaaaccgaggcacgguguugugacaugccugaggcagauaagauuuucgaugguaguagcagguuucagaucggagucacacccccaaagcuauguccuccgucccucucauuucccccacuccugucgcagugcuucuguugcuagguggggggcgggagagaggcaguggaggaagaugcggcgcuuggauugguggucgugcauuccuggccacgcgagauuucuguuagggcuauuuauugcaagaucuuccccaucucagguguuucucauggauacagagcccuaaugcuagguugucauuggucauugguuuugcuccuugauguucacccucccccaaacagccuauccuuggaaaccuuagucuguggcauuaucccgccauuauuucugaauagagaaagaugacguuugaccuguucuuuucgugguucuuuacacauucauuugcagcauugcuggacaucaucacuucaucaaaacacuggcagaaggagagaauuuuuauaugcaggguauagguuugaaaguauugagaagaauuuucuuucccuaaucucuuaccuucauucuuuuguuguaauuugaguuaaaaaaaaaaaaaugaaugacaguaaucagagauacugaaagcuuuggccagugguauuuauagccaguacucugccuuacucuuaugaacaucagacuggagacaaaugacaagauggugggagcaguggaagaaguagguggucuaggauuuagcuauaaggcauugaacaaaccagauuuuauuauuuuugacccacagugaucuaggagagggcuucuguuuuauaugugaagggucaggugaaaacauuugagcauuuuagguuuguuuaugguauuucgggagcacauguguuucucugggaaagggucaccauuuuuuggcaucuucuuugagaaaagggugaaaaggauggccuuugauugucuagacgucacacauacaccagcaguuuacagucccagggaguguguaccgagccgcccuuuccuagugaagagcccuauuucuugucuccucucuaguggcuuuuuuuacccccacaguggcaguaaaacuggagcugggcuucaggguccuggugugcauagugucuuaugagguuauuauuuuuugagacagucucauguggcccaccugccuccaccucccaaaugcagggaucaccaacauaugccacugugucccacuaccuuguggguuuuguuuuucuaaaauaaaagugccauaucuccuuuguuuguuaucauaagcuccuugaagaaagaaaauuuauuccacuuuaggacacacaguguucauguggaacaccacaguggacguguuugagugugggauaaacacgucuguguuauucaaaucaaccaacacuuggagucauuaaucacuuucccauagcugcugauauaaccaaaaucagccaugcaugagacccuggguuccauccccagcacaagaauaaaaaaguuuucuaacuaaauuaucugacucccuaccucaucugaacugaggcgcagaggcagcucaugcacagccacacaggcuggggagaacgugguuaugauuaucagguggggucuagagagaaccagggguaauuccuaccacccgcauggugucccaauuccaguuccaggggagccaacaggcaugcaugaaguacacauacaugcauaaagaagagagaaugagaauuuaaaagauguccacaagguggucagacaccuucuaugcauaaacaacaauuuaaaaaccaaucuuucaaaaaauaaaaaugaggaaaaguaggccaagaauggugacgugccugaaaucucagcagguuccgauuugaaggccagucugggagacuuuuuuuuuuuucagugcgugaacaaaacccucagauauguaguuaaagauccugcuucguagcucuccucucuaggguuucguuucccagguuggaggaaguugugaagagugacugcacaaggcucugaagguaggggacagacgaggcacagaauggcagagcauggggagacuggaggaaggacuggcugucagcaagaugacagugucagggucaauuuccccagcacucccuuaguguguaaggaagagcaguaggaugcuggaccgugggagaggauaagagggguaccucuggcuacagaugccaaacucagaagaacuguacuuguccgcagcaggaguuuguuggacaaagggaaaaggucuuuuaggacaagaagaaggcauacagguugacaacuacuuggaagccuaaagaagggggagcaugaagucagggcuagccugggauauagagcaaaucuaaggcuagccagguugacuuugugagaaccuguccuaaaaacaaagcugaggauauagcugagggugugugauguccuggauucaaccccugugcugggagugggagaaacagagauuacacugagaaagaacaggagguggggagaaggaggccuguguaggcaucguuggagagcagcucccaccagagagaugagacaaagaaaacccucagauauguaguuaaagaauggaggaaaagaguugacauggugaguucuuauguucaacuucaguaauaaaaugguguuaaaaaaugccaauuuuuuccugucagauuaguaaaagguuguuuuuaauuuuaguguuuucagagguguggaaggauuggcacuuauuuacuaucaauaaaaguacaaauaaaagcaauuuguacauuuuccauuuuuuaaaauuaaguuucuguuauuuuaaagaagagugucuugugguauuuucauacauaccauuauauuuuguuguuuuugguccuuccuccuuccugucccuguuuguucguguucucucucucacucuuucucucucucucucucucacucuuucucucucucucuccucucucucucucucucucucucucucuccccucuucucccaagcagcucucccacuugccuuccuaucauauaugcuccacucucaucucuuguccuccuuccucccuuuagaccuccuccucuucgcucaugcucuucccucucuacuuuugugauauauguauagggugugugugugugugugugugugugugcgcgcgcguguguguguguagcuguauggauaugaauggaccacauaugagagaaaacacugucauucugagucuguuucuccuaacgugauucccaguuccacccauuuuccugcaaacuuccuuuucucuuacagcagaauacaauuccauuguguuugcaccauguuugcucuaucccucaccuggugauggaccucugggcugaguguguaucuuugcuguggugcugacugaggauccuggcauagaccaggaguggaccauauguuucaguucuucaagcuuuauuccucccucguucucacuguaguccaggguggccuaggauuagcagggauucuccugucucaguuucccaaaugcuaggauuauggguaugagccaccaugcccaguuuauucuuuagcuuuuuaaggaaccucuauacugauuuucauaguggcuguaccaguucacauucccaguaaugguuccucuuucuucacacucugaccaguaguuguuggcacuuauuuucucaaugauaaccauucugacuggggugagauggaacuuguaaguaguuuuuauuuguauauucaaguauuuauaguccuuuuguuauuuuuucuuugaaaacugucacuugaauuaauuuucccauuuguugauaugauuuaguuguuuugguuuuuaauuuuaacaagucuuuauaacaucuagauauuaauccuugucgguguaguuaguuggcagagauugcacccauucugugggcugccucuuaugcugcuggguguuuccuuugcugugcacaagcguuguaauuucgugcaaucucauuucucaauucuuaggauuauuuuuugugcuauuggacuucucagaaaguucuuaguuaucuaugccugccucuuaaaguauuuugccuguuuuccucuguuuuguuuuguuuuuugagacagguuuuucucuguguagcccuggcuguccuggaacucucuuuguagaccaggcuggccucgaacucagaaauccgccugccucugccucccgagugcugggauuaaaggugugcgccaccacgcccggcuuauguuuuccucuuaauaguccauaacuuuuucacuuuuuugugcaagguuucauaaagcugaggcuggguuugaauuucugauccuccugccuccaccgcucaauacuggaaucaccaccauucccagcacccccuuuucuugacaaggacuuagcuguagucaggcuugccuuaaacucuucuuuagccucauccucccucccauccccggugcugggauuacaggcaugucuugcuucaccagccugaagcaaccuuuagaagaggguaaaauugaaaauaugagacuggggaucagauggcuuagcugguaaggugcuagcugcaccaagaugaagauuugaauuuaaauccccagcauccauguaaaaagcccaaagcccagaaauaauaggauccugggaacuugcuggccagacuguugagucaaauugaugagcuccagguuuuauaaaagaugcugucucaaaaaauaagacggagacugcuugaggaagacacuugauguugacaucuggccuguacaugcaugcacacauacauaugagcauguacauacacauuacacacacacacaaaaaaauuuaaagugugauagagcaauuacacaucuaggaaucuauccaauaaaauccuuuaacagacaaauacaaagauaauuaaaugaggauagucauuguagcacuguugguagcuguaagacaaugggguauauaaccaaaauaaaugaacaguuaaauaaauugagaugugcucaccacaguuugcuguagaagaauaagguggaaccauuuguauugacuugagaagacauucuuauucaaagcaaguuguagaguaaauuauauggaacaagucuauguuuuggauuguuuguuuguuuguuuuuguuauaaagaacccaccauacauaccuuuaaaacacacaaauacauggaaaaauaauuuagaaagauaccuauugaccagucauuguagggcuuaguaggaguuugccaauauuaguaagcagggugaggaguggggcuaaugugagcucugcagucuuacucugcucugugaacucucaccaaccaccuagcagucucuuuaucauccagugucaauaucugguuauccgaacauaagcucggagcaugucagagcuacuugaccaggggcuaaacacaaguuccuacaagacauuguuuggaucucgaaaguagguuucuugaaucgccugaguaagagaaccuugagauguugaagaagauacaauggcuggggacgguggggauggugaggcucaggucacagcuacuccugucauguggaaagcuggcgcucuuccuaagcccuugacucgccuggcacucugugaugcaguguuugcccuggagcaugcccuccucauccuuuggcaugacugggaauauagacagaccauagaggguaggauggaacaacuucaggugcucuggaaaaacuguuuccuuuaaaguauggcacuagaaaguucuuacagugguuugauuaucaguucucuuaaacuccaaagugcaagaaggaggaggaggaggaggggggggggaggaggaggaaaggaggggggaggaggaggaaggaaggaggaaagaagggggaaggaggaggaggaggaggaggagaaagaaagaagaagagaaacacuccaugcauucaggaguguccaugcauugcuggcugcucuugcaggggacccagguucagucccaagcucccacacagcagcagggaaauaucuguaacuccggggcucugauauucuuuucuggccuucuccagcaccaggcaugcaagugguacacagacauacaugcagauaaaacagccauacacauaagaugaagaaaaaaaaaaugguuucagguaagagauggguucauucagacgagguggagaucugaaaaagaggagucucaggccucgggacaaaucaggcaguggaaagcugugcccacacccuacaaguacaaguugucuucuucugucuucuucacucuguugcagcuuuuccugaaucucuaugcagcaguggaucuggccuuuuccguuuucccuuuuaaacaaauaccugggacuaaguuggauuaaguccccauguuuccagaaauggauuugguuggcucggucauccagccuaauguggcaaagcuagugcagugcccucaacccugacugugccaggaccccugggggcucucgcagauaugaugcuuguuuguuucauuaccauagauucucauuucacugcucugaauauugcuugggccuugggauguucuuaaaguucauuguaauauagagccaccauugcaaccagcugaucugagaagagcuuggggucaagcuguagucauggagugcuuagaaauuggaguccuggauggguagauuauucuccaguggcaucucuauuuggauccuccaucuuuccaguugucuagauauacacuaugcuagaauaaacugaaauauuucuuuaaacuuuaagacucgggauauagcucaaagucagacacuuguguggcuuugaguucaaauaccauuaccacauacaucuuucuaauacagaaauccugcuuuugggacuuggguaccagaaauaaugacagcaguauccaaacacagggaauauuagaaauagguacaagaaagcugaauuuggaagcaauagccaacuguaugaaaagaaaaacacaagcccugucauuaagacacuaagggaaacuacaccaaccaguaaugucagugucucaugaggcacuaugggauuaacugucaaaugcaucauacugguaauuacuaaaagacagagucaggaaaacugccaaugcuuuguggaagaaguaagauagaauguugacacuuguacauugggaaaggcaguuuacacaguuauuaagaguagguaucaggaacaucucaacucuacagguugggaaccaggauuaacaacagugaugcagcugaggcccugcagcuagugaaugguagaguccuggaagccugaugucacugguguauuaauaguaaucaggauugagguugaugaaaaggguguagacauaauuuacaaacuuggaaagauguauaaggaaagggagaauauggaaaauggugauuagaagagggaauggaagauaagguuagcuggcauuggguggcagucagcguuggccauugggucuagagaaccuuaaguaggagauguuucacaggaucugauauuugggguuugggaaacaugucuuacgauggaugacaggcaacuuuuagaagugaguguaaccccuuuuuccaguuucacuuugaaguuaucuacuuccuguguccuucuacuuacaccuaaaaggaagacuucuaagauccuaaggucacucacuuccucgccuguucagauugaauuugaggacuggagaauugccucagaacuauuaucagugauaguguuaagaauacaucucuucuaggguagugguggugcacgccuuuaaucgcagcacucaggaggcagaggcagguggauuucuaugaguuuggggccaaccuugucuacagagcaaguuccaggacagccaaaacuacccagugagacccugucucaaaaaaaaaccaaaaggaggaggaagaagaggaaaggagaaggggaggaggaggaggaggaagagcagcagcagcauaccaguguauuaccuguugcuuugcuuuuauugcucuggaguuucagagcuugggguucugucuccuuugcacccauacuccuuaucucccuacacauuuacagaccuuggacaucucugccuaacugcuagaaagucugcugaugacuaaguguguagauagacacaggaaauuccuuacaaauguauaauuguaccaaaguuaaagaucuaaaauuaauauauuauuacuaauuuuaauaauauauaauuaaaauaaacuauuucgacauaauaucaauaaacaguugaaaaugggguuuaaaaaucaugguagguaguguagggaaaaauacaacuaaaacccuaaaaaauauauuugaaguagcauacaauuacauagaaauaaaguuggugaaagaguugaagaucucucuacacaccaaacuuuaaagcauugcuuuaacaagcugaaggugaccuaaauaacuaaauucccaaacugaaucauagauucaagacaguuggagucagaaccucaacggcauuuuguacauuuuaaagagaugcucuuaaaauucacacagaaagacaguagcgcagaagagcaaagguuuacagagaacugaaacucaaugggaaaaccacuggacccaauaaauagagcaaacccucagaagguggagacaaggccugugugcacagugagcuugaggguagcacagacuccaugaagccuugucucagaagauacucuucacaacaccauaaugccaaauauguguccuuuacuuccuaaaacucagaauggagcugcguaugguggcacaaaccuuuaauccaagcacucgggaggcagaaauagaauaucugugaguucaaggccagccugacucaagaagcuaaaaugggggcugggaauguagcucgguugguagaacacuagccuagcguacaugaagcccuuguucaauucccagcaccuucauuaaguaggcugugaucguacuuuccugcaaccccaguguuugggagggaaggcggaaugaucagauggucucagaaaacgggagagggaggaggaggagggucauucagcacuuagagucagaaaacuuguauucagaucuucuaucuuuuucuaucuucguagacuguacugaacccugugguucuugaguuuuuaucuagugcugggaucagaagucuagggguccuucaccguaauaacuugacugcgcacucaguguagucgugucaagacugaccagaaaucugauguguuugauccugcucaagaaaaacaaacucucgugugguucaauugugcugcuuugcagguucagcuuguugguuuagaugaggagaguucagaguuuauuugccgaaacaccuuugaccacccguacccuaccacaaagcucauguggauuccugacacaaagggcgucuauccagaccuccuggcaacaaguggugacuaucuccguguguggaggguaagcagaggcuuuaccugcggguggccaggcaugcuuucuuggggacagcugacagcagugugcaguccugaagagcagacagcuaguaucacugccacauggaagaagcacaggacgugccuguggacugaccuuguuucagcucaacggguuuucuaggaaauguagcccaggucuugcugcugauggggacaagccuucugugaggcagagagcacuugggacccccuacuccauuacuagacaagacacuccugaguaaggagauggcaggguguugaucuugaugcacucuguguggagcuucucuucucagcugagcucagcagccucccuugugcucgggaauccagggccugccccgaaggcagacaggcugcuaagagcucuagagcgaggcguuggugaaagcugagagagcuaagcuggggaagggggaaguuguaaaagaaguccaaacucaggagucccuuuggguuuuauuacccuuuaucauaaaaauauuuucuccuguucuuagauuuauuaaauaggauuuuaaaaaaagauuuauuuauguauguaaguacaauguugcucucuuuagacgcaucagaagguggcaucagaucucauuacagauggcugugagccaccaugugguugcugggaauugaacucaggaccucuggaagagcagucagugcucuuaaccacugagccaucucuccagcccccuaagcaggauuuuaaguagggaugguauguguaggcuggcuaauguuuuaaaucauuguuucuacagguuggugaaacagagaccaggcuggagugcuugcuaaacaacaacaagaacucagacuucugugcuccccugaccuccuuugacuggaacgagguggauccuuaucuucuaggugagggcuuugaauuccagccugaggaaacagaagauacauuuccucagauccggcucuuucgacugaguuugaguucaugcugagaacaggucggggugaagugggugaauauggagagcaguuguuacuuccucaugggagcuuagcuuuuccugugugucuaucacaucuagaaucuaaggucuugcagaugugguggugcagugcaggccgggagguccugaguucaaggucagccugaacuacaccaggguaccaugucucaagaaacucuccucccuaccacaaaagacaaaaaugaauguucaggacgugguuguggccuguugucccuugugccgagcagagcagggggagucuguaugucucugacaugcucugauguccgcagguaccucaagcauugacacaacgugcaccaucuggggacuagagaccgggcaagugcugggacgagugaaucucgugucuggccaugugaagacccagcuaauugcccaugacaaagagguaauguuuuccuuuucuccuaugcugucugcaccugcaggugagaacagagcacuuaguguucucacgcuguugcaggcuauguagaucauaauguuggcauguaaauuauaauguguuaaaacagaaaacaacacuuauuggaugcacccuuuaaaacauguuuuauuuauugcuauuauuaugagagagagaaaguguguauaugugcaggcacguguguaccauggugcacgcguuaggagucaggcagaugucuccucccacugugguuccaaggagugagcucaaguugucaggcaugaacagcaggugcuuuuaccccauggcugagcuaccuccccccacccccaacgugcaucauuaaaugacucuaaccaccuaaccuagagucucauuucuccuuucauaucaaaguuuguugcuuuuuuuuuuuagaugaagucucuuauagauauccuaggagcuguuuagaguaacacuucucucugaauguaauggcuucucagagguggggggaaacaggaaggaggaaaauuucaugacagacaaucguaauuaaccacuuuucucugaaaccagcuugugaacucuaguacauuuacuuacucuuucuacuuucggucgguccuguuaggaggcaaguguguuuauuggugguguuuccgcuguuuaucaggaaagcgaggggagcguuccucuggugacuggggaagccagcauaagucugcuuccacagugccugugccccugucuuaguuccuuugcugccccuucaccugcagugcgaguaguaucaggguuuguauaggagaaacgaugccuuaaggccaucaacagaguaucauggagccagguagccauuccgaggguuugaucuuugguguucugcucuccugagaggaagcucuuuugcaagacuaugggacuugacuccugcuaagccaagggucaaaugcagagugugucugcagagaugaccacuaaaagaacuuguggaaaugucccagaauccaauuuccuaccucugauucauuccuuugucuaaacuaucuagaagcagacagcaaauuuggggcccauccaaacuugaccuguagcagucaggucucugugacccagagaagagcaagaggagcaggaauggaucaaagcaaauggcagaccugaaggaaggagccuggggauggcagaucugucugagggaaagccgugugugugugugugugugugugugugugugugugugugugugugugugugugcgcgcgugugugugugugcgugugcauguggugagagaggaggagggaagguuugcugccuggcagguguaguagaggagaguuuagugcauuggaaguugccaccuuuccucuuucaugaugaaccccacagguagagcacagauagauagcagagcaguuaccuaggcugagagagucucugcuccgagccacacagugggcauuccuggugucucugccugaggauuaccuagagccaacaggacagcagaugccaaacacagaacaaacuuuuuagaaucuugguaauaaugacaacugacaucaggguggaagauaagaauaucucacuaaaaauggaggaucugaagccaggcugggguaacauacaccuuuaauccaggaggcagaagcgggugguucucugauuugaggccagccuugucuacagaucaaguuccaggacagccaggaacagagaaaugcugucuugaaaacuaaaaaaacaccuuuaaucccagcacucaggaggcagaggcaggcggauuucugaguuccaggacagccagggcuauacagagaaacccugucuugaaaaaccaaaaaaagauaaaaauaaaaauaaauaaauaaaaaguaaggucugggguugaaaagauggcuuagugguuaagagccugacugcccuuccugagaacccagauucaauccaacaccuacauggcagcucacaaccaucuauaauucuaguuccagggaauucuaugcccucuucugaccucugcagaugcuagcuauucaugcaguccacauacauacaaggagccaaaauacucauauagauaaaauacaaaucuuuaaaaaaaaaaaaaguagguccuuuguccacucuugauacucagggacaaauacugcuaguagauccucaucuauuucugaucaauauacuaaccccuuuuccucuaaccauaaaaaauacucuauguaagauugacugauucaaaagggccagguauagugacacaugucuguacuccuaucacuugaauggcagaugcaggaggaucaagagguuuuuuuuuuuuuuuuuuuaagauuuauuuauuauuauaucuaagcacacuguagcugucuucagaugcaccagaagaggaugucagaucucauuacggaugguugugagccaccaugugguugcugggauuugaacucaggaccuucagaagagcaguuggugcucuuaaccgagccaucucuccagcccggaucaagaguucuuagucaucuugggcuauauuauagcaaguuuaagacuaaccuggaauauaugagacccugucuuaaaacaacaggaaaaggaaagagugauggguuccuggaugccugugauucuagugcauaggagguaaagauaaaaccgucuaaagcuugccagccugggcuacauaacaagacccugucuucuuaggccugacgcacuagauagacaaaggcuuugucuggugcuguucuacuacauaaggacggacggacggacggacacacacacacacacacacauacauacacacacacacauacauacacacacacacacaccacagcccuuaccacguauccaaccaaccugggccacaagagauuuuauuuuuuaagauuuauuuauuuuuauuuuauguguauggguguuugccuguauguauguauguccuuguaccacauguguguauaguaugagaaggccagaagggggugucauccuccauuccagaguuacagaucacucguagcugaaccugggucuucaacaagagcaacaaguacucuuaaacaccaagccauaccuccaguugcccucuuaaaaacacaaaaccaaaagucauguuaccuuuuucauacaaauggaucucaggucuagguuuuauagcuggccagcuugguagaaccguauguggauuuaucgugaaucggcaucugacugcguguaagugaaaccacuaauagccagaaaauacagaguccuauucagacccccgugugcugugcuagucagcgagagcaucucaggguuuuagaggagaaguaggaagcagggcaugggaagaagucagccagugucugugguaggaugauguguauucucugagaagccacucgcuuaccugcuguguggugaguugggguucagauggucuggaaaugacagccguccacgcugugagcugaaucuggaccuucuccccaacaggucuaugacaucgccuucagccgcgcuggagggggcagggacauguuugccucugugggcgcugaugggucugugagaauguuugaccuccgccaucuggaacauagcaccaucauuuaugaagacccacagcaccacccccugcuucgccucugcuggaacaagcaggacccuaacuaccuggccaccauggccauggacgggauggagguaagccccgagccuugacccuugacuccagucuguccaguauauuuacaagaguagcuuuuagaugguggcaguuuuaugcccaggauaucuuuggaaauauaaggagauguuuuugauugucaaaaguuagaguguguaguaaaaaaauaaaauaaaauaaaauaaaauaaaaggaggagguuaaaaaaaauagagaguggagucuuccuggcaucacauggguaaugacuacgaaggcugcucucauucugcaguccucaaaguccccaacaguguccgugcacaacaagggccaguggggccugacugaggaucccaucaacaaaaggacucggagccuucucccugcuuguuuggugagacagagucucuguagcccagaugagcuuggaacuuacugugcauccuaagguaacugcaaacucacugccauugcacagccuucuguguaaggaucucugauaugguggaauguggcuuaguagcagagugcuugucuagcaugcucaaggcucugaguucuauccccaguacaaaaaagaagcaacaacaaacaaacaaacaaaaaacaaaugcauacacacacaaaacccaauaaacuuuugcuggccauguuagcacacaccuuuaaucucagcacuugggaggcagagacagucagaucucugugacuuugaagccagccugaucuacagagugaguuccugaacaacaaggccacauagagauacccugucucaaaaauaaguaaguaaguaaauaaauaaauaaauacauacauuucugcuagaguaaagcugagacgaagagugguggugcgucugcagccugggacucagugcagacaccacagucaacaugauucuuggaguucuucaugcucgucccugucguuugcucaguggccucccucuuugggaaugugguguuuaauaaggaagcugauccuauacagaaaccucaaggaugagauaagaguguaagucagagcaacaggcauauggaggacuugcuguccuggcccagagugugcaagagccuuuuaagcuuaaacacauguaugcguauguuucccagcuucaaauuugaagucauugaaaaacucuaguccugaagaaauaauauuaaauccaucugguaauuugucaugaauuaguuauauaacuaauuuuaaaaaugcaaauaaacauuucacgauaaagaaaaaaggguuagacgagugacaucuaagugacuagaauuuaaaccaagucacaguuacugggacugaaugaaagcguaggccuucccauuugguguucuaggccgacucuccaggcagaugcucagacagcagcucuguggucugcuaguucuuaugagggguggauuguuggucgagaggauacaguaguuagccuugguuugggugcagcuugugccucagaguucuuacaucccggauugugcauugauaaggcaugugagaccuaacuaagaugcacaggcccuuagcaaagaugcuuguagauuauccuaacucacguggccuguuccugcuuccccuucuccuucagucucuuuauagucucccaaucucucagcaaggagaacacauggucuguguuagcucauuguuuucuucccuucuccaucaggaaacccuaucucuaguguucucggauccauaaaggaaaagaccaugcuuacagugcuguguucaugauagugcuuuccugcuacacucugcaauuauugggccuuuuucuuguauuucugcagguggugauucuggauguucgaguucccugcacaccgguugcuaggcuaaacaaccaccgagcaugugucaauggcauugccugggccccacacucguccugccacaucuguacugcagguaaccauggcgggaggaaguaucaggccaggugacuguggugggucuuaagguuuuguguuaguuuuguuauuuauucuguugagauagggucuugcuggauaaugcugccagguagugacccgcuguauuuaucaggcugagcuccaaauggcagcagucccccugccucugccuccagaaugcuguuacagucaugugccaccacaccuagcaaaacacauucauuggcaauaguucagguuuuuuauuuauuuucugauggugcuggggauuggaccuaggacuuugaacgugauaagaguuacucuaucacuuaacucuguucccagucccuaaugcugggguuacaggcauggguggaauuuuuuuaauguuguauguuuauauagcacuuuaugucaaccaucuguguaacucauugaaauguaaauguacauaaacugggaaacagucaucagagaagcaucuuuauccacgcaaguauuuuuaguggcugucaguaacaucauaguuuggggucauuguaucccguguccuucccugauuccugacugcaauguccugaucuaauucucuaacccugguauaguaaauggagcuuaaugacaccugggaaauggagucaggaccuagauuugguccucacuggcuacauggcaagaaggagcaagucuggugacauuccuaaaucuugguuuccucuucucuaaaauaaagcccuuucacaaagcuuugaugaacaaauguuucacaaauugugacugccucuccagaugcaagauuguuaccccauugccugagcuaugacauucuugcuugcuuuuucccuagcggaugaccaucaggcccucaucugggacauccagcagaugccucgggccaucgaggacccuaucuuggccuacacagcugagggagagaucaacaaugugcagugggccuccacucagccugacuggaucgcuaucugcuacaacaacugccuggagauacuccgcguguaguguugguggcaccucacguauccggcaggggcuugugugcuucagccucugcccccuucccucccauguaagaagaacauguucccaguggccaguaugucuacugcugcuuuacacccacuguguucagaagcugcuguagaaguccaggccaguuaccccgcugucuguguuggacugugcuguguggcgccacugcagcccagggcuggguuuuaaauuuucacuccuuuccucuucuuugcuucuucaauuaaacguuucuguauauuuguuugucagcuguuguguucauaaacaguacaagcacuggcucugucuguguccauuugcccaugucugucugucugcugcugaggcagucauccaucucguguccccaucugugucgugcuagcacuuaagugggaacaaaggccaacuugagauugucuuuccuccuggcaccagugucuuuuaacaaaccucaacuuuguauguuuuuuaucuaucaggcuaguuuuuuuaugaaaagaauuuaaccuuucugguuucuugauuucacagauuucccucuuuguaccuuccucucuucccucagugccugcaguggguacuggacccuagaccccacgagcaguuugcuuuccugagucacugccuguggggcacagcccugaccccugaccgggaguugacaacugcgcuggugcucugaagucuacugacucaccaaccguucucagccugggucuccugaaggcccucggaggcccaggagaugcaggaggcuucuguucacccucaagucccuuucucuggcuucacuaguugaguacccuguggggcugagauaagcaguugacuaggggucaugcggaaggagaaucauguucaggaaagcugaacuuauauuguguuuccaguaccugguuucagaaucuauuuuuccaguuucgaacuugaaugauaggcaagagagaucucucagcuaagcuucuguguuucuguuugcugagucuccucuaccuggugggacacuggcccaucuuuggauugaguacucugaauaagagacuuccugggagcuaccgucugugcuugacccugaacaagaucuuuagacugugacagacaggcaguucucauaaaugaugagcaaaucagccaagguagacucagggccagccagcuaagacucuccacgccuguggcaccugcccucucuucaguuaagguuaugagcaguauuggacuuuguaggcugcaguuggccaugcugacuuacaggccucgcgugucuguuuccguuagguguauggguuccacagaggggacuuguaugugguucugacuuuagaugaguccccggcaguuuggaacauggucuaggagaggguggcuguuuauaaucugcugagcugcuugcagguuucuuagacgcucugggacaaggagagcagcaggccugauggcugauggcugguuggccacucaugcugccauugcuggagaagucaaugucgacucauucuucugggaacauggacugucuggcagagucuuugcuugcuuccacaacugauguaguuguaugccaaaagucuuagauuuagauucacuauauuaggaccuugucccaaaggaaaggccuuuucagucaggguauuucuccuuggccuuccuaaucugucauucugauuuugggucucugggguuccugcacuaaccuguggcuuguccuggaucaguuugugguucccucugcucuuaguggcguuugccagccagguacagacuccucaaagguagcagacuugcugaugguugcugcuguaggagcccucaguuucuuccugggcugagucuacaguaguaggcugagucagggcgucgcagggccuguagggagcaccugugcuggggagcaccugugcuggggagcaccugugcuggguggacuuuagcuuggggugaaugauaggauugucaacuagaacuugaaaacaaaguuuuaaaagguuagcagcaguuuuagaauacauuugugugaggucucuaugugcuuuggaaaccaaccacgugaugacuuuuuccuugcucuguggacacuugucaacuuucuucagucuuccuuuucugcucuccaacuagauuagguaagacucuugcuaucucugccuccaaguacguguguacccacaguugcaggguugcuggcauuugaagucucucucuuaucauaugcacagguggccccuguagcugaggaagagguuucugugggcgugagaugcaggaaguccauaagucugcucucuucccugaagcacagcucuguuaaaguuucaaagccagucucuuaauauuugcuaguucuuagccugacggugaggugggucaguaucuccagaucuguccucuaggcuccaggcucugguggggcugcagugcuauuuugacgugguuuuggcaagcuacagcuagaggcucuggccugugguuucugugucugcuguaggggaggcugcaugaucggucagacuagcagagagcugagcuggugagugggucugaggcuuuugugggcuugcgcuguccccacuggagauugaucccuuuccugaccuccgaggcugggcuugaggaggagagugacaugagacaagucgguggggacuuccuaucaaaaucagcauuaggucagauaacuggagacagcccaggaagaacgggaaaaaggcagaauccuauaguauuuugaugauuguuacaacuaagauuugauauuuaggguagaguagaaggaaauacuagagaacacagagagucugaggggagaaacauucagaugguucugucucauagcuaugcagcggaccugugccucagccuagguuggcuucugcaccauuaaugaagccucugugucgcugggugccaggagguacugugggcggagagcccuucuggcagcagcgugaugucuggugguuaaauucuagguuuuggguaucccgugacagugcaugaugacacuguuugagacagguucuuucuuuguagaccaggcuauccuugaacugagugcugggagcacaggaugagccacugccccagcauccgugcuucuucccuagcgcaggccucaggcuaggccagugaccugccacugaaccacacccucuagccccugccguuucuuuccuuugucccuuucucauuaccucgcuacuguagaauguucucccugaugcucugggcccuugauuccuaggccguaagaaaauguaggacuccgggguuuaccaaacauggucggcaguucauaagugcacccuacuuuccccauugugaaauagggcagguccuuugauugccuggcucaggcuagaguaccauugcaauagaggccucagaacgaguguuuucuuuagagccugcccugagggugaggaaggccggccuauucagcauguggguuuucugagaggagagcuggucugagcaguuacugugaacccugagccagguuucccagaguuguccucuccuccugugaggcagcagcugagugucucacgucuccaaucuuguucaccucgagccaucuacauucucucuuucucccauacugucauugcugcuaauguucagagucaagcauguggcauuacggaaugagcaggucuucuugggcugcuaucugaaugucccuuuuuaaauguggaaacgugcagaugcuuucuccgagaugcuuagacugaugugucagccagaagaagcuuagacuccaaaggaucgaugcugacaucugugcaacagcugggaaguguacaagugaagccgaacugugcuauccaccauuggaaagaaacguucucaccuugggcugacugugauguacaguguguuaugggaauuguugggcugaagcuuucgucaaaucugagucccuugcuuugaucccguguauguuaugaccccucugucagugacuuuccccugagugugaauuauagcaugauuguauaaaccucuauguagaaaauggagauuucauguucuacaaauguuaagcucuaacugacccacuucugugcgcauguguaugaccugacuuucuuauauauuuaaacuuuccuucuguucuaaagcuuuuguggcauuccuuguucagguggagaggaagcugucccuuugcagaccuguacuguaaccauuucuccuuuauaaauauuauuuucacagggcugauuguauacagggcuuauaauaaaaauuuaacacuguguugucaacgagcugcgguuucuccacuggaggugacuucaaaagcaccugaggguggagugucccuucugugaccuuacuuccuaguacgugaagucuaaucucaguuuuguccuguuucagccuccuguauaagaaguaucauauuuucugcccaucauacuuuguaauaaaacuugaacauguauagauugaaau

SEQ ID NO: 6447 - RNA, 1808 nt, Mus musculus
acccccccccuagagagcucuuaaagaguuucaagcagcugcuacauuauuuuuucuuuauuuuuccauaguguccuuuuucucuuguuuucucugccaagagaaccgaugguggaaggggcuggagaaauagcucagcaguuaaggauauugguugcccuuccagaggacccagguucaauuucgauucuccaugugacagcucacaaccaucaguuccaggcuaucuugaugucaaccuuggcggcgguuucuuuaucuguaaaauaaauaucugagaacaccaggcacacauguagcgcacagacauacaugcagucaaaacaaccauacacauauauuaaaaauacuuaaacuaauuuuaaaacaacagauggaaaacgaagauagcaguuugacucaaaggcuggcccgaucuuuuguccaguauggguuggcaaaacaggcaaugccauccuuguuuacagaaaugaaaucuaaaucagaaaguuuuaaaugacugggcaaaucgcuucucgucggcuggugggguaguggcuuauuuuguuugguuguuuuuuuuuuuuuuuuuugucguuguuuguuuuaauuaaaguuuuugcuuuuuuuuuuuuuuugagacaaaguccuaagguuuccuucgccucuuaagugcuggaaucacagacauggccugccacgcccagcauuuaguacuuuuuuguuuauugcuuccuuuuuuuaaacaggcaaccuuggcggcgguuucuuuaucuguaaaaugaaccgacugaacuacauauuucuuuuucaaccaaacaauucuuauucuggacuugcucaguuaggaaggaaagucagucaccugaaucucuccgggaaggugaucugucguuuccaagcaaccgggagcaaagaaggguugcgucacuccuggcaggggcgggguuggaacgaguaccgcgaggcagcggaaccaacuuugcagaauccgggaacgucuuuuugcggcggaccgggcaaaggaaguguacugcaccauuuaggguccccgcgcccggcuccuucgcggucacucaaggcagugcagcgucaggaagagccgaaccucugaguuucuggagagcuguagcagcggucugaacguccagaccggguuguuccggggccggacuagacgggcugauuuuagcugcucaucuuugcaccgcgcagccccuugucgaagcagaugaugucuugggcugccgccagccugagaaugaccgcugucccgugcuuucgugugcgaugccucggguuccgcguggguccuuggggcgccucccagcaugcaaaccccggcuguggugcagcgccacacaggacgcugcaugucagcgcgacggccucggcgggacacaauaaguggucuaaaguccggcacaucaagggccccaaggacauggaaaggagucgaaucuucucuaaacucacucucaguauccgccuggcgguuaaaggugagaaccugguaguccucacugcuggucacugaagcucuuuaggugccuaaggcuucauuuaggaccguccccccaacccccaguugucauaauuguccuacucauaacccucaaagcacuuacuuacacuggauauaccuguuuuccuuuucaaagaccuucagagacccgcccuuagauaaaaaugacuucaucuaaggguauaguuagaagguacuucauagaaauacgccuuaagaaaguguggcagcgcggccggcuugcccgauuuccgcgaguugguucugucggugccggucgcggguucccgugucguuccggucu

SEQ ID NO: 6448 - RNA, 1808 nt, Mus musculus
agaccggaacgacacgggaacccgcgaccggcaccgacagaaccaacucgcggaaaucgggcaagccggccgcgcugccacacuuucuuaaggcguauuucuaugaaguaccuucuaacuauacccuuagaugaagucauuuuuaucuaagggcgggucucugaaggucuuugaaaaggaaaacagguauauccaguguaaguaagugcuuugaggguuaugaguaggacaauuaugacaacuggggguuggggggacgguccuaaaugaagccuuaggcaccuaaagagcuucagugaccagcagugaggacuaccagguucucaccuuuaaccgccaggcggauacugagagugaguuuagagaagauucgacuccuuuccauguccuuggggcccuugaugugccggacuuuagaccacuuauugugucccgccgaggccgucgcgcugacaugcagcguccuguguggcgcugcaccacagccgggguuugcaugcugggaggcgccccaaggacccacgcggaacccgaggcaucgcacacgaaagcacgggacagcggucauucucaggcuggcggcagcccaagacaucaucugcuucgacaaggggcugcgcggugcaaagaugagcagcuaaaaucagcccgucuaguccggccccggaacaacccggucuggacguucagaccgcugcuacagcucuccagaaacucagagguucggcucuuccugacgcugcacugccuugagugaccgcgaaggagccgggcgcggggacccuaaauggugcaguacacuuccuuugcccgguccgccgcaaaaagacguucccggauucugcaaaguugguuccgcugccucgcgguacucguuccaaccccgccccugccaggagugacgcaacccuucuuugcucccgguugcuuggaaacgacagaucaccuucccggagagauucaggugacugacuuuccuuccuaacugagcaaguccagaauaagaauuguuugguugaaaaagaaauauguaguucagucgguucauuuuacagauaaagaaaccgccgccaagguugccuguuuaaaaaaaggaagcaauaaacaaaaaaguacuaaaugcugggcguggcaggccaugucugugauuccagcacuuaagaggcgaaggaaaccuuaggacuuugucucaaaaaaaaaaaaaaagcaaaaacuuuaauuaaaacaaacaacgacaaaaaaaaaaaaaaaaaacaaccaaacaaaauaagccacuaccccaccagccgacgagaagcgauuugcccagucauuuaaaacuuucugauuuagauuucauuucuguaaacaaggauggcauugccuguuuugccaacccauacuggacaaaagaucgggccagccuuugagucaaacugcuaucuucguuuuccaucuguuguuuuaaaauuaguuuaaguauuuuuaauauauguguaugguuguuuugacugcauguaugucugugcgcuacaugugugccugguguucucagauauuuauuuuacagauaaagaaaccgccgccaagguugacaucaagauagccuggaacugaugguugugagcugucacauggagaaucgaaauugaaccuggguccucuggaagggcaaccaauauccuuaacugcugagcuauuucuccagccccuuccaccaucgguucucuuggcagagaaaacaagagaaaaaggacacuauggaaaaauaaagaaaaaauaauguagcagcugcuugaaacucuuuaagagcucucuagggggggggu

SEQ ID NO: 6449 - RNA, 8175 nt, Mus musculus
cgggcaaaggaaguguacugcaccauuuaggguccccgcgcccggcuccuucgcggucacucaaggcagugcagcgucaggaagagccgaaccucugaguuucuggagagcuguagcagcggucugaacguccagaccggguuguuccggggccggacuagacgggcugauuuuagcugcucaucuuugcaccgcgcagccccuugucgaagcagaugaugucuugggcugccgccagccugagaaugaccgcugucccgugcuuucgugugcgaugccucggguuccgcguggguccuuggggcgccucccagcaugcaaaccccggcuguggugcagcgccacacaggacgcugcaugucagcgcgacggccucggcgggacacaauaaguggucuaaaguccggcacaucaagggccccaaggacauggaaaggagucgaaucuucucuaaacucacucucaguauccgccuggcgguuaaaggugagaaccugguaguccucacugcuggucacugaagcucuuuaggugccuaaggcuucauuuaggaccguccccccaacccccaguugucauaauuguccuacucauaacccucaaagcacuuacuuacacuggauauaccuguuuuccuuuucaaagaccuucagagacccgcccuuagauaaaaaugacuucaucuaaggguauaguuagaagguacuucauagaaauacgccuuaagaaaguguggcagcgcggccggcuugcccgauuuccgcgaguugguucugucggugccggucgcggguucccgugucguuccggucuuuuuccgcucccgaaccuuuguuuuauuuugccgggcgagguggcgcaugccuuuaaucccagcacucaggaggcagaggcaggcggauuucugaguucgaggccagccuggucuacaaagugaguuccaggacagccagggcuacacagagaaacccugucucgaaaaacaaaaaacaaaaaacaaacaaacaaaaacaaaaaacaaaaaaagaaaguguggcagaagccggaggccucgaaccagaccaauaauucauggcaauggacauuugcaagugaagcuguuuggacaaaagaauauccagugugacacuccacaacaccgcagcuucugcuucuacaucagggauggguuugguuugguuuuguuuaggggagggagacugcaagcguggagaggauggaucuggagggaugacaggaucagugugagauuggggugcaugaugcgaaauucacaaagaaucgauuuaaaaaguuaaagauauuuaucaaauaaaaugacuggaagagggaaaaggaaaaaauaaagcauaaagagucaagucagggcuuggagagauggcugggcgguuaaaagcacuugcugcucuugcagaggaccuggguuuguuucccagcacccaugugacaucuaacaacuaccuuaaacuucaguuccaagguacccaauguucucuucuggccuccucaggcacugcaugcaucaugcaugcaagcacaugagcaggucuuguaaggaagaaagagaaagaaagugccuuucuugaagggacuaaccaugcgcucugcagcugcuucuacuaccacugaagguugggacaggcaugcugagacaagccauuucucgcuuccuuuucccucaucagagcuccuaagacauuuccuuggaaagucaguuuuggaaccaugcgucgcuucagugauucucacuucggugucaggcugguagaaguagaggggggaaaauccuaugaaaaguguggaccuggaguuaggaagaugugaacgauguauuggcuagguugauucaaugcccuucaacccguggcuuaacuacugaauuuuaauuuucuguaaagcaaggacaauacccacuuugagguggcuugcggcaugcaaaaggcaauaagcuaauguuaauuuaucccuacaacuugugucugaugcuucucuuugcuuccuuuucuaaggaaguuuugauuuaaccaacauuauuuuugacccaggaggggauacuacagagaacauccuguauagucccccucccccagaggcugaacagaggcugagcccaguccuaugugagcacuucagggagugcauuaacucagacaguaagagcaaguaucuuaacacucaacuguuucagcugacagaaauggaguuugcugaaacccugcaacaugauaacuaucccucaagacagacugaauuaggaacuucuuauccagguuggguuucuagcccaggcauaaagcccaguguucagcauggaugaggccuugaauuccaucgccuguacccaccaauaaagaaacuucuucccuaaaauaguucuccuuauuccaauagaaucacuaaaucaaguacuuucuguuuguuuguuuguuuguuuguuuguuuaugacagagucucacucuuuuuuuuuuuuguuuguuuguuuguuuguuuguuuugaaucaugguuucucaauguagcccuggcugaccuggaaucugccucugccuccugagugcaggguuugaagguguucagcaccauguccagccagaaucucacucuuaacugaaacggacccagaacucauuauguaguucacaugcugagccucuggaguggugggguuacgggugugcgccaauaugcuuaucuagauuaaauacuguguguguguguguguguguguguguguguguguguguguugugccagccacagcacacauggaaaucagaggacaacuuuauuuuuguuuuguuuuguuuucgagauaggguuucucuguguaguccuggcugucaacucacuuuguagaccaggcuggccucgaacucagaaguccgccugccucugccucccaagugcugggauuaaaggcgugcaccaccacagccuggcagaggacaacuuucugaagcugauucucuccuuccuccuaugaguagauuguagggauagaccuuaggucacuaggcuugcacauuaggcaauuuuaccaccaucucucuggcuuuuuuauuuuuaauucagggcucuuucuagccuagaguuuaccaaauagacagccuagcuggcuaguggucacaggaucuguaucugccugccugguucugggauuauaaacuggugcuggcauuuucuuauaugugggaucuagggaucaaauucugauacuuuuguccucugccaggcugugguggcacacaccuuuaaucccagcacuugggaggcagaggcaggcggacuucugaguucgaggccagccuggucuacaaagugaguugacagccaggacuuuacacaccucauuauaauguuaguauucugacaaagagucauuucucauugcuuugggguuggagaggguggaaaccacuuguuucuccuauacuguggugagaggcuuuugaucauucuucucuccuuauccagagggaggcccuaacccugagaacaacagcagccuggccaacaucuuagaguugugucgcagcaagaauaugcccaagucaaccaucgagucagcacugaagacagagguguguccuuagacauuauucaccacagcccccagagaguauauguuuggaaagccaccacagacuccuuaaauugucaggggggaaggguaggaacauggcugacaaguucaacccagagaccuuuggggauucucuacccuuggccuuuaguuagaguagugguucucaaccuugcuaacucugugacccuuucauacaguuccucacguguuggggacccccccccccaaccauaaacuuaucucguuacuacuuuauaacuguaauuuugcuacugguaugaauugucauguaaauaucuguauuuucugauguucuuaggcaagcccugugaaagggucauuugccccugcaaggggguuuagacccacagguugaaaacuggugggcuggaggcccaugaccaggauaggcuagguagacagcauggagaccuauacaguggagagcugcauuagaguagaaagaacagguaagacuggggaaagcccugacauuagguuggaauagggauuguuuuucuuuucaaauguuuaugucuaaagaaggaaagccagugaaaagagagguuaagggcaaugaugacagugggagguguuggccuccaacacgucuuucuccggaauagcuaggaauuugacgaguuaagaguaucuucuuguuguuuuaauuugaaauaguguguguguguguguguguguguguauguguguguguguguguaugugugugugugaguguguguauguguguguguaugagugugaguguguguauguguguguguaugagugugagugugugaguguguguguguaugugugaguguguguguguaugugugaguguguguguguguaugugugagugugugugugugaguguguguguguguguaugugugaguguguguguuugugugaguguguguaugugagugugugaguguguguguguguguguguguguuuagcccaggcuagcauggaacuccugauccuccuaccucagccucacaaagugcugagccgauagaggcauuucaucacucuccagagucauugucauagagcuggcaguuauugggacuuguuccagaccaaguccuuuaguaaaaacacugcaugcaggaucucagggacuccugcaggugaccuaaaguggaaacuaaggcacagaaagguuugacuuguuuuagcucaugcaaaaaacgacagaccucaauccaagcggccagaccccagaacucaguaagaaacuuggauuucaucugugaaaauggaugggaaggucaucaauugaaaggcccuuggaagauucaggccaaggcacucagaaagaguaguggcaugggcaggggaugaaggucuagggaguccagaggaaauugguaacuagguggggaguguuugaauuuagcuacagagcuagguucaguggcugccaugacaaguccuacauaugugguguuucuauagcagcauucagcaggggcauugagauuuccuaaguagguuucacauggaguggaauauaggaagaugaacaaagauaggagugaccagggacuacagagauggcucggugguuaagagugcuuauuguucuuccaguggacccaaguucaacucccagaacccacaucagguggcucacagacaccuauaacuuuagcuucaaaggaucugacacuucuugucuccauaggcacuguuauucaaauguacauacacauauaaacauaauuaaaaauaaacaaauuuaaaaaaaagucuuuaaucucaacguuugggaggcagaggugguggaucuuugaguucgaggccaaccuguucuacagaguaguuccaggacagcccaggcuacacagagaaaaacaaaacaagaaagaaagaaagaaaaaguaagaaaaaaacaaaagaaaagcaagcuaagagugacugugagaggauuggaugugagaucugcuuagagaggcguggaagcagagcugugaaaggcuauucaggaaugagggaaacagacucccuucuugaaggagaggauuuccagcggucucagagguugauaccauugggcuccccucagaagaaacaaaaauaaagacucgaggguccaagcuuaagucuugagaggccauggagccacucuuuaguaccugugguuuggugcuggcaagaagggcacugggacauuaggaaauaggauggugcauuuauuuguuuauuuauuuauuuauuuauuuaugcagaaaaacaagggcauuuauuugcuauaugagggucguggcccuggaggcucuucucugcucauugaggcguuaucaaacaguggucccaagugccaucuggacauuaaauauauccugaacaagaauggguaaguguguguguauggagaaaggggaaggagaaagggauagcaccuuuagauuccaguucuauguagcaaaugccacugguucucagcaauauuucagguucuaagcacacuucuuccuuaguggaauccagaauaauaacugauuuuuccuucaugucuuuugaaugagauaggaucccaaagauacagucauugggucuaagagagauuuuuuuuccccauuauuccaucuguagcuauagaacggccuagucuucaaaugcuccaccaggacaggaaucuuaauggaacaggaaacaaugaguuaaguugcauccuaccgacaccagggagggcagaaaauaggaggugggggugcucuucgagucaccucacccagcaccagcugcaucuucgucaugaggggagcugcugggugucuuugggugcuccaguggcuggauggcuuaggggauaguguuaggacgcagcgcuguguagaguugggcuucuaaaaucauccacacauucuugccuguucccucuccugucaggggaaugauggcugaaggagcacgccacuuuuuugacaaaaaaggagugguuguuguuggaguggaggacagagagaagaaagcugugaaccuagagcgugcccuagaacuggccaucgaagcaggagccgaggaugugaaggaagccgaagacgaagaagaaaagaaccuuuuuaaagugaguaugggugcuggugagauggcucagugcaucaaggggcuugcuuccaagcugacaaccggaagcauuuguguuugaugggauuccaaggggucucuaauagauaccugaagguauaauagauauaauagauaccuaaagguguacuucucugugugucagacuacagguaaagcaaagaauucacaaacugcacaguguuacuaagugaacaccagaggauagggccuauugugaguugguaagaagaauucugcgcauuggaaacuaugaacuuaaaggccaaugaugauauaguacagguugcuccacucaggauuuugcaaacuucugucuggguuguggcauuacuuccuggcuucucaccuccucacuucuuuuaucucuaguucauuugugaugcuucuucacuacaucaagugaggaaaaaacuggacucgcugggccuguguccuguguccuguucaauggaguucaucccucacuccaaggugcagcuggcugagccggagcuggagcaggcugcucaccucauccaggcgcuuaacaacuaugaggaugugauucacguuuaugacaauauugaauaagcggccucgacuagacuuggcuccggcucuuuccuaggccgcacaagcuucugcagcaaucucagagacugaaacagcugagagccuauuagagaccugcugcaauggcugucagccuugggaaagggggacucuuagcucuguugguaucaccgggccaucuggaaugcaaggugagacuggccagccggucugacucugaucccaggugacuggcucuugugaagagucuuaaguguccugugguaccguagaguggaaaugaucuucaauaauaacaguagugacuuuuggaugcuuuguugcugguaugacucuugagguguccugauuuguguccaguuuuugaaccucuggacuaacugacauucaagcccacaugcuuacuucucuacuuucauacuaagauugucuuuuuccuuuucuuucuguuguggaauagagacguggcuguucuugugguugggugcugguauaacgaccuagccuucucacuuguucaugcagcuagugucucuugaacaccuuacuuacagggauugugcuuuucuagggagaaggcaguucaguuggugcuuauguccugcucuaagaugugagaccucaaagggaagacacagggauguacccauggcacugcuccaggguaucauggauuacguucauuaucuuuguucucuuuuugugguuucuguuccccguuugagagcuuaaguuuuagugccaauagaaaaucaggugucaaggaaaaaggccuccccaggaucuacuuugauuaacccuguguuguaauauugauaacagcagauggggguugcuuuccuguaagggcuuauacuaacuuagguuugaaagcuugagggucucagaaggccaguuuuggcuccuguucuaaugacaccaaau

SEQ ID NO: 6450 - RNA, 962 nt, Mus musculus
uagagccaccaguuuuauuccuguuacagggguguggaaauaugucgccgagggcugugugaagacagucuccagcugggcuucaggcaaagcccucagcagaagucugugcccuagaugcugcugccuagaguccuuccccucaaccugcugugcagugggcuggggcggagcggcaaaagcagcucuuguugcacuuuguucucuaaacaacuccagccuaaauggcucucugcucccuucgguggaacaaggugugcuugaugcaaggaaguggguccuuucagauaggggcuugaccugggccauggcaaggcccgagguuacuaaucccacaaaaucuggucacagaaaccauuuaggaugucgagcuuaagggggcuggugauuucggaaaccacaaggcugcaguucucggauagcggaucugucacaccccuucaguagugacaugggcccaccgccggcucccuuggccuaacaucgggguauacggagggacuacgagccgccuccaucuuccucuguaggacuccguggcugccaguggaccugccucccgaguccccacaguggggugccucaaacuacugggucuuaagagcgcaagaagggggcggagcuaaugggacugcguucacaacggcuaacggguaaaccgaggcaguaaaggcccaggccauuucugaagguccgcgccggaagagccuugcgugucgaucgcaggcugaacucgucuccucccgagaucugcgauucgguccccgccgucgucccuucuccacgagcggcagaggagguuggcuccgggaggcgggagagcgcgggcugugaaagcgaugugggggcagacaaaggcggggggacggcgagcaagggaaagacaaagcacagaggggggucggcggcggcuucucccggaggcggccccgggcgcgcggagccaaugggcgggcgcgggg

SEQ ID NO: 6451 - RNA, 53612 nt, Mus musculus
caaagugacgucuacccgacggacggaacccuacgggagaaacgcagccuccgcuaguuagagcacuuguagcccaggggacgcuggggguuacguaauuuucccagcagcccuagcucgccuugcgcggauguccugaaggccgcgccccgcccccaccccgcgcgcaggcgcaaacuagcuguacgcauucuacguaacggacggcugaagcuacgugaagaguagggugccgugacugagcuaccuguucugggcuguucagugacaucgcggcccgcagauuaucuuugcgaccugaagacagaaaccagacaaaggcaggcugguuggagguaguggccucaggagccccgggcccgguugcagccucgggugcagguagguagcggggccaugacauuccagucggugugaccgugccaggccgagcggugacuaaguugcauggccgcagagccagguacuguuucccuccuaaccaacccuuuaaguccggccgguggugacaugcaucaauacccucaacuuaucuuuccagaauuaaaagaaaaaaaaaaagacuaaaccucuguccauccuuuucugcuccauuuuauguugggcuuuaggaagauuugggggaagguuucgaguagaucccaaccaacaggacaaaaucugagaaaauaucugguguguagccagaagaauaaaagagcaucgaacuaggcuucuccgugguggaccuaggacuagacacuagaaguuucacggaagcaaccgcuucuagagucgaccuuacccgaagguuucuaacaugcaaguuauuuguaaccaacacuuuacuuuguaaggugacaguaaugucuacaucauuucuagaaauuucaucauuuugacugaugccacagaggccugggaggacaagcaaugauugcuacauauacuccuuuuuacugagagagcuugcggaagauaaucaagauggguguguuaauguugugccuggcuuggagucuaguguuuucugcuucagaaguccuagaggcuggauggccuggcagagagcugugcaucugagaaauggguugacagguccagcugagucuuaucagaaagccagugcacaaauggcuuggauaauuuuaacauaaauaaccuugagggagccuguaugaauuccauuagaaacacuucuguguugugaacacuccugguauagacugaaauggccagacugucaaauugacagggauauguaguuacuucugcuuggacagggagccacuaaagcagacgcucuuuguucuuugaggcagugccucuuacucuugcaggcuggccuaauaucacuauguaggacaaggcagggcaggccacuggaacuacuauaccugccaccacccccacccccuuaaguauagggucucgcuauguaguccuggcuagccuugaauuuggacaugugccugcauuugacuccugaguacugggauaccucacccacccuaccggccccuuggagcuuuugagacaggggucuccugaagccuggacucacuauguagaagaagauggccuuggacucucggccucagucucccaagugcugggauuacaggaguaaaccgccacacccaaucuuauaugguccugcuaucaauuuagacagucucaacagcuugaguuacauccccagccucccuuuguaacauuuuaaaaauuacauuaauuuauuuauuugggucaggcauauauaaagggggagguauuauaucgcugugcauggagaggucagaagacaacuucuaguuuaaucaucagucguaauacacauacccuaucaguaauaaaacucuuacacgcaucuauccuuuaggcugaauuucaaugcuuaaaaacagauguuuauuguuuuuguuuuguuuuuuagauaauuaaagauauaggacugguguuuagauuagggagcagaauugaaaauguagcauaaaugcuuuuguugguuggaaauauuuuugcauuguacucugugauuucauacaaaaucaguaccuucagucugagcccguggaguaacgugguaguuggacugaugcaucuucuuucuguacuuaaguguucacacuugcggugaucugagcaaguguguguucaggagaacgugucugcaggccaaacacagaucuacaguuggucuguagguaaauggcugucucuuuuaguacugauggugaagccaaccuuauguaugucacaagaaugacaagaguuacacuggcuucuuuccagucugcgugguuuuuauuuauggauuauuuuguaacuauuuacauauccauaauuguaucuuauucucuauagucuuuaguucuuuuauaaaggauuuuuaagaauaauuuauuuauuuuuauuuuaugcacuuugguguuuugccuguaugcaugacugugugaagguguuggauucccgagagcuggaguugcagacaguaguaagcugccauguuggugcugggaauugaaccugggucuucuggaagagcaaccagugcucuuaacuguugacccaucucuccagacccuagaaagguuuuaauagucucucaaaaauacuuuuuugguuuuuugagacaggguuuuucuguauagcccuggcuguacuggaacucacucuguagaccaggcugaccucagacucagaaauccaccugccucugccucccaaguguugggauuaaaggcgugugccgcuaugcccggcuucaaaaauauuuuugaggggggaaaaaaaacuauggaauguauaauauacagaaagauuuuagagaauugaaccaaaagaaaucaauuguguauccuuguuuuuacugauaggaucuggauagaccccauaccucuuggcuucggcucauuguuuccuuuacguagggcuuucagaauccaugaguauugaggaagagaaaagcaggaggcauuugugagauuguuuuauuuuucuaaguaagggucagccuguaggcaggccuugccuuggacuucugauccucuuucuaccucccaaguaaugggaucacaagcauguaccacaacuccuaccuggcucuuaaaugacuuaacaauuuacaaaagacaauaaucacgcaugugcaagggucguucacuuagcauacacuguuucucacagcuuguuuuuaaggugcaaugaaagccuucuaugcuuucugugugguccucuugguguuugggagugucucggaagccaaguuugaugauuucgaagaugaggaagacauaguagaguaugaugauaaugauuuugcugaguuugaggacgucauggaagauucuguuacggagucgccucagcgagugaucagcacugaagaugacgaggacgaggccaccguggaguuggaagggcaggaugaaagccaagaaggugauuucgaagaugcagauacccagguggggcuuuuguuuuuaagauuuauuuauuuuuauguguaugaguguuuugccugacuguaggugugcugugugcacaccgugccugugaauccuuuggaacugagcagccacgugguuucugggaaucaaauccaggcccuuugccagagcagcaagugcucuuaauuuaucucuccagccccacgaaguggguuguucacuguugauuuauuggggaauucaggaggaugggaaaaucuauuagugcuuucucagacaaaaacccaaauauacggagacuguugcugucuggaaucuucauuuuugucuaauacuuuuuguuuagcuauucuaguuuauucucuugguuuuuuguuuguuuguuuugacacaagguuucucucuguagccuuggcuguccuggaccuggcuuuguauaccaggcugggacacuaaacuguagaccucagacucacagaggucugccugucucugccucccaagcacugagauuaaaagugugugccaccaccaccuuuaacucuugugaauauuuugugguauguucauaccuuuuacuuuaaugaagcauuguguuuucuguggaguagauaagaucugaacugagaguagcuaauguaugaaugagaauuuagaacuuuggguucuaaaguaaguguccccuuuugguguuugggggguuuuugugucauccuucagguuugcuauuuauuuaugcuguguaauagcucauuuuguuugcuacugagaaaaggucucacuguguuuuguuuuucuuuuuaccauaugcuuuggugugcauauacauugcagaauuaaauuaauacaaucaggcuaauuaccaucuucaucacccacauaguuuuauauauagggagaagaggugagaaaucaaggacauugccuuucugucuuguuuguuuguuuguuuagaggcagggucucacuauguagcccuggcuauccuggaacuugcuauguagaccaagauggucucagaaucacagaucaccugccugucaggugcugggauucaguguacuugccuccaugccuggcucucuuaucgaaauucaaauaugaaauguguuaugaaauugaaaugucauuggcguguauguuaguuuucuggaacuuacuuaucuuacaccuccaaguuuagaauuguacuaaaagcaugucucucuguucuguacuuguugcugacaagucauguuuuucucuacagauguuaccaacaaacugcgacacaacugcuggcgccauuuguagaugugauuguguuuuguuuuuguaggagggagauacagaaagugagccauaugaugaugaggaauuugaggguuaugaagacaaaccagauaccucuucuaacaaaaauaaagauccaauaacaauuguugauguaaguauauaagauucuuaaucacaaacuaaacuauaauccauugauaccauagcuauaauccaugacgcacaguagguacuggaauaauagugcagucuaauaaagagccuaacaugaauugugaugagcauccgucacugugaggcagcuucaugguguagucuggccugucugcuguuacucacuuagaguauagaaguggaugguugggcaugcuuagcuugauacguuugauagucucuacauuuucuucuucuuuuuuuguuuuguuguuugagacaggauuucucuguguaguagcugucuguccuaggacucacuuuguagaccaggcuagcuuagaacucacagagacccuccugauucugccucccgagugcugggacugaaagcaugugguaccacacacagaucuacaucuucugaaaggcguucaaaagcugaccuggagcugggcauaguagccaugcuguuagucccagcacucaggaagcaaaggcaggcagaucucacgauucugaguccucugguauacaaaucaaguuccaggacagcuagggccacagaacccugacuugaaacaaaacaaacaaacucaaaaauaaaaagcugaucuagaagaucaaaaugagcauauuuuucagaguguaacuuuuuaauuaugacuacuuuguguguagggguauuuuuuuuuuaaagauuuauuuauucauuauauguaaguacacuguagcugacuucagacacuccagaagagggcgucagaucucguuacggaugguugugagccaccaugugguugcugggauuugaacuccagaucuucggaagagcagucgggugcucuuacccacugagccaucucaccagcccuguagggguauuuuuucugcacguuuguuaagugcacccugugcaugccuauuccucuuggagggcaaagacaguaucaggucccuagaacuggagguagagaugguuauaagcuacuuucugggugcuagaaaucaaaccuauguccucuccaagagcaaccagugcuccuaaccaucaagucuucucucuggccacuaaaguguaacuuuuccccagugagaguuauauaaaguaucgacuucugucuaugggcuuucucauuuuuucauccauuccuuagacuccguguucaaccucagccaaaauuaaaugggaauuuuuccuucuuaagguuccugcacaccuccagaacaguugggagaguuauuaccuagaaauuuugauggugacuggucugcuugccuauaucaugaacuacaucauugggaagaauaaaaacagccgacuugcucaggccugguuuaacucucauagagagcuuuuggagagcaauuuuacauuaguggguaaguuaagccaauccaagucugggagccugccuggaaacagucugguaagaacaguuuauccccucacucaacagaaauagcuaaaugcuuucauggcaugcuggcuacagugcauuuguuuucuccagugaucccauucuguuggcuuccauauaugaguaaauuaaacauauaggcucauuuuuccuuagucaacaguauaauugcuaaauagcuuuugauauagucaauauaaaaacaaaauuuaaaaaaauuuuuuuuugauuuuuuuuuuuuuuuuuuuuuuugagacaggguuucucuguguagccuggcuguccuggaacucuguagaccaggcuggccucgaacucagaaauccaccugccucuaccucccaagugcugggauuaaaggcgugugccaaugcugcccagccaaaaaauucuuguugaaacaagaaacugucauuuuagguuguuugauaaacuaguuucaguuugauuuuuagaaauccucacaauuucuucaaguucuggguccuuugguuuuuaugccacaugugggauaugcacacacuguguggggcggggcaggcagcugugugagguugugagcucagccgccuucaugcuccuuaguggugagguccggcccaucugcugcuggucacacacacugcaguguguuccucacuugcauuguuuugucugguggguuuaguuguuuuuaguucauuuguuacuuuauguguuggaggugggcaggagugcugugaccaagagcacaagcaggaaaacaaccuguaggaacuugcucucuccugccacaugcaggccgcaggccccagcagucgggguuugguagccaaugccuucaccagcugagccaucuuacuggucgauucuguagcccugaccaugccucugccuccccaaugccaccaaguuaggccuuauacaauguuggguuuuguuugguuggccuuuuuuaaauuuuuuuuuuuuuuggucacauauuguuuccuaauuguucuuuguggcagcacuguugaugggacauaguuucuguuuuuucuaugaaggaggcugauguuaaagcuuaucuaagggguuaaauugcagcuauguuauuagucuaugcuaaacuauaccuguuuaccaguggaugcugucuccccuauuccaugguuuuuaggguguuuuuugaugguagaauuuggguugggggcgguggggagcauucuuuggcucauugcccucccucuucuucaugccagacagaauccauaacuuuuuuuaugggaacaauaaagaguuguaaaaguaaaaaagaagcaccaccucuacuagccugugcagcagccugcggcaccccagacacuuggccuagcagaugauaaagagccugucugucuccuugaugcccggucuuggugccugcugugcacugguggcagaggagaugccguucucucugcucucuucauacauuuacagaggaacaugaauggauagcaacauaaaaugguggaacaguggaaaucagucccuuugcacaggaaucucuggcaguuguuugcuguagucugcaugaaguugguauaaaauugaaauaaaauaaugauauuggugauuugaaauguguggaaacugccuuugaacucuacccugucagagguaauuggaaucaauggagcucaugcagaaaaugcaggccguauacacaagcguuguuaugaagaugguuggccgagaggugacacugaguaugucuucaagacuagaugaaugcauguacgauggagcagaugauaaauuuauacaucacgucuauugagguguaaaaccuuuaagauaauacugaaguaaaagcaacauugcugguccuuuaaucccuguccaaggagauucugugagauagcagagcguugcugcccuaacgugauccaaagguccagugagucagauucagugcuuuuacuccuaggggaugaugggacuaacaaagaagccacaagcacagggaaguugaaucaggagaaugagcacaucuauaaccugugguguucuggccgagugugcugugaaggcaugcuuauccagcugagggugaguagggagcggccgcuccaacgucugucugcccugcaguucuguuuucccuggagucccuccacggcccuucuguaacuguaagcugaagguauugauuaauuucucucauuuuugcaguuccuuaagagacaagacuuacuuaauguccuggcccggaugaugaggccagugagugaucaagugguaaguauuccugcuggcuuucuggguacaaacugaauuguuuacuaacuguuccauuucugucuggauuguguuuaaaacucacagcaaucuguguccaugccagaaaauaugauugaugcuugucgaccaaagugggucagcuuuucucauuucagcuguccggaggccucugacugcuuucuugcaggaauuuaaguuguuuguuuguuuuacuuuguuuucuuuucaaauauuuuuacuucaaaugauuaauuuugauugaaagagcucaaaucacaaucuagguuauuggcuauaugucuuucauuuauuaaauugacaugaaucuacaaauuguguucacugucaaaaaugucuuuugccucucucaaagagauauucucagauaggauuguuacuaauuuguugguuuuuuuuucuucuggguucuguuaaagagacugcuuuugcaauuuccuguaaauacagaaguacagauuuuuuuuuuaauacagcuaucauuuaccagguuuuuuccuacauuuagcauccugggacccuccuuuggaaaaaagauuuuugaauuuuaugugugaggugccuauaugucugucuguguaccacauguguucuuggauugucuagacaucagcugggauucaacaauucauuucugacacugccuggaauuagcuucagguucuacagguugaaggguucaggccccacucccuacccucagugucucuacuugugaggaaauuucaaaccccaggccaccauaccauaugcacuuuuggcugggcaaguugaggguucccauugccucccuccagguuuaauaacuuuuuuugaaugauucacagaauucauggcaaaccuuugcuuauauuuacugacuuauugaggacacaacucagcaauagccaguuuggggggcggggggagagggugccaggcaugguagcgcacgccuuuaaugccaugccagcacuggugagucugcagguggaucagccagccuagacuacauagggagcuccagcuugggcuacagagugaacucagccuggccagagcuacacagugagaugcuguggaaagggacggaggaguguggagccucuuuaucaucucugagcauccugcuguuuuagugaauccacacgcuuacaaauauggaagcuuucugaauguggcucaaggguuucuaaagcacaaagcuccguguuccucuucuucaggaccuugaggagggcugaaaguuucagcccucagcguuugcucuaucacaugaucagcccgcaauuccugaagcuguguggagaacuuaaauuagugugaacacaggcugauugaaagggguuucuuacaaauaaugaagcauaaagguuuuaguucuguuccagaaaccugugacaaaccuagauguaauucuuuuuuuuuuuuuuuuaauuuauauauaugaguacaccauugcucucuucagacacaccagaagagggcauaggaucccauuacagaugguugugagccaccaugugguggcuagggaucgaacucaggaccucugaaagaguauuagugccguguuucuucauaacaauuugccacaaaacugaucaguuuaaaauaguaccaucggggucuagagagauggcucagcucggcaguuggagcucuuccacaauaccuggauuguagaaccaacacccagcucuuaaccaacauucuguuacucuaguuccaggggauccagugcccucuucuagccuccaaaggugcugcacacauggugcacagauaagcaugcaggcaaacauauaacagaauagaaauaauaaaucuuuuucugugugugguuuuuuucuuuugguuuugguuuuuuuuuuuugagagucuaacuuuguagaccagcccucaaacuggaauuaaagguauccauuuccauaaccagcaaccuuuaaaaaaaaauuuuugagaccuugucucaaaagcaaaacaaaaacaacagcaauaacaacaaaaagccaaacaaacaaaaggaaaggaaaaagggaaaccagaacaauuuauaaucucacagugaaugaguacauaagcggcccagaguggguuagcuggguccuuugcuuaggccugcaaggcugaaaacggcgucagccgggcuuguguuuccuucuuuccaagcacauucaguuccuuguauucauaguuagcuguucuuucacugcccaucaacuaggagcuacccaggucuggaggucuggaccucaggacuuuaauccaucccucuccuugauggucauguaggucccaaagcuucucuucuccagcugaggcccaguuaucuuauuaacuugcuggaucguuucucauacccaagacagugcucuuuccuuaguuggaaucaacccccuggggguccccugucacacccaagaacccuguucacgggaagaguguggauaccagaaggcugaacuuuuagggccauuuagaaaccuacccaccauagaacucaguaagcgagucuugucuugucuuguuuucuuuuuaaagcaaauaaaaguaacaaugaaugacgaggacauggacacauacguguuugcugucggcacucgcaaagcuuugcugcgacuacagaaagagaugcaggaucugguaugucaaguugcucuaauuuaaauguuugucaaaacugccucuucaucacaaagaaguucagcucuguaggacagcacaguucugucucucagauguuaagcaccacuucaaaauagauuguacccagcacuugggaggcagaggcaggcggauuucugaguucgaggccagccuggucuccaaagugaguuccaggacagcuagggcuauacagagaaaccuugucucgaaaaaccaaaaaaaaaaaaaaaagauuguacauaccuagcagucugggaagaacuguauaaaauaucauguuuccuguuuucgauuuuucuuccagagugaguuuugcagugauaaaccaaagucuggagcaaaguauggacugccagacucuuuggccauucugucagaaaugggagaagucacagagggaaugauggauacaaagguaaaugugguacgggaugugcuccagugcauguguaugacgucaugaguucuagaccaggcuagguaguacaaggagagacucuccaaauaaaugaagaaauguguguguguguguguguguguacacguuauauaucucacauacugaauuuuacuugacccuugcuaaagcaacaggcaaauaaucucugacuacaaucacucaugauaagcauucuuuguguaacuuacaguaaucuaccugauuuugaucaacuggguaacacagcugucgauuuucugccauucuaauugaggcauuggcuagcucucauguugagcuggugaucuccuacaguugggacaggucuccucugagccguucauuaguuacaggugugcacugcuugcuccugcugauagcucagcagagggcugucaguccaggagacagacagcaugcgguuaagagcaccgagcaauuguaaggacgguagcuugcaggccgggcagugguggcacacaccuuuaaucccaacacucgggaggcagagguaggcggauuucugaguucaaggccagccugguuuacagagugaguuccaggacagccagggcuacacagagaaacccugucucagggaaaaaaaaaaaaagaaaggacuguagcucuuguccuagcaccuuccugacaagcuaagugucccacagcuccagcuaugagggaugugacucuccugccuuccccagguacacagcacacaugcacacacauugacaugcacaaguaaaauaaaaaguucucuaaaagacccauugacuuucaagguuuuuguuuuaauuuuugagucuuacuauguaacccuggcucauagagguccaccugccucuauccccccaaaugcuacaaauaaagaugugcaccgccacuccaaggcaacauucagguuugcuuguuuguuuaagacuucagucuagucuugaguuucaguuuguauaaguaaaggugggcacacagggugggcacuugugauccugucaugggagggacuaaggcuggagggugacugcagagaauagcccuggcugugcuggaacuugcuuuuguaguccaggcuggccuugaucucaugacuccccagugcugggacuaagagaaccaucucuuuaaauugaaggugagguaauuuuuuuaaaagaaauauuuuaaucugaaugacauuuuauaaaaguauggauuaaaaagugaauaucuaugaaagcuugggagugcacuaaacuaguuaauauucuuucuguuuuguuuuuuuuuucagaugguucauuuucuuacacacuaugcugauaagauugaaucuguucauuuuucagaccaguucucugguccaaagauuaugcaagaguauguauaaagucaaagcauugaauucauuucccuuauuagcuuuauguuggaacaccacagguagccucguuagccugacccagucguucagagugaauuaucgcucauguacucagggaccagggcuggcuucccagcucccuuaugaaggcuaaaaaccacucuuaacuccaauuccaggagauuugacacccuucucggacguccaugggcacugcauacacacauacaugcaggcaaaacacuccaacacauaaauaaauagaaauuuagaaauuaaaaaauaagcaaaaguguuuagaaguauggccucauuuuuuuuguuuguuuauuuauuuaaugucugugaguacacuauacucuauucagacacaccagaagagggcauuggauucccauuacagaugguugugagccaccauaugggugcugagaauugaacucaggaccucuggaagagcagucagugcucuuaaccccugagccaucccuccagcccauggccucauucuuaaauagaggcauuucuggcuccccaggugaaagugguuauaucuugucuacuggaaacaucccuggagggguucacauguagcagaguguccugugcuuaccugugacuuggaggugcagaguacacuuacugcuguuugcagguauuugcccaccugagucagaugugugcugguaugcauagauggacggguccuugcuuacaaucucuuaacagacuucucucugaugacagggaaggccagccuuuaaagcugccugacaccaagaggacgcuacuguuuacauuuaaugguaaguguucuggguccugucugucuagugcuuggcuuccucucaaauguuuuugagauuauuuuuccuucugaaauaauagcucuaaaacugcagcacugcuaacuuccuuccuccuuguugauuucuggguuccuccaaggagcuacacuguuagcauuaaaacagacagacugccaacccagaaguguuaaugcugccauuacucaguaggaaaauggcuuuguuuuccagugccuggcucagguaacacauacccaaaggauauggagucuuugcuaccccugaugaacauggugauuuauucuaucgauaaagccaaaaaguuccgacucaacagagaaguaagucccuaguccuuucuuacaaaccagccccuauuauuguuggguuuuccccugaugggcagcagcugucagugacugcagcgacccagccuuugcugguugacuugaaagugucaaaggggaggaguugagccaugcuaaguuggguuuucuccugugcauuagaauugguuccuuaugaagucuuuguuuucuggggaaggggaaacaaaaagcagauaagaaccgggcucguguggaagagaacuuucugaagcugacacaugugcagagacaggaggcugcacagucucggcgugaggagaaaaaaagagcugagaaggagcggaucaugaacgaggaggacccugagaaacagcgcaggcuggaagugagacacucagaggcucggcugcugggcucagcuucucuauuaugugguuuuauguuuuaagauuauuuugucguuuuuuuuuuucucucucucagagcugaggacagguacagggccuugugcuugcuaggcaugcgcucuaccacugagcuaaauccccaucccuguuucgagauuacaauuauaccauuucccucuuccuuguccucccuuccaaaccucccauauauuaguuccuuuccacagcucucuuucaaacuuagggcuucuuuuucuuuguuguagugacgugugugugugugugugugugugugugugcgcgcgugcgugcgcgugcgcgugugcaugcucuugcauaccuuaacuauauaaauacagucuauugagucugucugcuguuagcugugugcaguuuucagaacugacccuuuggguacuggguaaccaguugaugcucuuaucugggaaggcugguucuccugcuaucagaguuccucagcugccugcaguucuuugucuaggguugagguuuuugugagauugccccaaaacugcuguuuuguuuugaauuaucuacaugccuauuucuacccuacugucuacuauaauucucuguagaaaugugcacaaaguugggcagugguggugcacaucuuuaaucccagcacucgggaggagugaauuccaggacagcuaggacuauacaaagagagacccuauuucaaacuucuagcacugccacucucaaaaaaaaaggauuuugaguaauaauagggugaguggaggugcccgguguggaguucagaugcaucagaucccuuggagcuggaauuaaaggcagcugugaaccaccugacagaugcuuggaacagagcuugggucuucugcagaagcauccugaggucuaaccaccaaaccgguuccccagccccuggguuuuaguguguccuuagagcuuaauuuggacccucuuccccucccuguuacacaggaagcugcuuugaggagagaacaaaagaaguuggagaagaagcaaaugaaaaugaaacaaaucaaagugaaagccauguagagcugguugcagagguuguguccuugcugccguuagcucuccguccaccggagacaggaaaagcaggagucugcaccuaacagucacgagucucugcugacugagagaucuuuaucucacccucuccucucgguuuagaguucuacagagguuauagauacaaugaaagggcucuuucaguuauuuccuuccagauaaucaaauuauuuugauuauuuuauaaaaggagcgguauauaaaguauguguaguuuuaaaauauauuuaaauuauaaugugaaucaucagugcguuacuuugguguuugaagaccgaucaugaaauuucuagguagauuguugcucuuuguuuaaacuggacaguugaaauaacuauggagacugacucuaaaccaagacccuaauaucuauuggaauugcacaauaaacauugcuuguuuuuucuguguccacauuaaacuugugaaaaaaguggaacguagaacacuauguggugauaaauucagagacuuagagcauaguacagcguaugguuuguguguggguggugcuauggcaguauuauaggagggaaucugucgguauuaggauacuguaagucaguggaagauucuagauguagguaguacaggagcaguuucucauugccugauacuaugagcuaaugacacugugagugcuggauuugaaguaguuaugugcuuauuuuucuugagcaagaaugcaugacaaggugaagugcuucaccuagcucccuccgcucagcagcagucagguggcugggcucugugaggucacagugguuugcuugcuugcugcagccugguagguguucauggaggagcugaucucugucuuaggcgugcacuuugcuuccacgccugcuuuuauaucguccacaaggccgguuuguacuuucuugaaacaaauaaccaaucgauauacacaaauaugcuuuuaaaaagugagcuuuuuuuaaaugaaucagaauuuugucugacucaugaggcggaagcgaugguagggagagguuccucucugugcauaagcauuuggcuuguugagaucucugcauuuuauaaaugcuuccuacugagaaagcauuucuuaagucuuugcuuguaccaggucauuuuugcuggggugggaaagggugguuuuugcuuugggagcggguagugggguuuuguugaugcuuucuguguucugaugcaguaacagugaguugcggugaaaacugugugugcuguugccuugggaauuguauggaguuuuucacauggcuuuguguaggcuaauagaaauauaugcacugggauauucaaguguaauguuuuuuaacaguucacaaguuuaaguuauuaaaaauaacacaaaauuaaaucacuuuaaggccagauaauuuuagacuuaacauuguuuuacaaaucuuuaaaauacauuuagaaucaaaauuuauguguuuaguuaucguuuaaguaauauaagcuuucuuaaagucccauacaucagaccguggcagcuaauuuuguaacaagcauucauaugaacuaccuaugacauauauuaaacugauugacaaaaucugugugcugcuuugacuuuuuguaguuguccuacaagaauauguauacuguucucuuauuaaaagcaggaaaaucguuuuccuucaaaagcauuaaucuugaauauuccuuuaugguuaccacucuaaagcccuguauguauuguuucagaaagggucucacuauguagcccaagcuggccacagucaaacucaggaugauuuucucuccucagccugcugagugcugggacacugacauaccacugcacuguggcccacagguuuuauuuuuuuugaauuauuuuuuuuauuacuuuuuagguuuuguuuguuuugguuuuaguuuaguuuagguuuuuauuaauuuauuauguauacagcauucugccugcaaguaugucugcaggccagaagaaggcaacauaggagucagggcucuuaaucucuaagucaucucuccaacucccuuguucuuuuuuguugggggggguguuguuguaguaggguuuuuugguuguuuuguuugagacagaguuuugagcuguagaccaggcuggccuugaacucagagauacaccugcuucugcuucccaagugcuggaauuaaaggugugcgccaccauuaccugucuuaauuuuauuuuuuugguuuuguguugaaauagggucucucuguguagggcugacuggccuagaacucacuuucuaggccaggcugaccuuugccucggaucugcugguaucaccugcaugugugugcugucacacccagcccacuuuagcuacaguguuaaucagcucuccaucacugugacaggacagcugagaugagcuucagguaggaaaagaugguuuggguagagcacaccugcuugcuuccccguggccagggaguugacagacaggagaggcaggcggucugauaucucaaagccacacccucaacggccucacuuccuucuuugguuuccaucaccuacccauagugccacuggcuauauggcuuuacuguggaacuuuggugacauuuaagauccaaaccauuauagucuucuccuuggguaagacaucuuguucuguacagaaucagaggaccaagagaggagaauguugcuuacugucacacuaggaagaauccaucuuccaaaaucuuuuugccuggaucacuagcaagccaaaauuaucccugaagcauagacaaagacugucaacaaaaccaguugcuaggaccagagggauggcucaguggguaaaggugcuugcuaagcuugaccuuaguuugagccucagaauacaugcaacuccuacacgugguuguuugaccaccacaugugggccauggugugugcacacacauguacacaguaggugaauaaauaaauguguugaaaaaaaauugcuaagccuuuucuuuuggguaaguuacugaccucugagucugcuguuuauuccuuuauaauguggggguaaacauuuuuccuguguaccucacaguuuaacuuuuucuuuauguguauguguguuuugccugcauguaugucuauguaccauguguguacagugccuaaggaggccagaagaguguuagaacuucugggacuggacuuaccuguggcuguaagcugcccugagggugcugggaacugaacccagcaccuuugcaagaguagucagugcucuuaacugcugagccaucuccaacucaucucacagcuuaaaaccaaaagauaaugugugcaaaguuguuuuauaaucuuacacuuuacaaaggcaagacuacuauccaauggugcaguuuuacuuuauucucuuguucucgucuguccaguggaaugaggugagugaauucuuuuauccucugacuuuaucugucagaacugacaagguguuuguuuuguuuuuuuuggagcuggagggugcaaugaaaauagaggaauuauaauuguguuucuuuaguccaaggaaaccucaugguuaggcaucagaucuagagcuccucuauaugggccucggagaaaggggaauacuuggugacacgucaagccuccgguaggaaguagagagugugaagauuguaucaggucugcuggauuuugugaagagucaaauucuguacuuuuuccacccagguucucuugugccucauuuaacucuaaagguaaaggauguaagagggaagaguuagacccguagguauggcuucuauuacaaacugcugaaacaaaguaaagagaagccuggcugggcguggggcugaugucuuuucaaguguuugaagaucggcaaaagauuuuauuacaaaaggaagauaucagggcuagagaaaggcgagggguugagagcacuuacuacccaugcaaaggacccacauucaaaucucagcccuaggggaaucuguugcccucaucuggucucugcaggcacauacaggcaucuaaacauauauuuuuaaaaaaucuuaaaggaaaacaguguuagguuguauaaguucacagcuuucuuaucccucugaauuaagaaggaagaaaagaacgcuguuauuuuucccagugguggauccuacugcuugcuuugaggugagaucucaucuguaacccagacuggccugugucccagucuccagagagggugacagguagauaccaacacaucuacuguuuucuuagaggacuagcaucacauaggcuaguuuccagggcauagauaggcuuggccuuucaggcagcuggaguacacucccaugcucacucgcuguccuacccaccucuugagacagagucuuguguauuccaggcuggccuccagcuucugguccucacccuggccuuaaaguauuccuuuuccuugggaguuacugaagagcaaggugguacuaaacuuuucaaacuuuuuuuuuuuuuugcauuauucaaaaguauuucaggcuguagagauggcucagugguuaagagcacugacugcucuuccagagaugcugaguucaauucucagcaacacaggguggcucacaaccaucuguaauggaauccaaugcccucuucuggugugcucauaugcauaaaauaaauauaucuuaaaguauucuagguaacaugcagaaugggcuucacuacauguucauacccguaacauuguauuuuacccauguuuguucccagaguacucuuccccccccuuccauucauauuuuaaauuuauauagcuuucuucuguacauuuuucuguagcuuagcuuaucacuuugcauagaacugaagccuguuuccugugccaaggaugcucuggcauugugcaucauauauuuauaaccacacacacuugaccccaaggccuccuccguguugggugagcacucuacugauacacauccagcccuccuauuccagugcguuuaucaaggcucuuuugucuuccuacuccuuucuaaaauggcuauuugaaagcucauauuagguaguagaauguaaagugcuuaaggacguaugguggcaaauaccuagcagauuaaguaauucuagucgacuuguucuacaccacaaaaaaaaaaaaaaaaaaaaaaacagcagccaguagaacagcagccaguuuuccaagucaauuucagaaagcacugggaaucuuuuagcaccuaacacuaauacuucaaaaagcaucaggagccuguacuucccuggacucacacucuaaucucuguugaccuuuuaguauacaguuuacuaugacucaguaagacugcuggaugagaagcugugcauuuggccacucacacagucacaguagagucugggguucucugagcaguuacugugggcagccauccaguugguaaaaucuuuuagccacacucaauuuguaacauccuguuagaaaauguguuggcugggucacuagguauagaugaaauacccaguguuuacacauccuauuguaaugacuguaagaggcuuuagggcucaggcauuuguccagaaugcugugaagcccuagguucaaugucuaguacaguccaaagaaggggaagggaaagaaaggagaaagaaaaacucaauuugagguugccuuggcaauuagagcccggcgcagugguucacaccuauaaucccagaagagacgggguuuaccaaauuuaaggccagucugguuagccuggacuagaugugagacccugucucagaguuuggggcuggagagcugggucagcagaaagaugcauuugcugcucuuggaaaggaucaagcaccggcaacuaucugucaccccauccaguuccuccgccugcuucugcgcgcacauacacacacacacaaguacauucaaguacaaguacacacacaacauaugaaaaaauaaaaaccgaagcuugacaccuuuucagguauugcuuucccuaauauucuggauuccaaagaccaugugaacuggcagaaacugcauuuuccuccaguccccuugcuuuuugugaguucgugauguuuguuugaugaugaaauguggugagacugagaacaaauuuggcauguuaaacgcacuaggcaagguuacagcuguguguaaaacauugagaucuucaggugaggguagugugcguuuccaaguuccuguaugauguggccaaacuuaaaauucuuggaaguuagucgacugguauaaaucugagacaggaaaaaaaacaaguauucauuacuugacaguauguacacagauguauugggcccucacuccacaguaacugaagugacuaaaaaucacuucaugauaaaacggaguccucauuuuauuaguccuauaugguuuggccccugcugucuuuuuucauaaaggcaaacucaucacagguuucugcuaauagaggacauaccaccaagucuuuaaucccaucccagcagaggcagagggaagcugaucugaaggccaguccagacuacaugcgacacuaucucaaaaauaccucacuaccaaaaaauaguuaugaagcacuuagggacaaaaaaaaaaaaaaaaaaaaccccaacaaaaaacaaaccauagcucucguuuaguugagcuauuuucugugcuuuaaggagaaggaacuuugggcacaaaggguaaguuuccucuuuguuguucuauugccugagacugacccaagaaagacuuguuuuucaauuggaguccuaccaggugaaauggcaccugggauuugggaaccgcagagugugggaugaggggugggaauaccccugguagccaagucaauagcuauaguuagcccuugccccuuuucuugcugcuggguuaggagggguacagagacucgagggagacucuaggguccuuuggaacugcaacaaugacaaggucuuucgcuuccacauacguggggaaaccugccuucguccuagauaaggaacgaccucagcaaaggggaaaaaagacuaguuaauaacucucucccugacgaagcgacugcgggucuagcauguccgguaacgguaacgugggauggaagcagaagcucucucuggggaaaagcggagcuuccuccacugggauggguggggugaagcgaggcgagacgaagcagaguccuuagugggcaggggguaaggcggagcaucuucugagaaccgggcaaggcaggacuuccucugcuggaggcaagaggcggagcucccuucuuggguggggcaaagcagggcuucuccguaggggaggggcgggacuuccuccguggggcgggaguaggaggggcuuguuccgugaaggggaggggcgaggcucggccagucucccugggucccuccacugcgcaugucacguugcguaccucccucccagcaaccggccuggcggcagcgcggcuacaaaacugaggaggcggagccgagacggagucgguacugcgcucugacuccuagaccagguacccgguggcggagccgccuggugcgcucccagggauaaucccucuugccagacuccgaguccguguccucgggggugagccucaaguggccaucccggcucacccucgcccuccucuggcccucauuuaaccuggguucuggguucccgcauugagguuacagccugagagcaaaauuaggcuugggccuggcuggggagaugcugagcagaguugccggaccggagaggcuagcuaccgcauggccuccccaccuuuuccggggcuuccaaaugggguugaguucucauacggaagcaagaucagagcuauucucugcuuuggucaaaacgaagaguuucuaaauguguugucuuaagugucccagcaguuuuggggaccgaguaugguggcggagagugagcaugacagaaggggaguggcuaaauaaaauuguucauaauuuuaggaaauagauaacuucucaacucagucuucugcuaagacccuaagguacuucaauuugaccccuuucucccagacgguuggacucggucuuacugaaauacccguugaaguagaacuauguuccaguguuuggaugggucuucaugauaguugauaaccuuauccggagguacccaacaccugagacugacucagauccuugaggguugauuaaccaaauuugagacugugggcguggcucagcgccugaguucuugauuaacaucagugcggacuugcuuuccauucuccacacuaccaaaaagaaaauugcuaacuugcuucugccguagugcaggaacuuaauaguuuaaccauuaguuauaguacggaaacuggucaacucucuucacccuuuaauuagguuucuuagaagauuuuuuggcuggguuuauaguugugaccuccgacauaaaguuuggaggaccagcgguaaaaauagaagaaaaaaaagucugucagaacaagugaauucuccuaucgguaccuguuguagugggagagauaaugaggcgauaguaugguugggugguuggagaggugucucuguagauaggaagauaugcugccgucuccagaacucauguagagagccauguguggccaugagccugugacaagagaaacaccagagcuugcuggcugucagccuguguccagagugauagaguagaauacacaauguccuuuagcuucaccaagcauagaaacagguacacacauaaauauauacauacauacacacacaagcacauacauauauauacacauauauacauacauauacacacauugguaaguguaauaguuaaugugagagccaggcaugaugguauaugccuuuaaucccagcacucgggaggcagaggcaggcggaucucugugaguucgaggccagccucaucuacagagugaguuccuggacagccaaggcuacacagagaaaccuugccuugaggggaaaaagcuaaggugaggaauguaggugguuagugggagcgcugcuguaauagaggguacugagugucaacaauagacuggggacaaaaagggaaguggagucuauagacuacacucugucucuucuuuuuuucaaaagagacuguagccaagugugauguugaauuccugauccuccugucucugucuacugagggcugagaauccacacaugagcuaucauucucagcuguggauuucugccacuuuuacagccuuagcuggugaucuuuaaauccaccaagccaucucuaaccuccuuuuaaacaucaaguacuacuuuucucacaaauugcuaucccugcuucuuggaagauagaauccucaacauuagucaaccuucauuaaacuugaacuuggcagagaucaacagaggaagacaucugaugugcaccccuccugcaagccuucaguauacacuuuuuuuguuguuguuccuugacaggguuucucuguauagcccuggcuguccuggaacucacuuuguagaccaggcuggccucgaacucagaaauccaccugccucugccuccggagugcugggaugaaaggcaugcaccaccacgcccagccacuauacacucuuauacauuaaaugaauaaauauuuuaaucuaccccuccacuaaagccacuucuaccuccaaacuuuuccuuuucuggcauuggcuccguggcauauuaaucauuuuccgaacacucaaaaacacaaacacacaucagcuguagaaugggcucucagauaagguauuaagucucugcaguuuucagucagggacuacacaaccacauaucuaggagaguuuguaaaagauaguccccagccauacuugguggugcaggccuguaauccuagcaaugaggagcauggaggcagaaucaaguucaagaucacugucagcuacguaguggcuuuguguguaggagacccugucuuaaagcaaagaguuccaaggguaaagaaugaacuagauagccugggcugggcugggcuguacaugcuucauaguucauucuuuuuuuuuuuuuuuuaauauuuuaaagauauaauuauuuauuauuucauaguucauucuuagccacuuaucuguuccugguguuccuacugccacagacuccaggaaagggguuuucuaaacagcuugcuuuucucuaggcuauuuuuaccccucccugucuccauuccuuccuagauugacauuucuuggacuguucuuccaaacaagguuucucaaauauuaguuaauagcacaguccacauggcaacggcauugucguuuccagggagugcguuagaguuccccagcccaccccagaccuuccaaacuacaggcugcguuuucacaagaucuguaagugguuugugggcacaagauguaagacacagugcuuggacugccauugugugucaucuuucuguucaaagccucccgugcuuuuccucucccugcuaguacagccaugugcuagcaugccugguccucacacacuuagagaauggucaaagggcuaauguuucacggucaggcaguuuaguguuaccgagugacucguguguggcaugcacuguuguggaaguuggugauacaccuuugcacaagacagagcagauacuugauaauaguuacgcucuuuggcuuggaauuuccuguuucuuuaagucaccuuugauacuccaaggcuuccuaccucucagcugugcuuuugcugaguucuauaaggaguugcucacuccuugucuguuucccuguccuguuuauuggugggcaucccacuuccauagccaguuaagguagcauuugugugugucagguaccagggcccgguuaaaaggauguacacacuugaggauggugaaggcugccugguucucuuucaaggccugacacuaacauauacucugggguuguuuuuuuaagauuuauuuauuauuauauguaaguacacuauagcugucuucagacacuccagaagagggagucagaucucauuacgggugguugugaaccaccaugugguugcugggauuugaacucuggaccuucggaagugcucuuacccacugagccaucucaccagccccuacucugggguuuuaagauaaguuagaagugcccuuuuccagguuuaauguauaaacaucauagcuacucuuucagguaaagaaaaauaaaacuaaaaauaauuuuuucuauacuggggauuaaacuuagggccuugggcaugcugggcaaauaccacacagcucagcuauuccuagucuauacuuguaauauaaauaugggcccacccuaaagucgauuucucaguuugugcagcguauguagcauuuacucacacuagcuacaacugagcuccucauucuuacuucugaggacucccgguccucucaaguacuaggaguuuuaaaacuaaguaaccguugcuuguaaauaauaaagcgggaugucggaugggguguaccucagugguagagcacuugucuaguuaucucuaaggcccugugcuggaucuuuagcaccacaagucaguaaauuauaaggcuauuuuuguuaccugucaacuaugaauauugcuuuaccaauguauugugguguuaaauguugauaaaaauggauucauguuuugaaugacauauccaucugcuucauccuuccacuguaguuuuguauucuaagaacauuugaagcagccuagugaucuuaaugugacacagaguagaagguguuaaagugucuuuucuucaucugauguaauugcuguugccaaggcucacugccucccucugcuaaccuaggccuaguccuggaagcuucuagccuccauguaaucuaaucuagguccagaauguuuucagccucugagacuuacugcugaacaagcucacccuuucuagcucuuucugaacucuggauggcuggucaacccagcuguucuggcucaaaacgccuauccauacugauucaaacuggcuuuuuuggcuucugacugcauugcuuugcuuggccucuuacuaacuuuggcaauguguucuaaucuucuggcucuuucucauucugucuuaaccugugucuagcuuguucuuugucugcaaccugucucuauaaaacugucucaguaaaacugccucuccccucuccaucucucauugcugcucuuuuaauucaccucucuuuccucucuguucugagagcuaggcagauccuauucugucaggucuuucucugauuuguuacuuugucagccgcucaauuagacaucacuuucaaacauggguguuuccuuuuacaaacuaauuuuaccuucauuguuuggauauaaagguaugugcuaagggccuguuucuauuccacauggccauaguagccauguugcuggauuuaaauuccucuacaagaaauagaaaaggaggccuggagagauggcucagagguuaagagcacugacugcucuuccagaggcccugaguucaauucccagcaaccacaugguggcucacaaccaucuguaaugguaucugaugcccucuucuggugugucugaagagagcaaugguguacucauauacaucaaauaaaacuuaaaaaaaaaaaaaagaacuagaaaaggaaacucccucaauauucagaugaauugucuaugugcuuuuagauugguuuugguuuucccuugacccaagaucucuucugcagccaaacuggcccugaauucuugauucuccugcuccagucucccuaguucuaagauuacaggucuuuugccaugacacccagucugcucugcuagucuaaaaauugaggucuaaauuuuuguuuuguuuuguccuacuuauguguuuauuuuuggcccaggucauguaggaaaggcuaguuucagaguccuagauaggcaaauaagaccuugaaugccugauccucuggcugggauuacagguaugcaacaccacacccaucuuaaaaaugguuuuuuuuuuuuuuuuuuuuucguuuguagaauccuuagacucuuuucaguacacaauuauguuaucaguaaauaguuuuauacuuuccuacaggugcagcuggcaugucuguaauccuagcucuuagagucggagucaagaggauuguuugaagccagccuauauaaaggacuuugucucaaaaauagcagugcugguggcucacagguagagugccugccuagcguguccaaggccccucaggaaagagugcagagucacugcaguuugcugaacauuuuaauucaaaguaaagacugcaccuguauuuaaaauauucaacugucacuaaaccaaagaaaagauuauuggaugggugugguguuucaaucccagcauuuagauaggcagauauaggaggauuagaaguucaaggucaucuccugcuguugugagagaucacccugggucucuagaaagaaagggggaaaaaucuaggcuggggaugcugcucagcggugcacaccugcaaucccagcauagccuauagugugcagacuuucaggaggacaaggucauucucuacuuuguagugaguuugaggcagccucuaccuaccuacaggagacugauucagaaggaaaaauauuucugccgggcgugguggcacaugccuuuaaucccagcacucaggaggcagaggcaggcggauuucugaguuccaggccagccuggucuacaaagugaguuccaggacagccagggcuauacagaaaaacccugucucggaaaaaaaaaaaaaaauucuauaaaaaacaauuuaaccaauucuuucugcuucuguuuuccuuuuagguuuaaguuuuugaaguugaaguaggucuacacaguaggaacccaugucuuuucuuguaaguaaaccagagcgcauuagggugaguguucccagucuucugguuuucuauuuguuuuuucuuaaaaguguuuggguugguauuacaguggguuguuuuguuuuaugugacacccagaguucucugguggaaaacaaaacgggaaagguggcuuauuugaugaaucaauuggucacauguuaaauggguugggccgugucuguguaguuacauaguugguaaagaucucuuugcaccuguuucucagggauuucuguuuuuaaagucacugucauacuguaguuacuggcacacauuucuaaauauaaucauggagagucuuuaaaacuaaccugaagaacguauuauaucuuaauuuuuaucagggacuagugagcuggucccgcaaguccaggugcuuggugcuaagccugacuaccugaguucaguucccaggacccacacaguggaaggggagaccuggcucccauguccucugauccccacauaugcaucaugcacacaugugcacacacacacacacacaaagaccgucuacucaccugacgggagaugccaugcaggugguuucccaggugaaggcuuagcacgcagauaugcugaccccugcaauuucccccaauucagaaaacucaacuguguacuuugugguaguggaaacuuggcuccuacucucuccuguaaaaauuuuaagaaaaaauauuugauugaccuuaaggacaaauacuggguuuaaugccaaugacuucaguacuuaaggaccgcuagcuggcucagcagguacagaggcuugcuaucaacccuggaguccugaguucuauccuuggggaccccuauagugaaaggagagaaucccacacguuauccucugaccuccaugugugcaucucuccccuccccccaacaaaauaauuaaaauuuucuuaaaguauguuguuaucuuucaucaaguacuuaauuuuaaaaugcaaucauuauuuaaagauuuuaaucauuuauuaaagauuuauuauuuuaauuacuuaauauuuaaggauucuuaaaauuguauuuaaagauuuuuuauuuaugagaggugaauuugccauucucaaauauuaaagcacaaauuauccuuuguaguauaguucauagaaauuuuuacaguaaauuugauuuuuuuuaauucagaaaaaauuguuacagagaaggacaaagggacuuuauaguauauauauuauauaacuuauuuuauauuuuauauaucauauagcuuauauuuauauauuauauagcauacuauauaucauauaacuuauuauauuauauagcuuauuuuagaauguucuuuagacuucccuuucuuguguauacauguauaaaaacaguuacucuguaaggaauaaacuucaguguuaauuaagaggacaagguaacucacuacuuagccugagcuccacucaguggaaagaaugccuccaugccagauuuugacaccggucaugaaacagaaccugcauuccauugcuuuuaaauaggagccacauuccuauuuuaaccuguccuaauuaaggugaaacuggaccccugauuaguguaauggaaaccuaacacucaucugaaaugggcuggcaagguguacaaugauugugcuaguuuaguccugugaacuugauagaaguuaagucucggguuagaaacccuuguaaauaaaugugcagccccaggagccucugugcccccacggagugacagagaggaugagcaugcccacaguguaaggaugaccagcagaucucagacaggaaaucagcaggaguucagaguggggaaggggcaaggaaagggugcugggcugcaaagauguccaaggugcaugagcugcaugugugaaaaugccagggggaaucucauccuccgcacaaugauagaugcuauuuuauaaacacaacagaacagaacagaacagaacuugggaagcgggauuaaggaguuuaaggccaggcuaggcuacagagugagacccugucucacaaagcuaaaaaucaaacagaagaagaaagcuuugucaauuaaaaaaaaaaaaaggaugggauaugcuaggucacauuuuauaaacuagcagaggcucgugaagaauucuuuugaauucuaguaauacuuuuucaaaugggcaugaaugauccagaacuuguaaggacuaccuauggaauauacacgauggaaccaaagaguuuuucugucuaggagagaaaacauuauuauugggaugguuccacguauuuccccccagucacauggaugaaucaaucgucauuuugcguaagguuagacuugagaaaggacugaaucuauuguuuguagccaguuucaagauccuuacuuuucuauggccuuaguccuguuguacugcguaguuuuauguuuuugugggguaauugucuuauuugucucuaaaggcugauagcuacuauguuguggcuuagaagacuuacuaauucucuuugggguuuuccucuuuagcggugggucucggaaaaguucauuguugagggcuuaagagauuuggaacuguuuggagguaaguacgguauggcacuuaacaucauuucaggauaacugccgcuauucuccugcugacugcaucaguuuauagacguuagcaauuugaagagccauuguaaacugugugcuuagauucaugaggcuuccucuuuaguccuguguuucccagaaaucugcagacgaaucaagcagcuguucuuggccugucuggauuguuagaaagcaagugcagugguuaaaggccugugcgcuucugcuuuuuauaaguauuuguccagcugagacacauacugucaaguuaaaauuuucaaagucccuaaggcaggccuggugguaaaaaccuguaauucuguauacuugggaggcugaaacagcagcauuccaaguucaaggccagcgcuggcaacuuagugagacccugugucaaacuggaaaguaaaaggccaggaacacaugucagugugcaaagcuuuagcagggugcgggcucuggucagucucucucucucucucucucucucucucucucucucucacacacacacacacacacacacacacacacuuuuaaacacuagguugaggcagauauaaaacuaauauaaaauuucugguuguauugauccauagaguugacucauguuuuuguagaggaaaucgugagacuuaauagaacuaagaaaaaaaaaaucuaucagggaaaaaauacuaaugcccuaucauaaaaccuauuggcucaguagauuugugcugugagguuuagcaggcacagacauuccuguuuggcccuuuucaaaguaaggccuuuuagaaaugaugaucuuaguucagggcaaaggaaaaguucucucuguagaaacaguaguggugucugggcauguuggcacauaccuguuuguaauccuagcacucgggaggucaagacagaagcaucaagaaggccaucuuggacuacauaaggaaaaucaggggcaaaugggcuguauaacaaggccaucucuagaaaccuaaagauaaugauaauaacacaacaguauaguuguuucaacuaucaugguauucuaggcaucuuacagaugaagaaacaggaauccacagcauccacaaacagcaaaggaacugaaaacucaaauguuuuaauuacuagaaauguacuauuaacuuauuuuccuuaaauaaucuugaagaaaauuuagaguaguggcuucauggacuuaagaguuuuauauuuuagccgggcaugguggcacacgccuuuaaucccagcacuuggcaggcagaggcaggcggauuucugaguucgaggccagccuggucuacagagugaguuccaggacagccacggcuauacagagaaacccugucucgaaaaaccaaaaaaaaaaaaaaaaaaaagaaagaaagaaagaaagaaagaguguuauauuuuaaguaagagcucacaaaaaaagaaauaggaucuuuuuguuuuaauuauagccaacaaaaauuauuacaguauaaacuaauggaacaaaaaauaaguucuguuagcagucucuucuccuucccaucacuaauaaaaugcuuuaaacaccauggcugaugagauggcucagugcauaaaacauuugccuggugugaguucaaugucuggaacccauauuaagguuugaaagggaaccaauuccacagagcugucuucuggccuguguucauggaccacggcacauguggucacacacacucaacuuauaaugaauuagucacaaauauugccaaauaugugacugaaaugaauggauucuuuuauucaguuucugacuguggggucucuggauaccuggguauuuguugugguuuaguuuucuuguuuauuugaaaucgggucucacuauauaguuuugccuucaaacucagagauccuucucccucuccauccugggugcuggcauuaaaggaacaugccaccauggcuggccacuggcuucuuugacagcauccuagucucugaccuaaggcaguaaagagcuuguucuccacguggucuagcuuaguguagcuagaauuaccaagucuuacacugcuuggaaauugccuucugucaagaaaauugagguguauuucauguaaccucucacuugacuucuccccuuugacuaacugccauaagcaauugcuucuguuuguauccaagaaaaaugcugucuguuacuccuucgaaaaaccaacucuccuuuaaucuucuguagcuagguaaucggcugcucuaauguaucgagugaaaggcauuuuccuuggggacuaugcuuuccucucugacuugcuauaguuuaagguacuuagcauuguauuauuuaagauguuuggaaauaacuagcccuguguuuuaugguggagaccuuuaauaacuguuuccugggugggguggaugagacccagggccuggcaugcaccaggcaggcccacccgcacuguacuguaucuccagcccaugcuaauggaguuauuucuauuacuuuugaagauggaaaaaaaaaucaagggacacagagaguugugagcaggagguuacuuaguuguccuaucccagcagcugaugcccaaagccacugcuguacucaacgucagaauccauugccucugacugcgaguugagcugggaaacuacccuuagacauguacugcuuugcugaaacguguguaccuuaaaccaacgcccccgcccccaacccgcacacuccucaaaaagucuaaugucuacccugcucagaagugguucacagggcuagagagaugguucagcgguuaaaagcacugacugcucuugcagaggaccuggauucaauucccagcaaccacaugguggcucacaaccaucuguaaugggauguucuggugugcacucauacacacaaaauaaauaaaucuaaaaaaaaauaaaaauaaaaaguggcccagcaucccugugacuucaacauuugggagcccgacacaugccuugagucaugauuguagucucaguccuagugagaggcugcagcaggaggauugcuacaaguuccacgccaguuugaguuauaugccaagguacugucucaaacaaaggaacaaagaccagugagaggcucagggagccagggugcuugcugucaagccuggaaccccauggacggggagcagcauccuucccacgggcuguccuugucuccacacacaagugcuaaaaguuuuaaaagaaauuuccagaauaaacaaaucaagggacauaguagaguaguuaauugcccagccugagcaagguccuaaagaacaaggggaaggggaaaagugggguuuugguucacaagguauaaggcucagaagccagcaaaucccaacaauggacuaugccgauggugaguacgugugcucagggcuguacuguggaguaggucaauguucacguccgugaggcugcaucagucucacugcggucuauguauguguauaguacuguaaugacauacgugguuucuauuauuaacuguaguccuaagugugaucauugcuauucugaguguggguaugucuuccgcuaacaacaaaaugccaacaaucgauuucucuaccccagagcagccuccgggugacacucggagaaaaguaaguggcuuucugggcucuggcuguggcugcugcaugccugugagagaugccugugcucugccggcccgcgugcuaugcuucugcucuucuguucucgcagcuugaauugaaguacaauguuguuuuuuguuuuuuuuuuuuuccuuauuuuacuugugaugcuucagguuucacccuggaaaaaguuuauuguguauuuuaaagagcagaaaagucucaucuggggacuaaagucuucaccccuuccccaccccgcccuugcacuuuaaguucaucaguuugaauuuucagucucaguggcacuuccucaucaguagacaucagcagcaaguuucagucccugcagaaaacacaaaucucucucuggcucauuaggcaggaccucaggucuccuaguguaaaaacaaaaccaaaauucgaaagugcaaaagagacuagguauaccacaccugucacccuaccucucacagcugaggcugagguguagcucaggagcuagugcaugacaaauaugcauaaggcccugagagccacccuccauucaggacagaaggcaacagacagacacagccaggccugacggcacauggcugcagucccaucacuugugagguugaggcaagagaauggcauguucagagccaucgugagguauauggcaagccugccuucaaaagacaagccacagggucaugagacggcucagcaggaaaggcauagguuguagaagccugggcaccagacugaggagccagccugagugagcccuggguggaaggagaggacugaccccccagaguuauccucugaccuccacacacauacauuccugcucacguacacacacaauugaaaaaaacaaaaaauguucaacucaaucuuucuuccucccugcaaacccauacaaaacagggauucuuuuaaacuggcacaagcugcaagguuugugugucuuccuccacuugagcuuuguuuucccaaguaaauaacaccauauguguacacagcuauugugggaaacaugagucauuggcuagagagagaggaggggagagagagagagauggggagagggaggaagagagggagggagagcaagcguaugagcacacaguggcugggcauagcggcacacgccuguggucccagcacucaggagacugaggcugaaggauuaccaguuugaagccaaccaggguuguuaaacauugaacccuuagagguagggaaggaggaagggaucugggagagauaagaacagaacacuuggcggaccccuuucuguggguuguuuuguaggcagcacaaggcugagucaaggauaacgaugcucacguuaguuuugucugagcgugcacugucaagagcaccugucugucaaacccauguguuuucauucaggaaacaaacaaacaaaauaauuuuuaagagagagagagagagaaaaugcuaauuauauaauuuucauaugcucuuagcugcugauguucuagcaaaaacuguccuuggugaaaucuguggccaguugaaugcguucauuugguaguguuucauaaauauuauagucuuuauauaugcuuuuuuggauuuuauuuuaaacagugcuacuguuuuauggucauuucuaaguaucaauggcuuuuuuuuuuaauguuuuuaaaauguuucaagaaaguaaaaugcuuuuaauguuacagagaccuaaagaagaaaggaacagaauuaauuagccuuuucuugagcaauuugaaauuccagauuacacuggucuaauuaugcugugcuguguuuaagaagaauaagcuaauaaaaaaaaauucaucccuuugcucugaacauugacuuuaaaaaucuggacgauucgugagcuagcccuguucugauaaagcacagguuuaauucagugacucuggcuuuccgcaaccacagcuagaccucugucaucugcucugcucucagcaauaucguccauguucccacaacaguugacagcauuuccagccuagacuccaaaguccuucacaaucucccaccaaaacaugguuaugucugucacagcagucccuaugacccugauaccacuuucuuaguuugcuuuuuauuacugugguaaacaccaugacugaaagcaacuuggggaggaaagggcuuauuuagcuugcguauccugagucacaacaguccacugcaggagucaaggcaggaaguuaaugguaggagccuggaggcaggagcugaagccgaugccaugcacaagugcuccuuauuggcuuccucaggccucuuguaguagccugauagcccauggguggugcuacccacagugggcugggcucucccacaucacucacuaaucaggaaaacacucuacagacgugucuaccagcaaucuaauggagguguuuccucaguugagguuccuccagauaacucuagcugggucaaguugacagaaaaccuaucaggacaccccaucucuuuugucaguagcagaccaggcauuucagaaauccuccugcauuuuaaauccaucuguggaaaccagaugcacaauuuauuucaagucucuguuuagaaaugaagcugugcagguagguaaucuaaagggaaagugucacuagcaaccacaaacaugacuaaucuuaguuacccaaagaacauuaaaguauuucugugcuuguuacaaaaccuuucccugucucugugugcuggcucugacuguagacuagccagaggggaaggcuugcuuugggaauguguguggugaggaagaaagccggcagccggguagaaucugcuguggccucuaggcuagcuccucuccugcaguuccacauuuuccaguuccaaaagaaaaaaagaaaaacugguuacuaaagguuacuuuuuccggucauuuucugugcaacuagauuggaaggauuuggcaaaguuccuaagaaauucauugagccuuuuccuaccugugcucuacaagaaaugcauaguuggagcuuaguggguggugugucucauaugccucccugccaagaagugggacacagguaauaaaggaccuuuccaaagagaguuguuuaaaacauauaaaaaauguaaaagcgccuauaguaaacacuuuacucugaggauucaauuguucuuccuaauacuuuuuuuccaaacaagaggagguuuaagaaguuuggagauccagagaaagcuuuaaacacaaacagcuacuucucaugagguuguauguuacucgauuucaaaacaacaaaacaaaacaaaaacaaaaacaaaguaaugcuuucuugcuggaagguuuaggcucugggaaggugcuucaggacccaugucaccaucacuuugagcccucuuuccagagggauuggcauccacccuacucucugauucuucagggaagauuguaggcagaccucucagguuguaguggacuugacaggaaauagauugcuuaacuuuagcagugacuugugugaagaacauaaaaguagcguaguauaauaaagugauaggaaccaacucagcuuugcugggcagguuuaucucuggagaaauuauacuaagaccuaaaugauaagaagaccaugaugagaaaauguguguguguguguguguguguguguguguguuguaaccaaagggggcagccucagcuacauagugaguuugaggcuagccuggacucuaugacacugucucaaaacaaaacaaaaacaacagcaacaaaaaucaauggggacagaaguuguagccagguacaagugcuccaguugaagaacccagagagugcucaaagauuaaaagcacuugcugcuucuggagggcccaaguucaauucccagcaccuaaguggugacucagaacuucaauucucgggaauauggcuccuucuucuggcccuuagacauugcacacacuugguccacuuauauacgugcagacaacacccaaacacauugccuuaguuugcuuucuauugcuuugaugaacaccaugaccaaaagcaguuagggagaaaacauggcgcuuauuucaucuuacugcuuacaguaauucaggaacugagcgcagugaucacuggcuugcucagccugcuugguaccugggcuugguacuccuauggcagucauucaucaagaaagugcccuacacuugccuacagucaacuugacggagccauuugucucacccgggagucacucuucccagaugacucgaguuugugucaagauggacagaaaacuagccaggacacaaaaacaaauaaauccuaagggaggaaaguuuucuaguugaagugauuaacagguucacuaagguugaagacgugcuuuguuuguguggggaaagaggcuggucagggagauaagguccgugagguagccagaucugauagcaacccaggggcuuucugugacccaaacacugaugugacugagagcaagaauauucaagugcacuggcagcagggcuugguaggccugugaccugacuucaguucccacuucuccccguuaaagguaggagaaacugaccccacauagaugcucucuguccuccaaagcaauaugccugcacaccuacacaugcacacuauacacacacacacacacacacacacacacacacacacacacacagagucuugcaggcacucagaaugugaugugaauaguguccuggaaagcaaugccauugucucacaaaguuggcuggucggugauucuuucccguugcugccagcuucacucagaccauagucaagcacguugauaguaaguaguacagcucgucauagcguagcuggagaccagcccaaucccaucagugcuaggguggauaauuugaaauacauuccucaaaggaauaauauacaauagugaaagucagcgagcuauaccuaaauagaauauuauggcccagucuuggaauauaacaaaugguuaaauuaaaaguagacuuuauuagucgguauccauuuugcucaacuagagucuucuuagugucacuuucuuucucuuuguuguuuugagacaggguauuacuauguagcccuggcuauccuggaacuaaauauguaaagcaggcuggccuggagcucagagagauccuucugccugcucaguguugggaccaagauguuugccacuaagcuuuuaguucacucuuagugauaagggaggcagauccauuuugcuuuuuauggagauaggcauuauuaauugcuguaaacuagauggacucaaaacaucaaucagcaggacacuugcccuggcagggaggggccugguucuuaucuuugucacauagccauguucuaauuucuuagcaaauuguuugccuccuggacccuuguuuuugcuauugaaugauggagcuagugugauggaguacuccuguaaucucagcacuuagaaggcagaggcaggaagacugucauguauuccaggagccaggguuacucaccguggugccugucccguaaaaguuucacuuuuacugcugugaguguagugugcauguguaggugugcaggcagauugcuuuggaggacagagagcaucuauagcacaggaaugcauuuggcccuaaaggaaaagcaagcuugugaaaggagagcuguugguccacaucccaaauggcugguguccuuuuucauccccagccugagcuggcagggacccagguggcugagcaugccgacucugagacuguagcucagggagucaaguuacucuccagcacucagaaguucaaagacagggagaucuguaaguucaaggccagccuggucuacaaagaacuugucucaaaaaggauguaucuguuguauuuccucaucuagcauggggaaggaggaucagauccagcguaaguaggcucugcagagcauaugguauuucaaugaagccaagcacagugguuuggagggcuucucugccauggugaugauccagguaccaccuugucagaagagucucagcucuuacaggcagugcugacuuuuguguguuugcacuaucuucugaauggaggccagguuuguuucuuguuugguucuuugagacauggucuccuguugcugacgcuggcuuggaacuccugaucccuaugccuccuccucuugaguacaggauuacaggugggcaccggcaccccugccuugaagccaggcuuagaaccgagguguaccacacggggagccggccucagauuucuccauugcaguuagacacaccugcaggaagaagguuugaggauagaaauccucuccccaagucauaggaauguauuuggcccuaaaggaaagcaagcuugugaaaggagagcugucgguccacaucccaaauggcugguguccaguuucauccccagccugagcuggcagggacccagguggcugagcauggacucuggucaguagcucagggagucaguuacucuccgcuuacuuugggaacuucaggaaugacugggcucuugguuuacuaaaggaaugggguuccaccaguaaaguccuagauuagugguucuuuaccuuccuaaggcugagacccuguaauacaguucuucacgcugugacucucaaccacagaguuaugucauugcuacuucauaacuguaauuuugcuaccguuauggauaauaauguagauaucugauaugcgaccccuguaaaagagucgguuggcccuuaaaaggguugugaccuacagguugagaacugcucuagagcaagcuugccggucugaccuuuuagaaucuugcaguugggcuuuuaaaaauuggaucuuaaugaagcagaagacguagaacccuguauuucucuaccugcucacuucuuuggugugucuuucuccacacauccuuccccagccaagaacuugguagacuuuagcagucagucacuggggaggaccagcagaauggcaguugacugggguaguuguccuugcugguagaucucacaacucuuguucugccaggaguguugacugcacacccauaugcuguguuccucuucagguagagccagcggugcuucuuuggcaccgucaggauugcuguguguuguagaggcaaggcuccucgugcaucugugacugccucugcuccacucuccaccucuguuuucucaguuaaccucuuuuucuuuuccuuuaggccaaugaggcgagcucagaguccauagcaucuuucuccaaaccagagaugaugagcagcuuucuuccagagggcggguguuaugagcugcucaccaucauagguaacucccagggacaugcuuacauucccacuacagugcccucagccaucugggaggguucauggugacaaugggcuucuguggguuucuugugccaaguaugggaaguuguuuccaggaggccagagacugcuacagugauugucugagaaggagugauggacaaaccaagaaaugucuaauaugaaaguuccagcagugagcuuuguaacuagacuuuccugcugaaauggaguuccucuuucuuuagaguagacagaucuugguggcugguuuuguguaagucauuccucuuuucucucaggcaaaggguuugaggacuugaugacagugaauuuagccagguacaaaccaacgggagaguaugugacaguacgaaggaucaaccuagaagcuuguuccaaugagauggugacauucuugcagguaaugaugcauggguguggaccuuggagggagugggguggggguggcggugggggugcuccuggccacauggucauucuucuagggguuucugcaggagacuaagguagaccacgugagaagucaugaggcaucagugaugaaucuuaucaucugacaguugaucgggcuguggugcugcuccacccagcuggccccucuuuaaauauuucucuuugguuuguucuguguuauucagagaggcuaaguagcaugccugcccacaagcacagcagaaagcagcagagacagaaucagucccaggaagucuuggucacagcagagccacuugcucugccaccaguggccauuuucuggcccugggcauccuguuugcugcaggcuccuuucaguuugacaagcaaggagccucccucuuuuaagcugguuugggaacugaguggagugcgauuccuccugguccuaugauaccaguguguguagcauccagugcaguguggacucagugugcagcucccgcccuuccuuaccuguccuguucuccucaagugaugcuccccugacccugaccaugcugcccaacuucuucucuucauagucacuagacugggccaguaccagaaccugacauuucuguaguuuuuacuuuuuguuucuuuugagauagggucucauguucaggcuggucuagaacaaccucacuucuuccucuucuucuuccuccuucuuccuccuucuucuucuuccuucuuuuuccucuucuucuuccuucuucuccuccuccuccuccuucuuccuucuucuucuuuucuucuucuuccuucuucaucauugucaucucuuccuccuccucuuccuccuccuccuucuuuuuuuuuuuuuuuuaaagaauuauuuacuaggcuggagagauggcucaguguuuaagagcacuggcuacucuuucagagguccugaguacaauucccagcaaccacaugguggcucacaaccaucugcgaugggaucugaugcccucuuguggugugucugaaguuggcaacaguguacucacauacauaaaauuguguguguguguguguguguguguguguguguguguguguguacauauagggugcugggaauugaacucaggaccucuggaagagcagucagugcuuuuaaccgcugagccaucucuccagccccugauuuuuuuucccaaguguuucauauaccugcuuucagggaaagaacccccagucaaggugcugggaauguccccuuguauuccauacuugucauuugucuacuaauuuuguuaagucuuauacuuugcuguauagugugaaaauauuuuuuuuuuaaagauuuauuuauuuauuacauguaaguacacuguagcugucuucagacacaccagaagagggcgucagauuucguuacagaugguugugagccaccaugugguugcugggauuugaacucuggaccuuuggaagaacagucgggugcucuuacccacugagccaucucaccagcccccgaaaauauuuuuuuuuguucauuuuuagauagcauuuugcucuguuacccagccugaccucaagcuuacaguccuccugccucagugcccaaacuggguucuuacucuugacuuaaagaggacucuuccuuggccuuuggaauuuaauuaagugaaucacgcccugugucagccaccguuuuauuuuugucuuuucugaggugguuaacucucacuguguugacagcagugacccugcauggugagggguuguuuucuaaggcucuuggguguugguggcugacagggccaccaagaggcuuaagugggcaaauaagguggcuuuccucaaguaugguggcccuuccugcccuggaaggauucugaggagagcaucagaagguacuaggucccuacacuacugccauuuucaagcuggacacuuucuugacugcgaccucagcuuugccguugcuuucagggggagcuucaugucucuaaacucuucagccaucccaauauaguaccguaucgagccaccuucaucgcagauaaugagcugugggucgucacaucauuuauggcguacggugaguacgaaggcuugcagagcuguugguggguucugugcuguugcuuucuccuguuauuccugacguccuuuucaggcucugcaaaggaucucauuggcacacacuucauggauggcaugaaugaacuggcgauugcauacauccugcagggggugcuaaaggccuuagacuacauccaucacaugggcuaugugcacagguguguuccaagcugcuuaacccuuugcuagccaagcuagaguucauagugaaggaucuggauucuaagcuugccccuuggggaaagucuagcuagucagaacugaagucauaugaucuuuauugugugagggacaucugcuguggaccacugccccucaccccugacccugccuuacuccugugugcuucagagcaggcccaauggccagggcagaaacaguuugcuuauuaguuaacuccuaguggggaagagaauggaacuggagccucuuuuccaccuuguagguuucagggaucaaacugagguagucaggcuuggcggcaagugccuuuacccacugagccacauugccaacccugaagugcagacuuaaguagaagucaacugugagggauagcuuucggaccugagacacacaguuacuucuggucauuuaagaagcauagagcaagaaaaugauaaacuugauuauaucagguuuaaauauuuuuauuucauaaaugacacuauaaaguaauguauaccagagugacagauguuagcuuugucggaacacacgugagcaacaagaagaucaucaaaacagggaaaggacagcagaaugucaggaugggaaguuacugcagagcaggcccuagcagucauccacaaacacucagucaucagagaccucagaugaagguaagauguuacauuguaccuggaggugguuaggggcugaugggacccaggcucaucaucaagucuggcugugugccugucaguggaccugcaugcugacaucugugacauuugcacuaaguuggaaauuccuugagugucucuuccuggagaauggguaaauguuagaucccuggauuagagaugccaaucagaagcaagaaucagauguauacagguagaggcgaagaugagucuugcucagcacugacagagaagucgcuugacauaaaaugauuagguaaucuugcacuugccaagaacacccaagaacaaaagugcagauuaaaaguauuagccaggcagugguggcgcgcgccuuuaaucccagcacuugggaggcagaggcaggcagauuugugaguucaaggccagccuggucuacagagugaguuccaggacagccagggcgacacagagaaacccugucucaaaagaaaaccaaaaccaaaaccaauaaauaaauaaacaaacaaacaaacuuaaaaaaaaaaaguugcggccagccuagguuaccugaguaccugaguuccaggcuagcuggcuggggccugcuacuggauacagacacaccaggagccacacuguuaaagaaaacugauucuccuccccagcagcuaucaaccugucaguugggguggaggcucuugagccccucuccucccugcuacaaugcugacugcuugguuuucuucgggccuucugcaggcacccauaguuucugugaguucaugggugcagugguccuacuggguccagaaaaaucuguuuuggucagguccuccuaccucugguucuuagucuuucugucccuucguuugcagugguccuugagccucaaugggaagagggugauucacaugugcuaguuauggcugaccacugacacacacagcuguauuccagccaguugugaguuucugcacuaaucaccauccauggcacagaccuucugaagaagguugagagaugcacuaaucuguuuguaugaagauacagauuuagauggcucagggguuaagaucacugauugcucuuccagagguccugaguucaaaucccagcaaccacaugguggcucacaaccaucuguaauaggaucuaaugcucucuucuggugggucugaacaguguacuuacagacauauaauaaaaguuuauuaaaaauaauuuuuaaagauacagauuuagaggacacuuugacacuagggacauaguaaguuauaaaguauaaugauaauuaaauguuaguuagucucagcacuccagaaauacacaggcagguggaucucuauaaguucaagaccagccuggucuacagaggacuuccaggauagucaggguuacagaaaagaccuugcugcacaaaauaaauaagaauaaaaaucuagccgggcagugguggcgcacgccuuuaaccccagcacuugggaggcaaaggcagguggauuucugaguuccaggccagccuggucuacagagugaguuccaggacagccagggcuauacagagaaacccuaucugaaaaaaaaagaaaagaauaaaaaucuaacuacauaaauggggccauauuauuuuuucauuuucagacauguuuaaaaauguuuauaaaaucauuugcauauguaugagaugcaguuacauacaugugauaugcccauaggagagaacuggccaugucuaccaugugaagcuugcgcuucuguaacagugagaugugaccaugauccugucuuuacuuccccacaggagugucaaggccagccacauucugaucuccacggaugggaaggucuaccugucugguuuacgcagcaaccuuagcaugauuagucacgggcagcggcagcgugcaguccacgauuuccccaaauauaguaucaagguccugccuuggcucagcccagaaguccuccagcaggucuguguccuuggacacagggagccccuccauccccagggaaacgcuggagugugcuggguggggcugcuccugugucugguaagaggagucuagaaggaagaguccuucuguuugccucagaaauacugcccauccuagggcuaggggccauucuggaaguacucggaauuuagaucccugugcugaacgggcacauccaucucagugcgccuacuuauuucacagcagcaccagacguuggcucuccucacacagcaguuaggucacaagcguggucugaguuaugguccugacugugggauggcaguguuuguuuuuguucuauuuguccuauuuaagaaaacccaaggcugcaaauggaaucaucugugccuuuucuucugacuuagaaucuucaggguuacgaugccaaguccgauaucuacagugugggaaucacagcaugugaacuagccaauggccauguccccuucaaagauaugccugccacucagguaagccugccgucagugcucccuuccuucuccccugccagccuucuacacgugucugcugcuuccugccauauuuggacacugacaugaaagaaagucacucuuuucuucaagcuuuccacccuugaugcagggugcuugugcaauucuuuguucccuucucuggugauaaauguggucaggaacccagcccagggguggggcagguagggcagcaguacagucagaggcacauaacagauaccacauggcuaugcaaaccggguaaaccucacgaaccaacuuuguuaugcuuuguuuugugaaauaggcucuuuguguaguucaggcuaguaucaagcaauucuaccucagcuuccacgauuuguaauuacaggcauguaccaccacgccucgcuaagcagcccuaaucuuccuuccuccuuugaguggauacaaauucucucccaucucugaguuuugugccaccauauucuagcacauacuuuuagaaccuacauccuguaagcucaguaaaaacucaugcuccugcacaugccugccuugugaccacaauuuaggccaggguguagucuacucuuguuggacagauagacccagagaaacuuauucaggccccaucauaccaggaaaugaaguuggaauuguuuggguaaguguuuccugggucucagguaccuagagcaaaaucuagaaccagagaggaagcaagaaacugagcagggccuucccucaggcucacagacggccccucucaggcucauaccuuggaucacagguuggagcuagagaauggccaaguacuacuaccuggagcagagaccaaugcaacuucuagggcaggauaauacuuggucuaagacuuuuuguaaagaaaaaaacugaugugugugugcauucuugcauguguguauacaagugcacacauaugcacuccauguauguaauugucuaaggagaucagaagagggcaucagaguuccuggaacucuguaagccacuugacaugguugcuaggaaccaaacucgggucuucuguaagagcagcgagcuuccuuaaccauugagcucucucuaguccuggucuagccuuaaaagguacuagcgguugaccauaugaagaguuggggcagaagcuuauucuuggacuggaagugguagaauacuugccugagaugugcugagucuggaguucuguuuucagcagugcacgaguaugcacaagcgcaauuggguccagggggcugcugggugacggggcuggagaaggaggcagggcauccuauauauguucccuaggucguuugguucaugucccagugaauagagaagugcugaagauauaaguguagggguaauauaagauuaucuauccagccaucuaucugaaaggugguucaaaucuaucaauucuaguucuuagcuuaacuuagcugauagaauaauuagguuguugagccuagaauaaggaauguggccgggcgugguggcacaggccuuuaaucccaguacucgggaggcagaggcagguggauuucugaauucaaggccagccuggucuuggucaggauagccaggguuauacagagaaacccugucucgaaaaaaccaaaaccaaaacaaaacaagaaauguguaauaaaaaugagaaacaggacaugcucagaaaggaguuagaugguuaguuaguauggaucuaguuaguaugagccuaguuugcgugagccuaauuaguguggaucucguuagauugagccuaguuagugugaaccuagcucgugugaacauuagguucauacccagaagcaacauuguccauucgaacuuugucugccccuauacugcucacaguaagggagccacuaaccacuuguuauguugacuaccuaaacuguggccacugagucagagggauagaauuuuaaggcuaauguaauguaauguaaauauagucacauguggcuauaggcuuccacauuaguacagcccuagagaccucuccaaguucugcucggacugcucagcagguucaugagcucaccuauggggacagcuaucuucaagguguggcuuguuuugcaugugacaaguuugaaggcuuugggcuucuggugcagcaugcccgucaacccagggugcugugugucagaugcuccacugugggcuccacuggacccgccugcccugguagagcagagcugggagcacagagacccaugccagucugcuucugcucuggagagagggcucuaguuacugcagugcagugccucgcaaagggagcgaggacgccgagcccuucagaccagcccauucuuucccaucugccuucacugccagccaguggcuaguguuccucugcaaaagccagauuuacaucaugucuuaggguuuuuacuacuguggugaaacaccaugaccacaaguaaguuggggaagaaaaaugcacuuggcguauacuugugggaaacaagagcacuaagagaaggcagggcagggacucaagcagaagccacgaggggugcugcuuaaucgcugccuugcuccucgggacuuccucagccuguuuuacuauagaacccaggaccaccagcccaaggguguaccauccacagugggcugggcccuuccccgucaguuacuaacuuagaaaaugcccuaacggccugccuauagccuguucaugugggggcguuuucucagaugacucugcuuugugucaaauguaccuagcacauccaacaccugucuccgcggccagaggucccauuuguucaagggaggaggagaucugugaggagacuccuggcccuccugggccucucacccaggcccaucucucuuuccuagaugcugcuagaaaaacuuaauggcacagugcccugccugcuggacaccagcaccaucccugccgaggagcugaccaugagucccucccgcuccaucgccaacccuggccugaaugacagccuggcugcugguagccuccggccuuccaauggcgacucgccuucccaccccuaccaccgaaccuucucgccucacuuccacaacuuuguggaacagugccuucagcgcaacccugacgcaagguacucugcuggccaucagguggacuucagggagcagagggagccuaggggcugcagccaguguuccagaggcugcgacucucacauggauaucuggaaacccagcaggaagaacugacuuccuguuaagaaacuggcgaggguagcuugggcuguuagguacugggagacagugagacaggagagggucuggguuuggacagcugagcccaggggucauaugggucucguccccuuucucuccaggccaaacgccagcacccugcugaaccacuccuucuucaagcagguaagguagugcccuggcucccugcugcugcucccugugacuugagccgcugacccccucggugguuagguauccuuccucugcuuguuugaacuaaugcgaugaccguccuucuggagcuccaaggggcucgcucucuccuuccuuuccuuuuuggcucuagaacaccacagggcaggagcuuuggcuccugggaccugaguuguaggacacauacccaccuugucucucucccucagaucaagcggcgugcuuccgaggcuuugccugaguugcuccgcccagucacucccaucaccaacuucgagggcagccagucucaggaucacaguggaaucuucggccuggugacaaaccuagaagaccuggagguggaugacugggaguucugagucucugcagccuguccuccagcuggcuggcgugggguaugagccuggggccuucuugaggaccagcaucugccucuggccacagacuggguucaaaggauauucugccugccaagcuggcuguuggcuacuugaaaggacauucuagaagggacuucacuguuuuuguggcuuuugagacccagggaaucccaaucaccagggacuuggagaggccggaaagcugacauccuguugugugagcucaggggaccuccuuagaaggaagaagugcugcaugggccccgaggcucacggccaggcccagaguaacucuugacccagggaccuucacauccucuucccaacacuugcucucaguagccuagucccucuucccucuguucccauguccugaagggcugaaaggggacaaguccuaagcugucuggcccugcccagccgcaggcauugccccagcuacugagcaccaggucaguuaaggcugggacuggccauccucaucuccaccucucgugggcccugacaccugaaaccaucuuagcucauuuauuacacuccuuucccaagaauccaucuuacugccuccugccagcugcugccuuggugccuccuccaagggccauacaugucuugccucaucugagggcuuaagaguccuuaaguuguauuaguuucauugucagaacaaauuaaaauuuucagagaauguugggaauggcaccaguguuuccuuguguucagagccuguaugcuggcuucugggauugccaggcuggauuggcugcaggucacugguucuuccagagugggcuauguggacuugugccgcuggccuggcagugauuucuuucauaagcauacauaccaguuucuuagaaaacuggucuuagaagaaacauccguggucaccuuuuucuuuucuuuucuuuucuuuucuuuuccgagacaggguuucucuguguaguccugguuauccuggaacucuguagaccaggcuggcuucgaacucagaaauccgccugccucugccucccuagugcugggauuaaaggcaugcgccaccacgcccggcuccguggucucuuaauucccuagaguuugaguauaaaauuuuuuua

SEQ ID NO: 6452 - RNA, 33146 nt, Mus musculus
uagcggaggcugcguuucucccguaggguuccguccgucggguagacgucacuuugaucggaugcuccggaagcuaaagguggccauagucuauggggccauguggacagaggcaugaagggaaauguugcccgagucguggguuuuuuguguugcuuugguuuuuggcaagggacaagagcuaagggaagguggacauucuuauguaaaugaaguuuccaaucaacaccuuauuaccuugaguuuuucgggcgguuccccaucgccgcggcucucuucauugcagacucccucacuacacgacccagacacaauccucacccaggaccagauucccguccggggugugugacguaguuauguugcguuccggaaucggaagagcggcauuaauuggcgccuuucggcagccguagccccagccccacccuucggcucgcgcucuacuuagcgcgcaugucagacgcuccccccacccuacccccagucagcaacgggccgugaggcggcggcgaagggggcggaggaagagcgcggcuggacgcggucccgcaccgcgcguacgcagggccgcggggguucuuucgcgccgacuggaguagcaacugcgucugcagccgcggcagcggguuugggugaagggcucgccagacgcagugccgcuagcccgggggacacgagagguaacuggggccuggcgagggcggaggaaccucggccucguuuaacaaagaaucggcagagccuggggacccggguggcugcggggguccgggcagggauggguacgcgaucuggagccccgagguggcccucuggagcuacguugccuucccacggcucugcuccuugcacgucuuaacgaggcccacuuggcggcuuuccggaggcggugcuugaugggcuccaggaagggauuuuucagggugcugggcuccgaagcugugagagccaguggaggaguauugauccuuguagguagcuguuggggauugcggacccacaaauggaggcggggagggucucgguagcggagguugacagauuagaaggcugugauagucauugaucuuugugaaaccuugaguagaucaugauuaacaucaucaccauaguuacaaacuuuuugcggccuacuugagccuaccugauuugaauaauauauauggguugaaaaccuguaucagaaucguaaggaaaaaauuauacuagucaaguuuggaagcauauauaaacuuuucugucaucuuagcuuuuucccuuuucaccccuaccccuuuaggcugugguuuuguggcuuuccuacuguguuguuguuguuguuacuauuugcaaguguuauuucuguauugucuccuacacauaccugaacagcuauuaagcugaacaauuauuaaguagaguagauauuaugucuuuuucuuuuucuuuuuuuucuuccuucgagacaggguuucucuguagcccuggcuguccuggaauucacucuauagaccaggcuggccucgaacucagagauccaccugccucugccucccaagugcugggauuaaaggcgugcaucaccacccgucgugggugguagguuaugucuuaauucguuuaaacuuuguagaguccaauccuguucugacaggugggaagugaacaguaagucugauauaaaaauuuauucuuccagggcgaaaauguuauuuuacuuuaccuagaaggagaauugcagugauucauuuaaaaauaaaauuguuauugccuugccucugugccuguucucucuugaauugcuuaaguguuaaaucuaugaccacugcacucaugagacucuuuauauacauuuuuuggacguauuauuuuguuugucuuuguuuuuguuuuuucaagacagggcuuuucuguauagcucuuguuguucuggaacucacucuguagaccaggcuggccuggaacucagaaaucugccugccucugccucccaagugcugggauuaaaggcaugcgccaccacugcccggcacguuauuucuuuauguauguuuaucaugcccuccuguagagguuagaggccaaccucugggaguugguuuucuccuuccacuauguagguccucaggauggaauucuggucaggcgauuaaucuguagaaccauuuuaccaguccauuuaugaaacuuucuaaagaagaaggagagauguguguuaugcuuuauguuaaagaguagucuguaccagcaaaggaggcuugggagaagcugcaauagaguagucagggaaagcccuuucugguaucuaacagauauuuaggcaagcuagaaaauggugagagcaucuaaccacggagguaucuggagaaaggaauguucugagcagguggacagcaaucaugaaggccuugaaggggacaaagcugggccuguuagaggagcaguguguuuguagcacuuagcaaaugaaggaaugagaagaugaggaugaagaugagaugaaggaugagaccguaaaggaagaaaggaaaacaaagcaacuagggccuuguagacgguuuugaagauuuuguccucauucugcaugaaauggggcugucugagcagaggagugcuaaaucugacuuacauuguaauucaguuccauucacuguaauguagauugugauaauauaauguagucuguuucaaaguuccaaguuguccuuggcuuuguuaaaacugauaggaaaggggugcuuuucagacaacucucaccacuccccucacucacauuuuauuagauuuggaaugugaugaaagucuugguaaaugagcuaaauaccuaauaaaaaaaaaaaugaaaaaaaaaaaaaaaaaaaaagaaagucuuggguauuugacagcuuugcauuacauuaaagaaagugacaaaauuauaauuugaauauagcuauuuuuuauucuguuuuaauuuccuauuaagccauuaaaaaacuaacuggcucaacaguguuuaagauguucuuacuaagcagauuauuaaguagaguagauauuaaccaacugucauuguagcucucuuaugaagcuuaccccacucuuuuacucagugaucuugauaucguaaguggugcuugacccuugaaugggaaucugaguuaagagaucugauauuaucaauuuaucaauggggagauugcuuucuggagaaaugauaacuaugccuauaguguggguugcacuguauugccauacuucacucaauauauuugaguuuuauuuauugaauuugguccagagucucacucuuuaggucauguugaucuagagcucacuuuauagcccagguuagucuuuaacacacaguauccucucugucagccucuugaaugcugaagcaugggucacuacacauuuuuccccauuauuuuggaguaaaaaccuaguaguaagguguaugauagucucaccauuuugcaaauggaaaaucugcuaauaacaucuuuaagauucaugcuauuaguggcagaauuagaguuugaauauagcuaacugguauuauuuuacaauccuguuaaaauuucuaaaugaaccaucacauuuuggugccuggauaccaagcuguccuuuauagcaucuucaguuauucucauccaaggguagcuccucuuuaaaacucuuguauguaaagcaugaauaaugaguaucugcucuuaaagaccuaagagagugaauguaaauacucagccaugagauguaucguguuuaagaaacaauguagugccagguguuuaaagaccagagaagggguuuaacauaaaucuauacaaaucauauuuguguugaugcucuagaauuguuauuccagugagcuguacagguaagaaggaccuugauaggucaaugucaauaacagauuuugugugggagaacccaaguagagguaagaacuccaucagacugcuugauuuucuuuggaacccugggcaauaugggugguuaaaguuauuuacugccacaaugcaacaccuaauucuagucugacuaacuggagagcaguuaaauugaagggagugacagaaacauaaauugguauuuugaagaugguuuugcugaguguguguacuucaggagcucuguucuuugaugugacuuuccuugauuacacaguauuaacagacacagugcuguucagccaaaggaaguagaaauucauuuuguuugcaguuuugucucauucuuacuucauuuuauacuuuucauuuucauuuuauacuucauguuuuauaaauuauggaauguuagcuaguuguagaugcagcuuauagaucugagucacaugacuuuuccaggacaacagacauuguugaggcagaguaguagaacuuuugcccuguugaguaauauacuuagcucagugaguccuugacuugucugcaguaccucaccuccucguccugcuugcuuucauuucaugguauuuuuacgaucuaaaauagaauaauaucauuccuucgcucccuccccaucuccccaucucugaccacauugaauucccugagggcuuucugauuccaugcuuguauccucugagccuaaaaaacaauugccugacacaaaacaagcgcgccauguauuuugcuauaaugaucacucuaguaguuaugugggggcuugaugacugucagucuuguuggagaguugcagugguagaguaaagauggagagaagagcaucuauuucauacggaguuggggagcacacgucagagaguggguagugaucagagugagacaguggagcucaccaguauccagcuugaauugagucugcuguauggggguguuuggguuuuuguuuguuuacgaaauuagguguuuuaguuuuuaaagggauucuuuuuuuccaguacuugggaugagucuggggccucaccugugcuaagucaagagccauaccacugaacuguauaacuugccuggaaucuucuuuuuaaaccaaaguaauauucuguuuaagguauauauguaauguuuucuuuaaccauucaucggucagugaacacgggaugccaccuuuugccuuauaacccugauuaauguugcuaugagcuugaaugaacuuugcuuucauuugguggagguguauauuuauaagugaaauuucuggguuauaugccaauuguauguucuucuaauuaacaguaauaacaaccaaaagaaacaaccccaaaacauuuguugauagaauuccaacuagaauaaguguuccauggaucccccacccccaguuuugucaugauuuuuguuuguuuugguaguagauaaaugcacacauuuaauaugaagcuuuacagcuuacauuuuaaaugccaaucauagcuguauauaaguugacuaaguaauauauuugggucugguugguuugagugugguguuuuuauuuucaaggguuuucuuuuuuuaauaaugaaguuaaaaaaacaaaaacaacaaaaacccuguauauauuuauuuguguucagaauacaacuuggaggacuugguucucacuuuccaccauguagaucccaggaguugaacucggaccuucaggugaggcaaguccucuugcccagugaucuaucuuguugaccuugcuugauuuuuuuuuuuuuuuuuuuuuuuggaagaaaaauacugauugccauaguuacugaaccuuuuuuguuuguuuguuuuacauucuaccagcaguucgcagagguuccaguuucccuacgucuuugccagcacuuucucucccagaguuauauccucaacccuuagacuuaggugauuccaguuuuguugccagcauaauaaaguccuggcuauaccuucucuccaucaggccugaucaguuggcccugaugagccuuggugaauacaacaaauugucucugucuuccuccuggcagcugugcagggggauugauagcauagugauggagugaguguguuucucuugagagcacuuugcugaggauacuuguguugcuuuuggguuaguacagucuugggggcauccagaaagggggcaguugcugaucuucauuuuuguggcuuugagcaucugucaauacugaguacugcuuuggcaagagcaagggauuucuuugcuuucaaagauauauugauaaaaagcuguuuucuggggcauuuguuuguuugaggcauuaugagauacccuacuguuuuuuaauaacagucauccugaucgauaugaaauggugugcguugugguuuugauuuacauuuccuucauuguuuguaguauaaggauuuuugagacaguccuauacuguguagaccaagcuggucuuguacuugagauccuucuacuguaacaucuugaguaccaacauugcaugugugcauuacuauaccuggcuuugaugcaaggugucuuuucauguaaucuacugaucaguuauauauugucuucagagaaaucuauucaagucuuuugccuagucaaguguuuuguguguuuguaugaguguuugccuguguguguguguguguguguguguguguguguguguguguguguguguguguguaccauguacaaaaccugguucuaguggagcuggaggaggguauuguauccuccggaacuggugucgugacaguuuugagccaccauguggugcuggaaaucaaaccuggguucucuggaagagcacuagugcuuuuaaccucugagccaucucucuagccuucucuuccuuaccuucucauuuguuuguggcuuuuguuuuuuuguuuuuuuuaagacggguucucuguaacagaccuagcuggccuggaacuugauuuguagagcaggcuggccucuaacucaaagagauccugccugccuccgccucccccuuaucuauuuuuaagacuggauuuguauuuagugaaauuuaccugaguaaaugcuuaggaauaaauauuuaagccaggggugguggcaaaugccuuuaauuguaguacuccagaggcagguggcucucugacuuugagaccaaucaagacuaccaaaauaaaaaaauuaaaaaaaaaaaaaaaaagaggagggagguaggguggggaacaagcaagguugaagggccagugagcgagccgcaugauaaaccuaaguucugaucugcaauucccacaaggugacgagagcauguggacaguccuuucauuuccacacuuguaccaaagcacacguuuguguucacacacacuaaagauaguaaugauaaagguuaagagauugucuugcaauuucgauccuauauuagagauaguagguacugucuuaggaucauucuugacaacuccauccaauaaaaagguuauuuuacacaaccucauaaaaguacuucuuuuguuugggaucucaauaaaaugaauaauaguuucuuaaauauuuuaagagaaaaucauuugguugaaguuguaauuguaucugaaggccaauguuacaugccuucacgugguacuggggccuccacacgugggacaaguaaguacuguaccacuaagcagcaccuuaaauuuguagguagacauagaaaaugaacugaggguuaguaaggcuguuuacaaagucacauuaauaugugugcaucuuguuccuagcaccagucauuggcaucaugaacuggaauaaaggcggcccuggaaccaagcggggauuugguuuuggagguuuugcuaucagugcugggaagaaggaggaagccaaacugccacagcagucccauagugccuuuggggcagccagcucuucuucuggauuuggaaagucugcuccaccacagcuuccuucuuucuacaaaauuggaucuaaacgggccaacuuugaugaagaaaaugcguaagugauaauucuugaugauuaaaccagugugaaauacuaauaauuuucaggauugaaguucuugucccccacccugaauuugcuuggauuaagguauacaguauucaugugcuugcuuaaauuguuauucgggaaugguggguuuuuuuccugauaaguguucugaacaagaugaacauaaugauuuugguauuugagucaacuggagaguuuuauauuuaauucaaauggaguuugauggacuuguguuuugaaguaggaucugaucugcaauucccacaaggugaagaaguagcccuaucuugcuaugaucaugauccuucuaccuugaucuccuccuuucgagggucacagacaugugccaacaaacccugcugggaauucuuacuguguaaugcaccacggugaaagcgugggcuagugaagguuuuagucuccuuacugguuugucuuaauuuucagguauuuugaagaugaagaagaagacuccagcaauguagauuuaccuuacauuccugcugaaaacucaccuacccgccagcaguuccauuccaagcccgcagacucugacagugaugaugaccccuuagaggcauucauggcugaaguggaggcaaguguuggcucuuguuuccuuaaaauauugagcauauugaaauagcucuugggagggggguuguuuuuguuuuugguguuuuuagaauuuugcuauuuccauuugcccucuuaaguauuuucagagguaaucagugaguggcgcgaauaguuaauugcaauguuugaacauaguuacucaaauauauguuuuguuauaagaauuuuaguauauucuuaaguggaauacuguaguaugcacucuagcauuuauuaaauccuauuucauaaggaagcuaaaccuaaaggacgucauacauagaauuagaaggguccaucacgugagguuuccagagcuuccucuauggugcccccaacuaggcaguaaacccaacuugggacccuuuuuaggaauauuucauuacuaaaucauaaccuccuuguguucuauguccaacuuuuaucagccacagaacuaaguaagacugacuccuguucucccacagcagccuaaauaaccucuucuagcaccgucaucgcuuaccucauaagaccugugcccagcccaggucuacuguuuucuuguccuggcaacacccauguauugguagcuugauauguuagauguuuagauuucucacuuuugauuuaaacuaccuauuugucuagagaaaauaaaccucauaagugguugagccagaauucaacucuaauccuuguauucuuuaugucucugaguucuucuagcuuacagguuuuguguuuguuuugagacagggggucuacuuaguccugaccauccuggaacucacuauguagaccaggcuggucuugugauuuuuuuuccagccucugccuccugaguucugggaugaaagcuaugagccacaugccuggccuuaacauuuuuucaaauuaacagaccauagaagacaccaaaacuuaauaaaauuauucaaggcauacauguaucuugcaguguaguagguauugaauaaauaaguaauuugcuuuaaaaaugaaagauauauagugcuugauauacaauguuuuuucaugcucuuaagagagggacauuugcuacagggcaguauuucuuagaaaucucauucauucauucauucuuuuuuuuuaauguuuauuuauuuauuuguguauuugaauauaagauuugucugcauauauaccuguacaccagaagaggguaggaucccauuucagaugguuguaagcuuauaugguuguugggaauugaacuuaggaccuguagaagagcagaguagccaguguucuuaacacagagccguuucuccagccccacuauuucaugauaauccuaaugauaaaguauaagaaaagucaacucuuggcuuuguuguuguuuuuagguuuaaauuuaaagcuuucuaaguuuauauggcuccuuuugaaugaguuaguugagaauggccaaauucuuuuugcuugacauuuaaauagcugaaguucuuuugaguacgcuaacaugcuccuggaucucuuugguguaguauuaggagauuuauuuagcuaaguacagagagaucaauugucagauguugaaggguguuggauucuaagacgaaguccugaugucaaaugccaacuuguacgauguaugaacuuuucuaagacuugaauuugaugaagguuuauuuuuagacagugugcuaaugaaagauuuauauaggcuuaaaagaauauuugaggcuagagagauggcucaguggguaagaucacauuaccgguuuuccaggggaccuggguucaacuucuagcauccauggggcuauaauuccagucuuaggaaaucugauguccuuuucuaccuucagugugcacuagguacacacacacauagcaugcacacuugcauauaagaagugaauuuuuuuuauucaggcuguggugguucaugccuuuaaucccagccauugggaggcagaggcaggcagauagaucucugaguuacagaguaaguccaagauaggcccuggcuguacagagaaacuuugaaacucaaaaaacaaacaauaaaaaaaaccaaaaauauguccugcaaauguagugauuuuuuuuuuuuauacguaccaauauuguugguauuguguucaguuuauagcccucgacgugucucuaucaacccaaccccuugaaaaguaguuguauauaauguuucuuuuacaaauaauuccuuuuugaugaaaacauuucauucauaaaacagcuggucaugccaugguauauguagugacuuuuguuuuuuggggauuuuguuuguuuguuuguuuguuuguuaagauaaauacaagggccagagagauaguucugagagcacuguguccuucuagaguaccaccugggucugauucucaguaucuacucaguaguucacgcucuucuagagcuccagucccaggggauccaauguccuucacccucugcaaacacucaacacacauggcauacaaauauacaugcaggcaaacaugcauacacacacaauuaaacuaaaauacaaagauagaaaaauccacauuuucuuuaugcugaagggcuuuggaaaaaaguaauccuagcauuacuuuccaaauguauaaaacaaaggaucaguauagagcagugaucugcaauugucauuuuucuaauguauaagaacuuguauggaaaauguaacaaugauacacuuuuaauucuauuccuaaagguuuuaauuuacugguuuuuuuuuauagcacauuuucaacuuuauuaguauuuaugauugcguaauuuuuauuaugaggguuuugauuuuuuuuuuaagauuuauuuauuuuuauuuauaugaauacacugcagcugucuucagacacaccagaagagggcauuggaccccauuacagaugguugugagccaccaugugguuguugggaauugaacucaggaccucuggaagagcagucaguucucuuaacugcugagccaucucgccagcccauguuuuguuuuugagagacagagucuguguagcccuaacuguccuagaacucacuauguagaucaggcugcccucuaagucaagaguucugccuaccuuugccuccugaguauugagauaaagguauguacuacuaugcuaggcuuuagggcuauucuuguuggagacuguguagaagcaucucuagccccugccagccuguaucacuauuuuuaguuaucccaccucacucuuaauuuguaaaagcaaaaaugccagacauuuggggggggggggcaggaucaaagcaaagguggaggggaaauuacuuucaaguucagaaccauccuuccaaaauaagagucagagcucaauacaucuauuuuuccuuuuggcuuuugucuguuuguucuuucaguuuggggugggugaguggcuuguuuuguuuuguggugguagugcaggauuuugguuuuguuguuucaacuacaucuacuucaagcuauacuuaaggcugauuugcuugaauuucagggcaucuauagcaaguuauuuccuuuucuaagacaaaucaccaaagauuuauugguggugaauuaagcauuuaaaaguguauaugcacuuacauguauguguggcauauguauuacaauuaaaaacugugaaaucuauguauagcaaaagacaacuggauauuuguuuugaaaaauauuugucaacgcuuccugaaagguuauauggaaaugcaagugucagaacacauaaggaaaacuguggugaauguguuucaguauauaaacugucuguaaugaacuucuccugcagcauuuuaaagugaugucacuccauguagccuuuuauuuccuuaggaucaggcugcuagagacaugaagagacuugaagaaaaggacaaggaaagaaaaaacgucaaguaaguuuuuuucuccacucucacaaaaguuacauagaaauuguagaagaauagcaaagacuauucuuaagaacuuauaaaggaaagaacacuaaaguacacaaagaucuuuauuugagcugucucuguaucuugaguauuucucuagguaugaagauggcacagccuuugcauuuguaauaacuaaaggcauucucuuugguagaauaaguauuugguuauaaauaguuguccaagaaauggaagugaauuauagugaggguaaaggaaguauaguuauacaguuuagguucauugucuuagauuucuucucauaauaauaacagacuaaugccuaugugauaaguaauuagaaguuaugaugguuauauaauaaaacuauauaaaaauuacaagugaguaaaagcuacuuucaucugauguuacucuguggcaccaaaugcuuaacuuaaaugcuauauuuucugggaaagaaaucuuccucugcugaauacacuccuaaaccuuugcccguguguuuggacauuuuuuucucucuguuuggaagucaggccccucccaaaguuucugugccagauggagagucagccaucuuuugaugauugcugugugcugcauccuucuaguucccuuggaaauagcaaacgcugcaaguugguuagaaagagacuggaaagagugacaagauaguugacugugggaaguaagcaauagucguuuaugcaguagaugccugagagaugcagcaaguggcagugguuccauucucuaugugaaguacuaguuucaauuccaaacucaugacagaauucauguaguuucuuucucuccccauccccaagguaacugauuuugacuaaaagcaauuuauucuagagcuagaaguuacaggaauaauaaaguugugauauucuuucaacuguauaccaaacccaggaggguuuucuuuucaauauguaauacacaacuauguuauguuuguuguauauauugacaaagcuuaguaucccuccauaccucucuucaccaagaaagguuuuacuuuuuuuuguuuguuuugucugucugucugucugucugucugucugucuaagacacuguuucuguguguagcccuuagcugaccuggaacucuauagaccaggcuggucucuuaacucagagauccaccuacauuugcuucuggggugcuauuuaauuccucugaggaauuaaaggaaugggccaccacuuccuagcuagauuuuaccucucauaucaguugguaauugauguuucuaaggguaccauaucaucucauugcaaaaagagggaaucuuuagcucauagaguuaagccacacauauauuauggguggaucguguacaguauacuuauuguugcuuuguuaacguuaguguugagaguucuauacuguauggaauucaacacuaagcuguuguaaguauggagcuggguauguggaacauuugcagggaaguuuguuucuccgcuuguuuuuccagggguauucgagaugacauugaagaggaagaugaccaagugaguuucuaugcaguauuucuaucuuuuauuuuuacuccacaaagucuauacuggggacaggucagagcuugccuucacugaaugacuuacuccuuuucuaucugugugaccaauuaauacuaucuccagauucccuucccccaugaugcacgugggauuuuugaucaacugacauuuuuuuuuaaaaaaagaaccuuauucagguuuuuuuuuuaauccaaauuuuaaguuuacugugauaagccaguaauaugaguuguguggggccucuuacugguuuuuuuuuuuuuuuuuugccucuuuccaguaauuguuugugacucuuacauuguaguugaaacauuaguaacuauccauuaguacuucuuuuugccuugucuagugugggauggugaggacuauagacuuccagguuugugaucuuucuaaucaguguuaacuuccaaacuuggauugguauaaagccaaagcaugucuuccucagcucugggcaggguaguaagauguccccacaaacaggaaggcuucuguuaaauaaaucagaucauuguguaauauugucuugcucauugauuuugaguauugcuauuguaaaagaaaucauugcuauguuagugaaagucuuuccuuauuugauagguauuuguuuaaauuauauaaucuuaugguucacugugugugcacugcaugugcacugauugcaaauguauaaauguucuuaacuguacuuagguuugauugugcucuugugcuuuccugcaggaagcuuauuuucgauacauggcagagaacccaacugcuggggugguucaggaggaagaagaggacaauuuggaguaugacagugauggaaauccaauugcaccuuccaaaaaaauuaucgauccccuuccucccauugaucauucggagguauuacauuuuuugcuuuguuucuaacugauacaguuucauaguuuggaaucuuuauuucugcuaagugguuggaucagaaauuccaugaggcguucauaauauauaaacuagcucacuguagucucaacacuuaugagacagaggcaggaggauagccaagaguuugagguuagccuaaacugcauagugguuugcagcuuagcuuuguuuacuaaaugagacuauuucaaaaccaaaaaggcuuacuguaaaugguuguguacuauaagaagaaaauuugggccugaagauuuaacucagucagaagaguaacuugccuaccauucacaaggccuguuguuuaauccccagcauuucauaaaacuguauguggugcaugucgaguuccagcacuaucaaggucagccuggacugcauauuaagauacucucaaaaaaaaaaaaaaaacaaucaaaacaaaucagccaaaauaggcuuggccguucauuuuaauaaguuucgugggcaauuuuagagcuuuacagacuuuauuuuuggaacugcugaaguuauucuguggcuaagagcggccugcugcucuucagaggaccugaguguaggucauagcacccacacccauaccaggcggcucaugcauaaaccuaguuccaaggagugugauguccuguuguagcuuccccagccaucugcacauauggggcaugcacucucacagacaccuacauagaauaaaaagaguuuuauauuuuuuaaugauguguguaugugguggggaugauaugugcacaugagugcagaguccaaaggacagaagagaucugcuaucucuagaguuaaaagccacugaggguaaaugcuggaaacugaaguuggauccucugcaagagccauuucucuagcccuaauuccaugcuuuaaaaaaaaaaauuagaauuccuucucaagacaaaccuaucucuaaaggaaauacugauaauguuuuuaaaugcuuggaccuggaugaacaacuuaauccuaagcauuaaugauauuuguaaaauaauuucuuuuuaaaaauuuguccucugagaccuuuagcacuacagccauucuuuauucugcugcauguuauuaaagucugagaugucuguggaaaguaaauuggugucuguuuugaaaguaggaguucaagccgggugugguggcguacaccuuuaaucccagcacuuggcaggcagaggcagucagauuucugaguucgaggccagccuggucuacagagugaguuccaggacagccagggcuacacagagaaacccugucucaaacaaacaaaaaaacaaacaaaaagaagaaaguuggaguuggaaaaaauauaggcuguacuuuuuuaagagugugucagaaauaaaugaauucauuaucuuucuagaaagaaugccuuuguuuuuauaauauuuguaaaaaguuaucuuacauuaaaucaaacuuacaggauugacucuugaauucuagacuaacuuugaauaauuggaccugcagauugacuauccaccauuugaaaaaaauuuuuacaaugaacaugaggagauaaccaaccucacuccacagcaguugauagaccugcgacauaagcucaaccuucggguaagaaccauuacgcaagaauccuuacaucaguguuuguacaaguuuagaauuaccgcucauccagauaguaagccuagauuuauuuacuagggagaauaauaauuacagcccuaggguuugugugucuuggauuugauugauuuagcccuaaagaugcuauuucagaaagauuauuuugguuuuaacuuuucaucuuuuaaaaauacugugugugcacauauguguguggauauugggggguugcuuucagaugucaccuugcagaaguugguucuccuuccagcaugugauuccugggaauagaccucauugucaggcuugaugacaagugccuucaccugcugagucuucucaucagcccuauaucuuguuuugcacauucagucaacuuuguacugaguuagguggacuaagaauaaaaaaauaggaaacacaucuucagaggcaggaaguagaauuaauaauagaugugaacaaaccaugagcuguuggaauauuuugaaauuauauuuucuucaaguuuuauaugauguguuuuuuuaaaauaguaaaugagaaggcuggagaguuggcuuggugcuugcugcuuagucaugagaacugagguucagcuauuugcacauaagcgaggcaucccacagguagcuguacucaggcucagagggcuuagaccugcucugaacggggacacacacacacacaaagucuacuuuaaaaauauucaaauaaaucacugacuuuuaaaaacauucacgcacuaauuuuacaauaacacuuuaaauugccaccaacaaauugaguugcccauuugccauguuacuuaaaauguuuuuaauauguuaaggucaaauagcagagaggauauguugguuugcucuagugugaaugacugguuuauuucugcuuuauuaguugcuauauaauauuuaaaaucuugaauuuucaaagauaucauaguauguauguguguauauguaugcacaaauacauguuuacacucccgaugaaguuucuaagaaguuaauaguaccuucuuccccaaagaaaggucuucaauuauauauauuuuuauuauauauuauauauuuuauacacacacacacacacacacacacacauauauauauaaauaaaauccggacuggagagauggcucagugguuaagagcuccgacugcucuuccaaaggucccaaguucaaaucccagcaaccacaugguggcugacaaccauccguaaugagaucuggcgcccucuucuggagagucugaggacagcuacaguguacuuacauauaauaaauaaaucuuuaaaaauaaauaaauaaauaaaauccucguuggaaauuacgaccacucuaaaagaagcaauaaaaaguuacuacuacuauauagacaaaacggaaaucaguaguucucuuucuuuacugggacccaguugaaacgaggaggcuugaugguggcuaggccaucacuaagagaaugguuaacucuugagaaaucaguagguugcaucuuuauaaacaguagcgauagauguguuuucauuuuauuugcaguuuuaauuuaccuuacacugaaucuuaauuuuucugucaucccaguuaauguuuauucaacuugguaaaaagaauguugaugacuuuuucaguuaguugaauaauuuguuuccauuucucauaagaaaauuaauuuugagguaguucuguguacuuaaucauuuaaaauugguggugggauuauucaggaauucuuaccaugguuuccuuugcaugaggccaucguguucaggguuugacccuuuuugguguuuuugcuuacacaccugcuuuucacucuuuauucuagcuaaagugcuuggucugagugugcacuguugaacuguaaaugcuguuuaagugaaaguaccggucuuccugggaauugucuuugucucuaggucucuggugcugcaccucccagaccaggaaguagcuuugcucauuuuggguuugaugaacaacuuaugcaccagauuaggaaaucugaguacacacagccgaccccaauacagugucaggugcguacagcaugguggguggggauggaaagcucuggaacuucuaaagaugggagcgaaaggagaccuuuggaaaagguuuuuuguaccugcugaauccauugaaaauguguugugaaggagauacuuucuuuucuaaaccucacagaaaagauuuguccauggauauacuuugugcuuucaaugacuagaaucccuuuguaaaugacaugaaaguuuuucauuuauugcugugacggauagcuucuguuugccauucaaauguggaauuuauguauuccuuuacaaaaacagaaagagaaauuccuacauauaaaugaaguggccuauuuauuuuccaggagagaacauuagaagcccuguacaaaauuuuuaauaacucccuuuauacaucaagucuuuauuuugauauaucaauacaaaugggagucaugauuuuuuuuuauaaaugaugccuucaugaagguaauauuuccuuuaaaucaggcucaugggaaugucaggauucagcuaauguucauggcccagaauauuuuuguuccauuggaaaugaaugucauuuguaguaauuuuccccaagacguuaguucaucuuuagaauugagugaauauaccuuuccuuucuucuucucuaggguguaccuguagcacuaagugggagagacaugauugguauugcuaaaacaggcagugggaaaacugcagccuuuauuuggcccauguugauucauauaauggaucagaaggaauuggaaccaggugauggaccaauugcaguuauuguguguccuacuagggagcuuugucaacagguaugugcuuuguauaaaaggccccuuucuacuuuuggacuagcaagggacagugagcagaaugaucugugaaguuuaguuauuguugcuuggcacacgcauacaugugguucuauaagagaagucggaggcugacuuuggagugucuuccaggauuuaucuucccauuuggugagcuaguacugcuacuuuggcuugagcgggcuguuccacauauucucucuccaccuccuggguacuccuggggucauuggcagggcaccagucccacuagcuuuuauguggacucuagaagucugaaugucauuucuuacacuugcguggcaaguguuuaacccacugaaccaucuccccaaccuccuccaacucuuguuuuaaauaugauaaaacuacauauaaaauuggccaucuuaacuaacccauuuuaaguaucuaguucaguggcugacauuaagcauauucacauuauuaucuucccugugaaguuuugagaaaugugaacauauuuccguaauaaggguagcuuuuuuuuuuuuuuaaagucacaaagggguguggguauuaugggaauuguuuauauuauaagcucacaauguuuucuguauagugaauuuaauuuucuugguaaauagacuggaucaagaagaugaaugaugcaaaugaagaccauagccuuguuuuaugauuaagcuggauguaguaggagauuuauuuaaucccagcacuugggaggcugaggcaggagaauuuucugacuuugaggccagccuggucuacauagcaagcuccaggccagacaguaauauauagagagauucggccucaaaacaaaaaaacagaaaugaaaagaaacaaaagaauuucgauuuuaagcauguucuagguuuuuccuuuuucauuuuuaaaugguuguucuuguuuugguggcuguuuguguguguguguguguuuucaguaauaggaauugaacacagccuuugagcuauaugcccagcccucuucuguuuguaucuuccuaguuuuuguuuuugagauugugucuuaaguuacccagguuagacucaaacuugcuaucuuucugcuuuuaucaccuaguuaaacuauaagccugugccacuaaguacagcuacauuuugauuuucuauagugguauauacuguguucuaaggacuguguuuugaguaguuuuuaaaauauuaacaacuuuuuagauccacgcagaguguaagcgguuugggaaagcguauaaucuucgaucaguggccguguauggaggagggagcaugugggagcaggccaaggcccuucaggaaggggcagagauuguuguauguaccccaguaaguauaucuuguucucaaucucucuugauucagaaaacaugauugcuuuugagggaauucccucuaaauaugggaaagcuaggcugggauuauccugugaguaaccaaccuuuugucuugguuucauuaugaucaguugacuaaacagcagucuaguuauauccaugaccaauguaucagcagcuacaaguuccuauuuuaaacagguuuucuuaggcucucuuaaaaacugggucuggccggguggugguggcucgcgccuuuaaucccagcacuugggaggcagaggcaggcggauuucugaguucgaggccagccuggucuacagagugaguuccaggacaaccagggcuacacagaaaaacccugucucaaaaaaacaaaaaaccgaaacaacaacaacaacaaaagaaguuuuaucuagagacugccauauccagggauccaccccauaaucagcuuccaaacgcugacaccauugcauacacuagcaagauuuuaucgaaaagacccagauguagcugucucuugugagacuaugccggggccuaacaaacacagaaguggaugcucacagucagcuauuggauacaaggcucccaauggaggagcuagagaaaguacccaaggagcuaaagggaucugcaacccuauagguggaacaacauuaugaacuaaccaguacccuggagcucuugacucuagcugcauauguaucaaaagauggccuagucugccaucacuggaaagagaggcccauuggacacgcaaacuguauaugccccaguacagaggaacgccagggccaaaaaaaaaugggaaugaguggguagggaagugggggggaggguaugggggacuuuugggauagcauuggaaauguaauuaaggaaaauauguaauaaaaaaaaauuaaaaaaaaaaaaaagcugggucugugguuacaugaggaaccguagagauauucagauaaugguuagaccugccagaagauguaggguagacauaaaacucauccauaaguuuuuacaucuuuucagagcauauuacaagaugguucaggcccacuugcccauagaguuuaaacuguaauuaauguaaaggaagaacuugagucuucagaauucuauucucacuaaguauggugguacaugccuugaguccuagcaguuagagguagagacagucagaccucugugagcuucaggccaccugugaauagcacccugucucaaaagugcuuuucuauuuucugggauugguauagaaagacugucagaucaguuugguucaagaccagagaauacacuuuuccaggaauauaacuaaagaaugucuuugaaugccuuugauuauauuaacuauuuugugaaucucacagggucgacugauugaucaugugaagaaaaaagcuacuaaucuucaaagagucucuuaccuuguguuugaugaagccgaucgaauguuugacaugggauuugguaugccuugaauauuagcuucuucugucccuauucucaagucaguuuuugccauaucuuucuagaauuaaccaguacuguucaucacaaaagaaguuaaaaacucuuugggguuucaaauuaagggauagaugaaaucauaaaccaucauaguuuucugaagagaagugcacacgucuugaccggguugagaacuuggacaagggcuaggacagaagaaauguuuccuuuguucuucacucuuaaucacaggccuuugaagguuaaaguccauauucauggauagguaaauauuaaaucauccaagguccuuuucuuaaccaagcuuagcaaauuucuaaauaaccacuaucuacucaguucagcuauguugaugguuuuuugaaauuucauacugaauucuaucuaggaguuucaaagcuuuuuuuaauccgugagaguucucggguagauuuuacugaaguaacuuuucacaccugucuuaacuacauuacauuaguguguugauuacucuucuguuuuuuucagaguaucagguucgguccauagcaagucauguucguccugacagacaaaguauguaugaagcagcuuuauacuaaaacuauauucaaaaugaaccgggauuuuuauaaguacucacaguuauguaagcaaaaauugcuuuguauguccugaugaguacugcaaagaggagaguuaaugacauuuauuugagcuaaaaaagaccuuagacgacaucagaugugagguguguuuuguuguugucuguuguaucgaaccuauggugucauggauguuagacaaacacucuaccucucuuagcugcauaugaauuuccaguccucuuuuucacuuuguuuuuuagguagagucuugcugagcugacuaggcuguccuugaacucacuauagccuaggcagccauaaacuugaaguacuccuucaugcuuccuccuccaaauagcugggauuauggguucaugccaccaggcccagcacacugcucacuuuuuauuggugcuaaaauugaauuuaaauaauuuccugcaguguaaaucugcugauucaaaauuaaagucuuuuccugaaccauuauggcaacucauuucuugauugaaaaugaaguuuaaaaaaaaaaucacggccaggcaugguggcgcacgccuuuaaucccagcacucaggagcagaggcaggcggauuucugaguucgaggccagccuggucuacaaagugaguuccaggacagccagggcuacacagagaaacccugucucaaaaaaaaaaaaaaaaaaaaaaaucacuuuuauuuagugaaucaguuacauuacagaagcuuaaagagugaauucaguaagaagugauuuuuaacagaauuugcuuuaucuuuuagcucucuuauucagugcaacuuuucgaaagaagauugaaaaguuggccagagacaucuugauugacccuauucgaguggugcagggagacauuggagagguagguaauccugcuuaaggcaggguggguccugggauuuauuucucaugaggcuguggaauuuaauucuuaaguaaugauuguucuguuuuagauuuaauuuuuuuucuuuuuuuuuuaaugauuuguuuauuuuuauuuuauguauguugguguucugcuugcuuguaugugugugacaguauuggauccccuggaacuagagguaccgauaguuguggacugcuaugugaauacugggaauugaacccuugucuuuuggaagagcagccaguguucuuaacugcugagccaucuccacagcuccuggauuuguuuuaagauagacaaguuaagggaauagugaaaacacgaguggcacagaugauugauggaagaugagugauggguauaugggaauuaacaaguuucacuauguagcuuuggcugucuuggaacucacuuguagaccaguagaccagguuggccuugaacucagggauaucccuguuucugccuugugaaugcugggacuaaaggcaugugccgccacgccuggcuuuuuccacaaguuuuuaauguuuuaaaguuuuaaaagaacugggugguggcccacuucuugaauuccagcauacaacugagugaaaagaagucaaggcaggaaacuggauccagcaaaggccaugaaggaacacuugcuuaugucaugcuucccauggcuugcucagccuacuuucuuauacaacucagaaccacccacccagaggugguaccaccccagagggcuggccucucccaucucaauuagcaaccagaaaauaccccacaaauugccuacaggcauucugucaguugagguuccuccucugagauaacucuagcuuguaucaauuugacaaaaacucaacuaggacaauaggguuuuugacacauaauuauaaauauuuaugggauauuguguggcauuucaauacauguauguaauguguaauuagcauaucuaacaccucaaauaguaaauccuuucuuugaguuggaaacagaucuuuauuaaaauauguauuuauuagccaaccauauguauaauuucucauaguuguuuuuaaaguuucugagugguaagcaccuuuguaugucggguucuuauuuuuaauguacuuacauauaaauucugcuugacagggagugggcaagaccccgaaaaguacucccgagggaauaauaaaaauagguuuauaacaaucauuguagauuauuuuggcauacaaauuagaaaugaacauaccgggggaauuggugugcaaggugcuuuaaaggaauaauaaguuuuaagcuauauuugacauacuaaaggaaaccccaacgauaacagggauugugcagagcuauucccaugcagguagaaaauaaaauaccuagucuccgaaguuuccugugacgugagucacaacugguuauuuauuuccucucaggcgaaugaagaugugacacagauuguggagauucuccauuccggacccaguaaauggaacuggcugacucggcgucugguggaguuuacuuccucggggagugugcucuuguuuguuacuaagaaagccaaugcugaagagcuagccaguaaccugaagcaggagggucauaaucuuggucugcuccauggggacauggaucagagcgaaagaaacaagguuauuucagauuuuaagaaaaaggacauccccguccugguggccacugauguugcagguaagaguaugaauuucaucauaaccccagccuuuauuuuauggguguugccuugcucuguaaugagaccuguagagcgcaguggcucuguggccaccuucauuuacuauucuuggucaucagaguacccuugcagccagaggaugucuugaggggaacaguuaugcccucauguccacugcaguguguaucuuaaauuaguaauauaagcuuuggcuuuacucuguuaaguuuaucggcuacccuuaaaagcuaguguuuuggaccuccaagaugguucacuggguacuugccaaccagcccugacagccugagcuugguacucaggacucaaaguggagggaaaaaaacccgaccccccccccccaaguuguuuucuauccucuauacacaaguugugauauauauguaugcauacacccacacccacauccacacacacacacacacacacacacacacacagagguucuggguacugaacucagguccuuaugcaaacaugauacuacuaacugaauuacaguccuuaaacgguuaacuuguaugggguuggggaggggguuguuuguuugggggguuuuguuuuguugucuuuucaagauaagguuucucuguguagcccuggcuguccuuauguagaccaggcuguccucaaacucagagauccaccugccucugccuccuggguacuaggacugaagguguguaccaccacaccuggcuucuguuuuuauuuuugagaugaguucuuauauacguauagcccaagugaccuugaacuccaguccuucugccuaccucuuucaaguauuggaauugcaggugugauuccaguaaaauuauccacaguauuuuuuuauauuuauguuacucgcaaaagagugaacuacuuucuauucuuggcuucauauccaugagcuugccuagguauggggaaugcacauuauuagaaaucuagcauuucuaguuacuucgauuuuuuuucuucuucuucuucuuaacuguagauaaaaaguaaaagaaacucaauacuuuguauuucagcccguggucuggauauuccuuccauuaagacagucauuaacuaugauguagcacgggacauugauacgcacacucacaggauuggccggacaggaagagcuggugagaaggguguagccuauaccuuauugacuccaaaggacagcaauuuugcuggugaccuuguacggaaccuggaaggagccaaccaacauguuucuaaggagcucuuagaucuugcaaugcagguaaggguuaggcaaucaaaguuaauaaaaacaauucaacugaguaaggaauucaacaggcaagggagggaguaacauaggagccugaaagaaaaugggcagaaagggcugguuacuauguagacuggcaccaugggaugucacaauucauguguauguucuuucuaugcuuucuguugaaaaacugcuccuuucuuugggcuaaagucuguuucuuuaguuucuacuugccccauagcacacuuuuaugaguaaguuuaauaucagaagaugcccacuguucuugcccauuccucuuccccaagucuucucuuuuugagggcuaaaaaguauuuguuuacuaaggaaacaauugugugauuauuuguuuuuguuuuugcuacuaggcauuaaauccaggguuuuuuguacaugcuaggcaagugcucuacuauugaacugcacccccugccucucugacaugggcuuuaaguauuucuuacauuuuaacauuucacaucugaccauacugauugcccacuuccagauaugcucuauuccaaaacuaaguaagauacugugccaaauuauaccuugaaucacuuauucugugcaguucucaaauaacaaguugauucaggacaguuuguuuuuuauugcaagcuagugauuaaacucagggucuguggguacuaggcacacauuccucaagacaaguucugauaguaggaaguauuuguuugacucaagccagucuauuuggcuguuuuagccguauguuguacagcugggcuguugggaauacucuuguuugucacgcuaguggugaagaacugcagugcagaagaaaggagagugaucuuuuuuacccuuuccuugauauagagcaaaacuaaaauuugaaggguauaguuugcacaguguuuuugugcaccuuuuuuguguuuugggcuuucugugcucgguaccuuuccaagccugccauacuuuagucuguaagucuuggaugaagcuuuaacuccgagaugugugcauucugcuuguuugcucuucugaggcagggcuucacuauguggcccugguugucuuagaacucacuauguagaucaggcuggcuuugaacugacagacauccaccugucuuugcuuucccagugcuagaguuaaaggugugugccaccaugccugucuaaaaucaguucuuaauaagccuuauuuuaucuagcuuuccccuucauuucucaauaugccuguucuuuauaaagcuuugcuccuaacuguguaaguuuguguccaguaggaggauugagucauaguucccaaccuaugggccgcaauccuuuugggggucaaaugaccuuucacaggaguuaccuaggaccaucaaaaaagacagauguuuauauuaugauucaauacaauagcaaaacuacaguuauaaaguaagaacgaaauaaugugguugggguggccccaacauaaugacuguaugaaagcucaagcacuaagaagguugagaaguccugggauguaagguaaagcccgggccugaggagauggcuccgugguugaaaacacuuacugcuccugcggaggacccugcuucaguucccagcacccacguuagguggcuuacacuguaacucccaucccaggagauuucaguguccucugcaaacacaagguguguaagguguguaccaugcacuuggugaacuuaaacuuacacagacagauacacacucacuaauaaaaauaaaucauuuuuacaaacucuaaaguuagacgugaccaauguaaaauaguuauuuuacaguuuauguuuauuaaucacuguacuuccacaaaggaguaacaagggacaccuuagguaagcaccgaagcacacugauaaauuuguuaugucaagcuaucaaaaagagggcauauuggaguuaggaauguggcuuguuguuacagugcuucccuggugugcuugaaacccucaauucaaucccuguugccauguaaacuguacaauggugguaaauacuucuaaucccaguccuuaggaagugguaguggaagguacagaaauugagucaucuguguccucaaaaggccaagauaggaccuuuacuacgaauggucccucucaucagaaaagcaucagcuaaagaugaacaaagaagcuccuccuuccuaccuaaguguguacccugucugcuucucuucuuggguuuaaccuugaauuguguucuuugcagaaugccugguuucggaaaucucgcuucaaaggagggaaaggcaaaaagcugaacauugguggaggaggcuugggcuauagagagcggccugggcugggcucugagaauucggugaguccauccuacagcaguacucuagggaucggccuaugucuuaaauuauggugauuugcuguaccugagccucaugagccccacguccuguccuucaggggauuuguauguacugugcugauacgagucagugugguguuguuucacaaugaaacugcuaugggagaagcaugugugugcuuggcugacuaggcuugcucaggaagucuagcuuuaauggaucucaaauugcaauauucuacugacaggggacccagcugauuauauauguauauaauuuugccccaaaugauugguuugguauggugugggguuuuuuguuauuguuguuuuggcucuuuugguugguugguugguuugguuuuagagacaggcuuuuugccauccuagaacuugcuuguagaccaggcuggcuguccuuagagaucuauccaccuccaccucugcugccaccuccuaggugcugggauugaaggagugugccaccacggcccgccuugcaguagccugucuuuaaaagccucucuguacuggcuuagaaucuguugcuugggaaacacuaagagggucacuuagcuagaacuauacucagaaauagucucuacccugaacauuuugguuagaaggauuugagaagauaagauagauggucucgcaucacauaaagcauucacucacuggcuugccuguuuguugucauagcgauucuuaaagcuaggaacaaagcugucaguauacuuggauggcgcauuaguguuaauuuggcaucacuggauaaacaguauuccauaccauauuaugguaauguugauuguggaaauauuagugguucauggggauuauuaagcacuuuaaauaagccgaggccauuccaaauauuuccauuuuuagccaauauaaaugagugcagcuaaugaaaguuaaaaguuauacacuagcaaaaguugaauuagagauucaucucuuuaaauggugucacuucagauccugugaagcuacauugugcuauuauuggccuuuucaucuuuaacauuuuuacuuaauagaauguugauauaauaugcacucgugucaugauagaguauauaaucauguacuacacagucacaaaacaauugcauucugaucauuggaguugguucccagaaacaaaugugcuagauugagggacuuaaguguuuuuaauaccucuuuauuauugcaccuuuucucacaaaggaaguaacuucuaacaauaccuggugccugcugcagccuguacccaggguuucagugugaucggacugucugcugcaauugcuuuucuaauaaguaugcuugcuuuuuuuuuuuuaggaccgaggaaauaauaacaauguaaugagcaauuaugaagccuacaagcccuccacaggagccaugggagauaggcucacagcaaugaaagcagcuuuucaggucugaaacaaauauuccauuuuaaaagcuuucaagauggggcuagagaguaguuaagagaacuuguauucuugcagaggauccagguuuguuuucuuagcacucacauagcaguuuauagccaucuuugauucaguuccugggaaucuggcacccucuuguggccugcacagguaccaggcaugcaugugccauacaugcauacauauacacaggcaaaaaacacuauuucauuuauaauuaaaauaaaucuuuuuuuucaauuuuuuuuauuagauauuuucuuuauuuacauuucaaaugcuaucccgaaaguucccuauacccucccuaaaauaaaccuuaaaaaaaaacaacaacaacaacaacuuuagaacaguaucucuuggaagagugaggaaaccuuccugagaaagcagcugagucuguaagcuucaugcuagauuuagagccuuauguucacuugauuuucacauacaggcauuaacaguauccugcuugaauacacaaguggaguuucuguacacuuuaucauuaacgauuauuuguaacauuauuuguauauugaaguuuguuauacuuauuccuggugucuuuuuuuuuuuuucuuucagucccaguacaagagucacuuuguugcagccaguuuaaguaaucagaaggccggaaccucuucugcaggggcaaguggauggacuagugcaggaagcuuaaauucuguuccaacuaauucagcacagcagggccauaauaguccugacaaccccaugaccaguucuaccaagaacaucccaggcuucaacaacucugggaauaucaguagugccccagugaccuacccuucuauuggagcccaaggagucaacaacacagcuucagggaauaacagccgugaagggauuggggguggcaaugggaagagagagagauauacugagaaccggggugguagccgucauagccauggagaugguggcaaucggcauggagauggugggcgccauggagauggauaccguuauccagaaagugguagccgucauacugauggccaccgacauggagagaccaggcauggaggaagugccggcagacacggagagagccggggugcaaaugauggcaggaauggagaaagcaggaaagaagguuuuaaucgugaaaacaagauggaccccaagguggauagcagcaggauggacaaaguggacagcaagacagauaagacaccugauggcuuugcuguuccagagccacccaaaagaaagaaaagccgaugggauaguuagaggguaugugaaaaucagcgucgucagucgucuuuaauuuuauuuuuagaaagauuuugguaaugaggcgucucagggcuggguugggguccaagauauacagacccccugcccuugguggagaacuggagaguggauuguaccuucaucugguguucauucagagguuuccuugggaaccugagcuggcccuggaaagcagagagcugggaagcuuuuguuuguugugggugaguuuuaaggaggguaaguagaauacuuagggagaaagggccuuuuagggcacaaaaacucacucuagguuuauaauagcuuauauuuuuuacuaaaaugucaccuuauaaacaucuauaaauuggacuuuuuuucuuagcuguggccaggcagucccaacuucugcccuguuagggaugcuuggggagcaguggugcuuucagauguuugcagggaagaugccugagcgcucagguuccccagacuguuuccagcccugagacacguaggaaagacagccuuccagacacaggcuuugaaauccuaagccauuaggacugaaggaaugaucaucuuggaaggauuccaggauaauccaggccuggaguacugcuaaauuuaccauuuaaaaccaaccccaacaguagcauucaaagugucuauuuguuuuguuuuguuuuuuuaaacuugcccuaauaguagaaaaaagucuucugcugaaaugauuuugauuuuuguucuaucuuguuuauaaaagaaaaauauacaaacuuugaauuuugugauuuuugugaagguuucuuuaagaugugcauucccucucugcuugcucgauaguaaaugucuuacuacugggaccugagggcugucguuucuaccauacaaguuaguugcuacauauuaaauuauggcuuggaacaguacagcccaugaugugaaauguggggaagugcuugcuuauuaaacuaucagaaaaguuaucucuuuuaucuuuuuauucaaauacuggaaaagggugggagaggacuccgaaggaaccacaggcuacaacaaaggccagcaauacugagucccccugaaggcuucauaaaagauuugauccaucacaagccaagauguggguugucaguguaacacgaugaagaaauguuuccucagugcuuucaugguacuccucuguagcagcucucccaaucccacaaagccuccagagagaacuguacaccucccucucuguccuucagucuuuccagacaauucugcucacuugcgcuuguguuuuuucuucuguuccuuccguuguugugcucucugauccuucuucauccgagaguccacuaccuugaaaugaccuuugacuccagcuggccuccggaccuuacggccuacacccuuuuuggcuacaacauaagugaccuggcguuucuccuugccaaguccagcuuucuuguagagacua

SEQ ID NO: 6453 - RNA, 6949 nt, Mus musculus
guuaucucuuuuaucuuuuuauucaaauacuggaaaagggugggagaggacuccgaaggaaccacaggcuacaacaaaggccagcaauacugagucccccugaaggcuucauaaaagauuugauccaucacaagccaagauguggguugucaguguaacacgaugaagaaauguuuccucagugcuuucaugguacuccucuguagcagcucucccaaucccacaaagccuccagagagaacuguacaccucccucucuguccuucagucuuuccagacaauucugcucacuugcgcuuguguuuuuucuucuguuccuuccguuguugugcucucugauccuucuucauccgagaguccacuaccuugaaaugaccuuugacuccagcuggccuccggaccuuacggccuacacccuuuuuggcuacaacauaagugaccuggcguuucuccuugccaaguccagcuuucuuguagagacuauaaaagaaagaaacagguuaaaaggucugcucucuagaacucuauuuaacccaguguccuugugacuauucuuugccaaaucaccuucgcagcugugccaccuuuucccguucugagauguccacuguauucaccacagcuucugccuucuuuuuggucuguuccagcuucuucagcaccugggaggaagcaucaguuagucucucauaccuuucuccacaacuccugaccucaggccaccucagccacuuacccuccguuucuuucuggccuuggccucagcuacuuucuugaugggccgugcauugauuucccgccagcguuuucgguaauguuccaccuccuucuuaucaacaggcagcuggcguauccgaugcugcuuuucuuccugugcaaaccacucaggaaguucucccuccucuucauuaaaagcauaccugcguagagaggaugccaggccaauaaucaccgguugaaaacaccugaagaaaacuuggccuuuguccauugcaccugacagugugcugccccuuaccgguugaacgaguuaucuaugaggucucucuuugccuuuuuugaagaggcaauaacagcaccuagagcaaggccuucaggguccagaauucgguauuucacuagagagguaaagacaaaaaaaaagucaaagcccgauccucaccgcugaagcuuggacugguuucucucuccacucuguacaaaccucuuaccuggguccugaauaggcaccaccucaaacccauccucaucugccuuagagccacggccucgcuucacaccacgggacacuuuccagcuggaggagauagacugugcuuauuccacccuugcaaggugauacuccaccuugcuucaacuuuucucccauuuaaaacugccuaaugcaauuaaucacacagaaacccaucagcuguauccacuuaccuaucuucauccucacuacugcugcugucacuaucugagcuguugccucuuuccuccccuccagggucagugacagccucuguccccaagauggcuucugucuccuuagggaccucauucuggcccuggggagauuucuucucagucuucaaguuaguaggugguggagguggaucuguuggcugcugcuccuucugacggcucuuguacagcagcugugccugacugaucuccagggcuucgucagcaucauccucuaucccacugaagccguccuagaacaggaaaagcucagcaucccuucucuagggagugccacuucccaccagucucccuagcucuaccuuggagaaccacaggcuagcuugcucuuccugcaguacugccuuuucuuccagugguaccagcaauggauuuucuccuucuuccucuuuauugucaucuacuugaguaaaccgcaagcuguagacccaaaggaaagaggucagauucaagagacccaaccaaccucauaggccuuucuuuguccgugcccacacuaguuaauucugucucagagggcagcacuuccucucaaacagagagcccuuacuacuucugcuccuucagauccgaguguguccugacuccugccagcucuucuggauccaggucacuuuccagagaaguaucaucaucguccucagcaucugacacauagaugucaucccuuggcagaucagacagaaaggugucugcagcguucaugucuccuuguguuacuuccucuaauaacugaaauagauucaagaacuuaggcagcaucuucccaagcccauuaacuuagcucagcaacaucaauaagaaagaacacuggcaaauaauagucccuacacagcagccgugaccuaggaaguaaucaaccugucuaaaauguacagggcgcugaucuacauacugacuaguuuacaaaaaacccucaaaagccacuugacauacagaauucacauuuguguaauuugaucccaaauaaaggagcacucaacaggcaucaaacugcaucuguugauuuugacuacuauuagaaccccaaaaccucuacuccugguggacagagcugcucugugaguaucacaccauucuggggguaauacucaaccauuuuuuuaaaccucuccauaugguaugguguauucuuauuuaacaaguggggaaaacagacuuaaguuacacaauaaaaggggaguuggcacuaaaccguuccugcucuauugccucuccugugucauaaaggugaccaggccauugcaccacaaaagcucauuuugcugugagauugcuuugaaaggcuuauucuucagcagcccaaaucacagugcucauuaaacccagugagucaauugugcccccuugguaacacaggcauuacaacuucaucuccugucaugugaacucuuggucuuaacucuaguuuauagagcuuccugaugucaucauauuagagguguuucauuugagcauucuggagucucggguacuccuuuucuccucuaguauuuauagguaaacacaacaaccaaaccccacgaucacucaauauauuuaacucgaugcuucccccgaccucugagcccucaaaccgauggcccagcucucccuuaccugcuggccacggaugguucgcagggagaacaugccugucucccccucaucugcaauagaaaccccaggcagauccaucuucagcucgacacgcucccgcugcuuccucugcucacgaagcaacuucuucuucuuccugaucagauguugagggauuuaaccugcuugucuccaaaacuugaguguccuuuacccuuuucauauacuccuccucagaccccucaccucuugaguucugccacuucuugggcuuucaucucugccagaguccgauuaagcuguucuuccucucucucuucuucuuccucuggcgccugcuuugucucagcuacugccucuucuucaucaccuucuucuucuucuucugagcugaggcuggcaaaccagucgaaagguguguuuauuuucccagacacuugaucccacacccaacccucccuaacccuggcuaccuccuccuuaccugauguccaaugccuuugcuugcucuuucagcuucuuagccacauaucgccgaagcuuuguucuccaauucagaagagaccugcccaagaaauacuauuacugacuaaucuacccccaucuuugucccugucucuuccuuaaaagcccacacuccagauuucaggguuuagccauaaacaacaaaauccugguccccagaguccaacaucauguugcccuuacaccuguguaccuaaguuccuuucgccccagcacuuugauguccugacagcauacucuaaugucuucaguuguagcuggaugcugugccaacucuucaucaucuauugagaucuguuugugagggaagggaaugggauguuguucuggccauguuuucaggccucccggagacucucacucugggaacucacuucgcuggccuuggagaggaagucaacaggauuggcagcucgcaagaaguccguaacugagguucggugauaaagaguaaggucaccuucggcauagccuucagccuuaggaagagaaauaaagauaauuacuagacagucgcuucuuagauaaucaaguucucccaguuucagaauccauuucuuacaacaguaacaacaaaaccaccuuuggcuucuucuuugucaccaacucaguaacaguuuuagccugaacuucaaccuccuuaaaggcaaacuugggaucaaagaauuuagcaucaaccuuguccggagccaggaauccuaaaaggagaagauagauuaaauaaaaguuugcuuucauaauuagguugugucaagaggaaggaauaacgucucaccuugacagacuacaaagauuucugcagauucauggcgagaggcuuggggcuucguggccuggacacgguggaacagcugcuggaagauccacagcaagggcugauagucucgggaacgaaagacuuuugugaugaaacaaccaccacgggccaaaaaaucacaagccaaacgcagagccaucagaguuaggugagcuguaggacggaaacagucagggaaccucugcagccuuucgaugugcuaccuccacccucaccuccaagcccacauucccuguaccuugggaguaagcgucauggacccaacuagcccccacauugggagccccaucauugagcacaacaucaacuuuccaggucuucagcuccuuccucagggccuaaugaaaguaaagggguucuagcaauggaaacacaguaacugcuaagaacagaacucugguucagucaucugucuagucaugcacugagcgcccaccagugccaacauccugcaccagguacuagggaugcaacagcaacaaaaaauauacaucuuccccaagcuuagaauuaguucccuggaaagaauuuuucugaagauagaucucucauccuuccaccaauucacaguacuaucccugccaggcacgguggcacucgacugcaaucccagaggcagagggagagagacugcaagaucaaggccaaacuaggcuauguacucagcuccacaucagugugggcuacacaguuagaagcuauccuaaaguacacagcaagacucuaucucagggaaaaacaaaaacacuugauuguaaauaaagauggaaauguacacaaggauugucagucuuuuuggccacgugcuugaaaccaugguaaauugggaaguguuucauucacucuucagaggcaaugacagccaggcacuaguggcacaccccuuuaaucccagcacuugggaggcagaggcaggcagauuucugaguucaaggccagccuggucuacagagugaguuccaggacagccagggcuacacagagaaacccugucucgaaagaccacacacacuaaauaaauaaauaaguaggcaaugacaccagcacauaaagaggaaagaaaagaaggagaggucuuauuaccugccuacagcguucuguugugauauccuccuggagagucaccacauuggggagaggcuugauuggaacgagguccacuccuaaaagauguuaacucaguauuacaggguggaggaagauguaggacaaaauuaguaccuaacccaccccucccccucaaauacccaagagucacccaccuacaauaagacuggauacaggcauaaacuuggcagccaccugcagccugugaaagagacagauuuaaauaccuuucauccucccuuggcaaggugacuucucauccccuuaagaggcaccuguuaaguguaguggccaaaugucuaugcauacauucaagaagcaaccugcugggcauggcaacacagggcugcauuaccagccacuaaggagggcaagagauuaagaccaaaaguucaaggccauccuuggcaauuuuucagcgucccugucucaaaauaaagcaauuggagauauaacucggugguggaggggcugccuagcaugaguuaaguccuuagcaugaguuaaguccuuagguucaguaccacaagagggggaaaaugacgcucccuuccaaaauuugagagagacacauacuauggaauauuuaaucugaauuguguaaucggauucccauccuccccgaaaagcaacucaaagccaaccagugccaggaacgugucaucauagcagccccugccaaacguuaccauccgccaggcgcagcacacagguccaacaaggcccgggcuuucugcaggaacugaaagcggcgauugagcuggaucaguuugaaggcagagcgcgaacgauaaccuggaucguggagaguggguguauaaggcaauaccgucuacggaggccuuucccaggaggaaagccucacaaucccauaacccccucgaaggaaaaggaacucgggacuagaagaagcgaaaagacggggauguuguuccucagcgcgaacccacucaccagucuccuuggccaagugauagaacuugucccgccggcucuugccuacuuugccuuucuugcccauggcgggaugggggaguaucacucacucuggggagaaagaaaaaggugagaucgucuuuccgagcacuggaucucgcuucgguuccucaggcgguggagcaaucacuuacccagacguuagauagcccuuaacuccgcagguuuucaacucuuaggaagcagcacauguaggcaguaaucguacuuccgcuucugcgcgcguuuccuacauuccuggcgucaugauuuccgccauuuugaguguggccaaaauuuuuuugucagcaggccuuacaaguuaaaaguagaggcuaggaaguagagugcaauaacucguauccuaaacgcuaggaagcaucaaccagaaguucuauaucucuucacaaaacuagugaccuccaguagagccucuacuaauacagccacuguguuuguaucgccacacaccccgcccau

SEQ ID NO: 6454 - RNA, 7094 nt, Mus musculus
uccaaauaaaucuuuuuguuuauugguggugcccagaccuggucauugaacagugcaaccgcguauuaacaaacuggaguuguaguguuuaucaucacacagaccuuuauugguuggggggggggagcacacaaaggacacagccucacuuccauagcuucuugauggacauguuuuucucacuauccuuuugcaugaccuggagagggagagagaagagagugcauauacacgggugagcagggauuuaggaacugugaacacaagcgugaccccugcuccagagccaccacagcaaaggcagacaaguggaggcacauauaccuuagcuacugccaucucaaaguccuccugagugacguggacacgccguucccgcagggcguacaugccagcuucugugcacacacccuagguggacagagaagcucagacccugcugcuggagccccuuagcccugaguuggcucuuaaggcuuccugcuauugcccugcuccccugaagccuccaguuaccuucacuucagccccugaagcucccggcaucaacucagcaauuuuccucagguugaucccccuggucaaguucauuuuccgagaguggauuuucaaaauguccagccgggccuagggauaagagaagaaagcccuaagcccugcacugucuccauagccagagcuccuccaggcaccuccagcacagaccuccucguuggggggugggaauucaauuuuucugucaauccucccaggacgaagcagggcagaguccaggauaucaauccuauuaguagccaugauaaccugggaaaagaaggagugggaucagcuacacagcucguaggccugcauccgccucacaccuuucgcuggcuugucuaaggcuuauaccaucucaccuugauauucuugguggccucaaagccauccagcugauugagcaguuccagcaucgugcgcuguaccucacugucgccuccagagccccccuccagccgugaggagccaauagagucaaucucguccaugaagaugauggauggagcauguucucgggccaugacaaacagcucccucaccauucuugccccuaugcaaaggccaacccggcauuagagcuaugugcaccccaccaucuacccuuccacucacuccucacagucuuagccaguuaccuuccccgaugaauuucuguaccaguucagagccagagacacgaauaaagguacagucuguaugaugagccacagcgcgggccaacaaugucuucccagugccuggggguccguagagcaggacucccuagagggagaguauacauuacacucaggggaaaagggcaacucucuuacggaacaugcccacgugagggcuuuguguuggauccuugcuugaggugagggagaugccucuccuggacuguguauucaaacuagcuuacugcucuggaaaccuuguugcuggcuguggucagugugaggcuaaagcugacgguaccuuuggcugugcgaugcccagugcuucaaagagcucggggugcuucacgggcagcucgaucacuucuuuaaucuccuugaucugcuuguccaggccgccaaucaucucguagguugagucuggcaccuucuccaccaucauuagugacaccaaaggguccaccuuguuagguaagaucuuaugcagaguguagcugucauuucuuagagcgacccgacaauugggcgucacaucguugauaucaauguucuuguccacaucaacaacaaauuugcccucaggauggaccugagaaaauaauaaugggcuaugaucucccucgguggucagcauagccaccccaaccaggauucccgcagggaagcuugggggcagugugacagggagggagcacuaggagccuggccgcggcggcaugcugcuuuuaccuugaccaauacuuuuuucuuauccauggcccucacgacuucuccaacguaggagcccuguuccugcaacagcugcagcuccucccgcaacaggcgaacuaaaaacaacaaccacccccaaaccauuaaagaaacaucagccaccgaaggaccauuuuuuuaacacuuggaagggaugaaagaacuuaagacuugaaaagggcuuccagcagggcuuugaagagaugugcacgggaaacagccacagacaacagugagacuacacugucgacugagaggagacugagcgcugcacaaagauggggacaccuaaacccugccucaaaccaacauugacuuuucuaucuucuccccucucaccuuuugcauucagcucauuccucugugccugcagucuacggagauucuggcucuuaucauuuacaaucaacuguggagacaagagacaaccccauuacucaaggucaaagccuguaggaaacuggaucuuggcugagacucucuuucuccaacuccccaccuccccccacccccagacaggguuucccuguguagcccuggcuguccuggaacucacucuucggccucuaucucccaauugcugggauuaaaggcgugcaccccacugcucggcuuggcugagacuuuuuuuuuuaaauuaacuguuuuaugguuuaagaggguuagauuucaugauagcaaaacaaaggcauagggguagaaacagcugaccaguaacaucuuuuuuuuuuuuuuaacuuuuuccaauuuuuuauuagguauuuccuucauuuacauuucaaaugcuauccuguaaguccccuaugcccucccccuacccuguuccccuacccacccacuuccacuucuuggcccugguguuccccuguacugaggcauauaacguuugcaagaccaaggggccucucuucccaaugauggccgacuaggccaucuucugcuacauauaaaaauauggaaugcuucacgaauuugugugucauccuugugcaggggucaugcuaaucuucucugcaucauuccaauuuuuaguguaugugcugccgaagcgagcacuuggcugagacuuuuuuuuuuuuuuuuugguuuuucaagacaggguuucucuguguagcccuggauguccuggaacucacuuuguagaccaggcuggccuugaacucagaaauccgccugccucugccucccaaguguugggauuaaaggcgugcgccaccacccccggcugcugagacucuuaaaggcagguuuaaguugcuucuuuagcuucuccagcaguaucugaagacccuguccucucuaagauuucuuaacaagagagacuggagagauggcucagugguuaagagcacugacugcucuuccagagguccugaguucaauucccagcaaccacaugguggcucacaaccaucuguaaugggaucugaugcccucuucuggugugucugaagacaacuacaguguacucauauaaauaaaauaaauuaauuaaaacaaaaaaaggauuuccuaaugagcccuaggcaaguaucacaaaaggcccaccacuacugguccaggaagaacaaaaucuaauggagagaaacuauuuugcucauaggaguagccucuggagagguaacaugguauggugggaagguccuggagugagaagccugaguucuggcccaauugcugugaguuaaagggaagucaguuccaagcugcaaaucuucugaaguauguauauagccuggagugacugcagaaaccagggaagugacacacaaaccaugguggguguguguguguguguguguguguguguguguggauguguaacagacggguguaagugauuuguagggaaagugagaacggggggaacuuuaauuagagagcaggaagaagagaaauacaggaggaaagagcaaggugagauaguaaggacguuugaaagucaucaaggcauuacuaucuacauaauauauaaugcauauaagcuguggauauacuuguaguuaaaugcaauuuucccaucuggauugauaaugcuccauucaggacugguuaauaaaaacccaccacgucugagaagccaccuaaaacacaggcaauuucuauugcucguggugcccccuccucccgaggagugaagcacgacuccauugcugaaggcaccguucaacuucacacacaggacccagagcacuugauuuggcugccuuuucccuaaggcgccacacaagcuucucgggggcaggaggggggggggggcgagcaaccaacaguucucuucagcuacgaugccuaugaaccgcgauuacugugguggcgcccaacaguucucaaauuggacuugcagccugcuuaacaggaggaaaaccacaccugguauuagaaacauagccaacuacccugggcuaguuaaguuauggaucuuggagaaccuacaaucaccacuuuaccugcaucauuccuaacugcagugcauuuacuauagacaaauguaguucuaaucccuucucaagaaacuucucuuggcagcaaacggagacaauuacagacaaccacaacugaucaaaauguagagaccgagacucagcagugccgggucccaacugacgcacguacaacgcaaccccuacaccuaaggcucggagcuccaagauuccaggagccagagagacaaaagucugcugggagacugucucuuagaaaugucagaggccacacucaugaaaucucaucaauauggcugcuuaaauuaaguccugagcauugaugacaccaacgggcuugcuugcuaacccggaggggagagguucauucauggcgccucaacccuagacaaagaauuaagggcuccugaggaaugcuaagaggacaacagacuucuccaaggaggaacccccauuugguuauccaauaccaagugagcauauacauacagguaacauuauauagacugaacagguuguauuuaaguauuuaggguggugguggugauaaggauuucaaaauauaaaauuaggaaaaaacaaaacaaaaaaaaaaaaacccaaaaauuaggaaaaacaguuagucuaauagguaggcaugaugacacaggcucguaauuccaacccuaaugaggcugaggcugggagcuggagagugucagaccagucugggcuauacaaugagauucuauuuuaacaaauccauuaaauaaacaaaaauaagacaaaggcaagacaacagaagacagacaacagcauccacucuccugcuucauuucagacccaggagggaugaaaucacauagagaagcauuaaaaagggauaaaaaccauacuggguguggaggcucaugcuuuuaucccagcaccugggaggcaggcgaauucugagacugaguccagccuggucuacauggggaguugugggucaguugcggguacauggugagacauuugucuaaagaagaaaaaguaaacuaaacggaagaacugcaaaugugccugagguucaggcauucucucugcggcuucccucccaaacccauucucgcucccacucccaccuuuggccagugguuccucuguaggugguuuuguuuuccagacagggcuguacguaauccagacuggcuucaaacucaaaacacugcuccugccucggcucuggaguggcaaccuuacagguguaauauuugacucuugggcccggagagguggauaaaugagccagccgcuccucuagagaaccuggguucgauucccagcacccacauggccgcucacaacuuucuauaacuccacuucuagggcauccuacacugucuucuggccuucacaggcaaauguagggcacagacauuggaugcaagcaaaacacccaaacacauaaaacgaaaaaccuggaaaagcaagcaagcaagcacacaaacaaaaaauccuaacuaaacacuauucccaucaaagagauuaucaaucuaccuuacacagcuugguaccuccugacuacaaaggagcuggagagauggcucagcagucaagaggguuucuuacugcuuuugcagagggccuggguuuaguucucagcaccuguaguagcucauaacuauuuguacguaacucaaguuucaggggauccacugcccucuucugacuugcacagacaucuguauauaugugauacacauaagcuuacgcaggcauauauacauauacacauaagaaacagacaagcaaagagcugcaaacgaacaacauuggaaaagaacucuuugcugcacucccaguggaaaaaggacacagagaaaucugcaccuaccagcucccguccuccacuagcucccuuugcugucuguacucaccuggaguucuucaaucuuggacagauaauauugacggaguccacugccugccuuccccucuuccaguuccaucugaagacaaguguaaguguuaaaaaaaaaaaagaagaaaagaaaagaaaagaaaaagaaaaggcauaaaguacuaaaggguaaagccaaaguauuuucgaggcacucuaccauauagcuuaagaaacaaggucaggaaaauaccauucccuuuuccucagaaacugguaucucgaugggcgaggucuguguguuugaacuucggaggcuuaguucuugguucuaagccuucauuucugaauccacuacaaggaugcaauuaccgccuaccuucgaggacuuuuaggagucucaaggggccauauacccaccgagcgcacugcccuguggcuagagcuacacauccccaggguuuaacuacuacagacaaaggcagaacagagggaccaaguccaggucgaagcccaggccauuccggcuugccagcuucauucaguuuccacccaccccuguccugcuuuccucagggcggcgcugacacagcagauccagucccaggcagaguccggucugacgugauccacccaccccugauccacuggacccucucgcucguggccaccccucacuucagauuuugugcacuccacacucagcuuggaugccgcccagccgccgcggcagaauccuuaccugcucuggcccaucaagcgccaucuucccucucucggcagggaucgccggcauccaagucacucuaucgcgcaggcgcggaggcgaaagcaugcgcccug

SEQ ID NO: 6455 - RNA, 9811 nt, Mus musculus
uaacuggacuccggcgaucaaaccuccggaggccgggagaggccugcgggcucgcggcacaucccggaucuggaguaucccuggcaggagcggagucagaggggccgcgggauccuaaagccgggcugcaaagaacuugcgaacuuggaguagaagaucccggaacccgguaguaaaaucgggaagucccggaucgcggaacguagcucgcggagcggacucaacacggagaccggaggccggaucgcugcaccgcgggacgggacagagugauguccggccguggcgcgggcggguucccgcugccuccgcugagccccggcggcggcgccguugccgcggcccuuggugcgccgccuccgccugcgggacccggaaugcugcccagcccggcgcucaggggcccggggccuucuggaggcauggggguaccgggggccgccgccuuccgccccaugggccccgcuggccccgcggcgcaguaccaggugaggagggcaggcgagcggcgccgcgagggcgcugugucggucucccuggggccucaggugaggacaggcggcccaggggacacugcaggaggaacugucgagggcugguggcgggcaggccagagucccuugguuaguggcucgggguuggaggcaguguuggggaaagggugaaagcccucugcgguggagggcuugagcaguuagaggagucccggggcuucuuggcuccgaguaacuuagagauggaggcuucgugagaucuagagaauugugggcaaucagguugaaaguguaagacaggucccggaguggaggugagggagugacccgggauguggugaggaaaauuuggaagagggucguuagugagaaaacaggguuacucuuucuuuggccucggucccacugcaucucugccuuggcuuucuuucuuucuuuuuuuuuuuuuuuuucuuccuaguugggaacuggcagagcguuaguaugucugagauggcucccagcugcucaaguugaggaggaaggaagccaggcuuccuacgaaaugggagacuaaagagauugggcccagauaacuccaggauagauuagaaauagcuguguccaggucugaagaaggcccgaucccauuaacagaccauucaagauauccucuguacggggcuuuccuucuugaugccaguguccaguaaaguuuggaggagcagggaggcuuuguggaguccugcuggucuugggcugcacaggguacugcccugacccuucugucuuggcagagagcugucucagguugcagcaucaaaggccauugacaagcagagacaggacccguggucagugcauugggaacucagccugauucugcauguggcgcuccucauuccccagagcucugguucaaguggcuccagaauguuugggaauuuuguuuugcuuuugcauuuuggugcugagcauggaauccaggcagggcuuugcacguggcagacgauugcuguaucagggagcugcaccuccuuuccuggggauugugcccauccuucucccacauccuugucacuuuuguuacuugcuuuuugauacagggucucauauaguccaggcuggcuguguagccaaagcccaccuugaacucuuuucucucaagugucuggcauuacagucacacacuaucacgcccaaccucucuuuccuuaucccucagguuccugacaaggccauaugucucucaaccuaugugccagagaggugagaggugugcacuguagcuugcucuguccccugcuggugucucuagguagaagucucagaaauagaucuucaugauguaugcauauuccacccaggaaucagauuucuuuuuuuuuuuuuaaagauucauuuauuuauuauauguaagcacacuguggcugucuucagacacaccagaagagggcaucggauuucguuacagaugguugugagccaccaugugguugcugggauuugaacucgggaccuuuggaagagcagucggcgcucuuaaucacugagccaucucuccagcccaggaaucagauacccaggagauaccuaacugggggucggaguggggauaagugacccccuucauuucaacuccuaucuaaaaagaaaaugacgaguuuggguauaaacagagauagacgugguuccaaggauacuagcgggguuuaucuuucccauguggcuuucuuuggagauucaugggccuaguauaucacugaugagucucugcgucagcccuuggcucugcuuguuuagagcuggucuggaagcuuccuacaggcacuggggaugucuguuugguugguugguuuuccaagucucucuauauaguccuggcuguccuguaacucacuauguagacccauuuccuuggaaagcagcugauagagaacaugccauugggaaagccccuguugaagacuggaagauggauuccugcauauuuuguagaguagccuugggucuaugcugaggccaggcuggccagccaaauggcugcggcugcuaguugugagaaaggagauagccuugaaucugggcaucccauaccaacuauguuuccucucccccuccuccuccuccuccucuuccuccuccuccuccuccucuucuucuuccucuuccuccuccagggaaaggcaggggaaaggagggaaggagaacccaguuagcauugguugaguuugaaggagaucccgcuugcuucuucccauguccaacuuccagcaagucuugggaucugaggccagaggggcuccugguuagaguucuuggggugagcagacuugugugcucaagaugagcauauuggggagccugcugaaguaaauugauagcccaccuaacucuagaggcuuuuucuaguuuuggaguauaguuacccugaagagcuuaacaaaaccuagugugcauuauugcaggguucacucagcucagaguuuaaaauaccucuguucauagggucaggguauguccuccaaaugaggcucuuagguucaggcagcuaucagaaggaccagggcuacagauuuggaggagagcagagcauguuuuguuuuguuuuguuuuguuuguuuguuuuuuuuauuuuuuuguuuuuuguuuuuuuuuguuuuugguuuuucgagacaggguuucucuguauagcccuggcuguccuggaacucacuuuguagaccaggcuggccucgaacucagaaauccgccugccucugcucccgagugcugggauuaaaggcguguaccaccaugcccggcagagcaugcuuacuugagcccuacauuuuuuuucuuuaaaaaaaaaaaagauuuauuuauuuauuuauuuauuuauuuauuuauuuauuuauuuaauguauaugaguaugcuagcuguagaugguugugagccauuauguaguugcuggaacccuacauucuuaacccagagauggcagaaucaggccuagccuacuaaccuugucuuggugguuauaaaaucaagccuagaaugugggguuggugcuugaccaaguggaaguuacuguauucugguguccuggggauguaagcaggccugccuacccccaugguggagcaggcuggcagagaggcugagaaucuguggcgguugacuuuguuuuguuucuaaguaggaguuacuagcucuucaaagcccagguguagagcuugacaaagaggaaacuaggacuugaauugugagcagccuuccccugaggcugugggugagcuaggggccuggagccugagccccagaagucuagagcagaugucuggguggggccuaucccaggccugccugggcugccuugccucaggauuuccuggagggcucagccguacuacagguuuuaugaaccccaguggagagcuuuuuggggggagggcagagcaccgcagauuauaucugcaguuacucuaggaaaaccucaagucuggagugaugaugggggucucagguuguggccaccugagguuuuucuucuguccccuccccccuucuauaaucucuugcucuggcuuauuagggcagagaaacaggcugucuucugccuuucagcagcauugaugaauuucuuccugaugaggagaggcuguggcaggacucccaaggucccagggucucccacuuuuaacuccucaguugccacugucauccugcucugcuucuguccccuuucccuugucucugggucaugcgucugacuccuuaaugcuagauaaagaaauuacagggacucaucuccaggaugcuugggugugggggcugggggggggggugucuuuuaacucagugugaaucuccacccaggcuggcccgguugucugguuguacugauugauugcauaaccugggccccggggccagcccugugaagcugccagggacugugugugcaaggcagagcugccaaacaggccuuucaggcagcagcuauguggaugagcugggagguggagggcucccaggaaacggcagaaaccugggccuuggaugggaagucaaggcugcuugugccacccagacugaugcugcuggugacucuguauccuugccucccaggaccguugcauucugcgacuggggguggcacggguuaaguugaaccagcagcggccuggcugccagguggugcagagaccaugggcagaguccagauguuugcuguucccauucccacaggccacccaagaaccauaauuucuuuuuuugaaagucuuuugacauagagauaggggcauggcaauaagaaaggagggggaggguggggugggggaggggacaauggguccagguuguguuagggccauagggaccauauggugaccagauggugucuguacucucuugaggccauccccacaaguugugacauggccgagccauccuauuguaccugcucaccuggggugcugcggccuaaugggcuugcuaucccuacugccuuucuucccaucagccaccaggcagcagacuucacagagccuccuggacuccccuggguugcuaugcguuguccuuggucuccggaguaauguuuuuccuucaggauggcgaaaggaagaaggggucucuagugggcuaucuaaggacucuauaaauaccaugaagcuggcugaucccagggugcaggacauagcauacuggagcuggaaagguguugauuaguacuaaaaagucccucaggcccuuccuucugcaagagguacacuccucccccucccacccauggacucuggcugccucauuuguuggcaaggcugccagggcgguugcaggggcggggcagguguaguuuacacgcugggcucaggcgccuguuccccuuuguuccuggucuccccauuugagagagagagagagagauggaggguaugggcuauggaccucggagggcuccgccacugaccugugucccuccacuguuccacuuuccucagcguccuggcaugucaccaggaagcaggaugcccauggcuggcuugcaggugggaccuccugccgguuccccauuuggcacagcugcuccgcuccgaccuggcaugccaccuaccaugauggauccauuccgaaaacgccugcuugugccucaggcccagcccccgaugccugcccagcgccgaggguaagccuauuucucauaccuugccuaucuugucuuggguguuaaguuucucuaucuugaccacaaggaggcucuuggccauuugggagaggguuuugaagaucgugaguuuggacuguuaaccucuuaaauggguuucuguuuuccuacuagguuaaagaggaggaagauggcagauaagguucuaccucagcgagugaguguguugggaggccugcccaggucuggcuggccagggugggaguccuggaguggagaaggaggggaggaugguagaacuagagcugguaaaacaagccaucggauuucucaaccugcagauccgggagcuugucccagagucucaggcauacauggaucuuuuagcuuucgagaggaagcuggaccagaccaucgcucgcaagcggauggagauucaagaggccaucaagaagccucugacgguauauacuaccccaaguucucccaaacuguuuuccuuccuggacuuguucucuagggaugagcuugggcuugagcaguacucacacagggagcuguccaccaguagagcgcacacucacuuuagcgugcuuugaaauggugucuugcuacauauggcuacucacucaguccuccugccucuuguucuuccuuuucagcaaaagcgaaaacuucggaucuauauuuccaauacauucagccccagcaaggcggauggagauaaugcgggaacugcggggaccccugggggaaccccggcagcagacaagguggccuccugggagcuucgaguagaggggaaacugcuggaugaugugaguuggaaggggagaaggccugugugaacuuagacugagaacagaugugagcguucuuucagaaguccuagccuagggaaaggguuuaaucuauccaguuaacagcuuagacuugguggggugguuguuucuaugccucacacauauuauacuagucuagagugaacaucuguaguuacuacaguuuucuuauagauggcagucagaugugucugauucacuuccucauugguuggcaguggggcucaugaaguacccuuuuccugucacuuugcucaaauuuugaaugcuacuucagggcccaagacuggaccuugagcuucaugauugauaaauucagcagcacacccaucuuuuguuuguuuguuuguuuuucgagacaggguuuuucuguauagcccuggcuguccuggaacucacucuguagaccaggcuggccucgaacucagaaaucugccugccucugccucccaagugcugggaucaaaggugugcgccaccacgcccggcugcagcacacccaucuuauguagugcuuuuccacucccagccuagcaaacagaagaggaaguucucaucauucuuuaagagccuugugauugaguuggacaaggaacucuaugggccggacaaccaucugguggagguaagaaugguucuggagccugggagggacaagcugccaggggauacagagcagaccaucagugugcugguagagugcuguaaccuaucugcuagugaugaacucugcuguucucuugcccgacaguggcaucggaugcccaccacacaggaaacagauggcuuucaggugaaacggccaggagaucucaaugucaagugcacccuucugcucaugcuggaucaucaggugacaguugucuaggcucacaaaugaggccacagguuucaggcagggaaggggugcaggguccuuuuaacucagcaguucuuaaccugugggucaugacccuuugggggaggaugucaagugaccauuuuacaggggucaucuaagaccauugggacacagauauuuacaauucauaacaguagcaaaauuagaguuauguaguaagaaaaugauuuuaugguaugguugggaagguuaagaaccaccguucuaaccccuucagaugcuguuuccgcacaagaaucuuuguugacuccuucuguccauucccagccuccucaguauaaacuggacccccgccuggcgagguugcugggagugcacacacagaccagggcggcaaucaugcaggcacuguggcuuuacaucaaacacaaccagcugcaggacggccaugagcgcgaguacaucaacugcaaucguuacuuccgccaggucagcuggaauuacccgcuucuucucagcccuuggcucagcugcccuggaacccuagugcuuugacugcugucuccuggcccuggaauagucagcuccccgggcccucaggcugauaucaccgugccuuugaugcucuuuccagaucuucaguuguggccgacuccguuucuccgagauucccaugaagcuggcuggauugcugcagcauccagaccccauuguuauuaaucaugucauuagguaaauagaaggaagagaaaugagauggcucuuggaaaacagaauucacccugaaaccuuacucauaggauagacguggugguugggaugaagauagccauguuuuuccaugcuuuucugugcugccugcaguguggauccuaaugaccaaaagaagacagccugcuaugacauugauguagagguugaugacccacugaaggcccagaugagcaacuuccuggccucuaccaccaaccagcaggagauugcuucucuugacgucaaggugaguccuuuggggccagggugagggugaguuggucuguuccuuucacccagcacacugacaggaccucagacccuagagcuggagcacauuugacacagacaccccuucuccagauccaugagaccauugaguccaucaaccagcuaaagacccagagggauuucaugcucagcuuuagcaccgagccccaggacuucauccaggaguggcuccguucccaacgccgagaccucaagguauacuucuuguuuuuugaaggguauuccauggaacauaguggguaaaaguuuuucuaccccaugucucagguagacugaccgaggcaggggugggaaucgugccacacacaccuuaaccccucguucuucacagaucaucacagaugugauuggaaacccugaggaggagagacgagcugcuuucuaccaccagcccugggcucaggaagcaguggggaggcacaucuuugccaaggugaggcuuugccauuuuggccuccgcuuuucuugagaagcugaagccugaggcuugcuuugucgucuucuucaggugcagcagcgaaggcaggaacuggaacaggugcugggaauucgccugaccuaacugcucagggauugccuccuuccuuccuccccugcccuggauggaaccuggcaagagcccguccucuggguucuggcuugggcugcagacauguaggauggagugagguguguuuccugucacccuccacuccccagcuuuaguuucauaaauguaguuuuagaucccucacugcuugguucccaaagccuuauuacugaccuuuuagcgcuggcuuuaauuggguuugcaaugagcggccucagcccccugcaggcaggcaggccugaguaggaggcuggaggcugugcuuuaacuuuguaccagacauuuccaaaccaaaggcugcuggguuugcauguuuacaggcuccacccuagggccagugccagagcuggcuuuggggagcugggcaaggaagagaaggcccuagacucuuccuggccuuucuaaccaaaguuuuuugccauuccuacaagcccagucuugcugcugguuuguccuucuuuuuggguauuugcacuauuuggggagcagguuuuucuaugugggagccacuuuuuuguacagagguaaugggguuuuucagggagcccacuuggugccuccuucuuccuuucuuuucuuaaucuaugcaagcggcugcagccgccaucaucuccugguaugccacaaggcugcccacccauagcugcuugggcagggggagguggaaucuccugagaguggcaaugccaguucucuaacccaguuacagcaggggugugugugcgugcgugcgugcgugcugcaggggaaggggaaagcuggaggacugcuguuaccuuuugcagucggucuuaaagaggaugggccuaaggcuuggcaaacuuggaaaauuccaaauaaaucuuuuuguuuauugguggugcccagac

SEQ ID NO: 6456 - RNA, 3424 nt, Mus musculus
uagaagauucaggagcaaccccuucccagggggucucucaagaacccaaagcugugcuacccaggcaggaccacccuucgaguccuagcagaccagcugaugaagcugcccucccauagggucccuggagggauggugccuccccugggucucaauuugcauggcaggaaggggccuaauggggaagaggcggagaggagacaagcugcagcccaggcugacauacaguuacauguuucgcccccaaaccuccuugggcucagagacagagcagugaccauggccacacuggugcugucuuccaugcccugccacuggcuguuguuccugcugcugcucuucucagguaugacuuaugugacagacgauaggcucgcuggcuuugagacaggaccgucagucggccggucggcuccauucccugucucauuucggucucucggcucagccucuugcauuuugcugucugcuucuugucugucucccucuaacuguccugugcccaguuuguggguuuuaauggugggcucagggucaaaggugucccagcccuuuccagccuggaggguaucagguugagcuugguacaaggggcuaauuaaucucaugggcagcuaugaccuggaagaguguguguguguguguguguguguuggggcggggggcugcaggaggaagaggcccugaggguacugcauagaaaaggcucuuucccuauauccuggaauauaguguguuccaggaauuguccucucuuugccggaaagacugggagagccuugcugguuguggauucccucucauuuccacagaagcaacaggccagccugaugaucaaaggcagcagggggccuggguaugggauuuccaguacccauaccuuauuucugccucuccaguacagggacgggggcgggggagcuaaaggggcuugaagcuguagucccggaaggaggaaguagcucugggaauguggagggguuauggguggggcaaucaauugaggguagagaggucugaccuagcccugcccacuuccuuccacccuccaggugagccgguaccagcaaugacaagcagugaccugccacugaauuuccaagguuaguugccucagccaccacuucugggacaaaugggucuguuuaacacagcccuaucucugccuggagcucccugucuagagcgcccauauuuacaccuccucaaggccucauuaaggcuccauugcuggacagcugucgcucucaucagacuagugugcuccagcccuggccacugaaggccagaaccaagcagagguuggggaucagagcaggacagugcuagaggggagcccacaaggccaaaggccugggucugucuuauuagaaacccaacaaaccucucaggcccgaacucugagaggcaugggucccugagaaggguaagggaggugggccucgggugacaggcuaaggauucgaccuuuaucacccuggggauggugggcagaccuggaggauuuggaguggguguaggaaaguguagaggaaagaguuaaaaguacccaaccaggucaaaaggcuguccugcaugugaggccauuccagugaacauaaaagcaauggaaagguuccaaaauucuccuuaaugaaagacaacuggacagagguuagaucaggaagagguguacaccaguggcuuaguaugaggccucucacagacuuuaccuucucauaccucuacugacugccucaugaaccugaugccccagacacgugagauaggcuacaggaagacgcuaagccugauuuugaaccuugcccugauauguccgcaggaagcccuuguucccagaucuggcagcacccgagguuugcagccaaaaagcggagcuccauggugaaguuucacugcuacacaaaccacucaggugcacugaccugguuccgaaagcgagggagccagcagccccaggaacuggucucagaagagggacgcauugugcagacccagaauggcucugucuacacccucacuauccaaaacauccaguacgaggauaaugguaucuacuucugcaagcagaaaugugacagcgccaaccauaaugucaccgacagcuguggcacggaacuucuagucuuaggugugugcaagguagauuguguagccauccacacccacuccccagcucagccuaccuaccaggggaaguggcuaugauucuagaguccccaggagagcugcuaagcaguaguuucugaugguguccaaagauccaccauguuuaaccuucaacgccagucuuaugcccugcccuucuccccugcucccccaggauucagcacguuggaccaacugaagcggcggaacacacugaaagauggcauuaucuugauccagacccuccucaucauccucuucaucauugugcccaucuuccugcuacuugacaaggugcccacaggagcugggggagggggguccuugggaaggcugggagguuggcacagggaagacaggacaugggcagggucuccauauucugagacucuggcuacucauccagccccaaguccuguccauuggcucccuguucauucacucauuuggucuuggagacuccuucuuccucguccccacccagacccacaucccuggccugucaggggacagagauggaagacacuaacccucugaacugcauucccuccccaccccauugugcaggaugacggcaaggcugggauggaggaagaucacaccuaugagguaagggagaggguugcuuagcagcucugagcugcgaugcucacccucuguugugauaguuagaauguggcccagaccugaccuccaauucauguuucuagggcuugaacauugaccagacagccaccuaugaagacauagugacucuucggacaggggagguaaaguggucgguaggagagcauccaggccaggaaugagggucaccuucauccugcucaacucuugggccucacugcuuccaaaccgccuggcucacaagcccauucccugcuuccuggauaccccggccagcgucugaagcuggaccaucaauaccaccucucauucuagccccugguccccagcucuugcugaagggccugggguggaaggacaauaggguggugacauggaguaaggaguucucuggggauagacuugacccaaggcuucugggagugccaugugggaucuguccccauguuugggacaggaaagcagagacuuguuggaaucugcaaauggacucagaacacacuggcuucaagaggagucuaggaggaccaugguucacacugacaccugaagaaguugccagaaugccauuucucucucccauuccaaggaucacccaaagccuacagcccauccuccuguggaauaaauaaugugccugacaccagag

SEQ ID NO: 6457 - RNA, 326 nt, Mus musculus
gacaaggccacacguccauuccggccucuuaucgacggggacugcucuaagguaauguguucucugaggaagcugaggcugcacgguuugagcuggguggccggcgaugaugacacuccauacauagcacgcguuagacugcugauccgggugaugcgaaucguaaucugagccgaccgcaccggcagcgggagguggcgggcgcagccgacuucguacccucacccuucgcuucucuuucaggucugcccugcgcaggacagcagacagcguggacuucuaccaccuuuccccgagccucugaauaaaguguuuaaauaaccccg

SEQ ID NO: 6458 - RNA, 326 nt, Mus musculus
cgggguuauuuaaacacuuuauucagaggcucggggaaaggugguagaaguccacgcugucugcuguccugcgcagggcagaccugaaagagaagcgaagggugaggguacgaagucggcugcgcccgccaccucccgcugccggugcggucggcucagauuacgauucgcaucacccggaucagcagucuaacgcgugcuauguauggagugucaucaucgccggccacccagcucaaaccgugcagccucagcuuccucagagaacacauuaccuuagagcaguccccgucgauaagaggccggaauggacguguggccuuguc

SEQ ID NO: 6459 - RNA, 96418 nt, Mus musculus
caggauguguuugaucgaauguaggcuggagguacauaagcagagaguaugccaggauguuugcuugcuccugauuggacaaagguggaaaguauguagccuuuugggguuugccuuucuuuauaaaccuccgauuaauguaccuuggugacauacucccggaauccugaggauggauugucuuagccagcauagcaauuuggcucaaaaacugugauaguguucuuacuuucacccaaugggaucaacacuuucacaccacacacgcacacacgcacacacacgcgcgcacacacacacacacuuccuagcugccuaugaggugagagacagguuccagauguauaagguacaucuucuauacaugcagccugaagguaauuggaggagggauucagagaguccuuuggcacacucuucucaggucggcguauucagaccagaaccucagcaacauugcucucagcuccucucaucaccucuggagguaagucacaccaggcugcucuguaagaccuuccggccacccuccugccucucuagcaucuugcuugguagaugaugucuucuuggguuugguuugcaaauauuuuauugaguauuuuuacaucaauguucauaagggaaauuagucugaaguucucuuuuuuuuaauacuuguuuauuuauuuauuauauguaaguacacuguagcuugucuucagacacuccagaagugggagucagaucucguuacggaugguugugagccaccaugugguugcugggauuugaacuccggaccuucggaagagcagucgggugcuuuuacccacugagccaucucuucagccccuuaaguucucuuucuuuguuaagucuuugugugguucaggaugucuguggccucauagaaugaguuuagcaauguuccuucuguuuuuauuuuguggacuaauuuaaggaguauuggcauuagcucuucuuuaaaagucugguagaauucuucgcuaaaaccuucuggcccugggcauuuuuugguugggagaguuuuaaugacugcuucuauuucuuuagggguuauagggauguuuaaauauuuaccugaucuugauuuaacuuugguacuuaguauuugucgacaaaaucauccauuccuuuuagauuuuccaguuuugugaagugcaggcuuuugaagaccuagugaaucuuugaacuuccccagaguccuuaugucucccuuuuuaucucugauugucuuaauuuugguacugucucucugcccucucugccuauuaguguggcuaaguguuugucuaucuuguuugucuuucuugguuuuguugauucuuuguacuguuuguuucuaauugaacaauuucagguccgaguuucaucaucuccagcuaucuacuccuuuuggguguguuugcuuacuuuuguucuagagcuuucagguguacuuuuaauuuguaugagaauucuccaacuucuuuuuuuuuuuaaagauuuuuaauuuauuauuauauguaaguacacuguagcugucuucagacacaucagaagagggagucaaaucuuguuacagaugguugugagccaccaugugguugcugggauuugaacucuggaccuucggaagagcagucgggugcucuuacccacugagccaucucaccagccccuccaacuucuuuaugaaggcacuugauacuaugaacuuuccucuuagaacugcuuucauugugucccauaacuuugaguauguuguguccucauuuuuacugaacucuagaaagucuuuaauuucuuucuuucuuucuucccugaucuagugaccacugaggagagaguuguucaguuuccaugaauauguuggcuuucuguuguuuccauuguuguugaaguacaguuuuaauccaugcugaucugauaaaaugcaaggguuuuuuucaaucuucuuguuucuguugaggcuugcuuuaugagugaguauauggccaauuuuagagaagguucugugaguugcugaaaagaagguauauuuuuuuuauguuugggugaaauguuagauccauuuguaccauaacuucuguuaacuucauuauuucucugucuaguuucugucucaaugaccuguucauuggugagaguaugguguugaaguguaugcuucaaugugugauuuaagcuuuaguaauagggcauagauauucagaauugagauguccucuuggaggauuuuuccuuugaugaguaugaaguguccuuaccugucucuuuugauuacuuuugguugaaagucuauuuuauuagauauuagaauagcuacuccagcuuguuucuugggucuauuugcauggaaagccuuuuuucagcccuuuucucugggauaauaucuaucuuuguugcugaggugugucucuugaauacagcagaacgauggauucuaauuacgcauccguucuguuaggcuuugucuuuuuauuaugggauugagucuauugauguugagagauauuaauuaaugcucuuccagagguccugaauucaauuccuagcagccagauguaguggggucagaugcccucuucuggugugucugaagacagcaacaguguacucaaauaccuuaaauaaauaaauaaauauuuaaaggggggggugagauggcucagugguuaagagcacugacugcucuuccagggauucugagcucaaauuccagcaaccacaugguggcucacaaccauccauaaugagaugcccucuucuggugugucuaaagacagcuacaguguacuuacauauaauaauaaauaaaucguuuuuuuuaaagaaucuuuuagagagagagaaagagagagauuaaugaccaaugacuguuaguuccuuuuauuuugauaguaaugguggugggggugguggggguggcaguaguaguagcaguaguaauaguguguuucuccucuuuggguuuugcucugagaugauuaauuucuuguguuuucuuggguguaguuacccaucuuauguuuuaguuuuccuucuaguauccucuauagggcuggauuaguagaaauauauuguuuagaucugguuuugucauggaauaucuugguuucuccaucuaaggugauugaaaguuuugcuggguauaauaguugagguugacaucuguggucucuuagugucugcaagacaucugcccagacccuucuagucuuuagaguuucuguuaagaaguuggauguagcacuugggcagcagaagcaggcggauuucugaguucgaggccagccuggucuacagagugaguuccaggacagcuagggcuacacagagcaacccugucucgaaaaaacaacaacaaaaaaaaaccaaccaaacaaacaaaaagaaguuggauguaagucugauagguuugccuucauuuguuaguuugccuuuuucccuuucagcuuuuaauacucuuucuuuguucuuuuuauuuaauguuuugcuuauuaugugggaggaggcuuuucuuuucugguucaauauguuugguguucuguaagcuuccuauauauuuauaguacauuuauagacauuucuuucuuuagguuaggaaauuuucuuuuuuuccuuuuuaaaaaaauuauugauugauugauugauugauuuuauguaugaguauacuguagcugucuucagacacaccagaaaaaggcauuggaucccauuauagauaguugugagccaccaugugguugcugggaauugaacucaggacaucuggaagaacagucagugcccuuagcugcugagccgucucuccagcccagaaaauuuucuuucuuccuuucuuccuuccuuccuuccuuccuuccuuccuuccuuccuuccuuccuuccuuccuuucucucucucucucucucucucucucucucuuucuuucuuucuuuuuuuuuuuuucaagacaggguuucucuguauaguccuggcuguccuggaacucacuuuguagaccagacuggcuuugaacucagaaaucugccuuccucugccucccgagugcugggauuaaaggcgugcaccaccacgcccagcugaaaauuuuccuauugaagauguuuucugugccuuugagcugggaaucuucuccuucuucuuuuccuauuauucuuagguuuggucguuucauagugucccaaauuuccugcauguuuugugucacacacuuuaaaauuuuugcauuuucuuugaccaagguaucaacuucuucuaugguaucuucugcaucugagauucucucuuuaucuccugucuucuguugcugaugcugugucuguaguuccuguucucuuccccagguuuuccucguuugcuuucuuugcugcuucuaucuccaucuucagguccuggacaguuucacucauacccuucacuuauuugauuguguuuucccucgauuucuuuuuuuuuuuuuuuugguuuuucgagacaggguuucugugaauagcccuggcuguccuggaacucauucuguagaccaggcuggccuggaacucagaaauccgccugucuuugccuccugagugcugggaucaaaggcgugcgccaccacgcccggcucaugcuucauuuuuauuagguauccagggcuugcuauagcaggauagcugggcucuggugcugccauauugcccuggguuuauugauuguguucuuaugcuauccuuuaagcuccugguuuucccugguguuggcuggaagguggggggagccauggaacagguaaugagguuaggggacccgacuuugcuggcuaugccucagguggacccuauggcaagggauugguggagcgauguucccagcugguaguucugggggucucugcaguccuucacagggaagcaggaugcucuuagggucccacaaggcuccucugagcccagagccagacaguggaggucaggggaccaugcucucaacucaccuguucuggcuaugcucuagacugggacugagaagagauugguaagguaggguuccaagcugguaguucuuggggcccccagaggccaacacagcccaucaaauacuuuaagguuuuuuguuuguuuguguuuuuuguuuuugugggguuuuuuuuuuuuguuuuuguuuuuguuuuuuuuuguuguuguuuuuguuuuuguuuuucaagacaggguuucucuguauagcccuggcuguccuggaacucacuuuguagaccaggcuggccuggaacucagaaauccaccugccucugccuccugagugcugggauuaaaggcgugcuccaccacgcccggcuggguuuuuuuuuuuuuuauuagaaaaaaagagaugucuuuaauguuuaaauguaaagguguuuaaauggauaaaggcacugagugcucuucaaaaggaucuagauucaauuucuagcacucacauaacaucuggaaaccauucauaacuucgaauccagggacucucaugcccucuucuggucuccauaggcucugcaugcaugugacaccuaaacacacaugcaggcaaaauaccauuacacauaaaauaaaaguaaguaaaucuuuuuuuaaaaaagaaaaaagcuuaucaggaaaacacuuuaagagaugugugauucacaucucuaauaucaucggaggauggagaugucacaucugcagaguucacagccagcuguuccugggcagcauaguuugccagguauucuucagagugugauuuauugaagaggugaccaaggcagagacuagaaagucauacaaguuuaggcaggaccuaagcaaagacagggauuucagcugaguuccacacugucugaugucaggggcccugaguuuguguuauacugcagcauaagugcuggcuuuuauuccugucccaccccucaaucuuuagucauuggucgcaggcuuugguggggauguguguggacuucccagguuccuuaagacaaggucaccuguccucaacccaaccugaaccaaguagccucugacagcgucagauccaacaacaaauuagagaucuagacaccggggauguagccaaaucagcaaagugcuugcuuagcagguuuaaagcuccaaguuuaaucucuaacgcugcauaaaacagucaugggguacaugcuuacaaucucugcacucaggagauggaggcaggggaaccagagguucaaaaucauccuuggcuacacagugaguaugagccagccugugcuaugugaagcacuggagagugugugugggagagggagaaggagagggagaaggagagggagagggagagggagagggagagggagagggagagggagagggagagggagagggagagagagaaacacacuuuuaaacccaauaccugggaagcagggucaggcaggucucugaguucaaggucagccaggacuacaccgugaaacucugccuugaaaaacaaaagcaaaauaaacaaaacccauaaaaucuaucuaauuaaagccacacaauuaacaccacaaucuaauuuuagaauauuugcauacuuuuuuuaaagaaacccgugcucaaugagauauuuaaaaaucacuuuuuaaaaagggggagccaguugugguauaaacaccuauuauuaacaccuugacugugaauuugaggccagccaggacuacagagugaguaugagauaugccaacggcacuggcuggguuugugucaaauugacacaagcuggaguuagcacagagaaaggagccucccucgaggaaaugccuccaugagauccagcuguaaggcauuuucccaauuagugaucaaggggagaggguucauuguggguggugccaucccugggcugguagucuuggguccuauaagaaagcaagcugagcaagccaggggaagcaagccaguaaguaacauccuuccauggccucggcaucagcuccugguucuugaccugcuucaguuccaauucugacuuccuuuggugaugaacagcaguguggaaguguaagcggaauaaacccuuuccuccccaauuugcuuuuuggucaugauguuuugugcaggaauacaaacccugacugagacaccuacauuacauagcaaaaccucaggcucuacgaagaugagagaccugagagcugcaucucaguuggcagagcgcuugccuaguaucuaccacuguaaaaagcuaugugcaccagugcauacuagggucguaguguagaggcaagggggucaaggacaucuucaguuacaucaggaguuuaugaccagccugggcuaggcaagaucauaucucaaauaaauaaauaaauaaauaaauaaauaaauaaauaaauaauagccagagugguaccucccugugucuuagcugucacgaaauagaggcagaagggucaggaguucaagaucugcuucagcugucuaacaaguuuugagacuacccugaguuucaugagacccugucuaaaauaaaguaaaauaaucacaacaacuugccucaccccaagaaagccaaaauccugaaaagagaacuaaaugugucagagagagagagagagagagagagagagagagagagagagagaaguauuuaagauaagcuaugguguguguauauguacacggcucuaugugugugugugugugugugugugugugugugugugugugugugugugugugugugugugugugugagugagccugggauugaaccuagugccucauaacacacuagauaaacacccuaaccuuuaguauugcugaggcuggucuugaacucacaauauauccaagucaggacuugaauuuuuuuuuuuguuguucuugugccucagccuccuaaaaagcucgaaacccagguuaaugcugucacauccugcuaaaccacagauuauagcuguaaauuuuucagauuuagggagagcuguguguucaauuuuucuaauuuccauuagauggcgccauugucaaguuucuguaauuuuuaaaguucugggauggaaggaaccuuugccuuuuauugucuuguuuugacucucucucucucucucucucucucucucucucucucuccuuuuuuuuucuggagucacuuggaaggaugggggguggaaaggauaagcuaaagccauuuaguccuggacugaaaaguacccggacuguacgugaagacugccacauaggacagguuccugauugucuccgguggaaacgcugucagcuacucuuuuuuuuuuuuuuuuuuuuuuuuugguuuucgagacaggguuucucugugcagcucuggcuguccuggaacucacucuguagaccaggcuggccucaaacucagagauccaccugccucugccuccccagugcugggauuaaaggcguguaccaccacgcccgccaggcucugucagcuacucuugagccaucuagaauuuggagcaagcggaggucuuugcuaccucuuuguuggaguucucuacgaucuuuauuucauaaaccucauuauuagaagauuuuuauccaaaaugucacuggcauagugguagaugacugugaauccagcauuugggaacagauauuggaggauccagaauacaagaccaaccuaagcuacauagaaagacuuuggaggucuggaggccugaagcuugcuauguaagccacacuggccuugaacucacacagguccacuugccucugcguacugagugcuaggauuaggcccugcaccaccaugcccagcuauaucuccuuccucccuuccucccuuuuucccucuuucuuuuccuuccuuccuuccuuccuuccuucccucccuucucucucucucucucucucucucucucucccucucccucucccucucccucucccucucccucucccucucucucucucucucucucucuuucucuuucuuucucuucaagauaggguuucucuguguagcuuggcuguuuuggaacucucucuauagaccaaacuuguuagaagacagcucuuuuccggacagaucacaccaggccagcacaguuccacaaaaagaaauuuucuuuuuuuugaugggggagggggaaaugaggaagagaagaaagggggaaaaaagaggaaaagaaggcaaggggucagggccucugucuuguauuugggcugugacauaaauggcauguaaugacgcacacaaaugaggcacaugccaggaggauggggcgguugccauggcaacagccgcacaagggccauaguccccuaaggauguagucauagcuggauucggaggcugacuguaaaaccgcuucuucuucuucuccuucuccuucuccuucuccuucuccuucuccuucuccuucuccuucuccuucuccuucuccuucuccuucuccuucuccuucuccuucuccuccuccuccuccuccuccuccuccuccuccuccuccuucuucuucuucuuuucuuuucuuuuuuaagauuuauuuauugccgggcgugguggcacaugccuuuaaucccaguacucgggaggcagaggcaggcggauuucugaguucgaggccagccuggucuacaaagugaguuccaggacagccagggcuauacagagaaacccugucucaaaaaaccaaaaaaaaaaaaaaaaaagauuuauuuauuuauuguaaguacacuguagccgucuucagacacuccagaagagggcaucagaucucaguacagaucguugugcgccaccauguggauacuagaauuugaacucaggaccuucggaagagcagucagugcucuuaacugcugagccaucucuccagcccuguaaaaccacuucuaaugcuaacaaagcuguccucaaacucaggagauccacuugccucugccuccugaauauugggguuaaaggcgugagucaccauuaccugacuuguauuuuucuuuucuuucuuucuuucuuucuuucuuucuuucuuucuuucuuucuuucuuucuuucuuccuuccuuccuuccuuccuuccuuccuuccuuccuuccuuucuuucuuuuuaaagcuugugucuuuguuuuaauguagagugccuguaagugcaccccaugcaaacuagugccuugggggccaguagaggguguuggauggccuggaauugcaggcgcugcauguaggugcuaggaaccgauagaaagcugccagugcucuuaacuacccagccagcucuccagagcugauuguccuauucuggggugcccuuacaaacauauuuccugucccccgcccuccagaacugaagguugaaccuagagccucaagaacaccgggcaaguccagcaccacuacaccccaauccccauuucaauuuugauuugaaacaaggucucaguauauuaccuacgauugcuuuggacucuguagcccaucagccccggacuugggcuuuccugugucagucacuugaguagcuuggaucacaugccuguaucuacagccguggcuuaaaacuacaucuuguuaccugaaauucaaguuuaggugagcauccucuauuauauuuucuaagacucuguauguuguaaauauaugcaguuugcaacugucaccccaauucagucucagaaacuuuccgucaccccagaaaagucccuucuuguccauuugccaccacucccaaaguuuguuuuguuuuguuuuuguuuguuugcuuugguuuguggggcuuugggagauguuuuguuuuguuuguuuguuuguuuuggaaacagugcuucucuguguggcucuggcuguccuggaacucacucuguagagcaggcuggccucaaacucacagagauccaccugccucuuucuccugagugcuaccaugcccagcggaaauaucucuucguaagugucgagaacuggcuguuucauaauuuaguuaguguuaaaucauuugcauguggaauuugauuucauuuuuaaguaaggccaguggggaagcuguccuggguggaguuugccuguuggccucuggguugcacgggggggggggggggggggggggggggguuauuucaaucucuugguguuccuuccauagauguggccaggcugagccugguggccuagaacugaaggugggaucucuuccacuuccaggcagaacaggcaggaagggagggguuggcggauauucagaagggcugugugagcccaccauaugcccauaugcuacucugaaaaauguugguccuuuguugucugcacagucuuaaagggccauauauccaaaggaaauauuagggauaaugugccuaggacugugcucaggggccagagcguaaccagcugugggacaccuuugcuaaaaacccauuaagagucaaagcauagcauagcagccuggucuauacagcaaguuccaggacagccaagacuacacagaaagacccuaucucaaaagaaaaagaaaaaaacaagucaaagcuuuuuuuuuuuuuuugguuuugguuuugguuuuuugagacaggguuucucuguauagcccuggcuguccuggaacucacucuguagaccaggcuggccuugaacucagaaauccaccugccucugccucccgagugcugggauuaaaggugugcgccaucacgcucagcuuaagucaaaacauuuugaccagcgagugaccauaaagauggccccugcuuauuugaucuuuauacacuuacuuaaucugucugucauuuugccugcauguaugcccaugggccagguguccuguagucacaaacccaggccgucugggagagcagaaguguuuuuaacuguugacagucucuccagcccuccugccucagucucucaagugguaggauuauggacccacuccacacagcugacucuugcuuuuuaauuaucuuuuaaacuuauuguccuguguaugaaugcauggaaagaguagacaggcacgggugccacgguguacacguagagaggucagcagguagcuuuguggaacugguucuccaucuccacuuuuaauuggauucugggguagcaugcagguuaccaggcucagaccucuaccagcugaagcaucucucagaccccuggcuucugcuuuaaagcaacaacggcagaaauuaacaaacuggccaugguggugcacaccugugauuccaucaccguggcucgcgaagaggaagaggcaggcagagcucugugaguuugagaccagccuggcuaguuccgggacagccagugaaauccugucucaaaaauaaaacaaaacagaaagagaaagagggcugggguuagaaauuugucuaagcucugcuccacaguuaccuggcaacagccagguguaccugacucacuauaaaaggggcugcuugccaccuccucucucucucuuccuuuucccuucuugcucucuguucccucaccccuuucccccuucuccccauuccccuuccccccucucuccaugugcucauggcaggccucuguuucucuauucucucccucccucugccuuucucugccucuacuacccucucaacuccccuccccaugcccuaaauaaacucuauucuaugcuaucucaucggugaggcuggucccucagggcaaggccagccuggucuacagagugacagccagggcuauacagugaaaccuuuuuuuggaaaaaacuccaaaccaaccaaacaaaacaaaacauguguccaugugugcgccugugugcaucugucuaucuaucuguccaucaguguagagguaugcaugacauaacacacauucugguguggucaggacagcuugcuggcgucgggucucuucuucccaccauccaccauguggguaccaggaaucaaacucgggucaucagacuuggccacagcuacucuuuauccacugagccauccuaccuguuuuuuguuguuuuaagauagggucuuucuugcacucuguaguccugacuggacuggaacuccuuauguggcccagucaaaaccggguaauucuccugccucagugucaggaauucugggguuauagguacuuccgugccaggccaugcuggacucguguuucuaaagacccagacacacuccuuagaggcccaggccucuccaaccacccuggcgccuggaguggguuugcagggaaccaagagaagggaaaaauccuggagcuagcucccuucccugugauuuaucacuauggaaacgggagcucuuuuccgcugucccugccgcugcugcuggggacgcauuguugaugccacugcagcacaggucacaguuccuuccucuuuccugcugcagaaaugccacaguaaccuacguggccucagcauggccacucacaccugaaggacccggccaggcuugggaaaaacaaccgggcuggauuccccugggcuccagggaccuucugggucagcgcagaccugaacaaugcuggcucagaacaauacagccucgguggcccagccuucuccuuccuucagggaccucuggagucaggggauuaaaaauggaucuacaguucucagguagccgaggacugaaaugucaaggcccuuuguagagucaaaggcucacugugggugcuauuggcuuaggagaccccaguaggaaucuguccuccaauuaaagcugcagaugagguucuucauauaccuaugccagauuugggacaaaaggucacugggccagaacaaagaggaucccagagacaaugaaggaagccccuuaguuagaauauuucaacccucugccaggccuggcagucacugacuacucacaucaccagguccuaaagaguacugggacaaugcuagcuagccccuggugggaaggccuucagcacagcuuacuucgccucuccuggcaaagaggauguuccucugagugugcagggaccaguggaugcaggggacuuucacacugugcuccaaagccugaagggucucacaaagcccuaccgagcugaaggccagcugaaggccgugggaguccccagaugcugugauaccccaacaacacuggccucagcacuuacaucccccaaggauaggagacugccucccuccccuuuaaaaagaggauauuuuaaacagagacaauaaaauauucauguuuaugugcaagugagcaguacagaggaacuaagccuuuaguccugguuccucagcaguaauauucaguauaggcggucacgguagcacaugcuugcagaggcagaaggaggaagacuggcaugaacucaaggccagccggccccacacaguacccugucuuaaacaccacaagguaggcauuccuguggauuccauccacagaccagacuccagcugguguuacugguauucuuugugucugucuguguugcuuuguuaccuguguagauuuggguaccagaaaaccaggcaauacccugcauaaggcucagugaaaugguuuggaguggaaacgcugucuguggaaccuggcaacuggaauuugauucccauaaugcacguguagguagaaggagggaauuaucuccacaaaguuguccucgaccucugcauuccugauguggcauucauaugcccgaacgucacgugcacacaggcuaaaagcaaauuuauuuuauauauuuuugagacagggucucaccauguagccuugggaggccuagaaccugcuauggagaacacacuggccuugaacucacagagauucacacagcucaggcuccugaguacugggaucaaagguauuugccaucauaccuggcugauaauacuuuuuuauuaaaaaaaaaaauuguaggcuggugagauggcucaguggguaagagcacugacugcucuucugaagguccugaguucaagucccagcaaccacaugguggcucacaaccaccaguaaugagaucugacgccuucuucugauacaucagaagacagugcacuuauguauaauaauaaauaaaucuuugggccugagcgagcggggccgacuggagcaagcagagcugaccagagcaagcagagguccuaaauucaauucccaacaaccacuugaaggcucacaaccaucuguacagcuacaauguacucauauacauaaaauaaauaaauaaauauauauauuuuuaaaaguccugaaggggaaaagccacugaaccauuccaaagcacaagucucucaccugucccuggggaaucaccccaguccuccuggcucccaguccuaacaucugcugcuauuauuaugggcuguguaucucccagauccaagcugcucaggacccaaaaacuuuagauuuuccaauuuaauuuuucagauuuuggauuauuauuucauguaugauauauacagaugagauguugucaagacaggacuaacgucauucauucacucuauagcuuauauacuuaacccaaagauaauuuuauaccauaucuuaaguacuuuugugcagggaacaaagauuugcauuguggauuccauuccauggaaaaggaguuuccaauuuuggagcauuuuggguuucuacauucuggauuaggggugcucaaccuguggucuauccucucucugcagguuuauuuuugauguuucaaagauguuucacaaauuggaucauaucuggggugagagauuagcuuucuuuguuugguugguuuuguuuuuuucuccaaauaaucccuggaaauucacccaaguuguguguuucuaaacucagucgcuuuucgucauagauucacaucuuguagucuggguguacugacauggcaaaucuuuguucccugaacaaaaguucuuaagauacgguauaaaaguaucuuuugguuaaguauauaagcuauagagugaaugaaugacgucauuuacccuccgaggagcauuuacuuccucgagaaaucugaaauugaacaucuccuugccgagacuauccauauauagugugugugcaugugggcacgugcgcgcacgcgugcaguggagcacacaugucaguguaaguaugugccacagugagagaggagguuagagucuguaucccuuuuucaucuuuagcugggguucggggaauugaauucaggaaaccagggugacaucuuuggucaucaagagcuucaaaccucccagccaucucuugcucucucugcuuuguuuugguuugguuuugagaucuccauagaucaggcugucuugaauucacagagaucguccugccucuaccuccagagugcuggaauuaaaggugugcgucaccaagccugacccucucagcuaucucaacugguccauuuuuguuuuuugguuuuuuuuuaauuaaaaaagccuuaacuguguguguguguguguaugugugugcacacgcacacauguucacaccaguagacaggguaagaggacgccuuguuugaguuuguuuuauucaucaugugggucccaggggucgaacacagguucuuagucuuggcagcaggugccuuuacccacugagccguccugccagccccaucgacuguucuguuuuuaaagaccucuaauugaguaagcacugaacaucugggagguuccucccuaagaccugguacauauuuccacaacaguuuuagcccugcucguguggcuccuggcuugguccugagucacaugacucccacuucuguccacaagcaacuuuccugugccuauucucaaaccccaacuuggcugcccuuuaaaaaaaaaaaguuucuuaauguaucuauuuauuuugauuguguuuaaucggguaaugaaacugugaagaaacaggauguucgagacagcuguauagaacggagugaagaauugcauccgagaguaaccccgggagcuaaguauuucauauuuaguguguuugggcauuuucagacuuugacuccuucagcuauguucuaggccaauguuuucucuaguguguggcauuucaagaugucugaaaugauuuucuucuccgggcccacaaaggauucagggcuagagucagacagcgggaguuccaacuaacuccaccguccaagacggucaauugugggucaacggugggugcucuggccaagagcacuggucucucugagagguuccgggaggcaggaguuugaggcaaggggauugagcuuuggagaggggggugugguucagguaguucaagauccugagaugggcucuugacccuaaguuuaacaucacagagagagaagcaacagcauuuggggagguuucuuggagcccccacugccaaaguggcaucucaccuuccuuucagggcguaagcccgcagccaggagacagggaaagggagugggagcagggcauagcaccaacaccaucuuugguuuugggguuuuguuuuguuuuguuuuguuuuguuuuguuuuguuuuguuuuguuuuguuuuguuuuguugguuuuuucaagacaggguuucucuguauagcccuggcuguccuggaacucccuuuguagaccaggcuggccucgaacucagaaaucugccugccucugccucccgaguacugggauuaaaagugugugccaccauaccggaggagacauuuuuuucaccaucuuugauaguaacucacuuccugaguaagagauguucccuggcacuagggacacacggugucucggggcacuuguugguaucugugagaagagaugucuguacacuaagcagggagaaaggagagggaaggaaggagggaggggaggggaacgaggggggagggaagaaaggaaggaaaggaauaaagguaacaauaaugcuccacguggguaugguggugcacaccuguaaagcucacacacucucucuuucucucucucucucuuucucucucucucucucucucucugucucugucucugucucugucucucucucucucuuucaagacaggguuucucuguauaacuuuggcuguccuggaacucacucuguagaccaggcuggccucgaauucagaaaucugccugccucugccucccgagcacugggauuaaaggcgugugccgccacgcccggcucucacauuccugaagaggcagaaugauucagaaugucugcggccagcaagggcuauauaucuagaccaugucucaauaacuaaauguuaguuacuaugugugaaacacaagguccauaguagucuuguguuaaaggguaauucucaaaagucacaaccucaaacacacacgaaauaaauaauuaucauauauuuucuuuucuuaccaacugaugccaucagugagauucucucccugccugaaagaaucagaaucagaaacacacacacacacacacacacacacacacacacauacacacacacacacacacacacacacauacauacacauacacacacacauacacacacacauacacacauacacacacauacauacauacauacacacacauacacacacauacauacacauacacacacacauacacacauacacacacauacauacauacacacacauacacacacauacacacauacacacacauacacacauacauacauacacacacacacacacacacacacacaauccuagcacuggcuagacugagguaggagaauuaccauaacuucaaagcuauccugagcuacacagggaguuuuggguuuaccugggcuacagaaugagacccuaucucagaaacaaaacaacaagcuaauauauauaugcauguaugauuagccagaugauagaccaacagacuaguucaucuggagauauauauuuuccaugaaagacauugaaaugacugugcuaauggaugccaagucaucccgugugaguaggacaguacuaagcugcaccauccucaucccauguaagucaugguuuccuggaugucagucauccgugucaccgccagaauucuacaaucuagggagacaacguauucaaagacgagugaaaggcacagauaaucuauagacucagucuuugacugagcacucaagggcuggugagagggcuccguuggaagugacggcucugugggaaggcgcuuugccaccaacaccaacaaucugaguucaguccccaggcccuacacggugggaaagaaccaacucuuucaggucgaccucugaccucgacauauacauuguaccuggcuagugcaugucccccuguacuaaguacuugacaacgcccagcuuuuauuggagacaaccaagaauguuguugaucuacuaaauuuuuuuucacgacuuuuucugauacuucuuaauuugacauaacguuaagucaaaaggauaaccugugaaauugccuagcucuccgaagaccucuccccuaucccuucuuucugugucucucacucucucugucugucucucucugacagucucaugcagucugggcuagccuagaguuaacauaaaugaaagaugaccuugaacuucugauccucucacucagacucccgaguacuggaauuaacagcauaaacuccauuuguuucgugaucaaaccuagggcuucaagaauaaauuccuggcuucccuugaugacuucuuucccaugcugaccuuguaaagaacaaucuuucaugcagugagcuggggcaugaggaagacguggguccaggagcuuggcuccuuuccaagcuccuaagauggaggaagauaaaucuucggacucuaaguggcaagcagauauguaauguagguuauuuauagauccacuuuaaaagugaagcuaucuccccugccuguuugcagccccacaucauacuugacacaaaagaccaggaaauucuucggccgugugcacacagagucugagaucuccacccuuccuccaugaagcaucugaauggugcacugacacaguaagaaugacuacagauucagaacuaaaaugacccagcaaaguggcugugcucagaggaugaagggccaggguccaggguccacugugcacaagguuuccaaacuguccccugcacuuccucaaccugugagaguccauuguaaauauguagccugugcugggugauuuaggcagcuucggggcagggaugguugcuuuuuggguugacugaagcaacaugucguugucaaucaggagagagcggugcagccuuugcuaaaggucaugguggaaggaugugagaaggagcgggucauguuuucugaggagaucuuguagagagccgucagaucugugauucuuuuucuccuuucuggcacugagaaucaaacccaggaccuuggguacacugggcagacacucuauaccugagccgcagcagugagucuuccauaaguuggcauggagguacaugcuugcaaucccagcacuuagaaggcugaggcaggaggguugcugugagacugaguccaaccuggacuacaugagaucaccucacaaacaaaacaacaacagcaaaaauucuucaugugagccaucaaaaaauauguugaaugggacacagacacaggcuaggcaggcugggagcaagccccaaggcucuuccugucugauguauaacaguuuccuuugauugagcuguucuucuaucuggcagggaagcuccuuaagcaggaagguaaacaggcacaaaacagcucaggaagucccugaaacugagcagauuuacuugucagaauaaacaaugaagacugcugagagucacucucagacaagacaagcuucagugaacacuugaaaccagaguagcugccuagagcugccagaaaccagucaaacugccuagaaaagguuuagaccaaccaagucacuuggaaagggcagucuccagccuggugaaccaccuguaggcugugcacugugcuauagguuccaagcuuuugugagcggucacccauccuggguugggcuuugaucauguaguugucuuggagucauuucugcucuuuuaaguaacccauacuccugugaguaagcccaguaaaacccaugguucaccaagguggacuuuggucuguugugggcucccuauuuggagcgaauagauguguguguguguguguguguguguguguguguguguguguguguauguaucaagacuccccagaagaagucuugucacacaacaugucucugccucccuagcucugcuucuucuucuucuucuucuuuuuuuuuuuuuuuuuuuucaggagacaggguuucucucuauagcccuggcugucuggaacucacucuguagacuaggcuguccucgaacucagaaaucugccugccucugccucccaagugcuaggauuaaaggagugcaccaccacugcccggcuuucuugauauuuuaauggaccguuuuuucccccuugaauucucagagcuguuugcagaaauggggcuacauuuauagaagggcagcauaaagccgaccauuacucugcacccugacuucuugaauucugcuuucuucuuuucuucaguccuuaucacaguccagccaucuagguuuuagaagugguuuccagcuuuuccugagccauuagcaagacacuagccacugcuaagugugugauguguagagauagggucucccgaaugucaagccggucucaaaagugccaagcaucagagggugguuuucaacuccugauccuccugccuuaaguaaacgcugcagauuugggacuuagucccuauggacaagcagcugcugggaaggaaaacucuucaggcuucucaagcccuacccuccugaggccaaaaggcucaaagccagaagcuuggagagacucugagcucaugguuugguuucuuuucuuuucuuuuuuuucuuucuuuuuuccuucuuccuuccucucuuccucuuuuuuuuuaaacuuuucaccuccuuccuuucuuuccucucccagcagggcaccuagguccuuguaucuuccauguaagggccuccucugaaccugaaccucuccccgaccuugucauggagggcuugagggaagguguggcuagagaacagaaucaguauuugucagcuugccuuucucaguagauuuagcauuugcucagaagccaacuuaaacaucuggaucaaaaccaggugauaagcuagagacugcccgucccuucgaccagaguuacuguuuguacccaagguuccucuggcugaccucuagauaaccgcagccauuuucuccagagcuguuccuggcaggguaaacuguucccuaaacuugagauaaaccaauuagagguuuccucuuauuuuaccaaauuugucucacuuuauaugagacagaaaggagagaaagagacagagacagagagagacagggagagagagagagagagagagagagagagagagaggaggcagagaacaaaaaccugaguugguuugauugcuaauagcuucacgguugcuaugguagcaagagcagccuccaucuacugcauuuaagcaucagggugggaaauaguucaguggucaauguuggagccacaggggacacucaaauaacgagaaaagaccaccaaagucagaaauaaaccaaaaccagcuuuauucacugagggaaaaugcuaaccaguuagggucgaggccagauucagagcugacagcaacgacccugaaaaagcaggaacgagucucccuuugaauuauaaaaucacaagcagauguucaggggacaauaaagaagaaauucauagcugguuaguccuagaaugggacuuuuuacaauaugaugugccuuuuuacaauauaggcccaaggcuacucuagggcaucggucuuaucuugacuuuuaugggguuagcgcaggccaggugguuuuacuauaagugagaagaguauauauggccugacaguucguaguaaaaugggggcggcagcagaugcuuggaguuacucugggcucuucauucccuccucugagcgguaacugaagcaaacccuugacccacucugaucauccucugagacaagcaccaagggagaauacugagaccugagcaccaugagcuuaaugcuagagagucuaccuuggauaaggugaaucaaaguauuaacaucagaaaaaguacccguaccgguccagcuauggccgauaucaacauaguuaaccugggggcaggggaccaacugaaaagucuaugaaaccaaaguaugauugcugccuuucuugucucucagugaggcuuguuuuuagcucuuguagagcauauuuugauaacacccaaaugguugauauagaaacagcaugauucaccaaggccgaacauaggccucccgcccccaucuuuuaggagcaguaaguuugauccuuuucugguuuggagucuaccuguuguuugagauaugagguugccgccugaaggcagagaggugaugguaauugguuuggcuggugauuaaagcucccagggcaguagagccagcugugccccgucccaccagcacggggggggggggggggggggggcaaggauaggagcugcucuuguaugucggagccucaagggggugccacucaauauucuguccccuuggggccuucauaauagcaaaccugugggauagauaaucuguacuaaaauacaaaguucgggcuauuauuacugaugaagagaccaggagauagacacugguaugguccaguggugcaggcaaaccaagauccccgaggggcagcuaacuggugggaguugcuuaagcugugggaguugcaggauuccuggacuaauauacaucagggcuucuaccugucaaugacuaaggggucuuauuuaaggggugguuaugggagugaaagugaguggcauuccccuggaugucccccagaauaagggggucucccagggacagguugucccaucagucagggacacugacuuugaaaguuuugccuuuugaaaggauggguuauccaggaggccuaacccuauguaaaaaggcaguuuaggguucagacacagccagcaaucagccccgagguuagcacugguagaauuaaggagagaauagguagccggugccaugugaaggagaugaguuagaucuaauguguuggcuuggcuuggagaagcagcacugcuugucauuggaaccaguugcauguaagggacaggagcuuugaccugggagcaaugucaucccauggucaacacccuucucuauaaucugcaugcccauguuauuccugcaucccagacaccauaaguccguggcugcuuccaugcuuuaaccaggauuauaauaggguuacaagucuggggcugagugcaggaauuauuaacagagguugaaauuguuagguggugguggugguggggucucgguuaaccccccaagcagaguccuaaguuucacaucccuaggaugggcaccaauacugguuuuguuaaauguuccuuuuuuugguuuuuuuuuuuuuuugguuuguuuguuaaauguuccuuuuuuguuuguuuguuaaauguuccuuuuuuguuuuuuguuuuguuuguuuguuuguuaaauguucuuuuuuuguuuuuuguuuguuaaauuuucccuuuuuguuuguuuguuaaauguuccuuuuuuuguuuguuuguuaaauguuccuuuguuuguuuguuaaauguuccuuuuuuguuuguuuguuuguuuguuaguuaaauguucccuuuuuuuguuuguuuguuaaauguuccuuuuuuguuuguuuguuaaauguuccuuguuuguuuguuuguuuguuuguuaaauguucccuuuuuuuugguuuguuuguuaaauguuccuuuuuuguuuguuuguuuguuaaauguuccuuuuuuguuuguuuguuuguuaaauguuccuuuuuuguuuguuuguuuguuaaauguuccuuuuuuguuuuguuuugguuuuuuguuuguuuguuuguuaaauguuaaaugguuuuaaaggucugauccuccugacuccacaagagcugagauugcacgggugaaccgccacgccaguuugcaggauguuuuggauggaacgcaggacgcugugcaugcuagggguuucgaguuuuuuguuuuguuuguuaaauguuccuuuuuuuguuuguuuuuuguuaaauguuccuuuuuuuguuuuguuuugguuuuuuuuguuuguuuguuaaauguuccuuuuuuuguuuguuuguuaaauguuccuuuuuuguuuguuuguuuguuuguuugccaauacugguuuuggucacugcaguugguacuaguggcugagggacaagcauaauaauuuuucccuugaaaccucugugaaaaacauuuagcuguugagggggcuucacgcucaggagagcuccuccucaugauuucgggugcucuacacagucagagaaacuucucuaguaacgaacuauagaaaugaucccugaaaguauagucuuggagcuuuacauucuucuuuaaaagguucaccuuaggcugugcggugguggcgcacgccuuugaucccagcacuugggaggcagaggcaggcagauuucugaguuugaggccagccuggucuacagagugaguucuaggauagccagggcuacacagagaaacccugucuugaaaaaaaaaaaguucacuuuagcuaggaguagccgugaugacgucacaguuggccauaagagacacggucggucuuuaaaaccggaggggccuuaggguauguuuggacuaccucagauaauaaggcgcccuguccaauaguccaaaagucuccaaauaaaggugcuagcaggaauuagggggcucucagacaccccaggaauuagauaaaaguaagccagaaaaguuauuuuggccuguaagcccuuaaucuuaucuuuagcaggucuuuuauggaguuaacaaggccaggugguuuuacuguaacugaagcuucgcuguaaaaugugcgcugcagaggaaguuacucugagagcagucaggcaaaccaggggcuucaggcucugaguucggauccucagaacuuagauaaaagcugguguggggucuuuuuaaggucagaucuguugcucuguauuguaaugcuaaauucuguacccagaggucuagacccacaagugaauucucucaagguuacaagcuuuuguugugcaaaccuuauuccuugauuuaaaacuacugguuaaauaaaauugauugcagccaauuacuggagggauuagagguagguggguuuuuugagugaccugguugugggguggaggagcaaggggaagaggagaaaccuugaggugggagaggagaaggcaccuugagaggagagguacggugagcggugagcacguggccgggagaaacagcagguauuuggggagcgccgcuagggagguagccagaccagcagauagaaaaguagacccuucaguaacugucaaggccaaauaaaagaaccauagccugagucucauuuguaagcuagucagggauaaacauaaauugguuguaccgcagugucaccuguuuguaaccccgggagcuugugaagcagagacaggcaaaucccaggggguucacuagccagacaagguagccaaaauggcaagcuuaggguucagugagagauccugucucagaacauaaggguggagaaagucaucccgaagucaagcucuggucuccacaagugccugugccgaugagucuuccugugugcaaacacuacaugcagugcacagacacacacacuaggcaguauacucuccugaggaacccuauucuggagaaguguguggaaaacgaagccaugccacagcugaacuauguuucagaagcauucugacgaaggaaggagcuggcgauguugcucaguuaauccuaucaugaaagaugcuccacgcaugcgcgaaaccccuagcaugcacagcguccugcguuccauccaaaacauccugcaaacuggcguggcgguucacccgugcaaucucagcucuuguggagucaggaggaacagaccuuuaaaaucaucguccucuccauagugaguuugaggccagccugguuuacgaaaggcacugucuuuagauaccuaggggaacaaaagaauuguguuuguuuaaguuuagccugggacaagucucugguagagugucacugaggucucuuuaugcuucuguugaguaguuuauuaaugaggguucugaugguucagagauuagauuugaggaugacuuaaagccagaagggagaaaacagagauagaaucaauugucaaagaaauucauuaggagccaggcaccaccacacuggaagugcaggcgggaggaccagaagaugcucuguaguagucaggacuaaggagaaccuguggagauaaauacagcagcaacugacuaaacaggcaaagagcugccaaggcaauguccuuaagcagaugccauugucuuaucuaguacagaggugaagguggagagaaagagacagagagaacacgugagugagagaaggaaccucccuacuuugggccuccccucccccacaccccacaccccccaccccccaccccgcccagcaggaucucagucuguaagcuaugacucagcauggaaagaucuaccgaugaaccgaccucccacaaagcucuggaggacagggcagucucuuucccggggcccagcccagagccacuccaugucccauggcuuccucccuacaccucuggcuccaggccuguccuggagaaacacccuggccccucgaagucuccagccucacccagugcugucugacuugagagagaaaugcuauugggaaacagaugacuucagcccugggaaggucugguauuucuguguaaagguauuccggagucaggcuucacccccaagagguccugaggacggcugaugucaacccaggaaguucaguuauuguugacuuucaaauuaguuggcuuuuauaagacaggagcuaggagccaucuguaaucacccgcuggcccuuaauugcccaucuauaaugugaauuguggugcucucugugggaggcugaguuguccuaaaaaugugaagccccuauccccauccuaugggaugcuacccuauguguaucgugugucaggguuagucccuugggcuaccauauggaauaccauagaguuauugaaaagagaaaugcuggugugagggcccagagauugguuaagaauauuuguugcggggcuggagagauggcucagcucuuuuuuuuuuuuuuuuuuuuuucucgagacaggguuucucuguguagcccuggcuguccuggaacucacucuguagaccaggcuggccuugaacucagaaaucugccagccucugccucccaagugcugggacuaaaggcuugcgccaccaugcccagcugauggcucagcucuuaagagcaccaacugcucuuccugagguccugaguucaauucuuagcaacuacaugguggcucauggccaucuguauugggaucugaugcccuuuucugaagauagugacaguguacucauauacauaaaauaaauaaauaaaucuuaaaaaaaauauuuucugcuuuugcuggggacccagcccccacaggguagcucacaacucccuggaguucuaaucuggggaauccaaugccuucuucuggcuucuuucaggcacaaggcacauaugugauaugcauucuacacaaaugcaaaacacauauauguaguauaaaaauauauaaaucuuuuaaaaagaaaagaagaaauguugaaugugcuggugcacuuuuggagguagggguagaaaaaucaggaguucaaagauauuuuaguuacaugacaaguucaaggccaacuugagauagaugaaacacccuccccccccccccccccccccccgucuuaaaaacaaacaaaccaacacucgggggcagaugaauuggugcaaaacauuaaaauaaauaaauaaauaaauaaauauuaaaaaauaaaacaaaaaaccccacuucuaccucuucccuuauuuuuaaaauuaauuuacuuuuauuuuauguuuauugguguuuagccuggaugugugucugugugaggguauuggagaauuacagaccagguggugguggugcaugccuuuagucccagcacuugggaggcagaggcaggaggauuucugaguucaaggccaaucuggucuacagagugaguucuaggacagccagggcuacacagagaaacacugucucaacaaaacaaaacaaaaaaagaacuugaguuacauacaguugugagcugccaugugggugcuggaaauugagcccaaguccucuggaaaaagcagccagugcuuuuaaacacugagccaucucucuuuuuccuuuggcccccuccucuucuccccacaccccaucauugccuggcugccuucacuuguuuaaacccuaauuuacagugguuguuuuuuuuuuuauuguugaggcagugccucccucuguagcucaggcuaaguuagacggaacuuaugcagccaaggauggccuugagcacaugaaggcccuccugagucccagugcuggguuuuaaggugugcaccaccacugccuggcuuuuuuuuuuuuuuuaagacuuacuuagcuuuaaaaaaaaaaaugugucugaguguuugccuggguauauguauacacagcgugugcucauggaagucagaagagagcacgggauccccuggaacugaagugacagacaguugugagccuccaugugggugcugggaacuaaaccuggauccucugcaggaacaagcacacuaacugcagaagcaucucuccagcccccgucuuuuuaaguaaggcguccccaagacuuauuaagagaaggugagauaaaugcucaaaagugagaagagucccaggcagccauaccccaggcuccuauauuuauucuugugaaaauaagaagaaaaaucguguguguuaaaacauaugugugcacgugugcgcgcacagcacacacacacacacauuguaaaagagccauccgaagaggaggccagaagccauuuggaagcaggauacccacccucugaagaugaacuuuguuccccugaacccucugauugcagggauaauuacagugcaauagauugcaauagauaauuacagugugucugagccuuccaagugugucugagccuucuggguccagccgcagagguaagcagaugccugccucuaggcaucuuuaaccaggucagauaaccucucuucuuccucuacgucacaggacaccuguucuuccucagucucuacaauuucuacagaggaaaucucaccguuuuuuuuuuuuaaacuuguaucaauuuuuuaaaacuuguaucaauuuguaucacccaguaccucugcccccuuccccugccuucuuugggacauugcaugagagccguaaggacucaugucuaccugauuucaacucuugaaauccuucacgguuuccaguguccagcugacugacagugcccucugaggguuaaguggcuuacgaaugcuaguucucaugggagcuuccugacacaugcaagcaguggguagauggucaucuuaacuccauucuagguaaggagugaggucauccuuaaaccgcagaggagagacuagaacucucuguccugcacacucuugcaggcauaaacccuggccggguuguguccgaugccuguggauaggggauuaguccuccacagccacuucccaagguucaguagagcuuuggacacaggcugggggcucauggcucugaaucauguuuauugucaccauagccuagaaguggauggaggucugccuggccuggugcccgcaccaggggucugucaccugcccuguccucuuucccccagcccacccacugcagcuccucagaaaggcugccaucagacauuuaagccaguaggcagcuuucuaggugugacaugggccugugcccuuguaggcaggagcacaacacacagagaugaccauguguacuucuucaggugaaugagggaggagagggaagagggagaggaagaagaggagggggaggaagagaaggaggaggaggggaggaagagaaugggaccugaugggaucuaguccagucuagugacaucauucauucuugguaguguagggucagacccuugaugcgucaacacaguuguaggcagccuccccugccugucuuuccaacaagggcuucaguaagaacaggggagggaaggaagguagaaaaagaucauacccaaacaagaagcaacuuaauucauuacuaauuuaaaauuuguaguuguuuguuucuuguggaaggggcgggcacaucacugugcuuguguggagaucaggggagagcaggugggaguuagguucuccuguuguguauucagacucacucagguuaucaggcuugguggcaagcaccucuccuggcucucucucugucccuuaguuuacuauuuuuaaauguuuuuacauuuuuuuuuuuuuuuuuuuuuuuuuuggguuuucuagacaggguuucucuguauagcccuggcuguccuggaacucacuuuguagaccaggcuggccuugaacucagaaauccgacugcuucugccuccccagugcugggauuaaagacgugcgccaccgcgccuggcuauguuuuuuuguuuuuuguuuguuuguuuuuugguuuuucgagacaggauuucucuguguagcccuggcuguccugguacucacucuguagaccaggcuggccucaaacucagaaauccaccugccucugccuccugagugcugggauuaaaggcaugcgccaccaacacccggcccggcuauguuuuuacuuuuuaauggguaugaguauguugcuugcagguguguauguguauccccugcaugucuggugaccacagaggucggagagggugucagcuccugauugugcacuacugugugggaacuaggaaucaaacuggggcccugucugcaagagcagcaaagguucuuacccucugaguccucuucaacuuauuaucuuuuaacauguagccacagcuggucauggugguggucaugauggaacaggauuuaaucucagcacuccugacaacaaacugggcggugugggacacaucuucaaucccagcacuguaggcagagguaggcagaggaucuaugaauuugaggccagccaagucuacagagugaguuccaggacagcuagagcuacucagagaaacccugucuaaaacaaaacaaaacaaaaacaaaaaacuggggcuggagaggugacucagacucuugacuguucuuccagagguccugaguucaauucccaguaaccacaugguggcucacaaccaucugaaaugggaucugaugcccucuucuagauagagugucugaagagagcgacaguauacucauauacauaaaauaaauaaaucuuaaaaacaaacaaacaaaaugaaagaagaggaggaaacaaaaagagagaaggaagaaaagaaggaagggcucuuuaccagcucuucaaaccagucagagcaaggaugguuuucuagcuggaaaccaucacuuuguggcucuuacagugaggcaagagacuaguccucaacugcaaugugucuuuguugaccccugaaagcccugaaggauggcgcuucagaaacaaaguggcagguugggcuuguugcuacagcugggucagggaagcaaggagcucaagcuagccaaagccaucugaaauccuguuccuaaaacaaagaagggagggagggagggagggagggaggggagaaagggagggagggaggaaggaaggaaggaaggaaggaaggaaggaaggaaggaaggaaggaaaggaaaggaaaggaaaggaaggaaggaagacagauaagcagguaggcagaaaccauuaaggcagaaauaaucaaauucugacaauacaguaguugccaucacuagccuggaaaagcaucaaaguacugcuccuugggucuauuauuauuauuauuacuuuuguauuguuuugggacauagucucacaaugugacccuggcccaaacuccagacuguccuugaacccaaagagauugaucuaugugccucuaccaccagaacccuggaauuaaaggugugugcugccaucccugacuguugugguuuuguuuguuuuaaggcagggucuucugaaccuuggucuguaaaccuaaacauguagccaugaaagaccuuuaaccucugacccucuugcaucaggcuuccaaauaggauuugcagacaugugccaccauaccugacuuauguggugaucaauggugggccagcgcucuaccagaacugcagcccuggucucuggcuaaugcuuuucuauuuauuauuaugcuuuuuuccccccaagacagagcuuuuccauguagcccuggcuguccuacaacuugcucuguaggccagacuggccuugaacucagaaauccacuggccucugacuccugaguguuaucauuaaagacauccgccacugggaagcucuuuauuuuuauuuauguguacaugugugugugcaugauaucugccauguguggugauacucuuagaagcuaguagggggcacuggcuccucugaguuauagguaguaugagcaaucugcuaugggugcugggaagccagcucugguccucaaaacuggcagaaaugcucuaagcacugagccaucucucuagcucccugacuaaugcuucuugaucuaccaaaaccaaucacuuccucuggcaucaaggaggucuuggucugucugaggagaauaagccauugcuacaugcgguaggaaggaucugacaggaagaagucuggggaggcaaaggaacguggaggaagucagcucaguuugagaaagaguggggacauuucuagagaaauugaugaguaaggagaaacugaguaacgauuagucagaaaagaagagaggaaggcgagcagcaaugagaaaggcaugugaugcauucugggaacuuaacaccuuagcaacuagagcucagggcgaagaaggaagugguaugauuccaagguagagggggaagcaagggggugagcaagaacuggguaagggaggccuggggucugccuuuucccagagaauguuacaaccuuucaaacaucaaagggagagaaaccaauuuauagucuagaaaauuccguaggaggcaaggcuaaacacacaucugcaaucucggguguuugucugugaugggaggguuguguucaaaggcaucuugccauuuagccauccccugggucagaauaaagaaggaagggaugaagggagggaaaagggaauguuagcccgaugguaggggaggagggugucgggaggagggagaaggggugagcuggggacuggagagaugacuuggcaauuaagagcaaucaugaggacuggauuucaggucccaucaccucuggagaacgugacaaucgccucuucuggcuuccaagcacacacaggcacacagacacuccucccucaaaauguauucauucucucaugaacaugcaugaaagggggacaggacgguucacuggagaaaggugccagcugucgagucugaugaucuaaguuugauccugggacucacauaauggaaggagagaauuucuacacguugaccucugacacaccccccccaauacauagugguacacaugcauucuacccuacuuccacauacacaaauaaauaaauguuuaauaagaaagguugggaauuggcaguggggaaaguaguguguacuacacacacauauauacccacagucacagacacacacauacacccacaguuccacacaaacacauauacacccagucacacacacacacaaacacacauacauacauacauacacagucacacacacacaaacacacacacaaacacacauacacaaacagccaaaggggcuccuuuggugacuaagccggugaucagggaccacugcagcggcuuaagaaaaucccucuuucuacugagccaccaguagcguuccucacaaggacugcauauugucggagaagcuggccagugcaggauaggaggcccagauuuacacucuauggauacagcccccauagggagcccacaggaaaggcaaacaggucuugcuagguaucccacaaaagcacuuuugaguggaaauaaaaccuccuuguccugucaggagaagaaguccccaaacccagaugaggcuagaagcgcaagaacuuugaggcaaaugcuacuuguggguuuuuuugguuguuguuguuguuuucuccucuucuagacaaagccauuggguucaguggucccuccggaaggccagucauuuccugaggagauaucaggccagcccagaccucauuguucuugguuuccagcuauggccgccauuaccugacaaguaccagagcuggucucugcgcgccuggagagguugucagaguuguuucugcuuuucacacagcaggcuucuggucuguggcaggcaagagaauucugccccugaggcauggccggaagacagaacuagcugagugcuucagucugcagaagucuuucaggauucagcugaggugggccucagucggcagacaagaugcuccuggcucugggacucacgcuggugcucugugaguuucuaaccugcuuccuucuucccuucuuaugagacuugaauucgugaaaucaacagauuggcuuucuuuuucuuucucuuccagaugcaagccuccaggcugaggaaaacuguaaguccugguauuuucacauggcuuccuucuuugugucuuuucugaaauuaacucaugucagacugcuuaggguugguguuuacaacaacuaagaaaacucucaaagccuuguucuaaaucaagguucaaagaguguguauuagagacagcgguguaggagaaaauugcugaacaccagucuuacaucuugguggguuucuguuuguuggaaugggagagauggguuuuuuuaaaaaaauuccuuauauguauauauguauauauaugauuccuuauauguuuguggucuuucugucauaagcuauuucuuuuuacaucauacuaugccucuaauuguuuacuuucaaacucuucucuuuauucgcuuggauuuagagucuguaaucccaguacuuggaaaacagacacagaaagaucaguagugaaguccagcuucggcuccauaggaguuugagggaggccugagcuacuacgugaaacaguacaaaaccgacucccaaaaaauaaaaacuuaaaaaaguauuuuuuuuuccuuucacuuguuuuaauuuacaaaugagacucaguugacuugacagacuauggaggcugaaggagcagacaguaaaugggugucaggacucccucuguccuaagagaguaacaaaaaggaccagccagauccccuuucccucccaccggggaggcuccgcuccuaucugagcuugcuuguggggaaggguucugccugucuuuaaagucagaccuaucauccacucgagagcugauucggaaccuccgaauuuuucagauuaagaggaucugucucgcuccguccaucagagacucugaaggaagaggcucagcccagcccagggauugugggucaggaagaaggccacagauuacacuggcucagucaaaaguuauuccagugugggaagacuagggaugcugggcugcaggcauuuuugagcugaagaacgugacagggcugaguugagccagggauggagcuguggccccaggguggggagggcuguggucugugagucugugauuccuuaggcuucuggcucccuuggcaacaccuggagacagacuguguauugucuucaagucauccccacuaaagggugggaugggugagccucagaaagacaugacucagccuagaaugucagggcuugucagcacuacggccuccgcucccuggaacccagacaucucucuggggcuugugcuuggcuuuacuuagcuugcucugguuggggacuggggucucacacugcuaagguagucuugaacccacuguguagcccgggcugccuagggacuaacucuaacuccucuugccuuagccuccccaauacuccccagccuggugucacucagccggcuuggcuuugcuucuugggaccuuuuuccccugacuauaaaauggaaaccacccacagaccugguggcucgagcaggguaaaguugagauuggaguaagggaggaggagucauuugugcugucuauaggauuaguaaaugaucccgggcaaucaccccagcccuccuuuauaguuuaaauuugugcccuauuugcucuguacccuuccgugcccccuauccccacuccaucucucucuugcccucagggugucauauaccugaaacccacuguguagcucagaugacaaugacuuucagguccuccuacuuuccucucccaagggcugagauuauaggcacacaccacaccagguuuaugcagcacuggcagucaaacccagggcuuuaagcaugugaggcaagcacucuacugacugaacuacaucccagcacucucugucuccugucuggguucugcccugccagcccuagaggguucuugcaucucaagauccccauagcuugucucccaucucugugucugucucugucucugucucugucucucucucugcuucacaagacaucugcuguaagaaacauggcccagagaagcaggcaauagacugaaguugcuuuguuggaacuggaaggagccucaaccuuccccagggaugaaggaugaggggcuggggauguguguguguaugugcacacguagugcauauguaggggugcgugugugugugugcauguguguauaugcaucacuaccaggaaguuacagcuauuuuuuuguaguuggacuggaagcaggguggguucuuuuugauacuugggcaccuuguuucugcagguggagcugaccagucaggcuggggcggagccauucuuuauggcuaggacuauugcccagugcagccugacuuaauuccucauggccugaggcuauuauauaauauauucccaaauaugaaaggguaaaaagaagaaggggguggagcugggcaugguggcacaggccuuuaauccuagcacuugggaggcagaggcagguagaucucugugaguuggaggccagccugguguacaaagcagguuccaggacagccagggagggcuauuacacagagaaaccuugucucagaagaacaaaagaaagaaagagaaagagaaagagagagagagagagagagagagagagagagcgcaaaggcagggguacagagggaggguuguaguuuugggagggagggcuucuuccagcuagaguggggugacagucccagugguggaaggagcaugcuaaggucccuuccaggcaagauagugguuaguaguuuuuagccaugaagggccgagugacccguugaaagaacuuuuggugagacaguugaaaagacagagaccaaagagccaaguuaguacaaccauaaugauugagucugccaagggggugaccauggcccccaaguaguccagguguccucaaggaggacauugcuuacccuuccuugcuguuggagucuuucuaggaacuguucaccauuuucccauaguacaccauguugguuugcuuagaaauagccuucuuccccugggaaggcacagaugccuugcuuuggaaggcaucauuaagccuagucauccacacuucuggaggacacugcagccaguguaucuauuugauuuugguaggaugacugguuuguuguagcaagauuaggucuuccuuaauccgauugaucauuugaggguguugagcccuaucgcuugccguagcgagcgagccauugggagggcuuuccuaggaccucuuguuuuaguagagagggaaguucagagcguaaaaauacuuaaaaagaguucugugacggccaggguuacacacagagaaacccugucucaaaaagaaggggggaggagggagaggaggaagaaaaaagaagaaggagaaggagaaggagaaggagaagaaggaggagaaggaggagaaggaggaggaggagaaggagggggagggggagggggagggggaggaggaguggaaggagaaacuagucagugcuuuggugaucaccuucagccuucgaaggaaggugcugacaucccuauacagacuagaacaaaaaaauugcagccugugagugaguucaugggggcuuugagaugggaagggccccuugauuaguuuagagaaccauuucccucuugcaucagcuccacaagguagaaguaggccuaaugaggcgccugcugaccccucugaucccugcuauauauauuuuuuuccaucuaggccacugagauugagcucugcagggucaacccuagggauaagcaagcaagccagugucuugcuuccuaggcuacccaaguggaguaugugaaauguagguuuugcaguuuuucuaguuuauuuucccccacucuacaagucagguucuugcuaagcguaacucuuuuuuucucaggccucagguccaccucagccugccucugccuggagggaacucccuggacuucccgccuaguccuggccacuggcuaaucugccuucccacccauccugcuggcucccucccgugucagagcgcaggcacauucccucaagcugaccaggccccugcugggccaccuggaccugagccuauaccuccuucaccacaaggacccccagcccuggcccccaguuacuuccacucucgguggaccucugaagcuaguuuagaauggccaccucugcuuccucuggucauggccucucugccuggaaucucagcuccaccaaagaccaccugaugccaagccuuuuccaucccguaacuuuugcugcccuugucuaaagaucauaaggggauccugcucuccugacuaaggauuuccuuccguuuccucucccucguaaacccucuuuccuugcccucaagggagacugguucugcccagccccuuccuuuccugucucuagagccuccggguuacagugucuccauagccagucucugucuucugcaugucuccgucauacuggucucuccccugacccucaggcuuuaauccugagccugcaguauguuuaucugccaggccuucagauuuccccuuagaagcaaagccuuccuuuuucacucuuuuaccugacauuaucaguagccagcaaacugucucccauuuuucaggucccauagucaaucaaauuaggcauugaaaaguugugguaaaauauaaucuaaaguuuauuuuuuuuuaaaucuguauucaucuauuuauuuuugaggcaaggucucacuauguagcccuggcuauccuggaacuugcuuaugcaggccaggcugggcuggaagucagagaucugcccaccucugccucuucagugcugggauuaagggcgugugccacuuugccugccuuuaaaauauaucauugacaucuagagcacguacagccucguauaguucuagaagguuuccaucacucuagagaugaagcccuuucgguucuuuggagaacucucuuagcucagcccaccugccugccccucccccgccguuuccaucugauccgccccuggcuacucacuagccccuggcugcucacuggcauggagucugaggccauggugauuuuucuagaacuccgguaacuucuggcauuaccauccugacccaccugaccccuucucucccacacuccgcuccugaaacuggccacgcccagagugcacagguguuuuaugcuccuguuccugauacacgcuguucuguguucuggaguacccaacagcuggccugccgcuggcccaguggacucgauccuccccuccccccgcccccgcacauccagcacgcaguccuugcccucucccgggcaaucccuuccucucugcauaacugaguuauagccaauuauccaccagccugcgcgcucaaacagcaggagucauuucuuauuuuuccuggaccccccccccccccaguacccggcacaguuggauaaaugucacauggcugggaacuugaagugaacuuggagaugccugagaguccccagggcagaugggccagccuguccugugauagcaaggaagugccucagggcuuccaaggagcucuguaauuuuccugacaaugguagguaguuccucuuccccucugagucauuuccagguugagagccagguggcuggggguggcucaucauacuaagaggaccuuaauuugggaaggaagcccccucauuaaaccguuaguauuuaacauuguuuguaccccuccuccucccccccccccaaccccccagacaggguuucucugugaagcccuggauguccuggaacuccaguuuguagacccuccucucuuagaucucuuuaggcuguucugugcccuguuggccauugacuuuuuugaacaguuugaggcuugaugaggagcauggggugggggugggggcauuguccauugacaggaggucugugggacauuuccaauacugugcacaccuagagccuugggcccccccuugccgugaauaguccuguauccuggugagaccucugugcaguuucagugugcuucuccucggagggcauguucuuauagcaaggaguaagaauucuguuuuauagacauggagaagucucaagaucugcuggcuguauuauuauuauauuauuuucuuauagcaaggaguaagaauucuguuuuauagacguggagaagucucaagaucugcuggcuguauuauuuuccuguuugcuugauuuugcaaaaucaaagaccaaagaacaggacuggggauaugccucagaguucaucuggcauguguggcucccugguuuugaucccuaaagccacacauggugguacaagccuauaacacuaggacuugggagauagagacaggaaaaccauaaaguucaaaauccuaccuaauccuuggcuacauaguggguucauggccaguuugcucuauagaacuauuccaggacagcacagagaaacacugucgcaaacaaacaaacaaacaaacaaacaaacacucagugcagugcuuccucagagagccgaaccugggagguuggacuuucuagggcugccaagguuacagaguggggagugcccagccaaacucaguaucuuuguguuaacagaaaaugaaaggggcugggagaggggugugccagcucacacuguaguccccguacuugggaaaccaaggcaggauugugaagaguuuaaggcuagccugagcuacauagcaagauuaucuuaaaauaaacaaauaucuuuuuuaaaaucuugaauuauuccaagacucuggcuggaaguaguauaaacucagcaccucacccagucuuguggguaacucuggcucacaaucuugugaugauagacccuuuuggucaaggucaaaguuguuccacgaaggcugacuaagccugggugucugcuuuugagcugacuuuuguggcuacacugaaggccuccguucaucauccugugagacaccgccuucuuagcugcucuugcaggaugugacuuuugacccagggcugagguccuggaggagagagcuugacuagauggaagcuguacacuaacaucaggaggaguguccuggcuccauugggggagucaguccugugauagccuugguauggucaugugggagauguaacagggccgagggcuguuuuggaggcugucuagggcagagcggcugccacguuaucgaagcugguuauguucuccguuagggcuuggccuggcucauuugggaaauuuucuuuauuuaaaauuuugaaugcauguuuauuuagugugugugccugagcuugugugcagccugugaggugcuuuuagaggucagaggauaacuugcaugaguuaauucucuucuacccuguggguccugggauuccacaaacucaggcacagcaguaaguaccuuugcuugcuaagcugucucaacggcccuauuuuuauuuuuauuuauuuauucuucauguguauuagauggucgugagcugccaccaugucagugcaugaaauccuaguucugcaagaacaagugcucuuaaucaccgagccauuucucuccccgcacccccaucuccccuugaggcaggguuucacuguguaauccugccuggccuggaauuugcauuguagacccagaguggccucaaacucuuggcaguucuuucuucucugcuuccggagcgcuagaauuagaggugugugccacagcaccuggccucuugaguuuucuacaagguuucccccucuuccguccugugauacuccugcuggcugaguggcgacaugagguuccucccagugauccaggugcguguuacacaaguggaugugugucaaagaaaucagccgugucaauaccacccuccuuacaaaagccacacauuggcuggagagauggcucagagauuaagagcacugccugcucuuccagagguccugaguucaauucgcagcaaccgcaugguggcucacaaccaucuguaaugggaucugaugcccucuucuuguaugucugaagacagcuacaguguacucauauacauaaaauaaauaaaucuuaaaaaaaaauccacacaugccaagugugguggcacaucucuuaaucccagcacucaagaggcagaaacagguggauuucuguaaauucgaagccagccugaucuaccuuaccaguuccaagccagccaagauagugaguugcugucucaaaaacaacaaaaagccacacuuggugcuuuaauugagguuuuuuuguuuuugguuaaaccuagaggacaguucgaguuugagaaaaaugacagaacagccaaauuauaaaauuucaggggaaugaaggagagagcaagccaugccuuuugcaaugggggguagcgggcagcagcgaggcagagagcaugggggccucggaggcugaugcucaggguauccccuuccagacuuugaucacuaucagggggaagaggaaauagaaaaggagggaaaugacaaggccggaguuguagggugggaugcuucagauagcugcucacagcugccuggaggccggagacuuccuuucaaagaaagacaagucccuucuagcaugucuuuauuuagguggaaccgaauucccuuuggggaagcauuccugggauuccaacugaugaacugggcugguuggauugacaguagggaagggaagauagggauggcacaagaguuaagaguucuuacuacuuuugcagaggaggggugcccagcagccauguugggcagcuacaacugcccauaacucuagcuccucuucagggaauggacaccccuuucuagucuccuuggacauugcguuaauguacauaaacccauaugcagaauacacacaugcacaugauaaaaacgaacaacggaaggaacaauaguaugaacaguaacaguauguaauguuuuguuugaucuuaauucuuuugcaucuauuaugaagugggggggggggcggagggcguguuguugacccacucagcacuguggacagugccuggccuggagaggccccuguaguguuuccuauaguuguccugcaaugugaaggagagaagugauuauccaugaggcccaggguuuguuauuaccacgggcaccuugccucagucaccaaaaaauacggagguaggggaguggggcuggguaagguauggcucaguggccaagugcuugccuagcauuugaagggcacuggcgucaauuuccuagcaucaagagaaaaauaauuaccaagaaaugcagaugugcuagcauuccuguuucaacaaauagaagcaaaaagacuacaggaauuaaaaauaaaaaaaacaacuacuuccaaauagccaggcuuaguggugcacaccuuuaaucccagcacuugggaggcagaggcagguggauuucugaguucgaggccagccuggucuacagagugaguuccaggacagccagcgcuacacagagaaacccugucucagaaaaacaaacaaacgaacaaacaaacaaacaaacaauaauaauaaaacaacucucaacccuaucuagcuaaaggagacuguucaggaugcugucuguacaguagcccauaacuaggguggagaccacacaguaugagcaagucugggagccuaaagaacuuaccaauuucuuuauuucuggcaguccugaggaccgagccgaggacuuuaugcaugcuagguggguggucuacugcugauccacauccccaguuuggagacuauguuguuacaaaucguucugcauuuaauaaauuucuagaaacagagaagagaugaagcuuugaaacucccauuuauucugugacagauagaccccagguaccauuucccaggcguuuuccuggugcuaagaacgaugcugugucucccggagggugugugaugcuugccaaguaugcuacacucagaguuguagguucacuccucagcaucucauaagccaagugugguggugccugcccgggacccaggaggauaaagggcucggggucaucccucacgacagacaggaugcaagucugggcugagugggucccacugcugacaacuguggguugaguaacuaacggcccuucccacagcagagcuggccuguggccgcucauuuccugguaagaggucaaaucuugagaaugucucacugggucguuucugaauuucucuauuuuauguguguaugaaaauccacagugaauaguauagcauaauuucaucauuucccuguuuauauucauauaaccucuuggaggacauaaacccaugaaaccuucacaaagaagcaaacagggcaugaacagccaucucugcuuugagaaguugguacauguggaaccuccaguuagaugcucuauuuacacaacaacaaaacccaaccccaccccgagaggggggcucauuauauagccaaucugaccuucgacuucucccacugagcccuggccuuggcuuuauguguuguuguugguggugguguuuuuguuuuguuuucuuuuuucuuuuguuguuguuguuguuguuuuucaagacaggguuucucuguauagcccuggcuguccuggaacucacuuugaagaccaggcuggccucgaacucagaaaucugcuugccucugccucccaagcguugagauuaaaggcgugugccaacaccgggccggcuuguuuuguuuuuugaggcagggucucaguauauaggccaggcuagccucagacuugguagcccacugcugaccuugaacucucagucuuccucccuuaaccucaccaguaacucagugaaauuagagaacuuuuggauccaagcaggagacaaccaaaguccguuggugacuucugaggauucggagucucgcaaugagucagcugugcucacuggccuagcucuugucuagcgcugggaaucccagcucucagguuuuauuuucacuaucucuuuuccuggugcuggaguggaacccagggcucacaugcggcaagcagauagaaacaugcccucuucuccucucuaagacaauuuugugauuguuggguuuuguuuguuugaggggggggcucuguucauuuguuuaccacuauguuaaacuguuuguguguguguguguguguguguguguguguauguguguguguguguuuguuuguguagacaggguguuaguuucuucuuuacuuucuuuuaaaaauucauuuggaggaggacagcuauuccacacguaugaaggucaggggauaacuugaugaugugggaccucuccuuucaccacuggcuuccagggauugaacucagguccucgggcuuaguggcagaugccuuugccuggugagcccucacacggucccuuuucguuuuaaauguagugcuggggauuguacccaggaguuucauugcggauguuaaggaaguacucuaucaacucuguccccggccaggcaggguuuuacuuuguagcucaagcccuugaguucacaguaugguagucauggccuauggauaguuuccucuuaccagguaagaacaggacuuuuagagagccuuaucuaagccauggaacucuauguuuagcuggcacaacuucucuguaccugucuuguuagaguuuaucacugcaaugagacaccgugaccacggcaacuuguaugaaggaaaacauucgauuggggcuggcuuauuagaguucagaagucuaguccauuaucaucauggcagggagcauggcugcacacaggcagacauggugcuggacagguaccugagaguucuacaucuggauccacuggcagcaagaagugagacugaaccacugggccuggcuugagcauuggagaccucaaagccccccccccccccccaaugacacaccuuuuuaaacaaacccucacccacuguggggcccugaaagccaugcaaccugcugaacucuucuggaguaagagugagaucaaaauucauucaaaacccaaaaaucucaucccugaggccaccaggagcaggacugcuuccucccugcucugggcuaacaugucuaggcaguguacguagccuugggaccccacagucuacuccagcgaggccucaccucuuaauggugccuagcaguaccuggcaccuaauaccugauauccuccaccaucucugguccuugaauuucucacagccacaugcauuuuggguuuccccuggucaacugcuaggcuugaaggugucagucacccuaugugugguguguagcaugcuaucucuuguguaaacaggccagaggaacuuccucuuuggguuuucuuauguguacauguaugcucuaugcucacugggagccuccugccucaguuucccaugugggauuacaggugugagucagucacuacgcucagcuucaaauuaucuaaaaauaaaaucaucucuaguuguuguuguuuuuuuaggguuuauuuauuuuauguguaagaguguaagccuucaucugugucucuguaaaccuggccuagugaugcacgccucgauccccucauuuaggacaccgguucucaacuuguggggucaagaaagaccccuucggaggucgcauaucagauauccuugcauaucggauauuuacauuaagauucauaacaguagcaaaauuacaguuauuaaauaauaaggaaaguaauuuuaugguggugguggaggguuaccacagcaugaagaacugugucaaagucgcagaauuaggaaggaugagaaccacuggcuuaggagguggaggcaggaagaccagaaguucaguauauaaguuauguauaaugaguuagaggaagugcuaggcuacaucaaacucugccuaaaaaauacaauaaaauaaaauugguuccaagucuuccccagcaggcgacaccucuaaagugggucuguguccuccccgccacuggucacaaccucuuggggaggcagauguggagaguuugacugcccuuaucccauuccagugcuagggugggugcucagagacaucgcucuggggugggaaagcacagucuuaaaugugggaaugugggaaagucggagcugguuccaucccuggagcaggcaggggcugagggggucuucugacucuuagacacccaggcgcugaggggaaugaaggaggaacugagaacugagucaggggcccucgggcuggggacagugucuagccugggguggaagugggggugggagcacuggcuuaucccagcgguguuuggaggcgggcuugguggcaguuguggcuagaagcacggagaggccuucugugguagaauuaagcugugcguucauagucaaaugucuucucugugguuccccgaguuggaucuugagggaagagacagucugugguucuaaacaguuuauuguuccuucauggcaaaaaaauuagauacauaauauaccaugcccaguucucaggguggaccuuuuacagggaggaacgucugggaagggaagcugaguggcuaagcccucugggccucuagguaccucauuagcauagagagcucuguuuugggccuaggugacccuuggacacguuucuuuucugugaggaguguguuccaggccaggagucuggcagggagcgggaagucaccuaagccuccugugugugccuacugagucuccgggucucaaccugcucuaccuucucaaacuuccugaccagguuuuacaucccacacucugaggccacucacuaaauggcaaacaccuacuggcacaacccagggaguuuauuguuuuuaccugcauacgucuauuucagguaaugacuguccuuuuaaagccuguucuuccccccccccccaaggugcuuucugaaaccacagcauacauacgugaucucugaccuauauguccagccucaacauacauuuuuuguuugugguacuagggacugaacccaggccauuuuccaugcuaggcaaacacccaacccgugaaaugcauccucggcccucccucaacacaucuacuugucugucugucugucuauuuuaguuuguuuguuuguuuuucuuugguuucucgagacaggguuucucuguauagcucuggcuguccuggaacucacuuuguagaccaggcuggccuagaacucagaaauccgccugccucugccccccaagugcugggauuaaaggcgugugccaccacacccggccagagaaagcauuuuuaaauguuaagaagguagagagucaaaauaaggcaaaggaagcagucuagugugguggcacacaccuuuaaucucagcacuugggaaguagaggcagggcaaucucugaguucauggccagccuggucuucagagugaguucuaggacagccagggguauugggggaggagguaaaaaaggaaaaggaggaagggaaagaagaagggguguaggaggggggagaaacagggacaacuagaaccaugggugaauauuccugggcaugucugacuuuaugacagagaaucacuguuucuuaagcaacuacuguguccuguguacacauguauugcaugcuuccuggccacaacaauuuaagaaauaacuccuuuuaaaaaaagacuuauuuugugugugugugggggggaagauauguguaugguguguguauauauaugcgugguauauuuaugugguguguguguguguguguguguguguguguguaugguauguaugguguauauauguaugugauguaugugguauauauguguguguuauguguguauggauguauguuaugugugcauaugugguaugguguaugugugugugugcuguguauguauguguguguggucuguguguacguguaggguaugguguauguguguauaugugugugguaugauguguguggguuuguguggugugguguguguguauaugugugugguaugguguguguaugagggggguauguguaugguguggugugcguguauaugugugugguguauauguguguggugugguauguguguauaugugugugguguaugccuggguccgugucucugagcgaugcuguuucugaaguaacagugucugccauccuucugcuuugccucagccuucaccaucaacagcauccauauggaaagccugccaucaugggaggugaugaaugggcagcaacugacccuggagugccuuguggacaucagcaccaccucgaaaagcaggucucagcaccgggugcuguucuauaaggacgaugcgaugguguauaacgucaccuccagggagcacaccgagagcuacgucauuccucaggcucgggucuuccacuccgggaaguacaaaugcacagugaugcugaacaacaaggaaaaaaccacgauugaguacgaggugaaggugcauggugaguccgcaagcagaauagcagguugaugaugaugcucacguuggugacgcuggucacgccgcucauggugacgccagagaccggccagugaagcugguuuccuucuccgcuaagcuccaccuuuccuguucacuaccuggcauccugaccugaaacuguaggcuuuagaaacucccgcugugugaagacaggacuuccuccuuugggaugauguccuggccuugggaacacccuuccucauccuccuuaaguaauagacuacaucucccaaccccuucucugaaacagucucccuaaagcccgggcaggcuucagucuccugcgcaugcgcuggcguuacgggugugggacuccacaccccgcuacagaguucuucuugcacguucucaacagaguugauuucucccagggcaccagucuuuacaguguuuaugcuccucugugagagugacaaacagcaugguuuugucacaugaaccaaaccuuggugguacacaccuuuaauccuaguacucuggaagcagaggcagguaggucucugugaguucaagauggccuggucuucggagugaguucuagaauaaccaagcuacacagggaaacccugucuggaaaaacagaacaaaacccacuagacucaagucucucugcuuuagucaccaucuggauacguccaauagccauucuaaacuucaggggccacagagguaccugggagauuaaaguuauugcugucaagccugccaaucgucauucaauccccugaacccccauggcagaaggagaggacugacucccauagugucccaugaccuccacaccuacaccauagcacucuugggaccacacauaagacaccaaacaaauaauaaguaaaaucuaacaggagcauuaaacucuggaauccgcagggaugaagugaaauagcagguagucacucagggacucggcaugauugagugcaguucccugucuguugguguucagccgcuugagguacaauacuuaguccauggugaacaacacaggucauagugggcccaugagguaaacccacgagguaaccucgugauguuaugccaucuuggucugugcaaauuuacucucuuccuggaaugaugccaccucacaaagcauuucccaggcugugucuuaguuguugugaaacaaucuguguccauuuccccacaucuacugcucuuuggggcuauaaaaucucagagagauuaaauuuggccuauuuccagacaggcagagguuguuggaaagcgcaugccuuuaaucccagcccuugggaggcagaggcagguggaucucugaguuugaggccagucuggucuacagaacaaacuccaggacagccagggcgacacagaaaaacccugucucaaaacaauggcgacaacagugaccacuggccuauuuuucauauccuggguaaagacccaggcuugagguaggcauucaauaaguugcaacagaggccagagagagcucaagccguacaaagcuuuccacucagacuaaagacaggagugugcagacacccaguauccacggccugggacgugccuguaauccugcaacucaggguguggagagacaggaagguccuugggguuugcuggccauucagccuaguugaauuagugagcuacaaagucagugagagauccaucucaaacagaaagguggagagcagcugaggaagauguggccucuacauggaaguguacacacacacacacacgcacgcacgcacgcacgcgcaugcaugcauauagacagugaaagcaucagcugaaguaacauaauuaaauacugacuuuuuuuuuuuuuggagacagagucucacuauguagcccuggcuguccuggaacuuacucuguagaccaggcuggccucgaacucagagagcucugccuguuucugcuuccuaagaacgaggaugaaaaggugugcaucgccacaccuggguuuuuccuuuuuaaacuguaccaguugggaaucuaguugcaccaccuuccgaaggggaucgcaaaccauugagaacacuguuguauuauaguuuuaaacugucugcuacagugccaggcacacagauccccugggguagguaagacugaaucuucagggaauaaagggcccugaugcugaucagccacagugacagaugagggugauggggccguuaugcggaauugauccuaaguguacuuucuccuucuccaaaggcguauccaagcccaaggugacacuggacaaaaaggaggugacagaaggcggggucgugacggucaauuguuccuugcaagaagaaaagccaccgaucuuuuuuaaaauugaaaaauuagaaguggggacaaaguuugucaagcgaaggauagauaagaccuccaacgagaacuuugugcucauggaauuccccauugaggcgcaggaccacguguuaguguuucgcugccaagcugggauccuguccggauucaaauugcaggagucagaacccaucaggagugaauacgucaccgugcagggucagaauccugcccucuauaccauucuuuguagugacggguuauauguagccaaaaggagcccagaauuggagaaucugcgccuccuuuaaggcuguaaucccagcccuggugaaguacaggcaggggguucagggguucaagacuagcagcccucagcuaggcagugguggcgcacaccuuuaauccuagcacuugggaggcagaggcagguggauuucugaguuugaggccaguugaggcacucuggucuacagagugaguuccaggacagccagggcuacacagagaaacccuaccucgaaaaacaaaacaacgaaaacaaaaaaaaaaagacucuuucucccaugagccaaauaaauagcauuaacugaaaagaauaaguagggcgcuggaauggcagcugggagugacggugcaggccugcgaucccaccuacucgggacacugaggcaggaggauugaaaguucacgggcacgcugggcaguugagugagacccucucuuaaaguaaaaaugaaagagaggacuagagauacaaacauguggugagauguuugaccagcauuugggaaaaccuaugucuacugggggaggggccacaggaaggggagccaaaagagcgaaaaaggacuaagcaaauggcucaggaaguagaaugaauuugaugccccaaacacguguaaagcugggugugguggugcacguuuguaaucccagcccuagagagcuagagacagacagauuccugauacucacuggcuggucagccucagccuagauauugagccccaagccaauaagagagucugucucauaaaaaaccagaccagggcaaagggggcuagagagauggcucaguggucagcauucuugcuguuuguucuuccugccuuuccacacacaugcaccagaacaccacgccccccaauacacaggcguggcuccgcccacccagauaauagacuagaaagugcccaguuuugaacuugaaucuaacuggcuugucaucuuucuuguagaguccuucuccacucccaaguuugaaaucaagcccccugggaugaucauagaaggggaccagcugcacauuaggugcauaguucaagugacacacuugguccaggaguuuacagaaauuaucauccaaaaagacaaggcgauuguagccaccuccaagcaaagcagugaagcugucuacucagucauggccauggucgaguacaguggacacuacaccugcaaaguggaaucaaaccguaucuccaaagccaguagcaucauggucaacauaacagguaggacugcugagggcgggcaggcaauuguggcuagguauaguucuucaugucuguaauggcagcauuuggggguaggggggcugagauaggaggaucaugaguucaaggccagccugggcuaucuagugagacccugaccagugagugugaugccuuuucuguuccagguugucuuggguguaugcaugcugggugcuggggcuugugggaaggauucgaugcauaguagucggcuauacuggcuauacauucguucagaggcuggugcugacucaauccugcugcucacuacuucugugcucuuggcugaacucuugaaccugccccaacugugugagacccaauggggaugugaugguacccaccuuauagcaccaucacaauguccguuuaaaugagguagcuguggucugcauccaagugagcauuggcuaauaucucugcaggugucuguguugucuuuccucugagccaaacucuucuucauggccucuuuacguuuuuuaaauuuuauguguguggaugcuuugccugcauguaggucuauguaccauuuguagacuugguguccaugagggccaaaauaggguauaggcugaccuagaacuggaguuacaguuggaagucaccaggugcugggaauugaaccuggguccucugcaagacuagccagugcucugaagugcugaggccaaaccccagcccaaaucuuuuucuaaaagguuuugggguccaggagucaccccacaaaccacacaaacacugaucucagucagauagggcuguauugaacauauacccuaaaagacugaucaaucagggccauaguucaaauuuugggggcugagucuacgacccucaacauuuuuucuaugucaguuuauaaagacuaagaccacaaaacccaccaaugagcacauacgaagugcuggaaguccugcccaguggucggcccugacucaagccauuuuagacauaacaguucauacugaccuuuaauuugauggguccuaagugacacuuaugguuguggauuuuuuuuaaggucacccaaccucauaacaugcaaaauauaauaggguauguggucagcaaaaccuugcucugaauaauuucugcaccaaugacuggcagguguauuauagcaauagucagcaggaacaaaauggcugcagcuaugcuagggggauagguuucaaaaaaggcauucucucucucucucucccucucucucucucucucccucccucccucccucccucccucccucucucucucucucucucucucucucucuuguugcacacgcccaacuggccaggaagaacgacgcugcuacaggauccuucugcacacguuuauucaguccuguuucuucuuguuuauaucucucuuguuuauauaucucccuuguuuuuauaucuccccuguuuauaucucccuuguuuuuauaucucccuuguuuuuauaucucccuuguuuuuauaucucccccacuaauaguaauccucucucgaauaauaauccuccucuaacccgggccucucacucuuauauacucucaguucccauccacgcacagcaggccacgccacuucaccaggcacgcagcuucagcuaaucagggcaucaggggcaaaucuccaccaaauuggauucaccuguauccugguacaccugcgcagcacucaagauguuugugucuuauaugaggaagucaggugcaagucauaugacuuagcugcagucucuggcgccuuugggacugccgccacacccgcuccccacacucucuuucucuguuuuucaaaacaagguaucucugucuugaaaaaccuguccuggcuguccuggaacucccauuguagaccaggcuggccuuaaacucacagaaaucuaccugccucugucucccaaguacuaggauuaaagauaugcaccaccauagccagccuguaaaagauuuuaacggguaugaugacacacaccuguuccauaugucuauaaugccagcacuugaggggcagaggcagguagaucucucugaguuugaggccagucugaucuacagagugaguuccaggccaaccagagcuacauagugagacccugucucaaaaaacaaaaacaaaaacaaaaaaaaacaaaaagauuuugaaaaaagacuauauguaugucugugugcauuuauauuuacucucugugugugugugugugugugugugugugugagagagagagagagagaggcugagaucagaggaugucagagccuuuggaaguggaguuacagguaguugugagcugguugauguagguacugggaaccuaauccaggccuucugcaagaauaguaaguguggccuggugugguggugcacgcaugcccagcaguugggaggcagaggcaggugaauaucugaguuugaggccagccuggucuacagagugaguuucaggacagccagggcuacacagagaaacucugucuugaaaaacaaacaaacaacaacaacagaaagaauagcaagugcuuuuaacuauugagcuaucucucuaccuuccuccguuuucuuaaagacaagaucucauguggccgaggcuagccuuucacuuacuguguagaggaauuuguccuugaacuccugaccuugcugccuucuugcaaguccuagggcuccaggcgugcuccaccauagcaggaacugcccagugcuaggucuccugaccccaguucucggcuuuaucucucuaaaauacuuacacuuugacuacuguacucuuucuuguuugcugugcugugcauucagcuguuacaauguaagcagcugagggcugagaccuuaacucuucugcucagugcuauguccuuaacuuguacuaugguuagucagaggauugggcugagccuuguguuacaauguuuccaagagcagagucagcacuucucuucuguugaaagucuccauucauaaaaaccguccucaguucauucaguaguuuccccccaaauccccaagugucaagcucugaacaugcggucacagccaccacccccaggcuuauaauagguagguagaaugccaacucaucaacuaggggauuggcacacuauaucagauccuccugguguagggugugacaucaugcacaauuuagugaguuauuuauuuacuuauuuacuuauauuuuuugagacauucucauaauguagcuuagaacuccccuauguagaccaggcuggucccuauauaaaacucaagugcugggaucaaaggcaugccccaucauaccaagcauggauuauugauaaugacaaacauuuggagugcucuugauaaggcauacauucucuuguuagagaaaaaagccaucauucauauauauauauauauauauauaaaacuacauauuauaauacauaugauauauaucauauacauauauaugacacauccuucuguauacugggcugcuuacuaagaauugaggacuucagauacaagcaggccugucaauggggguuucuucuugccauaaugaacuugcaaauuuuaaaaaauauuuacuuauuuauuuuauguauaugaguacacuguagcuguacagaugguugugagccuucaugugguuguuggaaauugaauuuuuuuuuuaggaccucuguuugcuccggucaaccccacccgcucagucccuacuugcucuguccuaaagauuauuguauaguagcugaccagacgcacuagaagagggugucagaucucauaauggaugguugugagccaccaugugguuucugggauuugaacucaggaccuuugauagagcagucaguguucuuacccacugagccaucucggcagcccaugaacuugcaaauauuaucuaauauacuuucucuagguaaccaccuagagcaacuuccuuccaaggacuguucccuuaaccccuccagggugaaguucaguuuccucucugugggcucugcugcaaacaguauuccugaauugagcguuagauauaaauuccuugaagucagccugucucacaugcuguuaucuuuccauuggccagcaaagggucaauacuuguggaagccaugcauagcaguguacacuuguggucccaacaccugggagguagagaugggaggaacagaaguucaaggccaucucuggcuacauaguuaguucaaggucaaccuaggcuacuugagacccucccugucucaauaaaugaguggacagaugagugaauccucauaggaaaugcaggaagagccagcagagagaucucaaggucagagggaguccuguccucacucuuuuguuuguuuguuuguuuguuuguuuguuuuuugagacuggguuuuucuguguagcccuagcuguccuggcuucuuuuaaggccaugcugucaaguauaugagaagcagaggaagacuuuuugcagguuccuaaggguuaauucugcugaaaguaacugggcuacaaaugucugcggcugaggacugaggugguacccagacacguuucaccucccuucccacuugauguucuucagagcuguuucccaagccgaaguuagaguucuccuccagucgucuggaccaaggggaguuguuggaccuguccugcuccgucucgggcacaccuguagccaacuucaccauccagaaggaagagacggucuugucgcaguaucagaauuucagcaagaucgccgaggagagugacagcggggaguacagcuguacugcaggcaucggcaaaguggucaagagaagcggccugguaccgauccaggugugcggugaguacacucucagcugcucagauaugcaaagguuggguagggacuaggagcaugauggucaguuagcugucaccaaugcagucgcaaaggcugaucggauucaggcaggucgagaagaacuccugggagggccaggaaaauggcuuauuggguaauggugcuugcugccuagcccggcaacccgaguucagccccugugauccacguggaggaggcagagaaacaaguccuacaagcucuccuuugaccucuguauuucaucuguauuugugugugcacguagaacgcacagacuucuguguauaucuaagaccugguuacgaggcaugugguacauaccuauaauccugacauccaggacguugagcuagggauuguugugaauucaagaccagccugggauacauagcaagggccugucucgauccuccuugacucccaacauaaaaaaaaacaacaacaacaaaaaaguauuaaaagaagaagauucuaguuggguauugguggugcaugucauuaaucccagcagugaguuugcuggaggauuacugcaaacucacggccaaccugggauacagggcaagguccugcuuaaaaacaaaacaaaacaaaacacacacaaggggucuaaagagauuuuccagugguuauaggcacuugcugcucuuucgaaggaccuaggaucaguucccagcaccacaucaugcauaagccaccaccccuggaugguagaccuacaggcaggcauguaccaccaucccuggaucuuccaccuccugucucccuccauuaucuuccuuuccccacccucccccugacuuccuccuuuugagacaggacaacauuauacuauggagcucaagcuagccucaaauuugcaguuuuaccgccugcccucccagguauggaccuacagguguguuccacuacacccagauauuauaucauuauuuugcuuauaaaaauagauauuuuagcagggcagugguggcgcacgccuuuaaucccagcacuugggaggcagaggcaggcggauuucugaguucgaggccagccuggucuagagugaguuccaggacagccagggcuacacagagaaacccugucucgaaaaaaccaaaaaaaaaaaaaaaaaaaaaaaaaaaagauauuuuaagcagggcuguaauaguauacuccuuuaauccccauacucagauaguagagguagacagaucuuugugaguucaaggccagccuggucuacagaacuaguuccaggacgucuaggguuauacaaagaagccuugucuaaaaaaaaccccaaaccauaaacaacaggaaugauuaauaaaucaaaaacaaaacaaacccaacaaaauuagauuuuauauauauauaaaauuuauauuuauauauauauaaauuuauuuauauauuuauauuuauaaaauauauaaauauauauauauuugcuguucugacacagugucucacuauguagccuggccucaaacucauaaaguucuuccugucuccacuuucuuagugcugggaauugaacucaagacuuuacacaugcuaggcaagugcucuaccacugggcuacauccccaucuaucuacagcaguucauuuucucccuuguauauugcacacacacgcacacacacucaugcacacacacacacacacacacacucaugcacacacacguauagacaagcauugccuggacaggccacagcccuauaggagccccuuaagauggauaaggcaggcaggcagguaggcauuggaaaucaugaucucgauugggaaagccaagcucagaguuuucagaaggaagguucccggcuggguuguuccuuguguuuuauuuggauuuccccuguuguuguagaaaugcucucgaagcccaguauuuuucaugaugccaagucugagaucauaaaaggacaugccauaggcaucagcugccaguccgaaaauggaacugcacccaucacuuaccaccuuaugaaagcaaagagugacuuccagacucucgaggugaccuccaaugacccagcaacauucacagauaagcccaccagagacauggaauaccagugcagagcggauaauugccauucccaccccgcgguguucagcgagauccugagggucagggugauagguaagcagcugucuucugugaagcaaagguagggcucaaggcuagcaaggcuagggacuguggccaucacaaggaugcugccugugcaacccauagcagauauguaucaaagaccaagccccagauggugggucugagcaauauccgggguuucuugauguggccguuguaacccuuuuugaccuuccaagugacaguugacugcugguauuauguaguugggcuuccgugguuugagggggcggggugcuuuucagaugaagagagagcugcccucaagaacugcgggcuuagaacucuuuccuugcuaguggucuuaguggaacaucugugucacacaugaaaccugccacaggccuugcugcagaccaugggcucauggaaauagcugacauuagccugggauucucaccauggucuugggguuggauaucuuuuccucgagcaucugacuugugccuuuggguggcuuguugcagugucgcugcccccacugcuuauaagacucccaaugugccuucuccucuguccuucagcagcuuuuguuuagcagcucugugucgucaacaggcaguuuauaggugcuggagagauggcucugugguuaagaacauuagcuacuguuucagagauccuggguucaauuuucagcauccacgugacagcucacaaauguuccuagagaucugaugcccucacacagacguacaugcaggccauacacuaauguacauaaaaaugcaucauuaacaugcaguuuauaauuguauacuguguaccugugcuggugugggcgagaguuggcuacugguacaggguaagugguccaacaagccuguaauccuggcacuuaguaagcagaggcaggcagaucagguuauccuuaucuacauagugagaucaaggccacccaaggucacauaagacccaagucucagaggacaagggagggagguggggcauaauaagaacuggucugaggaggggcauaauauggacaugguuguuaugcauucaggcuguuguugaagagugaagacuucagaucuccagauguuaauuaauaauaaauucguccaggcggugguggcguacuccuuuaaucccaacacucgggaggcagaugcagguggaucucugaguucgaggccagacuggucuauaaaguaaguuccagggcggccacgacacagagaaaacuugucucaaaaagaccacagaagaagaggaagaggaaacccgaguugaaauugggucagugcuagugacgagcauuuacugagcccuucccaugugcccagcccugggugaagcacugugguaaauuaucccuaguaauauuuaaaauagcacaugagacucauaagugaacucacuaagacuuagagcuaaggcacgauagguaggacugggauuugaacccaggcaguguggcuccugagaccaacucaccacuagccucuuguacuucccggggggagagacugucaggucuagcagugugcucaggcugucugccccugugugggaccacugccaucccaggccugaugcucagcuuccuucaagaucauacgcccuuugugcucagagaggugacaugugucugugugucacuaguagggaagguggccuggaauggugacauaggaccagaauuugaaugguuaggaauguugcugagggaagguggcacagugggggcacaguggauuugccucucugagcuuccaggugggaaggaaaccaugaaguuccgggaagcugucuggacaggaaacuucuguuuagguuucagugcucagaaauaaaagcugaguguggaaguaaagucucuaagugaagauggaggggcuggugagauggcccagccuaaugaccugaguucaauacccuggaccuuacuugguggaaagacagauuccugcaaauuguucucggaguuccacuaacacacccaugcacagaauaaauaaguaaaaaaaauaaguaaaaaacaauguguguguguguguauauauguauauauauauauauguguauauauauauauagauagauagauagauagauagauacacguauauacacacacauauauauacacacacauacguguguguguguguguguguguguguguguguagaguggaguuggaagacuuaggaccaacuuuucagaaaauccaaacccauauuucauugccaaaauaaguagugaagaaggcaggcagauagcaagggaggagaaucugcuucagaggcagcucagauagugaagccaggucaacagggaccgggugauauucaggcuauuggaggccaagacuggaaaaccagguuaagaaugguuaaaacuuccuccacugaauuuucucuuuaggaucauggucuuaggaucaaggaaauuuuccagcaucuuugaaacuagaaauagcaaugcaguuucaaaagcagauggguagcuacagauguugguacauaccuguaaucccaggauuuuggaggcuaacaucuggaguucauggccagcucuaugagaccuggucucaauacaaaacaaacaugguuaugcauaccuuuaaucccagcgcuuaagagguggaggcagacagaucucugugaguucaaggccagccagaguuacguagugaaaccuugucucacaacaggugaaugaacaagggcaauagcaaacaagaauaacaaaaccaggugguuggaaggcgaacuugagggagagcaaaccaaugagagaggaggcuuuaaaagcacacaggaagaggaaaaaaacagggguaaucgccacacacccuuuaaaauucuuauuuauuuaucugaugugcacugguguuuuccaugaaugguuaucuaugugaggguguccgauccucugaaacuggaguugcagacaguugugaacagccaugugguugcugggacuugaaccuuggugggguucucuggaagagcugccggugcuccuaaccacuuaggcaucucuccaguccaugugccacacaucauuguaagcagaaaggcagagaugaacacacacacaaacacacauguacaccuacacacauacacacauacaugugcacauguacucaaaacuccaagacagagcacaaguuaaucuugucauucaguugaguggccagucuugcucaaggugcgaagauggugagugucccuagcaucuuguguuuuaucagugaauggggacaggaggugucuguugcuguccuucuggucuaaucaguggaaguggagagaagaggauugaaauccuaggcuggaagagaagcagauaagaagcaguggccauucuguguucccucucuguucaacucccuucuucucccucuuggguucuuugugacuggaucucugugucguauccuggcuuggaacaugagcuccuucugcaugcaucucccaaguacggggauugcggcugugcaccucuuacuugcuucucuccccucucugcucggggcuaauccuuggccugcuuuccagccccaguggaugaaguugugauuuccauccugucgaguaacgagguacagucuggaagugaaaugguacuucggugcucugugaaagaggggacgagcccaaucacguuucaguuuuacaaagaaaaggaggacagacccuuccaccaagcggucgugaaugacacccaagcguuuuggcacaacaaacaagcuagcaagaagcaggaaggacaguacuacuguacagccuccaacagagccagcaguaugaggaccaguccccgaagcagcacucuugcagucagaggugaguccacacccccaccagagcaucaguguggggggcuuccgagggucagaaagcacgaauuccuuguaaaagggagaggaguggagacuagcucauuugggagagcuaagagaccggugucugauuaguuacaauuagcagaaacccacucauaguagcuugagcagaaaaagagaugauucuauuuauauauaaucugaaaauguuuuauccagucccaauucuaaguauccgauagagagauaccaguugacaguugacgcauacuguggguuaaaugucuauccaugaacgaccuguauccaacauagauguguugauaggauucuagcugugugcuugaaugagagaguccuguagagauggagggccaccccaaauggaacaacaccucuacaaaauuagcuugguaccuccuugaagacuguaguugaccuugguuucuagcagaagccaccauuuccacccaggcugaguacagaagcccucaugggcagacaccaaagcaaaaugccauuuuuaaggaucgcaaaauggggucugaguugcugcuuaaaucugcugccauuucuugcuggugggaggaaaacauguguuuccuuucuuucuacccgacuuccagucuuccuugccccauggaagaaagggcucauugcggugguugucauuggaguggucaucgccaccuuaauaguugcagccaaaugcuacuuccugaggaaagccaagggugagugccugucugcagccuggguuuccagggaacugcauccuggaggaggcuaagggagcaccaugcauucuccuuaugggaugucggcuugguaacgcaagggccuggcguuggugggugugaagcuuuggcggcucacuagcaacggugcuuguggaguugggcaagccaacuggggggaugugggugacauuauaccugaucuagucacaagaagcuauuucuuaguguguguccccaaguguggugguauagggcacauacaggcaugcacauucuguguguggcacaugcacaaaugcacacacugugugccucccagauauucuucuaguugugucaugaucuuguaucauguaccauacacacuugugggaauagggucuagccuaggcuuaaguaaaauggugcugcugucugagccgggaggagcagauggguuggggucuuuugucuuuuccaagguaggaaaaauugugcugagcuacacccccaguuucucuuuucuccuuuauugaguauccgggcuuuaggagaaucaauggaaagauggucacuguccuguauacuuacacugaccuaaguuuuucuuucuuuuuuaaagccaaacagaaacccguggagauguccaggucggugucccuguuaagagggggguggcuucuuugugggcagggcuggauuugucugcaagcccagacugguugcuaggaaguuaucagagauucuuagcaaacuaauaaagaauaagggccuuggguauaauggguguguguguuucugucugucugucucaguggaagauugccaacucauuacauacuuagaauaauagaguugaccuuuuuaaaagaaauguuuuuuaccaagcuggagagauggcucaaucucugcugguaccaugcacuauaaaugugcaugcgugcgcacacacgcacacaccucuaaaauuuaaaaaaaaaaaaagucuuugcauccuuuugccaaggcuagccuuaaauucaugauccucuugccuuuaccucccaagggcuggauuacccaagggcaugugguaccacgacuagcuuuuugugucuugcuguguagcccuggcuagucucagagucacagccauucuccugccucaaccuccccagagcugugauuacaaguguacaauugucauauuucuucuugcuuucucguggucuuucuuugaugguuuuguugguuugggggaagaauaucaauacauaauuuucucuuuucuucuucauuuacaugugaaggccagcugcuccacuucugaacuccaacagcgagaagauuucugagccuaguguggaagccaacagccauuacgguaaauccaagucuuccuuuaauuacaaaaguuuuucccaacucaauguauaagguaggauuggaguagaagggaaaccccagcuucaggcagugguaccguuaccguauauaacaaaccaugagaagauuagugauacacagcaaacagaaaggaaaggcaggaccuuuucugcuuuccccaucucugcuucauuucuuugggaugaaaaauggagacugacccuacugcuuguugccuccauagacugaaauaauuaggcaguacaugggagacagaaaccagauuuuuuuuuuuuuuuuuuuuuuuugagacaguguuuuucuguguagcccuggcuguccuggaacucacucgguagaccaggcugaccucgaacucacagagauccgccucccucugccucccaagugcugggauuaaaggcgugugccaccacugccuggcuugagaagucacucuggugcaggccucagaggagagaggcugcccagugagucucaggacccuugggucugugagaaagucacucagaggcaggugugguggcucacucugaacaucucagcacucuguagggaggaaggagcagaugcagauggacauauuggaguccaucuuggucuacauagugaguuccaagcccaguuggggcuccauaucaaaaccuugucucaaaacaagcaauaaaaacaaacaaguaauuugaauaauagcacugauuagcacaaacacacuuuggaaaaccauguguuccugaagaauaguauaauaccuuauauauaagaauauccuaaggaaaacaacaugcuaagauguuuguuuguuuguuugcuugcuuuauagugcuugggauugagccaaagccuucacacauucugggcaagggcauuaccaccaagcaagccucacacuucauuuuguguaugugcacuggugugauaauccagagacacuguuauuucuuuaagucguauucucaucaacuuacuucccuaaccagacaauguuagcuaaccaucagcuuucauauuuauuuuuagucacuggcccuuucuagaaaggagcuucauuuuuaauuaguucuuacaucaaaccauucugaauuccaaauaacucucaaacgaaagugccccucugcagccauacuuucuauccaggcaguggagggagggcccacugcaugcaggaaaagcucacaccgcagagacaaaggaggagacccagggccagaggcgaaggugcuugucaccuggagaggucagacuugacuuucuuagcaguacuggagguuuuagaaguacuggggagauggugaaguguuugcuguugcuguguggaugugaggccuuggguuugguucccuagcaccuauauauaagccacaugugacagcaagcaccuguaaccccaguacaggggagguggauggaagugaccacaccccaugggcuccaucaugagcuaguccugcugaaucagcaagcuccagguucacagagacgcugccucaaaaaauaaggcggagggagagugauagagcuuccucuaucaugugaugucacacgagcacacgcacacuugugcacacacacauaugcaugggggagagcacacacucacacacaugcacucacacucacaucaauggguaagggcacacacacauacaugagugagaacgaacacacacacacacacacacacacacacacacacacacacacacacaguuacgguuacaggaaacugauaucuauugucacucauccugacuguuaauuuuucaaccagguuaugaugauguuucuggaaaugaugcaguaaaacccauaaaucaaaauaaagguaauuauuuaaaaauuguaguagaaacuuuuacauuaaaaaaaaaaaaaucacgggcagcuagcugugugcugugugcuuuaaucccagcacuccgaggagagaggcaggcgggucucuggaaucaaagccagccuggcggacauagagaguucuagagcuacacaguaauuaguaagacucugucuuuaaaaauaaacaaauaaauaaauaaucacagagaaaaggaaacguaaacucugagcugucuggauaauuuccacccgucuuagaggcucugucuauaugagccuaaugguaaaguguagguggccggguuuuuuucuccaaagauguuagccaguguucugaauggugaugccuccuaaccuaaguagaagcaagcugucauaccuaaaaacaacaacaacaacaacaacaacaaaaacaaaacaaaaaacaaagaaagaaacaaaaaaccuuucuggcucuccaagugcuguaggaagguguuucucuuggguggcugagguggagaguuuaaagaaauuuuuuaaagacaacuaacaauagacaguuuacuucugccuaaggcuuguuggcuuaaaucgccucuucaagauauuuucuauucugugccgcucucuugagaacugaaacucccaaccugcuccgugaagucucuuuggcuacaccaucuguuuuagcugccagcagaacaaaacaaaacaacaaccaaaaaaaaaccucuaauucugugggucuuaaaacagcgcagguuuuacguagucacaucuguaaucacagcacucaggaggcugaggcaggaagacaagguauucaaggcuagccuugacuguguagcaaguccgggcugcccuggaauucauguggcccugucugaagaaacaguaauaagggcuggagagauagcucgcuguuaaacacuggcugcucugucagagaacccagcuuccguucccguacagugaauggcucacaaucaccuguaaggcuagucccugaggaucugacacccucuccuggucuccugggguacuagacacaacgaacagcagcagcaauagccagaguugaaagcaaaaauaauuuccugggugccuccccagagccuggagauuuuguuacccagaaugccucauuuucuuuaaacacuuagagacugguaagcuugguccuacagcauucaaauccauuuccauggccuugagacuggacaggccuugacugcuggagcccaucuugggcugcuguccacaccuauugaaaauccucccacacucuacaagucagagaggcuauguacagugucugcugcccgaaccaauguagggcugaccggaauaaagguuucuagugugguuugaugccuccagaggaggugcuaucuaaacucacagcgcugugauucuuuuaacagacccccagaacauggauguagaauacacagaaguggaaguguccucccuugagccucaccaagguaagcagcccucgccaagugagccgagcccacauuaggcucugggcuuagauguagauaccacaugagaugcuguguacagucagaauugucucuuggaauggacauggucuucuguagaccuacuaggugugccuaagucuggagcuauaaaacugugauuguacucugcuuacucacugcgggccaggcagggacuaagagcugagcacucuucucuggaagagucuaugggagacuauaguuuccuaucccccgccaaguguucaggcuuucuuucagaggccagccccugcucagaugcaccuagaaaaguugucuguguggaccaaacgugugucaaucaaaugcaugcauaaaauggagaauauggggcuggagagauggcuccauggcuaagagcacagacuguuuguucucccagagaaacugaguuugguucccagcaucuguaucggguggcucacgaccaccuguaacuccagcuccaggggaauccagcguccucuucugguaucugcagacauggcacucacauuugcacagagccccuaccaccgcuaccacacacaacagauggugaugauggugguaguggugguaguggugguagugguggugauggugaugaugaggguguggacgauguauauguuacuuuguugcugugacuaaaugccugacaagaccaauuuaagggaggagagguuuguuugcuuugcuauuggaagcaauacaguucuucacagcacagaaaguaugauaacucagacagguuuuuagauacuguguccagggaaagcaaugaauucugggucucagcuacaucuguccucuuuaugcaacuugggaccacagcccaugacaagugucaaccacauuuaggauggcucuuuucaccuccauuagcccaauuuagaccauacacagagagagggggggggcaccacgcgugcaauucuaaauccagucaaauuggagauuacccaucacagaggccuuuccuccuuagggggacguuuggggaaauagaguccuuuccgugugacaugagaucugugccuuagcuuuuuuuguuaggugugugugguucacucaagggcaagcugcccauaaguccauaucugauucagugcugggagacagacgcacaguagguggguuacagcagaucucagccguucugagcaccagaaacaauacccaucucccaacccuucuccaucuuggcccacccuugggcugcugugugcuucaaaggaagcagccaucccaagccuuccggcccuugggaagcucccuaggacugcugccaucugucugccuuugcguugugcuggguucucagccaagcaacccugggcaguuuuccaggcugggccugccaaucauuagcuggagccacuuggugaugguguccugaagccaccucuugcucgaugauuuaggaccaguucuggaguuucucuuccaucucuuacuuaccgagcgugguuccaagugcccugucagcaguuauagaugugaaacuuuccaaucaguagacauguccugugcaacaccacugacacaucccugugaucuccggucagagcugccuccagagguguggacuggagacuuuaaugugcuuugcuguaugggcaugggugguguccugacuggaccugagggguggggcacguggaaggccugaugcucuugucuuuuuuuuuuuuuuuuuuauuuuggagugaaguguuugacucauuuugguagcugauagugacagugacauaaagaugccagccacugugugagacacaaaggcaaggguguucccucccuggugugcguguagucuaagugggagcugggaaaacuaaagaauagaugguaucaggugauuuuaagugcuguggauggguagagugggcugcaguaaggggaugcuuucucucaccuucgcugagccaugcaagagggccuccuugagagccguuaauuaagcaggggcugaagguuguaagcaaggcagcugcaaggaagacaguugauuaaggguggggcugguuagaaagacacagggaauggaaaggguaguuuuggcaggucacagcuagcuagcucauuuaguuuggucugaaaggguugcuggguguguggugcguacccacacucaaucccaaagcauggcugugugacacaggaggaccaagaguucaaggccauccugagauacaugagacccugucucaaaagcaucagaaaggaggcucaugugucugcagagacagaaaggauggaguuaggaggacagggugaugcuggagcacauggggccccaaggauuucaguccuauucuaaacggauaagggaacauaagggaacauuucuggaggcuucaggcugggcaauggcugguucugagcuccuucuuuaaaaaaaaauucuuagggacucuggaggaguucaguggauagauagggaggccuuaucuugucaguguaaggacuggagugugggucucaagaacccacauaaauacugagugagugugauggcccuccuguaauuccaguauuccucaaaaaacagacaggggcuucccagggcaagcuggcuagcuagaccagccauguccacauucagccuccaugaauauggugaagaacuguuguuuguauugauacuagauuuuuuuuuccauacacuauauucaguuuuguuuuguuuuggagacaggguuucucuguauagcccuggcuguccuggaauucacucuguagaccaggcuggccuggaacucagaaaucugccugccucugccucccgaguacugggauuaaaggcgugugccaccaccacccggccauucucucucucucucucucucucucucucucucucucucuuacucucucucucucucucucucauuagaaaaaaaacaggcauccguaaaaaaugagguaaaacacaauacaauaaugaacaaaccagaauagaggaaaucaaagaaaagcuaaggaauacacacacacacagacacacaaccacacacacauacacgcaaucacacacacaugcauacaugcacacacagaagucccauagagucacaaaucuggggaacuauugagaaagauucccagucuuucucagaccuccauacauguuaguccucccaagacauacaaccacugcacacauaccauacauacauacauacauacauacauacauacauacauacauauauacauacaaaagcaaacucaggaccaucaaggaaguggccugaagaagaacaagacagaugugcuaucacugugcaagagauagugggugccagaaauggauggugucuaggugcacaucugagauccaucacagcucguggccaggauuggggagccagagucccuauauuucuugcuggaguagcugcauggacggcugugguguuugaggauaagauccgguuugacuggguuaagucuaagaugccggugagacacccuagaguaggaagcucaggggucuggagcucagaggcaagccaggacagaugaaacuguagagugaucaguaucagcugucacugguccagccugggcuucgacugcauccugggcuugccaacccagguaacaucuuucuucuuccuagagguaagggaaggugcuagcuuaaggguugaauggcaagaucagagccggcuacaccauccuuucuguucuggacugcugcauucuaccguggugggggaacacugacagcuccaggcacaggggaccaaaucccugcucucuugucuguacagaacauccucaaguugccugucaccccgggcucggauaccaggcugaauccauccucccacagugguccaggcccaggucugggcaggcagcagccugaggguugugcaugauacuugugugggagcgcgugccugugcgcugggaguuccgaaagcugaagagggaagaaggaagcaucacuggcccugggaaaggcuccauuucccuuuuguugggagaguguccuuguaucugguguucuuuugcuuucuugagaguguggaaggauugaauagaggaaguguggcaguuccuagaauagggugggaccguggcaauugccucuggcuucccucgauagauucugcagccgucccuugcagccaagcuaucaguuacauuucccagcuugcacuaguugcccagucagggcucuggggaagauucuagaacaaaggucguuuggguggcaaggggaacuuaagaggauacaaauuguguuuccuccuuguugaagaaggacagugaggaacucaggucuggaccacuggugcuggccccuuguucucccccaagcagggacaagggcauugauugcuaggugaagaaagaagggcuuuguggguucaaggucaaugaugacuaaauaugagcuagugccugccagccugguccccuguucucaaggucucucauccuacacaauuggaggaggcuauggggaccggguccagaucuaacccuggcuggcagcucaccaaguggucacugcggauggaggaggacgggaaggaacucauuaaaucccgauuugcugucuguuugcuccgaggcuaauugcugggaaaaccccaugacguuggagccgucucuuucucuguuagcacagagaaaaacagaaaccaaaauagagacccaucaggaaacgccucugacaagcagagacaaacagcuccuggccugggcuagucuuuagcaggcagcugcugccaaggagacaugagagggggaagggcagugagcagcugcacccugcuccuccccuacccccgcccccacccccucuuacugagcugggcaaaaccaggggcaagcauagaccaugcagcucagucuagaaguggaaagcaucccuuccugacuugagguaggcacagccugaagccgcugagguccagagaauaucaaacuguugccaaggagaccagagagguaccuggaacaguggaguucacaagauguccaggcuaaccccacccauguuuggcugcccagcccacccagcccucaccucacccucaucccaauucaugucccuucuauccuagcuccuuguuaggcuagggcagaggaaggucuagacuugcuucuuauggacgacaucuuauagcaguuaucacgcaguuauuuuuagcuguguguguguguguguguguguguguguguguuguguguuaggauacaccugucucugaguacaugcagaagucauggacucuaauuuaugucaggugucuaauuuaugcucagucucccacuaccuuauucuuuugagacagucuccugcugauccuggaucuaggcuggcagccagccaacccuagcagucagcccucuuaccucugccccuaacaauugcugggguuauaggugccuacagcuaugccccagauugucugggauuuggguucaggauuccagcucagguucuuacguuugugcagcaagugcucuuacccacugagccaucucccagcccugugguauuuguuuguuuauuuguuugcuugcacuggggcuugaacccagagccuugcacaugcugagcugguacuguaucacugaaccacaucuucagcucauuaacauucuuggcacaucugucuucccugaagccuagagcaccugaaagcuagaaccggaucuacauuuucuucuuuagugguugaggucacauaggagauguguacagucguuaaauggaucucuugguguguagaaggcgucuuggagacgccuggaguuucagucucugcuugcaugggauccuguuguuucucaauaguucucuuaggcagaugucuuuacacuggggaacugggaucucagcuacuuuacugaccuccaacuccugccuugggaagugacuuuaauuccuucugcaacgccuucaucauucugggugccccaaguucugcugugaugauguggaccacuccuggccuuucucugucauacaggauuuauacagccacccacauccagugucuaaugagaaaccuagacuuuagucccacagccuaccuaccaguccuguggcgugcuccuuauuacauagacaggaaaucucaggaaggggcuaacugugccucgaccuucugaaguucaaggucggcaaugcuucagggccugggcugaugcuuuuccuucauuaccuugcagacaaugcuagggauagccaagacugacuggaagacuaugcaaagccugacugguggggugggguggagccuaagcugggccuuugcucuauaagaccuugggaauccaccagggcagacaacugugggaacaaagaaagcaagcaugcuuuggguaaaugucaccaaacugcucuggggucacaagagcccauggaacagcucagggcacagaagaugcaaauauuggggguauauaugcauauggcuguuggggugaugcugcaagagaaggaaccgcgucagaaauggaagggcucagaggccagagaaaggaagaggucacuguaggaguggccucacagcaaagugagaaaguaucuuugguguaguuagaauccauguggggccccaggcaucugcaauaaggacagcauguggcaggacaucucaggcucucugagggagauaggcagaggagggggcuagcccaaacccauccagcugugcaaggagacuuccuggucuucccugcaaguaucagaaaccuaggauguguuccgguuuuguccugcuuccucggugucucuagauauacguaugucuguauauacaugagugcauucucugugugagucuggauacuguguacaaguauguauagugugugcauacucugugaguguacacaacaccuguauauacacauccuugaacauauuucaauaugaaauaaacagguagccuugucuucuauucugaaggucuaagccagagaauuaugacacuggcuauagguucaagaccaugcagaguacacccguguaccuaggcguaauggugcaggucuauaaucccaggacuugggagaugaaggcuggaggaucaggaguucaagaccagccuaggcuauccagcaaauucaaggccagucugggcuacaugaaacuguuuuaagcaacaauaacaauacaaacaaaaaaaccccaacacagaacaaacucaugccaggccaggccccagcgugcuucacuuagauucuguagugagccuagauguugacaccagaggcaggcagcucagcaagcucuaucuguaaguggcuguuguccugucuguauggcugcugcucaugccagacuccaacccagaccucaggauccaauucuaauucuugggauccacccccccccccaacucccaguggcugugaggcuguacauagcagagcccugauaggcagguccugguagggcagcugacacagggucuccguggcagggaaaggggggugggugacugggcuagggacuuugggucugugcagagucuucgugcagccgggcucuucacacaguggccuacugaccuacuuucagugucuaggagccucugguuaggucugaacuucugaagcuggggaaugaugauauacucgguguggggcuucucgacggggcagcguugggugucgggaagguacagcagugggcuagccuggggcuccaaggcagcuacugaccugugccugguucccuuuccagcucugggaacgagagccacagagacgguguacagugagauccggaaggucgacccuagugagugaggggccccugauucccagagugggagggucugugcuagaaucaguaauggggccuugagagugggcagaggggugggggaaagccaaaaagagcaucaacucuuuaucaccgucccccaaaacccucuuuugguuuuuuugagacagaguuucucuguguaggccuggcugucccagaacucacucuguggaccagucuggccucaaacucagaaauccaccugguucugccucccaagugcugggauuaaaggugugggacaucacuucccagcagagcaucaacucuuauauuagggucugacucugucccuccuaccacccuaagaauacagaggcacagacagucuaagaucaagaucacagaagcacaucucugagcacccagagcuagacuccacauucccaucacugagcugcagucuuugguuagagggaaggagcuggcaggacgauuuuuccucuuacuggccuggguuccugccugaggccuugcaaaugagacaguccagcaaggaauaaguagacuggguugauuaaccuguagaagaaaucucagagaggagugacucagaaagaagguugggggaggggagguauguaacugcuuaacaauaaacguguacagaaaggacaggaugcugagccuggugguacaggccuguaauccaagcacagggcagggacaacuggaaaagcaagcguuggucgcccuugccuguauauaaaguucaagaauagccuggcuauguacaugagaacuguauuuaaaagauggggagggggccgggcgugguggcacacgccuuuaaucccagcacuugggaggcagaggcaggugaauuucugaguucgaggucagccuggucuacagagugaguuccaggacagccaggacuacacaaagaaacccugucucaggggaaaaaaaaaagauggggagggagggagagagaaagagaagaaagaacgaggggcuggauagagacugcucagcgguuaagaacacagcgguuaagaugcucuugcagagaggaugggauucaguugcuagcuccuacaugguagcuugcagccauuuuuaacuucaguuccaggggaucugacacccucucuggccuccagaggcacuagaaaugcauauaguacacauauauacaugcagacaaagcauccauacuaucuggggcagacuguccuuacacuccucauggucuucacugcucaucugucuugauuuggguuccugucaucaccagauccauuggagaauccaauucuacguuaaaccggcaucuuugugugaugggguggcccuggguggccuuggucaaaccaugaaacauucccagacuucuuuaacugucaccuucucugugaaaugaggggauggacuagauuccugguuagauugcccgauccacucccagcccugagugucugaauccuuuagguugaagaauuuauauuucuaaccacucauacaauauuggcugaggaagcuggccuggggacuccaguuugagggucagucugugagugcugugauugugccacacagguccugccccuagggucucucucacuccccccccccccccccgcgcgcgcauccuguacugaucagaacagagacagcugagagagaaaauccagaaauacccugugugugcacagagggugacagaaggugcgcguuugcagcuggcggcugacuggguguagggaaggcucuuagcagccgcuccccucacagucuuugcuauaucuucaguggcaccccaggacaggcuguuuggggaaauggcucauagggcggaguuuuggcucugaaacccccuuuccccugagagauucaaaggaaggccacuccccuagauaagcagaagggcuuaggcaggacagccuccaaggagcagguuccccuccccacccccaccccaccccccagggaaugggcccuuggagagauuugggggagcuugacaaagaagcaggagggagcuugcaagccaugagaggggcaugcugucugcaaucucggcuuuagaugcuaagcugaccuucuuuuucuguauuguuauaacauguacauaaaacuuaauguuuuaaccauuuccgaauagucagguggcaaaugugguguccuuuacauccuuugauacuguuggguagccagaguucucaccacccauuucccgaaucuccaucuucccagucccuuaaccaauaacuccauccccaccugcugccugccccagccguugguccucaccauucugugaauuuggccccaccacacccugucugugaauuuagccacgcucagccuuuucucaugucaaacgaagagacugagccagcggguuugagcucucuuuuaauugaaacacuucaagagucccaggguugcacuggcaagaaggucagcaagcaggucaaggcauuaucaccaagccugacagccugaguucaaacccugugacucacauaguggaaggaggggcugaaccccgaaaguugcccucugaccuccagaugagcauggcagcacaugcaccucaccacccagauuaaguaaauaacuggaauaaaaauaaauaaaugugcaccuggcagugguggcauauaccugugauaccaguguuccugaggcagaggcacgcagaacucuggguuugagaccagccuggaauauagacagccauagcuacacagagaaauccagccuugaaaaaaacaaaacaaaaagagauaaaaauguuuaaaagauuaaauaagacaggcaugguagagcucaccucuaauuccaguacacaggagguggaucuuuguggguucaagucuagcugggucuauaaaaacauuucagaccagucagagcaacuaagccaaaccaguuaauuaauuauuaauuaauuaauuaauuaauaaucguuucagguuccuggcauuuggaaauagagagcagccccucagccuuggccccucuagcucugucugccuggacacaccugggguguagucacuuuaaggguuaacccgagucuaauccucaacucacccucaucucucugucgacacucagauucuauagauguuuucagaacuuccuagaucucagggucugccugucuucauuucuccggaguucgcacuggccaggauccagccuggacauuuuucugugccauugucauggaaagcuccauagcugggcccccugauguuggcucuggucucguccgacagauggacagagugacccuggcacaggaacgacuauaaaaguaggcagaaauacacuacagugaaucuugggaggguaagggcugugauggguuuuguaacucaaacauucagagccccccucagggucugcuaagucucucugcagcccacuaacaccagcuugcccuagcaaugggcucuuagguaagaaccucuuaggcagaggcaggcggaucccugaguucaaggcuaggcugguuuacagagggaguuccagggcaaccagggcuacccggagaaacccugucucggagaaauacaaacaaccacaaauaacaaaacaaaaagaacaccucuagaccuuugaacguuguccuuuccuguugcugcgugaggcgcuaaugccagccuguccccuggcugagugugagcggugaggggagggcaggcauucucagaacuaacaaaguagagauaaacaaacucuaugccugugaugcuagcgcuuucgcgcuuucgaggaggaaacuaugcuuuccaagauggggaguucaaggccauccucggguaaauagaaaguccaacuccaacccaggccucuugagacccuauucaaaugagagagagaaugagagagagagagcaagagaggagccaaaucuagagaggccaaagggaaggaaagaauaugcguugguuguaaucagaacaaguaagaggccguucuucagcaguaaucuguggguuuuguuuuuuauguuauugguuuaaucuucaguuuccguggaggaaugaggccaaugcuguugauggucaccaccacccaccccaugauugacugauugauugauugauauuggggauggaagccaguccuccugaguaucugcccuugagucacauuucugggucuuuccuugucgcuuagaugcaaacuuaaucuuucagcauucuaaaaguuauuuucccuuuuaguuaaaaaauauuagccgggcuauggugcauaccccuuuaaucccagcacucaggaggcagagguagucggaucucugugaguucgaggacagagcgaguucuaggacugccagggcugcacaaagaaacgcugacuuagccgagcgugguguugcacgccuuuaaucccagcacuugggaggcagaggcaggcggacuucuaaauucgaggccagccuggucuacaaagugaguucuaggacagccagagcuacacagagaaacccugucucaaaaaaaaaaaaaaaaaaagaaaagaaaagaaaagaaaagaaaagaaaaagaaaaagaaaagaaacucugacuugaaaaagaaaaacaaaaaccuucauguauguaccguuggugccugguaccacaaaggcuggaagacagagucagauacucugggacuggaauuacggguguuuaguugugaguagccacaagggugcggagacucgaaccuggguccucugcagaagcagucaguguccuuauccacugagccaccucucuaagccuuuacgucuucuuuuauauuacuuuccugagguuagaauucacaagccucagucaguggcucuaguuccaguuuaugaaugaaucaccuuaaccagaagagggaaccguuaagugugugucucucagggcacagcggugaacuguaagagagaguaggccaggccgaggcuguauacauuucugucugucacuuaacucuggacuccauugaccucagacuucaugcgggauaaucugugauaugccugagcucuaggggguuucguuucauggugguggccugcagugcuggagagucggcccgcaggaccucaggccugccaguuagaugucuguccacugagucacacccccagcucagcacacaugcacgguugcuacaaccugguguagggagagcaguccugaugagucuggugaguaggagucagggaugcuaugaaacaucucgugguacagucagucucggucaagaguucccagcccagaaugucagcaggaugaacacagagaagcccuggcuuagaggacaccagcuucuaugccuguccaccaggagagcucccucagacaccagcucuugcuuucucuguguccaccucaggagcugaccagggcaccuggucccacccacaccucuggccuguaaaggaaaccaagucuugcucucagccccagcucuguaucaguugggcacccccacuccccacccaagcgucagcuacuccaccccucuucacccuugcuuucucuuuguguggaauucagacuuccaggaucuuuuccuuucaucuucuuuuccaguuccucccuaccccaucuccuuuucuuuccuuuucuuuaagacaguucaguuaaccuccaauucauaaccuuccuguggcagccucucaaauggugucauuacaguugugcaccaccagacccagcucaggaugugugaauggggcugggggcggugggaagcgagugggcagaaaucccucaucuuucucacauuccuuacugccccuuaccaagaggauagccaugacaggaaguaccaucaagaaagaaccugaccuggacaucauggcacuugaaaggcugaggcaggaggauugcugcaaaucugaggcuagacugggccaggauuagacccuacaucaauuuaaauuaaggagaagaggccucucagcaggaagccaccaugucuaaggguggaacacucucuggucucugagcccugggcuucaucuugcccucccucccccuguacccccuccccccauuccuagaacucugagcaauaaauuucuguuguuucuacauuuaaaaaggaaaaaauaggagcaggggugggggugggggugggguccuggcuaaguccucugaagggagagaagaacacuugaaaguugguucccacccauccuguguggcccaaagccagcugggccagcagguacugccaggguggcacuuccugccugaacacgcaggaggggaaaguaccuuacgccgugccccaucguguaacauuacccaccaaagaaacagucuccaagugggcccagacuugccugccaucagucuugccuucucccaugcagaguuuuguuuuuugguuugugagguuuguuuuuuuuuuuuuuauauuuauuuacuuauuuauuauauguaaauacacuguagcugucuucagacauuccagaagagggcaucagauuucguuacggaugguugugagccaccaugugguugcugggauuugaacucgggaccuuuggaagagcagucggcgcucuuaacugcugagccaucucaccagcuccugugugguuuuuuguuguuguuguuguuguuuuuguuuuuuguuuguuuguuuguuuuuccgagacaggguuucucuguguagcccuggcuguccuggaacucacuuuguagaccaggcuggccucuaacucagaaauccaccugccucugccucugccuccccaaugcugagauuaaagguguucaugcgccaccaugccuggcugccaugcagaguuuuaacacgucacauuuuguuucugcuucuggagaacgugggcugggugggggaggccgggacaugggguucuucuccccuguggagaccugggccaggaggagcugucauggccucccucgguguguggaggcugacagaguggcugcucggugccugggcugauguacagauuuuuugagaggccaacugccuuugucccgcuagaauagaagaggggccccuuugggacagcgguuccuguucccucuaacuaggaacaauggaauauuauaugacaggguuugaaggggaaguagacuuggggaaagcagguuuuuauuuguuuguuguuuugugacagagccuggaacucuugguaaucccccugccuggcagcuugacugcuggauuuacaaagagagcuaccacacaaggcucaaaggguuuuuuguuuguuuguuucuuaggauuuuuugguuuugccuucuaucuuuccaccucuucuuccucugugucucugccugucugucugucugucucucucucucugaggaugaccuugaacuccugauccuccugccuccaccucccuaacaccagacuuuauaagccccgugcugccacaccaauuucuaugauacugggggucagccccagggcuccauguguuccaggcaagcacuuaaccagcuggccugcacccuuguucuuggcuuucucgccaugaccuuuaccaucuguaagagcagccaccaaccccuaacccccuacccuguccccaccccuacccugcccccagcacaugggaacuuuuuucccagagagcacaugagguauucauugcugcuguuuccaccagaccuggagaaucagccccaacacagagucagucccugggaugggcgggagagucugacucugugcgaagaggcaaauccuaccccagccucccaucugguggugaggcuccucuuccagugaugcaggcagugaugugauccuuccgugcagagcuuccugcucucucacucucuccacuuccaggcuuuugucagaggccaugggcauaacaacgguggccuggcugggcagccgggcacagugugcauucugacaaaaggaugcgucaacuugagccucauaugggaaagggaaauugcaggcucugcucuuagucaguuuggccauggaugccaagagccugaguuauccuccuccuccucuucuucuuccucuuccuccucuucuuccucuucuuucuccuccuccacuucuucuuucuccuccuccucuuccuccuccaccucuucuuucucauccuccucuuccuccuccucuuccucuuccuccucuuccuacucuucuuccuccucuucuucuuucuccucuuccucuuccaccuccuccccuuccauccuuacucccaggaaugggcagacaguguaaaaucaacugugagaauagauuugcugccaaagauauuggcaacauuauuuacuuaagacagcaaaauccuggacagaaccucuuuuguuuuuaaguuuuguuuauguguauggggguucugacugugugcgagucuguguagcaugugugugccuggugccugaggaagccagcagaaggugucagaugcccuaagacuaaaauuauagacaguugugaaccaccauguagguacuggaaaucgaaucugggaccucuggaaggguagccaguguccuuaaccacuaagcgaucucuccagccccagaaccuagcuuuuuaaaguuaggaaccugguuaagcaaucagcuguguagccacuuaacuugacgguguagcuacuuggacaguggcauuuaagaaaggucaugagccaggugugguagcgcacgccuuuaaucccagcacuugggaggcagaggcagguggauuucugaguucgaggccagcauggucuacagagugaguuccaggacagccagggcuacacagagaaacccugucucgaaaaacccaaaaaaaaaaaaaaaaaaaaaaaaaaaaaaaaaaaaaaaaaaagaaaagaaaacaaaaggaaagaaaaagaaagguuaugaaaguucuuacaaaaccacacugcaugaaaggaugggguggaacacaucacaggccuaucgcccuaacuuccccugacccuccccaacaguccacucagaacacugcuaggggacaguggaagggaccaaaaguggguggaggguggagcagagaucacuuuuauuugcaacuuucuaauuuucuguuuucuauuuuucucuacuaauuaaaaaucuuuaaaaugccacacaagaagcugcacuucuucgaucccggcacucuggaagcagaggcagguggauuucugggaguuugaggauaccuuggauaguuuugaacagauagcucaaggacacccagggcuacauaaagagcuccugucuuuaagaaaagaaaagccacaguggggguguaguugguagaaugcuugccuagcaugcacugggcccuggacuucauucuuagcaccccaugaacuguguggugguucaugccuauaauugggaaauggaagucucagaaacucaagguuauccuggacuacauaguaaguuaaagggcuagccuggccuacaugaagcccuacuuaaaaaaaaaacaaaacaaaaaacaaaaaucaaagcuagcacacaaaaaggucaaaugacguuccagggacucuacaugccuaucucauggcugagaagaucccaggggcuugccuagagacaaaaggccaucaguagauggccugagacccccuuauacacuaguguucugucccguccccaacccuccucuauauccccccuuugccauuugccacuuugcacauuuccagcagcagauccagugugaagcugcccuaccucgcacgcucaccuuugugccgucuuuguuuugcagaucucauggaaaacagauacucuguaaguacacacgucacacacacuacguuaaaaaugcacccaugaagcuugguaguagcucauaccugaaucaccacacugaggaguguuguggacguuugaggccuuccuuggcuacagaauucccuuucaggacugcaguauguggcuguugcuguugcuuuacaaagguguucuauagaacaacgaacuauuucccaauuuguccagggucugcuuucuacuaauucucgccagcaccuuguucuaaccuggcccauuugagaccaggaaccguggcauccucuggcagucuaagccaguuccaguacugauucuccugucuauaccguuacagcucagucuauauagggagagggaccaugggaauccucccaugucgcugggagucuuucugcucuuuuaguaagaaagagucucgggcauagugagcgacacacacuugagagaggagcuugugugcaagaccaguuuggacugcauacuaagucccuggugagagagggaaggggagaggaaaaggaaggaggaaggggaagagaagagagaugaagagaggaaggguagggagauagggcaguuggccacauacuuacacaaggaucuggguuuaauccuagaacccaaagugaaaauuucaguuguaguggcaaacaugugagaucccaguccuggggagaugaggacaggucccuggggcuugccaaccugcauggugagccuaaggccaacgagagacccuguugaaagaagggaaggaggaaaggaaaggaaaggaaaggaaaggaaaggaaaggaaaggaaaggaaaggaaaggaaaggaaaggaaaagaaaaagaugaaugguucuuaaggaaugacgucugagauugccaucuggccucuauaugcacguagacacacucacaaaggaacauuuguacacaggcaugugcacgcacgcacgcacgcgcgcgcgcacacacacacacacucacacacacaaaaggauguacaauaaacucaggagggagggagggagggagggaagggguuuaaguucaacccauucauaacccacugccuuccgguucccagccugucugugggcacccagcagcacagggguuaacagggcagcuauuaucuucaaaaauaaggaacuggccucugaacuggucuuuugggucugggagaaacuuccagcaagacuucucuguagccuucaguggggcccuggcuuccuuuguuuugcugggucugaauucuugcuaaacagagcucauuaugcucuggacagacaggaaggcgcugacauucucuguggggaugaaggcugucuguuuaaggcgaagaggaaugaggugaacagcuucccuagcugcacccacccaggcugcugagagcacuguuguguggaaggggcaagggagccuguuucauagacgaagaaauggggggccugccuugcuaaagcauccagaaucccugagaagcagaaacagaggucacgucuccaaaagcccuggccugggcuuuguccucacuguuaagaagugacacaagccaggcuugguggugcuuagcugcaguaagugaucucugugaguucaaggccagucuggucuacaauccuuuagcccugaguuccaggacagucagggcucuguuacacagagaaaccuugucucaaaaggaaaaaaaaaaaaagugacugucucccaagaggugagaauaaugacaagcuugcuccacaggcagaguaggacccugauuaagaaaaaaaaaaaaaaaaguucacuggcuguucccauggccguguguaucuguggccacccaaggcagggcugcgggccagccgucggaacuuugccgaaccaaccuaguuacuuugucuuccacccaaaggggcucucuggacaaaggcucugaacuccaggccaguggcagaauggcuuucccucagcccccaaagucuacucuggucgcagggugcucccaguacuugggcuagcccuaccuccaaaauaauaaaaccaucuggcaggaacucagggcuucccagucguugagaagugaauuuugaaucuugaagcaaauaacuuuuguuuaugaaagaagcaugcagcgcuucccuaauaaccagccagcgugggucagaagaaaaugaacacugaauugcucggcagggaaaugggaggggcuuccuuccugaaaucaaaccuggcaaucauuccucgcuuguuuaauggccugaggaaauaucuggacaaugagacagccacuuagccagcuacgagcuugguauuguuugacuugcuccaauggcacaggcugacuucacuuuuuccucuugccauuuuuugccuuguuuauaaaccggguuuguggcccacgcagacagauaacguggaagagaacacccugugcuuaaaagaaagagcucgaaucuggaccuaugcgaaggucuccagauggugggcagaaccccugacucuuaccgguugggaacaagacagugucagugauggggucccuuccccacuccccaggaccagcagggagaugaguugucacaggaccugcucaggaguggggcugaggcugcugcugaagaacggggucccacuucuacaaucuucuugugggugacuuccucaaaccuaagcaccacugccuguaaaguagaaauggugaugguaguggugaugcggauaaugauggcgaugguggugauagugaugauaaugauagugaaaaugacgaaguaacaucugcccacugggauuuucuuaaggguuaaaugagacucugcagacucaagccaucacaaaaaagccacugucuccuuuaaugaucuuuuccucaagcacucugguaacaguggauacgguuaagagauuuacuuuauuggcucugaaaugcaacacacacacacacacacacacacacacacacacacacacacacacacacacgaaacucaaagccuaggauucaucaaagccaaagcuugacauaggccugggagaaccauauacagaauuauccuaacuagcugcuuagucuguauguaagguuccgucuucucaucaguuaccauuuuuauaaaaagggugucugugugugugugugugugugugugugugugugugugugugugugagagaugcagucaggauaaugucugagaguccaucucccucuccugugggcuucaagguuagaacucaggcacaucuucaggcuugugcacucuugccugcggagucaucucucccagccccauuuccacgaucugcaaacugggugacuucucaccugcauuucugcagggauuaagagaacacucagcucguuccugauagacuggaagugcucacccugagaacucuuuagaaguaggagucagggacccgggcaaggagguggagucagaaaggucuuugggguuacugggggacggaggggggaggggguauggggagauggggggggagcacaagcugagcagaagcagggcagauccagagcugacagcuggcuucugacuaaagcauaacaaguccgcuccucacugagaguguguuaacuuucacguuuaaguccccagacccugcugauggacuagcccuuccugucugugagcuuggucccauuauccagugccguuuucccuaagagagggagaacagaggcaucuggggagagacuuggucuggggccugcagaaaggcuagacacgaggaucccagcuccuugcccuggaagagcggaggaaacggcaggcagcagcugccagugcuggcaaaccuccagcgcucugggcucacacggcuugcuuggcccguuugugcaguuccauccuggcaagggaggagccagagucuuggucuccuaguugggccucucaggucugcauccugugcuaaaagccccaggcccagccaaacaaaauggagaguccaggaagccagccagccuggccacagguucccuacgacgccaggcaaccuuuacaucuucuuuugcccccaccucuguuaaguuccacuuacagcaagguguccucgguccgcagaggguucugaaccgugggccuguguuuccuguucuucagggcucuccuuuugcaaggcucucagcucccgaaucucccagccugcccagcuccucugcuugcaaauuucuuuccccuuuacaaaaucuuagaagucaguucaggucacuucugaguacuucaggaguguccuggucagaaugugaugcccccaugccuccaaauuacuucaucgaaauguugaucugggauugauaaagggcagggagguggcucaguggguaaucaccuguguggcaauugugaggccgugaauucaaccccacaauccacauaaaagccaggcauugguaaccccagcauugagaugggacguggggagccccuugaaacucuugggccaacuagcaacagggaacaauaugagacgucgucucagcugagcagugguggcgcaggcauuuauccuagcgcuugggaggcagaggcagguggauuucuggguuugaggccagccuggucuacagagugaguuccaggacagccagggcuacacagagaaacccugucuugacaaacgagggagagagagagagagagaaagagagagagagagagagagagagagagagagagaccuuaucucauccagaaugggaggugaaaguacuugaggcucuccugauuuccacaugaaccccauagcacagaacugaauaugcacacauuguacacacacacacacacacacacacaagcaaaaucauugguggacuaugaaauccuugggacagagucuguccucuucgggauagagaucuguacuaggucagauaaagguccagaaaccaggaaguggguggugggugacucagacuaccauuuggggcuauuuuggugcucuuuugagacaggucacauaugaagacagcccagguucuucugaggauuacuuugaacuccuuuuuuuuuuuuuaaagacuuacuuauuuauuauauguaaguacacuguagcuguccucagauacuccagaagaaggcaucagauuucguuauggacgguugugagccaccaugugguugcugggauuugaacucaggaccuucggaagagcagucggcgcucuuaaccacugagccaucucgccagcccuacuuugaacucuugauggccccaagugcuguguucugaacauuuaucuccacgccuggcuuuuuuuuuuuaacuuuuuuuuuauuauuacaguagaacauacacaaccuaaaauuaaccacuacauuauuguaaaguaguaucguucaagagcugggguauggcucagagauggagcaaugccuccccagcacuuaaaaacagagaauucaguugcacgagucacauucauaauguaacugucacuacaaugcacucucgauuuuuuuuuccuuaaauucuuguuacauguucguuugcacacgcauucaacagucagagacagcuucugggagcugguucuuuuccuucaaccucuggaucuugggacugaacucaauuuaucaggcuuggcagucagcgagccuuucuacugagccauuuaaccagcccuccagaacuuuuuuuuuuaaagauuuauuuauuuauuauauguaaguacacuguagcugucuucagacacuccagaagagggcgucagaucucauuacggaugguugugagccaccaugugguugcugggauuugaacucgggaccuuuggaagagcagucagugcucuuaaucacugagccaucucaccagcccugaacguuuuuuuuauaaaggauuuguaugcccacacgauuguguguggaggaccaugaggcaaagagggugcuagcuguugcuuaugacuaccuuugaaacagguucucucgcugagccugggguacauauauucuccacuagacuggaaaccagaaagcccuaacacucugugcuccccucagagcuggaauuccaggccauguagaccaggcuggccauaaacgcacaaagaucucccucugccagcuggaugcugggacuaaaggugugcaccaccacacccagccacauuuuuuaaguuaaccaaguuuuuaagcugaccuaaggaccuaagauggccuggugacucacgucuaccaucccagcacugagaaagcuaagaccaaaggaccacugagcuggcccaggcuacagagugaguuucugguucaaaacacaaaaccaaggcagacuagagaaggugucugcuagccacagguccagagggaguuagguguaagcucucuccuaccugaggguuccuuccauuugaucccugugcagcacccaugggacaccacacugggugcacguggguaucgaugcaguggccugauacuacagcaagaagguagagguagugacgacagccucuacagagcaaucauggagagaaaagaagauaggggggggggggagcagaagcugcccuagaagacggagucccaaaggaugguggcacagcucagugcuuuuguauguuugagucgagguccccaauauccaggauagccuagaacuggacuuugaaguugugauccuccugccucuaccuccugagucccgggauuacagacaugaaucauguguggugguaguggugaugcagcuuagaccucaagcauuacacccaagcacccacauucucagccccuuuggcguucucgugugcuguacugguucaauuuaugccucucuccuccggggugaucucuaguccucaggguguaacccuaacucuugucuucugucuuacagagaacggaaggcucccuuaauggaacuuaagacagucaaggcagugcacgucccugggaggucguccaugucccgagaagagcagccgauuccuggauugcgagaguccugugcacguauuuaugagccuguccccaccgaaagcaguaauccuucaggccaagccauccaauuuuaaaccccgcugccuuguucauguuggguauacagagacucagaggcgcuaguuaauggccagccugaccugucuuccuuguguuucggggggugaaaggagguuccaggagaauaaugcccuggaauauucugaggcugaaauguugugucucggauagacagaguacuucuccguggguccuccugcacagaagcccccuucugcucuguugucaaucacuggguuaguuuuuuguuuuguuuuguuucuguuguucucuucuuucuggguugaucuuaaucuuuggaaauacacagugcugcucagguuugccugguuccccugugugaccuucccccccacacacacacaaagucaaccagcugacugggagcaaugcucguggaauggccagucacuugaagacagaccucaagccagcaauggcaacuggagcgagcacuuaaagcgcaccuugaucuuccuuuccguuccaugccgaaggcccaaagaagagaaauggcuggcuacaacaacuguuauuauuuuuuuaauaguaaaaggaaauauguacuuuucucacuaauuuuucuuuauuuauuccccacuaaagaaacgguuuccuaaggucugagcuguuucccagggugggcuagagugggugggcaggagcugccgacauuuuguguacuauaccuaacccuccucgccuucuccguuugccucagccacccggcuccagggccccugaggggaguuguauuaaauaaaauugauuuuuacucuucaguuau

SEQ ID NO: 6460 - RNA, 693 nt, Mus musculus
accuuuuuuuuuuuuuuuuuuuuuuuuuuuuugguccgggagggugggccgggacccggggcggcccggcgaccucgcggcuguugagggaaacccggaggaguguuuucggucgggaagcgccgcgccuuugaggcgguucccggcgucguuugcgcaaucuuucguuggguuguuuuuugaggggggcccccccuuccgguauccccgggggaaagaaggggcgcuuucgagguccccugugccccguuggguggccuacgccggcggauucggccauguggcggagccgcagccacaaaaugccggccucggacauggcggcggcgccuuuguuaccccgcccggcggaggagcucaaaauggcagcggcgagaaaauguggcgcagagagaaaugcgagacaaagaaggaagcgccgccccagcgggaacgccgcccgggccgggacuccucccccgguugcuuucggcuccuccucuuuuucucccucgcguuauauaauuuuguuaccuugguuugcagccguucgcggcguuucccuagacucggcucgcuggcgccuguuccccuuucuacccuguccgccgugcuagccucguucagcugcucacauugccuuugcggccccguuauuucuuuaagauuagguccuuugaugaaaacgggcaaaaauaaccuuccuaagcuccu

SEQ ID NO: 6461 - RNA, 2227 nt, Mus musculus
ggugcuuucugauuucacagcgagauuuacuguuuugcaaacacaaucaugauauuaccaggucuuaacaucaaaauggcaucagauacaccagaaaacguccuggaaucgaugccaguuuggcacaaaacagguugcugggagcaaggaggcauggcaauacacaggggcuuguauugugugguacagcaggaacacaccuugaaugguguuuugcuugaauuagcccuugaaauguaauaguuuuugcacuuggcugcuguuugaucuauaugacauuucauauguaaaugaccaggguguuuacucccgcauguggaauuuaaaacuccaugcuuuaaauacaaaaucuggcuugacaccacgugauagauacuagucaaaguuguauauuuaaauucgagaacuguuuugugaacugucuccacuggggggaauguauuaaauuaaaauaacuuaaaaacagcaaaaauggugugaucuguuggcccacggggucuggugucuggguugugugcaugacugcccucgagggacuuucgcacaguguccugaagcacaccugucagcauuuuguagauaaagugacagcuaagccgcacacggaguccauaagguagcccgguuucacagaagcuucccgucacgugaagaccgaccccaagugccaaguucaaaugcacuggguguggguggcaccucgaacuugccacucccgcuuucgguuaaaccucuucacguagcugcugcuaccccggaucagcccgucuccuggacgcaggcgcccccuuaggaccuggagcagcgcacuggggagcugccgucucuuaugguagauguggcccaucacaauauaccugcuuccugaacaaaaagcauaagagaaacggugucaucuaaaugccaagaaacaaugacaucugagcuugaaucucguuaccuugcugugcuuguagcaauuuaaacuauuggcaacaggcgaaaaacauuagaacagguaaccuacagacuggcaacauuucaaaacaaagcauucuucggagaccaucucuaggaagaagugagaauaggaauccccuacacugccacugcccggaagaggccuuucucaucucagugcuggacaguagaagccccuaggcauuccuuuugaaaguagugucggccaggcggugguggcacacgccuuuaaucccagcacuugggagacagaggcagguggauuucugaguucgaggccagccuggucuagagugaguuccaagacagccagggcuacacagagaaacccugucucgaaaaaaaaacaaaaaaagaaaagaaaaaaacaaaacaaagaaacaaagaagugucaaccuagguaucaacauaucgguguuuggggauuugucuuguuuuagccaaagcuggcuuugggggagaugaccuugaacuucugacccuucauguuuccaaauugcuccuggaugcuggaguugcaccaucaccgcuggccuguucugugccaaccaauguucucaccuugagggagcugaaaagguacagcugucaucuaaacucuauugguuaaacaguaguuacuguuuggucacgaaggagcugggguugagcuccaccaguaacccagcauauguuaaggcugaaggaagaggauuaccggaauuucgaggccaggcuuucuaucaagagccugucugaaaaagacaaauucugggaguguaacuuaugacaugcuugccuggcguaugugaggcccugcucaacgccuggucuuugaaaagggaguugggugcuggggugaccaacagaagcugggcugcagcacucagguccccaguagcauuauaaaggacacgaugaauggccuuuucgggggacgggauuucgauaccggguuuaaauucuggacacggcuuauggcaacuggaggaguccagggcuaguauaugcacgcggaagaaaaagccgucgggagugauguacaggcggcucaucuuguacagcccgucgggguccaccagaagagucaccaggcgcaugcccgcgcccaacacguccacgucgugcacgauuccauucaccgcugcuuuggaaaaacaggguuuggaggaaaaagcauuacaacuagcuccgggacggggacgggcgcgcggguucccgggagggugcagcgcgcucaccgaauucgcuggcgcaauaggccucccacucguccgcguccgcgcug

SEQ ID NO: 6462 - RNA, 23038 nt, Mus musculus
ccucuuccgcccgccaggggucgcaguucugcucgagcugauuuuccuccuuggugucggucgcucucgcgagaggaagcacaaaggcugccgggaagcaugcccgggcuguaggccaacccaaaauggcaacccuggaagaagaauucacguugucuacuggagucuuaggcgccgggccugagggauuccuagguguagagcagacugacaaagccgaccaguuccuagugacggacagcggcaggaccgucguccuuuacaaggugaggacgguggggcuggccggcaggugucucgccucuguccgaagccgggggcgggaggcuugaguuucucacacuugggaaggaaagccgggagcgggcgugacagagacccggggugcgacagagucggcgggacgccgcaugagguucagaaguuguuugucaguagugaggaccggcguauuuccgagugacgugcggcggugucugggugcacaugggaugagcuggggaccugugccuccccuuuccccggggacagagccuggccgaggggaccacgucugucacccagcagcuugcaugacacugacagguugaaaauguguguucuccaggacauccuccgcuccuuggggucccgggggcggggugagucggauggugggaagaggcagggauuucuugguguccuagaaagauuggacaguucugcaucacacugugaaagucgcagucucacccgcuuugcagccugauucccggcucaacaagcauacguagagccuuguuauagcaaucaucuacaaagcacguuuuuuaagcuggaguuuugaaguuuguuguuguugucgucauuuugguuaguauuuuggguuuucgaaacaggguuucucuguguagcccuggcuguccugacucuguaaaccgaacucauagagaugcauuggaauuaaaggcgugugccaccaccaccaaugccccugaacaguuucuugugucauuaaaaaaguuauccaucugcaagggcuggagagaguauuggcugcucuuccggaggacugggguucaauucccagcacccacauugcagcucacaacuguaacaacgggaucuaacacccucacacagacauacaagcaaacaaaacaccaguguacguaaaaacaacaggaacaaccgaaaaacuaaguuauucaggaaaaaaaaaguuacccaaguguuuuauuguuuuggggacagguugccaacaauccccuauacuguugguuuaaacuucccuucaaacuuggggcugucuacuaauuuggcaguuucugcauaggaauacaauaguugaugacaguuagguggacuugcaccaaccugauuuucucuaccucuguuccacaaguaaucaauucuuuuuuuuuuuuuaauauuuauuuauuuauuauauguaagcacacuguagcuguuuucagacacuccagaagagggcaucagauuuuuuguuacagaugguugcgagccaccaugugguugcugggauuugaacucaggaccuuuggaagagcagucggcgcucuuaacugcugagccaucucuccagcccccaaucaauucauuuuuaauuguaucauuguucauacagagugucuuguauuaauuuucauauuguuaagaguuuuggaggauuuuuguuuuguuuuugagacaggucuggcuuuggguuuuuguuuguuuguuguuguuguuugaaacaguuucucccuguguaucucuaccuguccugaaacucacuauauagaccaggcuggccucuggcuccaccuuccaagugcugggaucaaaggcaugcagaauucccuauccugucucagccucccagugcuaaggauacaagugugaaccaucacaccuaguuagaauuuaaagaugacacuugaucaucacaacugcuaagugugcaaauagugaaaugguacauuguuguauagacaucaccacaauccaccuccaaggaacucuuaaucugugcaaguucugagggcuguugagauggcccagcugguaaagguacuugucaccaagucuaaugaccuggauucaauuccccagauacaugugcuagaaggaaaggaacugacuccugaaaacuguccucuagccucuggguuuauaagugugugugcacacaaauaaauacauacauguaauuaaaaauaauuaauaucuauccacucuagaacuugagguaagagaauuuugguuuugaggccagccuagacuacacagaaagacuaauaauuccucccagcccccagcagcuaucacucucugucagccuucguuauuuuaguuuagguacgucacaacguuagaaaucauauucagugcugucauucaagggcugcuuuuuuuguuuauuaaaucuaauuuucucuaacauccgaagcuaaauucuuaaauuguguauucuuuugccagguuucugaccagaaaccguugggcagcuggucggugaagcaaggucagaguauaacaugcccugcugugugcaacuuucagacuggagaguauauuaugguacaugaccauaagguaaaauugaaaacauguuaauauguguaacauaagcuguauuacauguauugauuguucuuuccauguaaauaagcaauguaguacuacuuaaaccaugugcuuuuuugauuuaagguuuugagaauauggaauaaugaugacguaaacguggauaaaguauucaaagcuacaguaagucuuuggauuuucugacacuuuuaauuacugcugacaugaaauaacucaacuucauauuuuuuauauaucauauugccucugggaaagaagcucaugguugcagucaguuuuucuucacagaucuugauaauugucucaacucauauguuaauagguuagaaaauacagguuauauuaucccauaaagacugauuuaaacaguucugaguggggcuagaagauggcuuuuuuguuuguuuguuuguuuuguuucuuucaagacaggauuucuuuguguagcccuggcuauccuggaacucacucuguagaccaggcuggccucgaacucagaaaucugccugccucugccucccgagugcugggauuaaaggugugcgccaccaccgcccagcuggaagauggcucuuuaguuaagagcauuugcugcucucguagagauucaguucccagcacacacccacuuagaacuccaauuccagacagucuugaugccuucucauuauguacaugugcuugcaugcacaugaugcacacacauauacauaacuuucucaauauaaaaauguguuuggaguuugaauguuugguguguuucuugugagaauguuuauuuucugugacauuuuguuucuccagccccuggggcacacuguuaaucccaguacccaggagacagagacaggcagaucucugugaguuuaagguuagccuggucuacauaggaaauuucaggccagccagagcuaccaaguaagcccugucucagugaacuaauuucuaguucuaaaugucuugacucuauaauuaauagcauuuggggcuggagagguggcuuagugacuaagagcacuggcugcucuuccagaggacccugguucaauucccagcucccacaugacaguucacaccugucuguaacuccaauuccagggcuucugacacccucacacagacacacaugcaaguaaaacaagugaacauaguaaaaaauaaguuuuauaauugauacauuuuagaaccccaaaugagacuaauucaaauccaauauaauuguugccuagacucaugaaacuucaaacugugcuuucuccuaaaaccuggagagguuagcuauuucucucacccuuuguuagcagcaagagccuuaccuauuaucuuaccagcuccuugaugguuuaucuuugguuuuguucuuguugcuuguuuuauuuugugugguuguugucaccgucugagcacugcauguggguauggugauuagcucaguguuagaaugagaaugcuggcccagccuguacaaggcccuauaguagugcaucagacagacagacccagguuggaggcaagcuauucucccccccaccccccuucucucucucagacagaauuucacauguagcccuggcugucuuugaacuugauauguagaccaggcuagccuugaacucacauagaucugccugccuccaggaagucaauagcucaggcuuuuggauagcagggagaacaggcagauccuccaggaacuaaaggugugcacccaaacauaaaugagucuuuuaauaagucuuuuaggcugggucugauggcaccugcuggugaugucagccacuuaggaagcuaaggcacaguaaugaauccaaggcuagacagcuaagcuagauaccuaaaaaugucuguauuguauuauauguuuauucuuuuagaguaaaacugaaaauauuuggaacuuuuuuccagcugucagcugaaguccauagaauccacucaguacaaagaacagaacccuuggugcuguuccgaggaggcgcugcucgugggcuagaggccuugcuuguagagccccagcagaacaucgaaucugucauaccugaugaggaagugaucgugugagugccagugcuugcguaugaauuucccagcagaaaaugugcucugcguuaccuuaguacauucuuuacugugcuacauaaagaacugugguauagcucagugguagaacccuaucuaucauguuagaagccuagaguuaaucccuggaauccaaaaaaaaaaaaaauacccuaauuaaaucccacuuauugcuuauuacuagacaaacagaggcagucagaucucugaauuugaggccagccugauuugcauaauaaguucuaggcuggcauuaaaauguuaacaacuacaacaacauuuaugagacacugagcaaaauucucaagaaccugugagccuguggaaggauaguaaaugaugaggaaauguccacagcccuggucagaggucagggaccuggauugucagcucuuugugaaggaaauggguaauacuggaaacccaaacucuuugguucugucaugcuuaccagccaagcugcagcccuuuccccuggagaaaagcaugucuuuguaguaagaggugaugguggugcuguagcgccucuggcuuuccugggcuaugaaggaaugcuggguaaauugcucauucaccugguggugggaccguccaugacaucaccauucacugguggccugguagaaaguaaucucagagccaagccuugugcugagugagcgagugagcacccgaucuuggacugagcacgucucaggugugaacagcugucauggagugggugaccuuuggguucucgucaccacuaugccacauaccagcagugcugcccugugccucauugucugcuacuuauagaaacgcuucuaccguuguccuaagaacacagguccccaaagugaugaugacagggagauagagggcucaauguaaauguuugaaggacugcaggcuccucucaccccaccucgcuguuuccaucagugucugggaaguuuuacaaccugugcugccugcacugcuguuacugaagucaggccucucuuguucuggcuccaaaacaccauaauaguuaccuaaguagaauuaaucaauaacauuucucaacugauuucauguuuucuaauuuuucuuucuuucuuuaaagguggucagagguuuucauguuauuuaagcaaccaguuuuaauuuuuauuacugaaaauguaagugacaucuucaauuucuggucuuuguggcauuuuuuuaagucaccuguguuauuuucaaagcuaaaauguaauuuugcuauuucucuuagcuuguuucuuuugugaacacuaaaaugcuaguuaaaacuguuucuaugccuaaauuaagguuuuuuuuuuuuuagaagacuuaauucaguuuuugguauaaaacccccauuugguagcaagagcuggagccuaugucccccaaauggagacuccaguguggaucuucacaagaugggcagugguuuccugauaggggacuuagugaacagagucucuuaccagagguggccgucagucuuggagauuguaucaaagauggccuuuccaaaguugcccaggaccgggcagugguggcgcacaccuuuaauccgagcacuuggaaggcagaggcaggcggauuucugaguucgaggccagccuggucuacaaagugagugccaggacagccagggcuacacagagaaacccugucucgaaaaaaaaacaaaaacaaaauugcccaggguauuuggacagaagagcaaagaaauaccauugccucugggggcagggauaaggcauaucagcccagagccacaacagccugucaucuuacaugggacagugugaggcuugcaggucuugauucccacuagcccuuccacacacagggaaaauggaaagcauagccaaggcaguggacccucagaugucaguaaccaccuccuuagaccacuucgcaccaagucuaaccuaagccuugaagcaggccugcuggccagcccugcucugcuccuguagugcugugacuuuuagaaccucauccuuuaaggaugcuccaggaagucaguaacucagauuucugcauggcagggagaacaggcagauccuccagggacuugaucuucauguccuugacuucaaguccaacuuggugaugagaaucgacuucucaucuuugcugugucuccacaagccccucggcccucagacugcugcuguguggcucccagggucugcugcccaggguugcacagcauauuauguuuuaccaagaaagaaacuaaagcaacauuuuuaucacaucuuaaauuuaacugaaaacaugccuauauuuauagcaugccccuaauuccaacacuugggaaaauggggcagcagaauagagacuuugaggucagcuugggcuauguacugagacacggucuuagaagacaagggguggaauauagcucaguggcacaacugcuuaccaagcacagcacuucugcaguccugguggcuggaacucacauggagaccaggcuugcuaggaauuugcuacauuuuucuucucuuugccuccuaaguacugggauuacagggaugugccaucacacccagcaguuuuuaaguauuuauugaaguaauuagaauagagcaauaacuucuaggauuuuguuuguuuguuauguauaugagugcacuguagcugucuucagacacaccagaagacaucagaucccauuauagaugauugugaaccacccugugguugcugggaauuaaacucaggaucucuggaagagcagucaguguucuuaacugcugagccaucuuuccagcccuaacuucuaguuuuaauaguuauuugaagugggggauguuuguaaaauaaauuuuuuuuucuugcagcauggucauuauuaugcuuauguacgauuaugcaaaucacacagcuuaagcaaauacacacucuuacuugaaaaagaagaaaaaucuguuaaaccaaauuuuacugcacguguggaugggaaauucaucucccuggugucgcuaaguaagucuuuaauaccacaggugguaaauggaggcagucagaaggucuuccaugaggcagagucuuaagcuuucugcagcuuucucccauagccauuucaaaggacuuucaggcuuaccauaaacaacagcaaauaaugcagugccuauaaacaagaaaauucacauagcuaaggucacaucgcuaagggugccugacuuuauguggugcuggggauuaaagugaaggccuugugcauagaaggcaagcaguuuuacccauggagucacaccuccaguguguugccgcaacacucacacguuuauuuggcauuacuuacuguguguuaugugcgugugccuugguucucauuucagaccagagaacaacuuauaguucucucccuccaucauaggggcuccagugaucacagguuucuaaccauguuacugaccccauuuauaaaaagaaauuuaauauauuuauugagggaaagaaaggagugauauaguuguccaguauucuaauuggguaauuuauggacuuguagucuuagaaaccuucaaauacauuuuuagaaacccccuaacacguuuaacuugacagauacagacuguccuuuccccauuacugaaugucaacuacuugcucccaacaggcucugauggguguauauaugaaaccuugauaccaauauauucaagugacacagaacaaaaccagagguuaguuagagcauugaugcucaagucaguugugucuggcgguguucgaaaugguguugcccucaccauccuggaucaagaccacauagcuguccugggaccuccacuuucagcuucuaaggguaauugcaauugcuuaaucaauuuuagcuuuuagccucuaguuucuagccucucuguucucaacagaaucuuacuauguaaccuagguuggccuugaucucaggaucauccuaccccagcuucccaggcacuaggaccgcaguguguaccaccaugcccagugccaucucccaguacacgaacuccaucuguguaggucuuccuuagugucuacuagcaagcaguaccuccuaguuuuuacuguaccgucaguuguuugucuccuuuaaacacuuauauguuuccuucucagagcuucucuuucuaagcuauagaaacacaguugauuuucuguguuauucuuacccugcaacuuugcuaaguguuauuuauuuuguacuguuaguacaugcuucuguguguuuguguguguacauacauguauaugccugugugugcuggcuuuggccucaggguaacaugggcccacaagaggguuaggacuucuucuauauucuaaaauaauuuggugcugauuuuaugauugcugggauucaauggugaggucaucugguccuagacuuccuucuugaauguuguuuuaauuacagacucagaucugcuaucuugaacuuuguggggcuuuuccacucucuaccugccuugugccucaucuguuugaauucuuggggcagccacucuuuuguauacaucaagcaaacuuguguguuucccucugccuccuuccuucaugccagaauagcuuguguuucuguuuaggucuguuucugaacuucuguaaauuauauuauagagugccucuccauauggaacauaaaguuucaaacauuacagacgucaaaagagcugccacaaggaaccagugggcagguaagucugacuuuuuuuucuuguuuguuuguuggguuuggguuugguuucucuguuuuguugggguuugaguuugggucuuugcuugagguaagauguugcuguguagccuagcauagccucaaauuugcaauucuccugccuccaccuccccaguaccggaauuauuauagacaugugccaucguucucuuaguuauuuguuuuaguuaguuaguucuauuaaguuucuuuccucugaggaaaacuagaauuacaguugauuuuguuaccuaagagcuuacauuugauuggguuuuuguuuuaaaaaagaaugaaccuauguguccaucaaugacugaauggaugaagacaauguagaauauauacauaauggaacuugggucauaaagaagaaucacauuuguaggaaaaguauaugaaaauuuuagaaaucaggauuuucuuuuuuuuugguuuuuuugagacaggguuucucuguauaccucuggcuguccuggaacucacucuguagaccaggcuggccucaaacucagaaauccggcugccucugccuccugagugcuggaauuaaaggcgugugccuccacgcccaguuuaggauuuucuuuauuucuuuuucuuuugggggggggggguaauugagacaggguuucucuguguagcccuggaacucacuuuguagaccaggcuggccucgaacucagaaaucagccugccucugccucccaagugcugggauuaaaggcgugcgcuaccaugcuuggcuaggauuuucuuucauugcuggaucuagacuuaaauuugucugagauaugaguguggagcagggucaugggaagaugagacuggcagcagugaguggacaguaauggaaaguaagggcaggggcuugugaguguaugugcaacagucagacuuuagaaaaauggaugcuuauuuucuuucagcucugguaucauggggaaguacuauucaugcuacauggaaaaagucuaacugugauuccauacaagugugaagaaucgucucuagcaggcgcucuuggaaaacucaagcacacacaagagucagguagaacccucucuacuuucuuagaucauuuuauuggcuccugguuccuuuuuucuuuggguuuuucuagacauaguuucucuguauaguccuuacucuccuggaacuucacucugcagaccaagcuggcuucuaacucagaucugccugccucugccucccaggcguuggaacuaaaggcgugcaccuccaccucuuggcuuagaccucucuuaaauugugcauaaaugguuuuccuuugcuguucauugcuuugaugauauuagaucaaaauaauccaguaauuuuauguuuuguauuuccuuaggcacucauucugugccccacuuuguaaacugggaaacauguucaggauaugaacuuggguccuccggugcagagcagucaagaacuguaaguucaguagugggaugagaaauguuagugcgaauguaaaaaaaaaaaaaaacaaggaaaagcuguauuauuguaaauguuccuguguguuucuuuuguuuguuuguuuuuguuuuuucgagacaggguuucucuguguagcccuggcuguccuggaacucacucuguaaaccaggcuggccucgaacucagaaauccgccugccucugccucccgagagugcugggauuaaagcugucagcuacaucuugauuuuuaauaacggcuucagcauuguaacuguacagcuuuuacccaaacugauacuuggcaacucuagauguuaauuuuuuuuaaauaguuauuuauuuuauguucaugugcccaaguauauacgugcuccaccaggcaaggggaggagagucagaugcccugaacuagaguuguagguaguugugaacugccacgucgguacuggaaaccaaacugagguucucugcaaguacaacagauguucucaguggggcucucuccagccccaguauauguuaguauuaaaggaugugugugauaucaacuaagucccaaguagaaaauaugccagugugcaauuagcaguaauaucuuccugaguguagagguguccagauaaaaaaaaacaaaacaaaaccacuaaaaccaaagcuggaugugauucaagccucuaaguccagcacuuaggcugagugaggaggguugcggguuugagggcagucugggccuagugagguccaguccagccuaaguuacaaacaaaaaacaaugagcuuaauuuuagauuuuuaauaaaagcacuuuauuuauaaauaaaucuuguuuuuaaaaaauauuguauugaagcuggagagcuggcucagcaguuaagaguucuugcugcucuugcagagggccuaaauauagguucaguacugauugagacagcucacagcugccuauaacuccaguguccucuuguagccuucuccgguaccugcguucacacacacaccccagggagacgcacauuggccugugcgggaagaaaaucuuaagaggaggucugcucuucagaagcccaaguucaguuuccagcaacgacaagguggcacacaaccaucuauaaugagaucuggugcccucuucuggccuucaggcagaacucuauguauaauaaauaaaucuuuuuaaaaaagaaacaaaagagaaaauauuggggcuagaggggugacugagugguuaagaguacuggcugcucuuauaaaagaccagguguugcuccuagcauccacauagcagcccagaguucagggauccaacccccucuucuggccuccauuguggccugcacugaacaugcuaaacaugcuacacaugcacacaugcuacacaugcacacaugaaggcaaaauacucuugcacaaaaaauaaaaauagcuggacauggugacacaucccagcccuuggaagguagaggcagguagauaucuuaaguuugagucaagccacgcacuucauagugcguuucaggacacccagaacuauagagagagagacucugagucccaagggaaaacaaauauaauuuuuaaauaauaaauccugaauauguauuuucuaaguauaugaucauaccuaguauucuaaucuguuucauagucuugauguuuugauaggucuuuugcauuuuuagaaaaccuaacaaauuuauuuacuuacagcuuaggagaaaaaaaguugaaacaaauuuacagccagaaguuccaggauucaaacaacuuuuaucaauaauaaagguaauucuguuuguuugguuuuguuuguuuguuucguugguuguuuuuuuuuugagacaggguuucuuuguguggcccuggcuguccuggaacucacucuguagaccagacuggucucgaacucagaaaucugccugccucugcauuccaagugcagggauuaaaggcgugagugagccacuacugcccggcccggcuuguuuggauuuguuguuguuguuguuugguuugguuugguuuuugguuuuuuguuuccaagacaggauuucucuggguagccuugacuguccuggaacuugcuauguagaccaggcugaccucgaacucaagagaucugccugccucugccuucugaaugcugggauuaaaggcauaugcuaucacugccuacuuaauaaaggagaauuuuuuaaaaagaaagcuagaaauggggcuggugagaugguucaguugguaaaggcacuuguccugcagcccugguggccaaguuugaucccugggacccauacagagguggacugaaagaacucaauguguaugcucauuaaguauaugagugcacagcaccagagugccugggaaguuaaguaagcuacaguguagauuuuaggcacugaacccagaucauaugcacaaacaagugcucuuaacagcugaguuaucucuccagugccauccuucauguucuaauguuuauuguuagcuauggugaacauuugcauuuuaacuuugucagaguggucaccaaacuuugccuuauuugacucuauuaucugauaaaauuagugaugugcuguugugcucuuccuguaugugagaguccacaugguguuuguaauguagucugaguaacuggguuuauaaacccuuagauuucuccuccucuguaguguguauguguguguguuguacaauuugucaacuugcuugaguggguuacaugaauauucauguuuucuuuuuuuuuuuuuuuuuuaaguucagacugauauuucuuaaugucucaggcuaaauuguuuaauucugcccuuucagaaagauucagaaaagcacauugaaguagaacuccguaaguuuuuggcgaagucaacaccugccuuucauacuauaauuggagacuuaguagcagggcuugugggaagauguaaagccgagccaucguuuuacccccggaacugucugacacagcucauccaaacacacgugcuuuccuacaggugggugugggugucuccugcuucagacuuagccuuuuuuuuuuuuuaaucuuguuguuuguacuuguagguuuuuguuuuauuuuauuugguucuugggagguaccucagcaagugaaguaugaggacuggaguuuggccucccugcgcucccauaaaauuauggugggguauggcagcccaccugcaaucuuaguguaugagagauaaaaauaggacuagccaaaauuucaaucucuagguucaguggaagacccugccucuuuuucuuuuuuuuuccuugaaaguauuuuacuucagauugaaaaauuaacagccugcacgcugcucauuccagauacauaguauucacgaauacaaugcuggucaucuggggaauguauacacaccucaauucuccuucaugcuuuuucuuuuagaaagauacuguguaccaaaaagaaacaucagcaguacaggaaaaacuauuuucccaauaaauuuacgaaaaccuaagauucccaguggaaucaagauuaucuucccgcuaccaccaccuuaauauaaucacaugcuuauuggacacuaauaacccacuuaagaguaaauuuacuuucaacaaugagggugauucuuugagacccugccucuuauaaggugaagagcaguagaggaagccacucaguaucacucuggagccuccacagacucgggcacacacuucuaugaacauccacucauaagugaucauguacaaauuaacaccacucacauagcucaccagagauugcugccuggacaugauaguagucucaguuccuuuccuguugcugugaugacaugggcuucaccacauagaccucuccauaccuucacagcuucgcacaguggguuugugaguccucuuuauagagacuucaaucccaccauacauugccugccucaguuuccacaucuuugcccucagacuauuacugcaaugauaaugcugcugaguucaagaaauggcucagaccacugccauaucagcucauuugugcaggcccuagggaaacauuuugcugggcaguuggauuugaggagcagggaacuccuucaguguagacuucuuuaaaugacucugaauauucacuagauaagggaugauguucugcucuugggacagcuuuccuguuguccauucuagcuuaaacgguuucuaguuaaggguguugaucucuuuaauaguuacagguggucucucaguaucaaacuaaaugaccucuugaaauuuccucuaugaaacaaacugaucuguuauugcucagcucaacuucauguauguucucaggguauggacagaggaaagccagauucuugauucgauaccacacaaguggcccauagcccaguccccuaagcauccuugguccacuguucagaucucuuccaccugaauggccucccgaacuuugcuuucagcauuuaacugcuuuuugaaccugaaagaaagacauuaagacaauguugagauaugugccuguaagcccagcacuuaguaggucagagcagagagauugaguuugaggucagccuggacuacauagugauucuucuuuaaaaaacaaaacaaaagcaaaaaacacuggggcuggaaauaacuugcuugucuugcaaaggaccuggauuuauuuucucgggaccugcuugguaccaagggauccaggcucuccucugacuuucagagacaccaggcacaugugugguacacagacauacauacaggcaaaacaaucauaaaauaaacuuuuuuuguuguaauuuacuaaugauuuuuuaaauauaaaauuguaguaauuguauuacuucuggucucagcuuaugcccugacuugauggagauugcccuagagcacacagaugugcagauguuacagcugugucuacagcaguucccugacauuccugaguccaccaccugugcuugcuuaaaacuuuucuugagguaaguuagauccugugcuuucagucccuugacaucauuuaagucugauuucugagguguuggaugcuuggauuagaaaaugaauuuacagaaguuucgaauugugagaagaauuaacucuugcuuucaauuaacaucauagcguuggugaugacugucuucgagacaguaauaucaacauggagucaguuuuugauuauagugauuccacacaagaugagaaaaaggaaauggaagagcaaauugaaauuguucagaauggcuuuggaccugaagaugggaacugcagugaagauagucagcaguuaaaugauaagccugcagacacagcacacgagcccggcuccuucccugugaccucauguccuguggcaccaaagcgagcagcucugcuguauccuuccaaaucauuuccacugcacuguguccaucagggacauaugcuaagcagaaacuaaggcgugguuaaauuguuuuuccuguguguuuuucaguauuuacaagaaaugcauuauagucaaugcugccuucaauuauuaaaucuguucacuugugugagcucgcucucucucucucucucuuucucucucucucucucucuuguguguguauguguguguguguguguguguguguauguguguguguguguguguguguguguguguguguguguguguguguaggugaauuacacccaugaucauaugcauaccuggcaaacauacuaccucagagcugcuuuccuuugccauuuuuuuuaagauuuauuuauuuuaugcauaugaguacaccaccauuacuuucuucagacacaucagaagagggcaccagaccccauuacagaugguugugagccaccaugugguugcugggaauugaacucaggaccucuggaagaacagucugugcucuuaaccacugagcuaucucuccagccccccuugccauuuuuaucuguuuucuuuggggagucuuuuguugauucuucuggcuuaauuuuguucugacauguguccuauggcucauguagccaagaacagccuuggcuugggaggcaggggcaggugaauuucugaguuccaggcuagccuggucuacaaagugaguuccaggacaaccagggcuacacagagaaacccugucucgaaaagaucaaaaaaaaaaaaaagaauugccgaaugaauauucagggccagccuagucuagaguauccauaaaagagagggaaagaaaagaacaaaggagccacacaacuuuccccgcaacugccagcuugugcggaagcagaagcucuggugcguucaagauuuggcguccccuguaauccaccgccauggccgaggaaggcauaggugcuggacgucaacauuacaagaggugcugaagaacgcccucauccacgauggccuagcacauggcauacacaaagcugccaaagccuuagacaagcaccaagcccaucucucugugcuugcauccaacuguaugucaaccugguggaggcacuuugugcugagcaccaaaucaaccugauaaaggcugaugacaacaagaaacuaggggaauggguaugccucuguaaaaucaaucaagaggagaaaccacggaaggugguugguugcaguugcacagugguuaaggacuauggcaaagaaucucaggccaaggaugucauuuaauuauuucaaaugcaagaaauaauuaaauuuuggcucaacaaguggggggcacacaagcuguaguaauguacaagcuucauugauucugugaaagcauuguuuacgagugcgcagcaucccugagcucugacagcagcagaguauugaccucucccagaccaugagaaggaacugucuccaccagagcagccuucccucuacugacgaguuuccuuaacucccgaguagaaaugcaguccuucauuccgcauacagugagcccuuccuccugccgcacuugaaggacaucccugcgaagcaugucacgguaagugcccugcacaucuagugcauuuuaucugggcuggguugugcugcuuagaucugagcaucugauaggccauccuggacacugcaggaugcuguccugggcauuagacagguccgcacguguuaaaugugcugaggauaugagggugguuugggggugaucaaccuugaugugcucugucugccaugcuuggaaaccaggguagacaaguuaucauuggaaagacaccgagaaagagagaaaugguuugucaccugcguguacuugaucugccccaacuugagugaaacgaagcuucugucagguuugcuugauggauaauuuaguugaacagcuuuguaaauuuauugucuacuaucuacuggguuuauuuauagggaauauuguuuuaccacaguggauaauugugucccucuuucccucacagcuguuucuccaguauuuguauuuccucuauuugaaguguacuggcagugcuaccaugacucucccuggagugaacccuccaaccgugagccaggucagacaucuuuugccuuuguacagaaaccuugcaugcagugucagcccuggaguucuguaacugauuucucccugucguccaagaugaguagacaccaucuuucccucauucccacugguggguuggagagggcuucucucaucaguggauggauaucuggagucauaauuccagauuacaggaucccaaagucaucuuuguaauuggaaguuucuauaucaaaaaaguuucaaaaaguaaacuuugggaucagauaugguggaucaauuuucagaauugauccuaauucugaaaagucaggagcggguggaucucugugaguucaaaacuugucugaucuacauaaugaguucuccuugccuccaaaaaggaaaaagaaaaagaaaaagcaagcuuugccccucugccccucugccuccuugggaugaccaccauuaauguucuuuuguggagcuggguuugauagugcucgcuuggaaggcagaggcaauucaagcuacccugaucuacacagugaguuccaagacagccaggacuacauagagaaacacugucuugaaaaaaacaaacaaaaaucaaacauuucuuuuuuuuuuuuuuuuuuuuuuuuuuuugguuuuuuugagacaggguuucucuguguagccuuggcuguccuggaacucacucuguagaccaggcuggccucgaacucacaaauccgccugccucugccucccaagugcugggauuaaaggcgugugccaccacgcccugcccaaacauuucuuuugugucuaaaaauacugucucguauuacagaaccauauugcagacauggucuggccugauacauuagucuucacauagguguacuugugggcacguucccacaagaaaaacacugagugagacaggcauguauuuucaguuuucagaaugccagaauaccuucccaaacaguagugaugguggcuagcccugaaguuuggggcuguaguuuucacauucugcccauaucugcuauuauugucaagcuucuugcucuuacucaucagguagggagugguguugucuuguuuucuuuguauuucuuugucagaaggugcaguaauuuuucuugcuuuauuccuuuuugugagguauuuagucagguucuuuaccuaucuuucuguuguauuucuuguuuguggggguuauaaacagucccuguauauugaguaaauuucaauucauucuuugacaguuccauguguuacauauucagugguuuuaguccuuuucuuccuguuucucucucccccuugcuucugcugaaacccuuucuuucugagacaugcccuucacuuucauguccgugugagacccacugaaucugauuagggcuccuuugugagcguggguagaagucaucuacuagaucaggaucucucuuccaguggcuagacuacuggacagacacccucaccaauggggaauugcuaguaguccagucccucagggaggguggggccgccuguggucuccucauuuuuuaaguauaauuuuuuucuaggcaaauuuuaauuuuuacuuauaagacacacuggacucauacauauuguauauuuauauauuuucuuguuuuguucuuuugaggcagacucucagucuagggcucacacuggcugaacucuuuaagugcuaggauuggcuuuggugcugggagucucaucaagcaauaucuuuucauauuucuguauuuccuaggacauuuggcaguguagaacuguauagcauacuguguaaauauauauuuuauuugcauuaucuucacuuuagccgguaguaucuaugauacucugucugugauacacagcacucaugauaugucugucaggguagaagguaaaugggguuuuucuugucauuaaagaugauuuuugguuuuuuuguuuuuucgagacaggguuucucuguguagcccuggcuguccuggaacucacucuguagaccaggcuggcuuccaagucagaaauccgccugccucugccuuccaagugcugggauuaaaggcaugcaccaccacugcccggcaagauaauuauuuuuaaaaaauaguauuuugucuucucuuccuuuggugagauguaaaaccuauggcccagccagccuggaggucacaccagucaucuugcagugcucagucacagaugggaaccaccauaccugagaaaacaagcuuucuguaaggaaagccagcuagugcuaagugcuggauuagaucggaucuauguucuuaucacucacuaauguuauccuuacaaaguauaaaagcaagaagaaaacauuuaugcuucuuagaaauuauuccaucucuaagcugaaggguggcacacaccuuuauucacagcucuuuucagagcuagaggcaagcagaucucuagucagucuaucugcacagugaaacccugucucaaacaaaacaaaacgauuuuuugaauuaauaaauuaaucuuuugccgggcguggcacacgccuuuaaucccagcauuugagaggcagaggcaggcagauuucugaguucgaggccagccuggucuacaaagugaguuccaggauagccagggcuauacagagaaacccugucuugaaaaaccaaaaaaacaagcaaacaaacaaaaaacaaaaccccaaaacauuuuuaauuaauuaauuaaucuuucuguauuuauuuccagauuauggauuggauaugccuacuucuagaugcuaauuuuacuguccuauuaaugauaccagaagcaaaaagacuuuuacuuauucuuuacaauuuugugaaaucucagguuugugguucuuuaauauugucagguuuuguuuugagugaggucugugugcguguggguggguauaugccagagcaugagucuguagguuggagcauagcuugagagaguucccauccugcagguccaaggaauaguggccuguuucuagcaguacuuugucucaaaagaauaaaaaaauaauaacugggaaccguggaugggcacugaguaccagcugcacuuccagagguccugaguucaauucccagcaaccacacagugacucauaaacaccuauaaugagaucuuguacccuaacugggcaugaguaaaauccauaauacuuuuccuuaaaauuugccuauaaaggggcuggagagauagaugauucagcgauuaagagcaccaccacaugggaucugaugcccucuucuggugugugacaguguacucauauaaauaaaacaaacaaacaauucuugaaaagaaaaauuugccuaugaagaggugggagucagcucaugguagaggcaacaauacaugauugauuccagugccagaaaacaaaaauguuuuuggaaaaaccacuaguagugauuggaaggugugauguauguggaguuccagcacaguuacucuggguccuugucgucuucagaucuccaucuauuccgagcucaacaagaucgcagucagcuuccgggagcugcagagauuaaaucgggagaagagcaguagaggacuguacuccaucgaagugcuggaacucuucugacagucuugcuggcuguucugaacuggauauauggaccaggcuggccgcgaacucagagauccaccucccaaagugcugggaguaaagguguggccaccacaccuaacuugauggauauauauuuuuuuuaauaugaaucuuccuguucguccagggaagaaagauuuguuaguacccaucucacucaguguccagagagaaauaugagucccuggaccaucacagaccaucacuccuuagugugcugcggguuccacagaaucacuucuagguugcagacaucacuggagggauguugugaaaguuuuuuuaaacaugaaauugagcugauuuuaaguaaacguauuugugucuaauuuuuuacaaugcauuuugaauaguuuuucuuucaaucaaagaagcaaaaccaggggcuggagagauggcucagcaauuaagagcacugacugcucuuucagaguuccugaguucaauuccugccaaccacaugguggcuuacaaccaucuguaauguuaucugaugcccucuucuggugugucuggagauagugacaguguacucacauauaugaaauaaaucuuuuuuugaaaaaaugaagaagcugcaaaacaucucugaugaguggaucuaaggagaauguauaucagucugaagcuguucccagucaucuguaucauggagcacucagggcaccaagccagcauacugcauugugccuacugccauuucuucaucuuucaucuucuaccaucucuucuccuuucucgggaguugagaaauucccuguuccagcguggugucucagaugaacugugacaaggauaugguaaagauugguuuaaauuauaaaaucuuauuaccaaauaaugaaaaugucucucuuuuuaaaaaaaaaguauugaggccagugagcgaguucaguggauaaauaugugcaagcucuauaagccuguugucuuagagaguugaucccuggaguccaugugaagugggaaggagagggccaguuucccaagaguuguucucugccauccacaaacacuacccacaccuucaaucccagcacucaggaauaauagcagacuaaucucucuguguucaagaucaaccucaucugcuuagugaguuccagggcagcaagagcuacauagugaggcccugucucaaacccucccccca

SEQ ID NO: 6463 - RNA, 3878 nt, Mus musculus
uguggagaaaaggguuuauuuggcuuaaacuuccacggcacuguucaucauugaagagcgucauggcaggaaacuggaaccaggagcugaugcagaggccacggaggggugcuacuugcuacuuacagacuugcuccacauggcuugcucaaccuucuuuaaaaaaaaaaaaaaagacuuauuuauuuuuuauauguaaguacacuguugcugucuucagacacagcagaagagggcaucagaucccauuacagaugguugugcugggauuugaacucaggaccuuuggaagagcaguuggugcucuuaaccacugagccaucucuccaguccucagccugcuuucuuacagagcccaggaccaccaggcgaggaacagcaucacccacagucccccaccaaucacuaauuaagaaaaugacuuacagccagaucuaauggagacauuuucuuacuugggguucccacuucuccaaugacuccagcucgcaucacguugacaucaaacuauccagcguacugaccaaaaacaacuuagggaggagaggguuucuuucagguaacaacauaucauaguucaucacugagggaagcugcccgugaccagccuggacuugaagaggaguuccugaggaagggguguuaggagaggggaaagaaggacucgaagucaaucauggguauaagcuggcagcucuguguucugcuccugcuggcuuuccagacagcuggguagauaacccuugcagaccaaagcccaguccuuuauuuacauaucaguucaaucauuacccgggguucccuuuugauuaucccacaaaucaacguuuuaugaccuuagccccucgauacuuagaaagagcuaucaagcacauuuucuuucuuuuacauagcaaauaaauccagagaucugccugccauuguaagcacaaacaauacguuuaguacguuuagcuggauaggaccacacacacacacacacacacacacuuuuuuuuuuauuucuguguauggaaaugugcaugugugaguccagcuugcauguuuggagccccaaaaagguuguuagcugccagaugugggugcugcaaacugaacucagguccuuuagaagagcagcaagugcucuuaacugcugcgccaucucuccagccccucagcugacuuucucuuacagucugacccuucuguccagggauggcaccacccacaguuggauaggccauuccuacaacaauuagcaagcaagaaaaugucccacagacauaccuacagaucaaucugaaaaaggcaguugagaucccuucuucccagauauguugaaguuugaucaaacugauaauaaacuagugauguuagguauaggucaauaauuugccuuaauguucuugcucuguucccaucaugugagccaaaaacaaaaaaacaaaaaaaaaaaaagaaagaaagaaagaaagaaaaggaaggaaggaaggaaagaaagaaggagcaaaggaagagacccagggauguagcucagugaguagcaugcuuggauagcuuauaggaagccuuagcuucaaugcccacuaccacauaaaucagguguagugcuacaccccguguaguucuagcagugggaagguggaggcaggaauaugucuuagucagucuucuauugcugugaagagacaucauaaucagggcaacucuuuuuuguuuguuuguuuuuucgagacaggguuucucuguauaacccugacuguccuggaacucacuccguagaccaggcuggccuagaacucagaaauccaccugccucugccucccgagugcugggauuaaaggcgugugccaccacugcccggcuacagggcaacucucguaaaggaaaacauuuaacuggggcuggguuagagcuucagaaguuuaguccauugucauugugacugggaccauggaggcacgcaggcaggcaguguuggaggaguagcugagaggucuauauccgguugggcagacagcaggaagagagagagagagagagagagagagagagagagagagaacacuaccugguucaccuugggcuucugaaaccucaaaccccacucccagugacguaccuccuccaucaagucugaaccuccuaaucuuuauccuuucaaauauugcugcuccuuaugaaccuacgggaccauuuucacucaaaccaccacagauuagaagaugaacuaugggggcuggagaguuggcucaguuugggguugaaagcccuuggcucaagcccuuguugcucuuacagaggaccuggucugauucucacucaguacauacaugaaagcuaacaaccaccuguaacuccagucaugaaggaucuaaugcccauuucucaccuccaagggcacugcauacacguaauucacagacagaaaugcagacaaaacaacuauuacacauaaauuuuuuuuuuaaaaaucagucuugguuacauggucaguuugaaggcuaaaaauaaaauaucgguaacuuccaggguugcacugaauagccugaacuaaggguugaauuauaagcacuugggauuuaagggauaguuuuguuuaacuguaaaaaccaguucuggagccagaggaugguucagcagcaaaagggacuuccacugagccugacaaucugagcucagacuccaggacccacgugacugaaggcaagaacugagcucugcaaguucuucucugcccuguagacugauacagcgaugagugugcaacacacacacacacacacaaaguagaagaaacuuuuucucucuacuccccuccagacaggguuuuucuaauccguguagcccuggcuguccugaaacuugcucuguagaccucaaacucagagaucacucucccucugccuccccagugcugggauuaaaggugugugccaccacacccagcugauacgccuuuuuuuuuuuuaauaccaaucaugugccacuaaggcagaugcaaaagacuuguaauuuuucuuuacuucuccucuuacccagcuaaaguccuuugcuuuuaaauguccagucgguggccacuaaucugcuugcacaucuucccugcagcugggguaucuccacccuucaguguuccugguguaacccacuugagccuuagacuuugaagccagugugauaaacaccuuuguuacggagccagccccugacuuuaacuucuugcuaggaaguuaaauccucagacugucuacagcaaaggauaacccugaagucccgauccuccugccuccaccuccccagggcuagugucaggacuauagucagucaccaccaugcuuaguuuuaugcagugcugggaaucuagcacaugcuuggugcuugcuagguaaggaugugacaacggagucacugccccaggccuccagucuucucucagaaagcaugaugggaguuauaacuucuggaacacacacacacccgcccccucccucugucucccccccccccaaccagagcgucuccuaacagcucuggaugauagagcuugcucucgguuuugccuguggauugcugcucuuggccugauccucagauucucucccuuuaacuugucuuguccuuuuuguuggccaacuugccuguaucuuuguccuucuuguugccuuuggacagcauugccacacucagagaacggcguccacuacggcagccucacgaagaaaauggcuguaccuccuuaaacuucacgaagacaguuuuagccacugucucuggagggggguugagggcagacaacucugggugauuuuaaaaucuuaucccaaaauaaauuucccacucccuggggauggucuccgugagaugcuggcggcugacuacacacaggcgacccuug

SEQ ID NO: 6464 - RNA, 2145 nt, Mus musculus
aagaagguugagcaagccauguggagcaagucuguaaguagcaaguagcaccccuccguggccucugcaucagcuccugguuccaguuuccugccaugacgcucuucaaugaugaacagugccguggaaguuuaagccaaauaaacccuuuucuccacaucuugcuuucuggcuaugguguuucacuguagcaguagaaacauuaagcucuuguuuaucauagcaacagacaacaaacuagagcaccaacucucccaggaacucucucucauugaguuugaaugaaguagucuauuaagucacacaggauggaagagagagaauguaaguguagacaaguuaggcacaaagagucaaucuguaaccuuaaaaaaagagcuugcuggacccaccacaccccagugcagaugaauacuccgguuguccuagcaaagcuaucaaagccucuggcugacuggcaauuucaugaauggcuauugcagaccuagaauguauccugaacuugagaccaggguacaacuggaaauccguggguguucagagggcuaagguuaggccucagugggaaggugcuuuugauggaaagcugcuuaggaacucggaggagucacaaaaaccuaugcauugaggauuagguauguaaauauuuuacaaccccauaaaguucagccccaggaggcagccucugcccaagaaagccagccagcagcugugugggaaguuuguguguuuugaauacagaauuaaaaggcuggaugggguguaauggguguaauggugagguuggagcuacaaaagggaacauguuuuaguuaauugaauagauauuacacaacucauaggacuucgguauaaaaagcacugugcuaguuuccuucagaggucagacuguggcuuuauuuucuuuuuucaaauuguaucucuuucucuuucuguguaucucucuuucucuuucuguguaucuauguaucuaucuauguaucuaucuauggugugugugugugugugugugugugugugugugugagcgcacacacaccaugggaccuguguugaggucagaggacaacuuuugagaguuggucuucuucuucuuccaugugaguccuaggggcaaucuucagucauuagacaaggcagcaaauacucaggcccaccuagucagccugccagcccaagcauuaacugaaagauagacuaaggguuguucugauaguuuauauaugcucugcccagggaguggcacuauuagaagguguggcccuguuggaguaggugugucacugugggugugggcuuauccuagcuaccuggaaggaguauucugcuagcagcggguacacacuugaaucccagaacuuggaagguugaugcaccaagauuguaauuucaaggucaucuucagccacauuacaaguacaagaaguacaaggagauaagcacuugagacuuuguccuuuuuuuuuuuuuugguuuuucgagacaggguuucucuguguagcccuggcuguccuggaaucuuuagaccaggcuggccucgaacucagaaaucugccugccucugccucccaagugcugggauuaaaggcgugguccaccaugcgcccagcucacgaacaccuuuuuuuuuuuuuuaacggaaauguaauuucuuucuuuuuuuuuuuuaagauuuauuuauuguuauauguaaguacacuguagcugucuucagacacuccagaagaggguaucagaucucauuauggaugguugugagccaccaugugguugcugggauuugaacucaggaccuucagaagagcagucugugcucuuaaccacugagccaucucgccagcccucacgcacgacucuuaaccuggcuuggagagaaucugguuggcacucccaaggauuccugucggcuauguaaucucaaacuccagggacauucaaguaggggcuagguggaaaaggcagucuaugcauucagucuuugggguuauagguuuucuuuuggauauuuuuagacuggaaaacuaaggucacugggaauuuccuacaaagggauguaagauaccauauggccauugguaggagaggcauucuugcacaucaggucauccagcuggguacagcaauugggacuucugucuucuuucc

SEQ ID NO: 6465 - RNA, 24892 nt, Mus musculus
cgggcuuccgacgcacugccugaguggaugagcgggcgacuuccggugcgagugacgagugguggccgaaccugggguacagcaggggacucuuaggcagggaccauggcggacgguggcucggagcgggccgaugggcgcauugugaagauggaaguggacuacagcgccacgguggaccagcgccugccugagugcgagaagcuggccaaggugaggggaggacggccggcuguuggcgggcgccaggggcugagucacggcguggagccugucuaggccucagggggacugcgggcuggagcgugcauccuuggugucuuccuagccgggguuggaccugcuugagugggagaccccgggucuaucuucccgggagucgccgcaacccgaagcuccccaagcccuagauaaauaaauggucaucucuugcccaucgaacuugacgucuggacuuagugcuugcucuuucuugggacgcuaaggaagguuugguuuaguccguucucagcugcaggcugcaucagagaguuugguucuaauauuacuguggcccgaucagcuaauguccuuuaaguguauguaaaucauggcagugacuggucuuuggucaguaggaccaugaaagugauaauacucacgcaaugaacgcgggacccucugcaucuuggugagcuauccaagugaaaguguuacuggaacacggaaggaagcugauuguucuuaugggagagaagcugacauuaguagcuuagauuugaguaggcugaaguaaaguugagaugguuacuucuagagaggacaauauaggcaagacaaacgggauuuaaaagugccaagccugagauggcagauauaugaacaauggugguuuguggugcuagggaucaaacucagggucacgcacacucuaagcaaaugcucuaccauugaacuaaagaacaccauccaucaaaccuuuauuauggaauuaagagcauacauaccuugacccaaacauuuccacacucuaugcuaugugucuggcaacuuucuauaucaguuuauacuuaaagaagccaaggcugaaagcauuuugcccgagguuguaguuaguaauagccaaggauucaaaacuagguuugcucauugccuagccaauguuguugguuauugauaaugauugcacucagaccuccuuaaacuccuacaguucagugucaccuaggauacacucacuaaggauugauuguuugguuuuaagagaacuaaguacagaguguagaauacucacaaauaucagcugagugacccugcugauuugaaugugaaaccaggaguguaaaaauuuuaaaauuauuuuauguauggguguuuugccugcauguauguuuguacacugguuguaaguuuauauguucugggaauugaagccagucuucuggaagagaagccagugcucuuaacuaccuaccaaaccaucuuucuaccaccucccaccccccccaggaauauggauuuuugugugaaauauuuuaaugcuuaaaacccggauguuaaucugucuuaaaaugcugguuaaaccgaugagccaaagaauuaaaagacaccuuuagguaaugccaucuccuaaccauccccuuugaaaugaauacaacugugguauucacagcagguaaaaacaucauuugccuuagaaaguacaacuacaccagcagagguagcugguacuuguaaucucagcacuugggagguucaggcaggaagaggauuguagacaaaguguuguccaagaaaaggccaguccuguucuguaugccacaguucaguuccacucaagggccagaugcuuuccugggcggaugaugggaaauggaugucuccaaacaaagacugggccuuuaaacugguuaaaaauggagacguuucaauugugggggcuucuguguguguugcuuuugaagacugugugcuugugaagcuaagcaagggauauguaugugugaguuuauuacacuuguuuaagggucagaaaagaagacugggaagcagguggacucuucccccugaaacacaggacaauaguuucuguuuguuugguugguuuugguuuuugugcugggauuaaaggcgugugccaccaccgucuggcuaggacaauaguuuuaauuuucagauuuucucauaauccugguuaauuuuuuagauuucuuuaauuuugcuuuauuuuuuuaaaacaccugggcuaacucugggggaggaugagaggugcuagaaauugaacccaggauaugaugggccagcacucuacugagcuguaaccuccagcgcuuuuaauguuucuagcauggcuuucccuccccagcccuuuccagacuggagauuaggccagugcucuugcucuugcugcugaguccuuaacacuacaguucuacuuuagagaauuguaugaacauuuuaguguacauugcuuuauuuuuaucuugagcucauuaguuacgaugaagaaaguuuuguucuuuucauuugugagcagacuuaaaguucaaugguuuauccuuggguaaucaugcucagguuccuagcaacaagaagucaauuuuugcuauaucucauuuccuguuuaaagggucaucugcacuuaauuucccuucagacauuguuuguuucaaaugugaaagaaaauuugaaggugaaauugucagugcagacacuugauacgcaugcgucagguguagggcucagcaguuaggagcguuugcugcucuucagaauuccugaaaucaguuuccaguacccuggucaguggcucauucugggcuucagaacauuuaugguaacuuuguauuaguuccuccuugggguuguuuguugacagauuaacagauugcaucucuuagugguuaauagaggcagacuuagagauccugaagaugccuggcacuuauggacauugaacagauucuguagacauuaccucaucugcagagauuuuuccaagugagaaaaaugagucaaauaaguuacauuuucuggcacucugguuuuggauggcuguuaccaucuuacucccuuugaguugaaaggcugccuggaggagguggcauuuugggagcugugaagagacaggaaggaagaugaugcauagucauuggguuaaacguagaaaagugggaaggagaagugagaugguuugagaacuacuuguauuuaaugaagaugaugaugguagugucccucagacagggcuaacauaauaacuugacagccauaacaacuugucacauccucuuuauugugacgccaagacuaguaagccaguuaagaucaucugaauaguuuaacauauguuguguucaaguugguaugagggaagcuauaaguaaacaaggguccaggccuaaggaacucacagaccacuugguagaccacucucuauauucaccacuauuacauaagguaugaaaauuuaccuucaagcuagauguggugguuugaauaagaauggcccccauugcugggcagugguggcucaugccuuuaaucccagcacuugggaggcagaggcagggggauuucugaguucaaggccagcuuggucuauagcuuuggucucaaaccaaaagaaaagaaaagaaaagaaaagaaaagaaaaagaaaaagaauggccuacauagacgccuauauuugaaugcuuaguuaccagagguuugagggguuuuuuuuccccccuuugguuuuuggagacaggguuucucuguauagcccuggcuguccugaaauucacucuguagaccaggcuagccucgaacucagaaaucugccugccucugccucccaagugcugggacuaaaggcgugugccaccacagccgucgagguuugagguuuuaaaaagcccacuccaaacccagagugucagugucugucugacugugugucugucugucucugccucacccccaccuguggaucaggauauagcucucacuacugcuccagcaccugccugugcacugccugcuccccaccauuaugauaauguaccaaaccucugaagcuguaagcaagucccuaguuaaaugcuuucucuuaggagaguugccuuggucauggugucuuuucauagcaguagaacauggauuaagacauaaagcaugagacaucucucaccugugagcuuggcauacaguaagccaggccaggauggccauuguaggucugaggacagccuggguguccgagugagacccugucucaaaaagagcaaaggugucuguagaagcaauaguauguguuuggcuaaugaagcuucacauugagcuaucaagauaaacagcaauuucagaguguaaauuuuacugaguuacaaaguaaauauuagaauauaguucagggucauggcaaaguagagccuguauuaaaugagucaguauuaaaugaggugcaaagugacaguuucaguucagagagcacuagccaagaguuccuuucuaagaagauggccuuggauguggugcugauccugcaguacauggacuugagcacuacuuccauguagggugcaguuccucaguguccacuucugaguuagugugccgugaugccucuacacuccaccugaccacagagacagcacccaaggcagcugcuagcuuagugaguaaagggugguuaacauccauccaucuaucuaucuuucuuuucucucucucucucucucucucuccuuccuuccuuccuuccuucuuuccuauuauuuucauaugcuauuuucuauagagauuacuuggaccagagcucagccauuuucaguuagggagcgaccaugcugcacuggugggguuggagggcugggauggaaggagccuggacucugguucugcuggugcuucuguggcugaucaagucccuuaagcugucagcuggagucuguagaauggggugacagucaaauuugcagcagacuuccuaacacuguuuuuuuuuuuuuuugucuuuugugauuuacuagccuucuagauuuguccauuguucuccuggaggugagcauucagcuaaugcuaugcauggaucuacagggcuagccucagacuugcagaccucucuacgaugugcccuucucugcucucaccucuccuacucacuugcucucaucgcccagcaggguguauuuaguuugcaucagccgcuccuuaaaaacaugauuuucuggcuagcuuguggguguuuucuuaaaaucauuucuucuuuuauuuguacuuuucagaguccuaccaguuaggaguucuggauagaacaagauaaacagguaucgccacucugaguugauaaauuagaaucuaaaacaaagacucaguguuuucucagaggaaaccucauuguaguuacagguucaguuuuucugagguuguuggggcaggcugugguggcacacacgguuaaucccagcauuuaggaggaggaggcaguuggaucuuuaaguuggagaccagucuggucuucuaggacagccauggcuacacugagaaacccuaucucaaaacaaacaaacaaaaaauuuguagaucuggggguguagcucaguugguagagugcacgacucccaugcagaggcucuugcuucuaccccuaguaccguacagccagauguggucauagacacccgugacuauggaagcaagcaaguagaaauuccgagucauacuuggcuacagccuggacuccaugagaccugccugugaaugagugagugagugagugaaugagugagugaguguguaaaugaacaaaugaauaaaaaagaaguguggggaggggacaaaaaagaaaaacuuguagacugcuggaaaugaggcacagugguagagcacucacacacaggagaaaagaagcgcagcguguggguccuugggaggaaaggccuaaccuaaagacugccucggaggagcaagcuuuucacagauggagaguuacagacaagagcaguaauggcggacauguuuccuuuagaguggauauugcuuuaacuuucccagaugcuucggucagugcugggucuguuggugauacuuauguucauuguuucucuuguuucaggaagggcggcuucaagaagucaucgaaacccuucucucucuagaaaagcagacccggacuguaaguacugggugagcggugcagacugcacuugcagugguuggugcagugguugauuggugcugccuguucacuuacauauauuuucauccuugcaggccucugacaugguguccacgucccgcaucuugguugcaguagugaaaaugugcuaugaggcuaaagaaugggacuuacuuaaugaaaauauuaugcuucugucaaaacgacggagucaguuaaaacaagugaguuccugauugcuuuagaaacacaaaaaacugggacuagacagguggcucaguggguaaagguuccugcugccaagccucacagccugaguucaguccccaagauccacacgguagaaggaggcgcugacgccugcaagguaucuucugaccuccacgugugggcuguggcacacaagcucacacacuuaacagauaacuacacauuacaauguuucagcuguucccauuuaaauaaggaccuuuaggaaucuaaucucugaaagucauggaaaauuuguuuagcuucaaauuuucuaauuguguucuagaguugauuugaaauucuacuggaauguaucuauggaauuucccucccccaggcuggguauagugagcauuccuuaaucccagcauuagguagggaugcaaaggcagguggcucucugggaauaaguggcuagccugguguucauagagaguuccagaccagccagaacuccacagagagauccuuucucaaaagaaaacuauuuaguuucuuucuguuugaagaaugaauuucacuuaagagugguuuaucauauuuuguuaggcaguugcaaaaaugguucagcagugcuguacuuacguggaggagaucacagaccugccagucaagcugcgauugauugauacucugcggaugguuacagaaggaaaggugaguuuucugcgggcaugacuucuuacugcacucugugagggucaagugcuucuguauugcauguauauauauaucgugguuuuuguuaguuuguaugaccgacuggaugucuaugcagccccaaaugaccucagacucacuguguagaccaugcuggccucaaaccccaagagaucugccugccuuuccucccagguucugaaaugaaagguaugugccacuauacccagcaugcaccaccacaccuggcucagaauuaagugauuuuuuuuuuuuuuuuuuuuuacucaccccgccccgaauuaagugauuuuaauccuaaaauugaugugauauagcuuuuugagagaaagagaugggagucuggaaccauuugguagggauuuugccuugguucucuugguuaacuuacugggucaugugacuuuuguaaaaauuaucuacuuagguauuuuuuuaaauauaggagugaucugucuguauauauaccugcaugucagaagagggcaucagaucccuuuauagauggucaugagccacaacgugguugcugggaauugaacucaggaccuuugaaagggcagccagggcuggugagauggcucaguggguaagagcacccgacugcucuuccgaaggucaggaguucaaaucccagcaaccacaugguggcucacaaccaucuguaacaagaucugacucccucuucuggggugucugaggacagcuacaguguacuuauaauaaauaaauaaauaaaucuuuaaaaaaaaaaaaaaaaaaaaaaaaaagaaagggcagccaauguucuuaacaacugagcaaucucaccagcccagucaugugacuuauuaaaaugagucaaaaucuauauggcccaagacauuguagauaugaggaaauuuauagguagauagauagauagauccaugcauggauggauggauggauggauauuuuggugcacuaacaacauggcccaguggguaauuagaugcuuccucccgggccagacagcuuuccuuugaucccugggacucacagguucucugauuuuaauuccauauguacuuuauugcauuagcauucauacaugacuacacaugcaaaaaaaaugugugugaauaaagaaaaagauaacgaaguauuucaaaaguugauguuauuggaaauucaaguuuggggcugggugaggaaggguuauugcauagcaugaauguuuauuucucagacucuuuagagguuaaacuuagauuuuuaguguuugauuuauuaaaaauuaaucuggggcuggagagauggcucaguaguugagaguacugacugcucuuccagagguccugaguucaaaucccagcaaccacaugguggcuuacaaccauccuuaaugagauuugaagacagcuacaguguacuuacauauaauaaauaaauaaaaucuuuuaaaaaaaaaaucuacuaggccggucgugguggcacacgccuuuaaucccugcacuugggaggcagaggcaggcguauuucugaguuccaggccagccuggucuacagagugaguuccaggacagccagggcuauacagagaaacccugucuugaaaaaaaacaaacaaaacaaagagagagagagaagaggcuaguaguuuaaauuguuguaagaugagauuggagagaaggguaaaaauagaauagauagucuuuuguggcucaugcuagcuucaaacuggagguccugcuucagccagcuuccugaguacuggagauacaagcaugcuccuuaccuggccucagacauuuuuuugaauuguauuuacuaugaauugggcuggagugccuuagugaccauggacaugcuuagagacgaugcagaccugcguucaggccacagcauucggaacauaagaugaaucugguuuugaaccuuagaauuagagauuuugagcucugcauauccuuguugcaaaucuuuuaaagccacuuucuguuuucugugccauuuauaaagcuuguaguccuguuacuuggggucuuuuugcuguuguuguugguuguaguggguuuugcggggcaggggguuacauuauuuuacuuuauuuauauauguugggaguugauauccacaggggccagaaaugagcauugaaucccuggagcugagauugcaggcauuugugagccaccagaugugggugcugggauccaaauugcaguccugguacagcaauagacugagcuggugagcugugucuccagcccuggagaauguguuuaaaagauacuuguuuuugcauucugguucuaagugugaagugagagaugucucacagugugugugugaugaauugugccauaugaugaagcuguuagaccuaauagugcaacucugcccuuuaaauguuaacauguuucugcaaguguuuaauaccaucacuuucucuuuauagauuuauguugaaauugagcgugcucggcugacuaaaaccuuagcaacuauuaaagagcaaaauggcgaugugaaagaggcugccuccauccuucaagaguuacagguaaaaugauuuagggaccauggaaacugauaugcugaguugguaguauuuucccguggaaguagauuauuuugauacuucacugcuuguaguugcuacguuaacaagagugagcauguacacagcacaguguguucuuggagcccugaaaacugauuuugcaagcuaaccugcuaaacaaaguuugaagaaauacuagcaucaaaagauugaccuuaguuuuuguagaauuauuuuuugaacauuuguguucuguuuagauuuugaggugguuuuuuuuuuuuuuuuuuuuuuuuuuuucuaguucuuugguugguugguugguuuugguuuuuugagacaagguuucucugugugacccuggcugaccuggaauucauagagauccaccugccucugccucccgaguacugagauuaagacaugcaccaccggggcuggccucuguuuagaauucaaauaaguaaaugcauuaucugcugcuuuuaaauuauuggcuuuauucuuagugaaugguugauuagagguaaauuucuagaccaaaaugguuugaccaagaaaaauugccagagaugggacucuaagaucucagugauaauuguuucccuugccuacagaacccuggguuuaaugcuguagucaccaggacacucuaaaagcacauacuuacagaauggaugugugugcuuucccuuuacagcuaagcauucugagaaaggccagggaugucaccaggguauaguacauuuucugugcucaaagugucaagucaugauaaugaccucacagugccuggaccccaucagaggcugcccacugggcuaaauagguuacucugacauuccagucaauuuccuuuucuacugggguuaaggaaggaaagaaaugacuuuauucaaagggucuagugcccuguauugucuucauucucugcuuuuuuuguuuguuuguuuugguuuuuccagacaggguuucucuguauaacccuggcuguccuggaauucacuuuguagaccaggcuggccuugaacucagaaauccaccugccucugccucccaggugcugggauuaaaggcgugcaccaccaugccuggccgccuuuuuuuuuuuaagauuuauuuauuauuauauguaaguacacuguagcugucuuuaggcacaccagaagaggguaucagaucucauuaggaugguuaugagccaccaugugguugcuggaauugaacucaggaccuucggaagagcaguuagugcucuuaacugcugagccaucucuccagcccugaucuuuucuuuuauaaaucucagauccuuuauauaaucauuaguaauuuuucaaaucaugguuucucugugcagcccuggauauccuggaacuaucuccauagacuaggcuuguccaggucuauuaagaucccaucugucgucucccagugcugggauuauccagcucaccacagugaguuccaggacagccagagcuauguagugaaacccugucuugaaaacaccauauuuuauacacacacacacacacacacacacacacacacacauacauuuuacacacgcgugcacauauacauguauguguguauguuuggacauauaugugucuuagucggaguuucuuuuuuuuuuuuguuuuuguuuuuguuuugguuuuuccagacaggguuucucuguauagcccuggcuguccuggaacucacucuguagaccaggcugaccucgaacucagaauccaccugccucugccucccgagugcugagauuaaaggcgugcgccaccaccgccagacuuagucaggguuucuauuccugaacaaacaucaugaacaagaaacaagcugaggagaaagggcaggaagcaggagcugacgcagaggccauggagggauguuaguuacuggauugcucagcuugcuugcuuauagaacccaagacuaccagccccagggauggcaccacccacaaugggcccuccccccuugaucacuaauugagaaaaugccuuaugguuugaucucauggaggcauuuccucaccugaugcuccuuucucugugauaacuccagcuugugucaaguugacacacaaaaccagccagcacaacauguauauauacguguuuagauguaugcguguguuaguguggcuuuggauuuuugagacaggguuuucucuguagcccugacuguccuggaauucacuccauaggcuguccuuaaaaucagggagcucuaccugccccugucucucaagugcuaagauuaaagguguguacuaccacugcccaauucuguuuagaaaauaugaguacacacacacacacacagacacacacacacacgcauaaaauagauaaacacacacauguguaugacucauaugcauaugcccucguguauaagagaaaggugugucucuacacacagaggcccauggagacuagaugagagcauugaaucuccuagugcugggguuugaagggguugugaggcgccugacacagugcuggguacagaacuggguucuauggaagagcagcaagcacuuguauugcugaccgacaucuuuagcuccauaacuuacuuuuuguauacucgccaacacuauacaaauacaaagaauuaauacgugaucugacugacuguuucaguauccauugaguaauuuaagcuuaccugaggaauugcucugcuagguggaaaccuauggguccauggagaagaaggagcgaguggaauucauucuggagcagaugagacucugccuagcugugaaggauuacauucgcacacagaucauuagcaaaaaaauuaauaccaaauucuuccaagaagaaaacacagaggugagcaugucucugcgcagccuggucacacucggaguguuuggcuggaagccucaagcucaacuuacuuugugaacuuguuucagaacuugaaguugaaguacuauaacuuaaugauucagcuggaucagcacgagggguccuaucuguccaucugcaaacacuacagagccaucuaugacacucccugcauucaggcagaaagugacaaguggcagcagguaaggagacauguggugacagaaggcuagggcagccucagggcagggugcagcucagucuagaacccucaccuggcuggcacugggcccucaguaugauuccuagcaugaggaagaaagggggacaugacuugacauuuuugccuguuuuuauaucacuguaacugccauaaugaugcacuccauggugcugcuuucuuuucauucugccuggcuaaaugggacuauuuugcaagacaaaaaucugauuaacauguugaguagguuacagauaccaauaacuuuggcaacuuauucuauuuuuguuuaaaaggcucuuuuuucccauuguuguuuuguuuuguuuugagucagucucauauaucccaggcuagccucaaacucuauguauucaaagcuagccuucaacuccaggugguuuuacuuaucucccacuccuggaacuaaaaguauaugccaccagagcugcuaucaaaacugcuuuaagggcuggacagauagauggcucugugguuaagggcacugacugcucuucuagagguccugaguucaauucccagcaaccaugugguagcucacagccaucuguaaugggguccaguccccucuucuggugugucugaagacagcuacaguguauucacauacuaucaaccaaccaaucaauuaaucaaucuucaaaacaaaacaaaacaaaaacaaaaaucuugcuuuaaaagaugagaggaucacagcaaguuugggccaacccauugugcacagugaguucugugccagccacagcuacauauugaggcccugcuuuaaaaaguaaagaagaaaggacacuuguggcuaugugcaguuuaagcucacuaacagcaaggauuguccuugauauauuugcccccaaaauuguuugcuuguuuguuuguuuauggguuuggauuuuguuuuuuucuguguagcccuuuccuggaacucagucuguagaccagguugaccucaaauucagagauccaccugccucugccuccugagugcuaggauuaaggaaaacaaagucuaaaacuugcuauguagaccaggcugaccuaaaauucauagguuccccugccucugccuucaaguacuaggauuaaggcacaugccugcccccuucuaugacuauuugaguuaaaauaaaacauacaacuauuuuacucuuuuaccuuuuacucauucccauuauauuuccaguuacaaaugugcuauuguuuacaacuuccuuaggcucugaaaaguguuguucucuauguuauccuggcuccuuuugacaaugagcaaucagauuugguucaccggauaagcagugacaagaagcuggaagaaauucccaaauacaaguaagugcacuugucacagugcaaacccagaucgcuccuuucaccugugcccgugccuacuucaugauuggaguggagaaaaagucacugugacaaagucgaguuagugcugccacagacacugacauagugcguuagagcaugccugaugcucagcuccuccaacacugggaguucucugucagauguugcuuagcaaaagccgccaauaauaauaaucuguugucagcggguuuaucaccagugccuggacaccauguucuucgggagccuguccaucugaagugugucaaccuucacaacaaaccguuucuucccaagugacugacuuuuguuuuaauaguuguuuuuucuuaccuguuugacgcuuauagcuguuucagaauggcagggacaguaaggagaacacuuuugauagaggggaaucucuucaaauugugggaaacaacacagaaauugaccagagucaagcuuguuaugcucuacuaaguaagaguggcaagaauuugauuuguuuguuugcuugauuuuaauuuguuguugaucaagcugagacucucugaugugaaaugcuugacaugagauguuuuucacauuuugaaaucuuugcauguacacaguaaccauguuggguugggcuggggcccaagccugaaguugaugcauguuucaucuauaccuuauagggcuagucagaagauaaucuuacgcaauauuguaacuuucagaugaaccaucaggugguagagguguggcucucuccccauguucuaguucugaaccaugaugcuuccagugagaacucauugccuuacacuuggucacaagcuuaacauucaagcccacgaaguccuguggacuuuuccacuguggcaucaugucacauaggccacaagcugcauagcgagcaaaggugcuuauaaacccggcagccucagccacucagaacccacaaggugggacgagaaccaacucucacaaauugugcacccucacucacgcacgcacgcacgcacgcgucaguuuccggucgggaagcacuguguaucugggguuuggggcuggccacagugaccuugcugggcggaucucggacaccgaguugcauucacagggaucugcugaagcuuuuuaccaccauggagcugaugcgcugguccacucuuguugaggacuaugggguggagcugcgaaaaggcuccucagagaccccggcgacugacguuuucagcucuacagaagaaggggaaaagagguggaaagacuugaagagcagagugguggagcacguaagcaccaggcagccugcuggcucacgucguaccucucagacugccucuuagaacuaagugggugauuugagcauaagcuacuucccuuuucuggugaagggggacaagcuugcucucguuaugaagcucugaaaagccugcaauucacuaugugggccaggcuggcccugcacugccucugcugucucugcccccagguacugggaauacaagggcaagccacagcugaaaaccauuuuguuuucaauaauuuuauauguuugccugcauggguacuaagugcgugcagugccugugaaggccaaagaggguaucaaacccuguacuuuuaauucauucugucucucucucucucucucucucucucucucuaauucauucugucucucucucucucucucucucucucucucucucucucucucucacacacacacacacacacacacaccuaccuucaugcacuugggcacuucucaauaaagaaauaaaugagacugucucaauaaauaaagaaaugaucagucaauaaaauacuaaguucacaaggggcugggcuaaagagguugcuuagugguuaagagcacuggcugcucuuccagaagaccuagguuaaauucauaacaccuaugugguagcucacuaagucugucaguaacuccaguuucaggggaucugacacccucgcacaaacaaaacaccaaugaacaugaaaauaaaauacuaaguucacaaauaacugcaaaagccagucuuuauaccucagggguuaguuuuucuuuugagauuuaaacccagcuauagaaaagcacagcccugcgucuguggugcguaugugaaugcuacggaacugacaacuguuguguguguccccugacagaacaucagaauuauggccaaguacuacacucggauaacaaugaaaaggauggcacaacuucuggaucucucuguggauguaaguuuugagugugcugucacggcaugucauguugugugucaguggccuugugaaaagggagugagaaaauuguuucacuguuuaugugcucagacagaaguucucaccucagacugguuuccucuaccuuccuguauucucucuccaucuucccaccucuaucucccaagugcuccccuuggcuuuuauuauuuaaauuuaaaauuuagauaauuuaaaaagucccaagcuaucuugaauauccccccaagccaaaauuaauaaguuuauaguuacauuaauauuguuugugcuaaucagaccuucacugaaaggucugagggucuaauucccagugcccccaagacuacauuugcauugguugguuuaaguucacaguguauaugauaaaaauguugguagaaccacagaaacaugcugugugucucuguugucagugacaguacacaaagaugugggagguagcguugccuguaauccuggggaacaggaggaucuuauauuuaaugcuccugucccauaguuaguugaaagccaaccuaguauauacaugggacccugcucucucuuuuuuuuucccccuccagacaggguuucucuguguauaguccuagcuguccuggaauucacucuguagaccaggcuggccucgaacucagaaaucugccugccucuaccucccaagugguggaauuaaaggugugcgccaccacugcccagcugggacccugcuuucagaaagaagguccugaguucaaaucccagcaaccacaugguggcucacaaccaucuauaaugagaucuaaugcccucuucuggugugucugaaggcagcuauaauguacuuauguauaauaauaaauaaauguuugggccagagugagcagagguccugaguucaauucccagcaaccaccugauagcuuauaaccauugguacagcuacaguguacucauauacuuacuuacuuacuuacuuaauuaauuaauuaauuaauuaaaagauuucuuuaaaaaaaaacugaauguaggaguugauagccauuucugucacggcaagaacaugcuauaacaguucaucugaaagaaccaccacaggucagaguugaauggcuucccucuugauuagugguuaguucuugugaaagaggacacaccagaguagcaugauuuaucuguggccuuguagcugccuagugacaaagcauguguucccuacccagcauuucuggaaacagcuauaccauaaugccucuaagagguaacugggugaggaauccugcucagcgggcaagugcaugccuagccugugcagccccaguuuaauccccagcacugcagagaagaaaggagggaggaguauaaaagugggaccaguucauggcgcuagcccuguuucucaucgccaccagggcucuaaaucuacaggguuacacuuagucucagaccucguuauagagacacucagauguuguguugguugguuuccuuguuaacucugcauuuacagucggugcagaaaggaaccauguucccgccaaguccuggucuugccugcaccucccccgugcugggagcugccaccacacuugacaggagacucauuaguugaucauccaguguuguaucuucaucaucauggucagcucagugguuggcaaggaacugucagugcucucagcuuguguguucauggguggagaauuuuagaauguuuaguuauccaucuuaauccaaucugucugucucucacaggagucagaggcuuuccucucgaaucuagucguuaacaagaccaucuuugcuaaaguagacagguuggcuggagucaucaacuuccagagacccaaggauccaaauaauuuauuaaaugacuggucucagaaacugaacucgcugaugucucugguuaacaaaacgacacaccucauagccaaagaggagaugauacauaaucuacaaugaggcucuggaugcuuuuagaagacacaaaauuggaggucauuaaaaaagaaagacuguuuucaugguguauauguuguuuuuuucuuacucucgaccuuuuuugcuaaaauuuuaagauaguaaauguguuuaagcccccucugccuuucccacucucugauuucaugauaacugcaaaacauuuuuucagucugaagacagaaagguuugugucucagcuuuccuugaguguguucauacuauuuguuuuuauucaccugacagccacgugauaguaauaaaaacaggacauguguuagcuccugaaguugccaggguggugauuaacaaguguuuauaaaggauugugucauaaagcuauugaugacuuauagaauaaaaaaaccaaaaauaaaaaaccaaaaaaaaaaaaaaaaaaaaaaccauagaccaugcaaggaucuugugcguggaguuugcuuuguguuuugacacugacaggaaggcucuggccugagugcauuuggaaugcucucauggacucugcguucuuucucucacauugcauuacuauacuuuaaaaaugacugaaaagggacuggagagauggcucagcgauuaagagcacugacuacucuuccagagguccugaguucaauucccagcaaccacaugguggcucaaaaugugggggaggacagcaaucugauccugucucugcuucccaggugcuucugggauugggcacugggcucuguacagugcuaagcaagcccuucccaacucagcuacaccuccacccccauaagcaaacuugaguuacaguauuugaugauguuggccccuugcacuucucugacauccugcugguuuugagggggucuuccguagccuaggcugaccugaaguuugcuguguuguggagccucccuccccuuuccagaagccaggcuucaggugugcacucccaagcccgguuuagcuggucguuaacuaagucagaugaugauguuacgagcugcuuucuguuaaauccuguuacaggagucacuacugaugguauugugguuuggcuuugggagcuguucacuucucccacauccuuuguauaaacuuaugccugacaccuaagguuuuuuuguuuaugggaaguccagcccagagcuucggauaugagagcuugcccaugaacuauaaaccuggccuuacauuuuuacuuuuuguuuuuugacaggguaucacuaaguugcucaggcuagauuugagcucacucuaacccaguaagccuugaacuuggaauaaugcauaaacuggcgaaguaucuaggaugacagaccugugucacuuggcauggccccucaagugucacucauauagggcuccuuccaggcuucaggucuaguuaugcccauaacaggccaaguucauuaucucuauagaaucuccaguuccacacccugguucuagguaauauaauuacuauacuuuaaaaaugacugaaaagggacuggagagauggcucagcgguuaagagcacugacuacucuuccagagguccugaauucaauucccagcaaccacaugguggcucaaaaucaucuguaauggggaucugaugcccucuuuugguauggcugaagacagcgacaguguacucauauacauaaaauaaauaaaucuuuuugaaaaaugacuaacgccgggcggugguggugcccgccuuuaaucccagcacuugggaggcagaggcaggcgaauuucugaguucgaguccagccuggucuagagagugaguuccaggacagccagggcuauacagagaaacccugucucgaaaaaccaaaaaaaaaaaaaaaaaaaaaaagacugaaaagcuaaaggccaucuucauaguaaaugucaugguuuaguuuuucucuuucauagcauugaaacaggugcuuuuaugucagccucugagaucaaucaguauaagcaaguuuuguaagaugguggguuuuuuguuuguuauuucaaagaaaauagauuaaaauguuagaaaauuaaagguuuuuuauuuuaaguggaggagguaugguauguguucuuugaaaaaauaccacagaggucccacaauugucccaaauuguggaaucaugaaauaggacaauuugguggccuuuaagugggauaugagaauagguauucgugaauggggaacaguguuugguuuagccaggcgugguggugcacgccuuuagucccaacacuggugaggcagagacaggcugaggcagaaacaggcaggcuggccucuugaguuugaggccaaccccgccauuugcagcuaaccuuugcuuuauuuuucuuuaaaacauauauuucauuuguuuauuguauuuuacauauagaaauguuuuggcuacauguauguauguggaccacuugcaugccuggugcccacggaggcuagaggaugcuagaggaucuguagucacagcucuaugugagccaccguguggaugcugggaacccaucccagguccucugcaagggcaacaaguacccuuaacugccgagccaucuccccaucuauuguuuguguguuuagacccuugguccugugaaggcuugaugcccccauccauauaggggaaugccaggaccaggaagcuggaguggguggguuggugagcagugggaggaagacgggcaugggguuuucagaagggaaaccaggaaaggggauaacauuugaaauguaaauaaagaaaauacuauuuuuuuuuaaauggaggaaaaaaaaaagaucuucagccugauggaugcuugucugcucaccagcuucaauccugaaguugacagcacacugacagccugcaguuucagguccuuuaagucgcugggauccaccauuggaaaauauuucucagcccucccaagucuuugcuauucugccucuggcugagcccucucggguuuuuaccaucucuguaauuuugucuuugcggacaugacucaaugguagagcacuugccuagcaugcacaaacccuguccucgguccccaacaacacagauuccagugugaccucuuugcaggaggucacaugguugaaauagaaaggcuaacaccucugucgcuucuuuuacuuggugcuaugauuuauguucaccacccccaccccggucuuuuaauuauucauuugucuuuagacaaauguuuuuuuuuuuugguuguuguuuuguuuucccacuuugguuugguugguuuguuuuuuuugggggggagggggguugguuuuucgagacaggguuucucuguguagcccuggcuguccuggaacucacuuuguagaccaggcuggccucugccuuccuagagcugggaugaaaggugugugccaucacuggccugcagacaacuucaguuuuuaccaggucuugggaccagugggauggccaaggguguuugcuggauacuaguguggcagugacaggccaaccucguucagcacuugcuuuccuucucgcuggagacucacugcuauauaaccagaccuacuggcuggugaacuuguggggauucuggucugucuucacuggaagaacaacuaggauccagauccauuuuggacacugaacucuguuccucuggcuugugagccagucguuuauccacugagccaucucccaagugaaggguugaaauucuuuuguuuuagguguguguggguguuugcugggguuguguguuuggugucaaggaguucagaacagggugucaaauccccuguaacuggaucugcagaugguugugaaccgccauaugaguccuaggaauugaacccaggcccugugguagagcugcuagugucauaauagcuaagcuagcucuccagccuucccagcguucaccugcaagagcuaucuauaguguaugugcagagaccagaagauaacuuguggaagagaguucucauguuaucuucugaccucguacacaccaugcaugguaugagcgcuggcacacauacacaugaaauaaaucuuuuaacaaagcuaugacgaaucugugucgacauagcauguucgaguuguguggauuuugaaguagugggaacauauccugcacaguugucugcagagguagcugguugccuggaguugcagcuuggcacacuggaaaccuaucacauccuaugagggagcagcugcaugaggcuguugguccaguguggcacugggccuacaguggacuguugucuauugccagauuuucaggcuuguuacugccucugagacauguuugcauucuucaagaaucuauaaaacuccuuaacuaggagcuuaauauuaauuauaaugaaagaaugauuuuuucccccaggauuacaaauuuuguuaguuuucucuuuccuccccuaacgagguuggagacacacaagaaguguugguacacucuaugaccccagcagugggaagaaagguuggacaacaggaccacaauuucagaagccccgucucgugcugggguuguggcucaguucgguugccagcacuugagaaucagaaacagaagggugaagacacagucagagucucugguuguagggagucggagaccagcugaacuacaggagcccuugucucacaaaacaguuggcaucuauguuaauucauuuuaaaacauauucauuuaucuaucaugaaggugagaggaccacuugucugaguuuauuccaacugccaaguguaucucagauccaacccagguccucaggcuuggugucauuaccagcugagccaucuugcccagaaccccugggacugcagugcugaaucaccuggccugcucacacacccaacccacacacacacacacacacacacacacacauacacacacacauauacacacacccacacacauauacacacacccacacacacacacaccgcccccauccuucaugcccaugccccucugccauccuuuuccguccucgcuuacaauuuuuuuucuuuucuuuuuuuuuucuuuuuccuuuuugguuuuucgagacaggguuucucuguguagcccuggcuguccuggaacucacuuuguagaccaggcuggccucgaacucagaaauccaccuacucugccucccaaguaaaccacgcccgguucucacuugcaauuucacacucugguuuuugguuuuuuuuuuuuaucaacuacuuaaacaauccacuuuuuuuuuuuuaaagauugauuuauuuaugauauguaaguacacaguagcugucuucagacacuccagaagagggcgccagaucucguuauggauguaauagccccagcugugagccaccaugugguugcugggauuugaacuccggaccuucagaagagcagucgggugcucuuacccgcugagccaucucagcagcccacaauccacauuucuaaagcagccuugacugccagauuguaauagccccagcugugcucucacagcaggacaguuuccacagcugucugaaggccccaugaguaaaccccagaugggacccagcuucccacccuucucuauucuaccccuugggcacucuuaacuccugggucacaugccugucuccgaggcucuuuggugcacacuguguggugugcuauccagacuguaccuccgacuccagaucuuguauguuaaaacugagugaacuugucuuugccugccucccuugguuacuuccaucucaagaggcaacuucucuuugugagcauggguguauaaagaccugggccuccugcuguugagggguuagaagauguacagcucucagaagcccugagagcucccucuggaacauggagggaggccuuuguuacugacuuacaguucagccuucugacuccuccugccuucacuugcccauagguauggaccacccaagcaagaccucgcagaaucucccuuggugcuguauccaucucugcaucugcuucuagggagauuggacuugaguugguguagccugggagccaagaaaagagacaacaaugggacucuguaaccaccccaaccacugacuagcuggcagugagaagccaucacugcuaagagugggagcucccauagccccugggaaacaguggggaugcuuuguuaaaacccguuuucuuaggcugacagauagaaggggagcccaggcuuuuaagaaaugugguggaacugcuguuucuuggggcagucaguaaguagaagaaagacaaagacucaucaucaucuaagggcuuaaguguguaaaccagaggacacucauuagcaccucuugaagagaccuguccaagauguaggaagaacacugucagccuugggacugcaugagugugguaguccacacacuggagaagcuaacaacccaguaggagcuacuuggucugugaaucuggauucuuuagcuaucccacucuggagcuaaagaccuagaggauuccuggagaaccagcagucuuuaggccacguuggaaccccagagaaguuagacacugaugucagcagaagagagaaggugggagaaacagggcagguguacucucaaccagaugcaaaaggaaaacgaaaaagcuggcuacauagugagaccuugucucaaaaaaaaauuaaaaaccaaaacccuucua

SEQ ID NO: 6466 - RNA, 5448 nt, Mus musculus
auuauuaaaaaggcauuuuuuuauuauaaauacauuuuaguuguagcaguaaaauacauuuuguguuaccaugaaucuuuuaaaacaaaagaacuucacugacaagggucacacuguagacuccugggcucaaaaaaaaacaaacaaaaaaacaaaaaccaaaguccuaagaaaguagcguaagcuaaggagacuccaaaacccgaguuaggaaagaggaagaacagagaaaggaagccuugguggccagcuuuggggguuaucuuaugauacaaaaccaucuuuacuuuuaagaauaaacucuuccgguauuagagccucucagacgaggcaugguauaccgcaaagggacagagucacuguugugguuuugccauagauuuaugcugagucagaugcugcauaaguggugcuuguaagguaaacggaccagggugguuuuacauauggccucccuuaugaaggcuuucccaauagaagauccagaaugcaucuacuaugugacugaucccauacauuacugaccacauuuagagaauuguauuuaaaaaaaaaaaauuaaaaagcaagauccugcaucacugacaauuaggacgcuuuacuaaaaugcaaaccccauuagcuuuauaauucagagaaaguauuuggaccacucuauucucccgggaugcaacuauuaccuauaaccaguaccuuuaugggucucaaagaaucaggucagauggcuggcacagaaaucagauucaguacuugauguacauaaugucauauacauggauagauagaagcagucaccuuccugauacauggaaaucagggacccuucggcggcggcggggggagggggggucguugagaaacaaucuuagguaaaacugacacuuugggacuucaaccuggacaaaagaguccucugaccuccugaaagauacaaagugguaucaugcaaggcaaaucgcaaauaaaccgaagucccuuauaagcugggagugcauaaaggaaagcugugcugagcacaccagcaaccugcagcuagagcuucccgggccuuuuauguaggaaguccugggggcuaagaacucuaaagcuguguaaaucuaugauggucacuguguauuauacuucuacgccuacgccguucuacauucuauucccuuaaaaauagauuuguuuucuugcuagcaacccaguaaauucaaagccagacuagaaaccagaaagcagaacccgauacccgccaagcugcagcccaggcugaacauuaaacacaacacacaaauguaaaacuauccaaagaccugucagguugauuauguuguaggcaguuucuuucucaaaacuaacgugcucacccaugucugcucugacuuaggagucacucaugcuaugcgggugguguguccccucaacucuucggcaaacauacagaggucuucaagguagcuaaggagucagaaacaauugcuuuuuuccugccacauacaacacccaggcucucccuaacaccugcaggcacggcagagaacccaaaauaacuuuguuaaccugagaaacauauaacacgaagguaaauccuuugcccucgccccaacacacauacaaaauaagaaagggggggauaagauuaaaaacuauaggcuccauucauuggggacugucuaauguuuccgaugccccaagucacugccaccgaaggaccgggacuaagagccugggcaagugcaagcacacucucagggcauccgauggcuucuuuccacaauuaugucuccauguggagggaucgaggucgacucuaagcacaucccacaaacgcacagcuuccgaacaauagccaggcagcugcgucacuaacaacaaacucacuccagaaaugaaagcgccccugcacccuaaugaggaguagcagagaccccaaagggagagagagcucuucccacgaacgggccacuugaggugccaggaugauuaaaauggcccacgaguaaagagauaaaccccuccugacucucaaagugcgcuuccuggacggcugugacgccacccuggcagugggcccagcaaucucaacaacccguccagggaaaacugaggccagcuucagcuucauaaucacuuuuuuuucccccuuuauuuuucuugaucuugcucacaauucuaaaaucuuaaaauaugauagguuuguaaauaguuaccacuguauguuaucugccacccuuaccccccucaguuucaaacauuaaaauauuaaaacaauuauuccauaaaaaucaaaauuuuucuuaaaagguaauauugauuuccccucccguacaucauucuaaggcaggcaagcacaugcuaguauacuaaauaaaauacagaagagaccucauaugagguagaaauagccaaaaagacgccccccccaaaauacugaaaaucucauaauauuguuuaaugaacucauagaauuauauaaaacuuacuaugcauuauguuuaauauuuguaucaaaauaaaaucucucuguugaacaaauugcaaguaaagucuggucuaccacucugaugacugaaacuauaagacuuguaggcucucuugaaacucauuucagaagcuucaagcuuaccacuggacaaaugggcuggauuagaaccacagcucacaagucuaagucuagagucuucuauuauguaccuccugacauaaaguuuuuuucuuuuucuuuuuuucuuuuuuaaacaaugcagguuuuguuaaguagauauuuucaguagguucgaaauaucugaauguuacacuaaaacuuuaaacauaaaaauuguuugaccugauauucuagcuuagaguugaugauauaaugccacuuucugauguuuuauugggaugcuaaacuucaguaaaaauccccuccuucuguggucuuggaauugcuaguuaaacgagggauaaaacuggcaagugugaaccucgaagccucugucaagucgcagagggaaaugugaaggcuugauggaguggaugcucugaggacccguaugacggguacucuggguaccaggcuaccagggacacaccaagugaugcucugaacaaggagagcaagcaccaccugccucuucucuaacuucugggcagugugaauacugaucagaugacaccugcgcccagaugugagcaggacacauggggcgguugggagcaggguugucaaacauuaugggaaaggcaagaauaacaaacaaacaaacaaacccggaucuacucacugagaaaaggcggguuuaagugugaggagguggagaggugggugggggagggauggacagccuagguaauauuuuaaagcaguaauguguauguuuuacucuaugggaaguuuuaaacuuauguuucuacauaauuuuucuacuaauaaaacucuccacuacgcaaugauucuuucgcucaugagcaucuccuuaaaaaaacaaacaaacaaacaaaaaaucaccuaguucaggaaaucuaacauuucccaugacaaucgugggaauguucagauuuagccuaaaauuguucuccacacccugacucgcagucgcgguggcuagagagauacauucuuuuauguuuucagcuuugcucucaaaaugaaacauaccaaacuuagaaccauuaacuacacuacagcaacauaacacagcauaugagcucaagauuaaaaagacaguuuccucagaaccucaaggccuucagaaagaggaaaaccucuccaaugcauaggcuccagagaccgccauguuuacuggggaaugcuuacucugggagacuuccgcguauuuuccuuacccugaaguucucugaacagaaaggaccaguugaugcuuacaucaaaccugaacucauccuacgaucuugauuagaaacaaggcaaaagaaaaagaacccacagcagacaauuuuguucuccucacacaagaugacccagacagcgagcaugucugugugacgacaggaagaccgagauccuuagucuccaugaucaauaacuaacgacugacuggucaaggacgagauaacgugacuagcaagcguggggccacaauggacuucuuugaaaaaaacacaccagaaaauacccaugauacagugaaugaggcuugucaauucucaucaggaauuuauuuuuagaucaagagauaaagggugggggggugggggaggggaacaaacuuagcgcgaauacucugaauuaucaccuaaaagaacuggaagagaaagaugaaggagagagggacagaaagggaagaaagaaacaccucgaguuuguacugcaauggcuaaaaccaguacuggcaaggacaaggaaacgccuccgacgggaaaggaugaagagaagagaagaaaccauaaaggaaacucaggagaagaaaaggcauggcagaccuaucaaguuuuccuuaaaaaaauaauaaaugugugcuuauguauguaaacaaacacguauauacacacguauguacacaugucccaucugaacucuaaaguugaaugaaagaagcaagcuauuuccgggaggcugacuaacccugcuaaugcuaccggggugacugcagagagccccaagcgagagcucgcaauggcucuucugguaaggucugcugucgacuguuacgaggugcuggguguaagaaauaggcuuuuuagagccuggacgggaagacaagaguaacgcugggaaggagggauaaguacucuaaccagaccgugaagcgacggaaggaaacccccaacugcagaagcaggagagagaugggaacgcaccgacacucgcaacagcgcagucaaguaaggaaguagcuagugucauuucuuagacauaaccacguugagaaugucaccgcaaccugacggguuccccauccccggggucccaccaucagugucuuauauaagaugauagggugcacacgugacuuuaacuaaauauaaauaauuuaaaaaacucauauauuuuuaaagguucaaguaugaaaaacaaaaaaguaggcaaugaucuccuggcgagaggugacccgaaaacugacaguauaacucugucugaauuagcaggauggcucugaacucuugcccggcauguacuuuguccugugugucugcaugcgugggcgugggggcacucaccuaugggacacagacagcucuaucaugggugaguccuacuugggcacagaguuagcaaacagagaccuguggcaaaaguugucucauucugccugcgucacgccagcaugugaugaugucaugucacgcagaaugugguguccugacucaguggauccccgugccugccgggaucugugaacaccacuuuagucuguggguccguccauaccuggcagcucagaagaggcauguagcccgagacaggaacaacaggaagccagguuccaguagcccaguccugagcacagaggcagaacu

SEQ ID NO: 6467 - RNA, 2119 nt, Mus musculus
caacccuagacuccucccgcccccacgccagccuccaccucccccaggggcgccggcgaggccccuggggaucgcuccgcucucggguugcgcgcgcgugcgugaguuucuguguguuucauugugucugugcgcgagggggugugcgcgugcgagccgagaguuugugggaucgguguguuggggagguccccagccuagagggacccgaggcugcugcgcccguguccacucgggaacccacccucccagcuuuagguucuuugugucucgcguggagccagcgccgcgcccaccccucccccggcccacuccccggggcaaugugugcgugugcaugugugcguguuaugugugugcguuggggguagggguccuaccuucgaugcaacacacccgccacagucccgaaugggugaggucgccgcgagcgcggcggggcgggggcccgucguccauggucagguuggugccguugcagaugugcgcgcuggaguacagccaguagucggugccgauggcgauggccaugagcgagaaggcggcgaaggcuccggccguggucagcagcaucugcagcccgcggucgcaucgcaccauggugggcgccucauaguccgccgcccgccggcccggcccgccgcgcccgcccgcccuccucccucggcgcgcggcuccgggggcuccaggggcuggggggccgagggccggggggcggcgccgcgcugcgcgcuccgaccccgcgccccgggcgugccugcgcuccggcugcgcggggcucaaacuccgaggcgcggcggcgagugagggcugcgcgggcuacgcgggccgccgggcgggcuggcggcggcggcagcggcggcgguggcggccgggggcuccucccucucggcccgcccuccccuccgcucuuggcccgcgcccuccgcgccuccacccaccgcccgccgcccggcgcgcucucucggcgccgccccuccgccucuggccccgcgcucgcucucccacggccgggauuuucccuccccucucuccccucccugcgcucacgcgcgcucucuuuucucucccaggcuucauucacauuaucagagcgaaggaagccgagggaaagaaagauugguucccuggaaggaccccggggaagcugcgucuccagucaccucucuuuccaacccgggacagccaggaucuccuuaguccccaggauucuguaucccauucugugggauggagauugcguccccuuuccuucuuuccccacggccuuauggcuguaccugguuaugaaggucuaggcagggauguacugugagacuccucgcguuuccaaagggcccagaugugggucacagacgggagacauucuuuaugggccaagccagaugaagaucaccuccauuucaaccgaagcaagccaagggguucuagcaggcacuggggagcucuggacuucuucgaagggggacugaggaugugacacacuacagucacacuucugauaguccauugcugauagaggcaggaacaccagcaacuacauuguagccuccagcuguuucuucucccuguccuucucugaaccuuuacuuuuucuccgguuggcucuuccucagccuaaccggcucuuccucaccuccccuuaaccuugucagacucugccucggggccucuggccucuucccuuaauugcuuuuggugcuggcagggucccaagcuggauacacuccgagcuccuuggagccaggcuccuuccuugccacccaguuccccuccuccccugcaggaggccugaaacccacggggggggggggaacucaggccauuucuuacacccuugucccuguugcauccucgaggguuguucugugggcugcuguucugacccccugggauugaaagagacacauggaaagcugcugcccuugcaauuuuaccucccgggccacuuucccagcuuuccucagagaaaauaaaugaaugaccccagccucagagcacucacuguucuuccucucuggagagugugagcuccccccucguauauagccgugugugguagcaaugugcaaauguuugcccugggaaaaauuaucuuuugcugggagaagggaauaua

SEQ ID NO: 6468 - RNA, 4577 nt, Mus musculus
uaggcaguagcaucaucuuuuuguuguuuuuuauuuaucuuuuauguaaaaauaauuuauagaacauuaaaacacaaauaguaaguuguagucuuccaucaaaaucaguaugcauugauuacuugcaugguauuuaauuauauauuaccgacaaauauaugaaauauagaucaaaacaaagccauaauuuaaaaggaaucucaagcaugcaauacuaaaauauucugucaagaggaaacaaacccagaacauccccuaaugacugcugcagugugguucagggaugcugggcacuuaguagcauaagugagaaacagcuaacaagaguguguaucagugugugccuucuugacuagaggggaguccuuccccacccugagaguucccuuuccccuucagaaauggagcggauagucuuagaaauaauuacuuuuauuaaggugccacucauuaacuacuuaaauucacuaaguaguagaacugaaucuugaaacaaguuaagauuggguagugagcaauacagagcacuuacaagaacucagaaugguuggcauccaggggcugcuuucugcaagggcagucagccuuguguacugugaacaucauggcuguuauuuauaaugaccuuauguaaucgagagauauguagaguguucuauuugacucuguagcuguaauguuuaacauugagaauuuuuuauguucuaguauucacaagaaccuugccugaaguaauucacuuuaccagaaaucuuuuuuuuuuuuuuuuuuuaccagaaaucuuaauauggcucucguugaucccauuuguagagaggacugagacacacaugcuaaauaacuugagaaguagggagaugaccauugaaacuuauccugucuuucuagcuagaguugcuuucugccuccaaauaaugaguaaaguuuguuucuauuccaauuuaagauucucacacugugccaagcagaguaauaccuaucaaggaucuauaagaaguaagauaggaguugaagucugagccugguaaauugugaaaagacagcuuuuccuacguagaguaaaauaaauuuauugguaaaaaauuucaaggugagaugauccuucucaucauaagaaaauaguauuuaugacauauuauaaguugaucauuacagugccaagaaguggggcuugugucugcucauucucuuggccagucaccgccucagcaugcauugucuucucugccucccaguuuugucuugauuuagugguuugccagcugagaaacuggaaaggcuuuuugauauuaucauguaaaccugcaucuccagccucaugacuaguuuaaaagaauauuguugauuuuacuaauuuauuugcuuuauacaaagggaaaaauucaaaauaauuauaaaaaaggaaggccaaaaauaugugggauuuuaauuagguccaaccaaacuuauuuuuaaaaaacuacuuuugccugguucugaugcaguguguggcaugguuuuagagugugugugugugugugugugugugugcgcgugcgugugugaugugcgcuucuugucauucuuucuugcuucacuguucagcagauucauauucaguccuauggugguggccagcaggucuaagugguuugucacauaccaaguggagugcuuucuuaacccucagggaggcucugcagccuuacuagcaguguggcuauaaauauaaggcauucacuuuucacuuucuguccagcuguucaaaauuucuuuuccauauuuuaugauugccaucaugugcacaugaguauccauacugcaguuuuggauaugugaagaacauuuucuucgccuucgugguuggugccgucauccacccacucaaagguugcuacaugcaggaaggaggcaacugggauggaggaguuugugccaaacuuggucaauggaugcacaaaucaugcuuagugaaggaagauuuuuauaauagccgcucuauagcuggucaaugcagacacaguauuuauccuagucuucucaagcauguggaauuucuuuccuuugucaaagugauuggugcuuugugaaguugauguauaccaagucuuuuuaaagacaaucuaauuacuaguguugaacugaaaauuaauauugggaguagaauauugaaauuauucuauggauaagcaacuuucuauuaugaaauacguaaguauuucugaauucauaucacaaaagauuugagauuguuguugguauuuuugaguauccuuuucuuccaguuaauuucaugaauucuuucauguagguucaugaacugcagagugaacuugauaaagagaaggaagaugcucagaggaagauccauaaauuugaggaagcuuugaagugaguaaaaaaagaagcagucacaaaauauuuaauguuuaaaaaauugcuguuacuuggggcuggagaggugguucaguggcuaagaguauuagcuucuuuucccaaggaccuggguucuagucucagcacccacuugguagcuaacgauuuuguauaacuucagagcuggaagaucccacgcccccucuggacucaguggacacugaauccguguguguucugacacaccagcaggcaaaacaucuguacagauaacaucaagauaaaguuaaaagcaaaauuaaaacacacagguugcucauaguucauugagauccaaguugacuagacggugagugcauguucacaauagccguguagugcuucacaauagccgaguagugcuucacacugcuuugccauucaggaucuguuuucagauacuuuacuagaugauuuuuuuuuuuagcagaaaaagccguucagcuguccuuaagugauaggaaugagagaaaauagaacuuagugguuucagaugcccucugccucuuaaguggaaacacauuuuacaaaaugagauuuaggccuuuggaccuuuagaaaucccugugcagauuguuguugggcacuagaguuuuaguuaucauguucacaaacggauucguaucuaagcauugcuuagaagaguuuuuucuccugaccugucaugugaagggccuggcauggcagcuugucuuccuccacccgguuacauggguugaaugagcuguguuugguuuuuacuguguaagcuuagcugggacauaccaauuuacucaguaaaaacucaguucuuacucugugucaugcaauguaagaaaauacauucccagaagaccuuaaaaucauuugguagguuauuuaggaaccuuggcaguugcuauacagagcagacaggauuuaccuggaggaaagucagcauagcaccugaucuaagggauucgggagaggggcuuccaugaguuuugugccucuagauaauuuguuuucuuuccugaaccuccaaaccagagucacuuacagaaaugcccccaaaggauccuucccucccuccuaucaaaugugcuuccuaucacauucucccugcgaggcugcagcccagcucuuccucuugcuuugcuuauuaguaaaacugccuugguuuacuugcuaaacgaacaucuuaggauaauuuacguacugugacaucacaagaaguaauguuuugauccacacaaggacuuguugcuuauuugcucacaucagcucugaaccagaugccaugaaggggaucaaaaggcaagcaguuguacucauuaaacauuaaauugucaucuugauucaugacaacacugacacucaucaagggcuugaaagaaucauaccaaaauaacacauuuuaucuggaguuaaaauaaacuauuuuagaccuuuaaguaaaauuuccugguagauucacuccucccauacccuagguagucacuguccccauuuugaacaauuagcugauggucuucacaguauagcaccuaguggagcaacaagcaauaaucaagauggaaaauaacugaggaaguuaucaugaaaucagaacuugagaauaaguagcagaagcuggcucuuuuccaaauggaaaauauuccaaggagcggcuguuaggugcuuuugaucuaagacuugugcuguuuuguuugccuaaguaugguuucaugcugcagccuaugauguaaaaacuugccuugauuucuuguaagccuuuuuucuuuaauaaauaugcacaaagguaaaaauaaucuuguguuuugugcuauauccucauguaguuauucuuucuucauuucaucuaauaauggcuguuucuuaugugcaguuaaauggauaguagaagaugccagagaauccagaaguauauguauguaagcucauauuugaguaucuaaaaguauagccuaagucagugaauuuaaaauguauaagugcuaaucagaaagacauauugcugauagcaggccugucagagaggagggacucuuuaccugauuucacugagaguggggacaugggacgcuuuccuggauuuuggucuuguccuguuuggagauccugccugccauggcuggccucauuuccuuuccaucugugaguucuuacugagagugcuuguuuccaucucuuucagaucugcuccuccuaugucuuaguuccca

SEQ ID NO: 6469 - RNA, 964 nt, Mus musculus
uauguuguauccaucaaguaugucagaaauaacuaacuucacucaugauccuuucuacuucauccucaccggcaucccaggauuugaggauauccaucucuggaucuccauccccuucugucucuacaccaucuccaucaugggcaacaccaccauccucacugucaucugcacagagccaucucuucaccagcucauuaccucuuccucuccaugcuggcccucacugaccugggucucgcucucaccacacucccuaccaucaugcaccuccuuugguucaacauucgggaaaucagcuuugaagccugcuuugcacaguucuucuuccuccauggguucucauucauggaaucaucuguucuauuggccauguccuuugaccguuacguggccaucugcugcccacuccacuaugccuccauccucaccagugaggucauugcuagaauaggguuggccaucauuugccgcugugucuuggcuguucuucccuuccuuuuccugcucaagcgccuguccuucugccauucccaccuucuuucacacuccuacugccuccaccaggauaugauucaccuggucugcacugacaucagggucaacagcugguaugcauuugcucugguccugcucauuauuauauugaacccucugcucauuguacucuccuaugcaguuauccugaagagugucuugaacacagccacuuggacugaacgacuucgggcucugaacaacugucugucccacaugcuggcuguucugguucucuaugucccuaugguuggugugucuaugacucaccgcuuugccaagcaugccucuccacugguccauguucucauggccaauaucuaccugcuagcaccuccugugauguaccccaucauuuacaguguaaagaccaagcagauccgucaaggaauuacucgccuccucuugcagagaaaggugcacugaa

SEQ ID NO: 6470 - RNA, 2708 nt, Mus musculus
cagacuauggcggcuuuccagcuccaguuucaguuucuccagccuggagaugagcucggcggcgaaggcagcagguuccacaggcgucaucuccuugggcaggcgguggguucucugagggugugggaagaaggcagaaaccaagcaccauuagcaguccaggcaggcacuggccauaccagcuuggauggagcuugcggggcccacugaugugcgccagguccccguguuugaguggagaguggguggcgagccggccugugcugcucaggacuuuuaugcaccggcucuguggccucauggagagccaugguccccaccagcguuugccuugggcaggagcaguuggucgcacuccgagaggcccugcuuguucucucuguaguacaaccagcccaucaguagcuacucugaaguagaaaaucuucaaagacuguugucaaacaucaaaaaaaaaggcagcccucugagauggggaggggagagaaaccaacucaaggaauaaaaaaguagagucuaaacagaaagggaguugaaaauuaaaaaaaaaaaaaauaauaauaaauaagauuggaagagaggcaggggggaggggaggggagagucaccggccccagaucagagaagaagugguaauuuauuuccuggccucacacugggcaccuuugagguaguguugucucaacacugcuccaucucucucauuuuuccccuccuccccuccuccuccucucuuuguacagaaaaugaagaaagcugcugcgggcuaguagcagaacacugcugagcucggcugccugaagccgaucuaucaagggaaaacggaacaucuccaaaccaaguacggaauauaaaaaggcgucgagaaagccugccaagaacugcaggccgcgagaacccccaccgcccggcuuucuguccuuucucugucaucucgccccccacucugcccuccccaccucuccauuuguuccucuuuccuccuccucuucuuccuccuccuccuccuucgcucccccccaccccuaaucucccucucucccucucgcuuugccucuuuucuuuugggguggggaagagcagaaggccaacuuacucuccaggcugaagagucagucucacucaguacagaaaccauuuagcugcaccaagugagcgggggagggaaggccccuguguggauggacggcuguucuuaggaaggcugcuuccaggaaccauacauccuccaaaguugaucggcacaggccgggacaaaaucagcccauuuauagucuuggggaaucaaauuuugaugaacacauacccacucacccccacacucaaauaucuuugucaucuacaguauauggggugggggguagagaucauaaaaucacuccccaaagccauccuaauaugcuaguuuuagacaagguaagucugccauugucugugccaggaguuucccagggagagcuagcaucuugcaaugcuacucaggugaccugggacuagaagucugacguguuaaguuuuuugaauagaacacaaccauacgaaccggcuggauucucugaagcugccggaaagacagccuuacagagacaccugcucucaacaggauggcucuucuuuccccccugcacccuggguagcaggcuaccguagaaagaguccagccugggcagggcccucuaggcuggcuccugagcccaguagacugugccggcugcccucagggauguguuacauacgagggaagguccccagaggaaccuguuacccucccucaggcaugggaggagguuucuccagggaggcucacuucuagacccccccccccccaccugcccauccacagucaucagacacagacucuaagagagcccagcucuggagcuugggacagcuaagacuguauaugggagguuauuuucuuuccggggugagcagggcaccaggacauaacgcacagagauucucccaaccucauucacuucaggcuuagugagcgccugccugugaugggaacuguagcagguccgggauacacagaagcuaacaggcaaaacucuggggcuguggagagggggucagagguuaaaagcauugguugcucuuucagaggacccagucuuaauucccagcacccacaggacagcucacaaccaucuguagcucccaaucucggggaccugacgcccucucuggccucuaugaguacugcauucacauggaacacauaugcaggcaaagaacuagugcauauaccagguaugaaugaaugaaugaaugaaugaaugauguuucuuuuggggcucccugccuuuggggggcuucuagucuagcaggaaugcagugagccuaccaugucaucaucaagugauaaauuuuguuugcuugucuucccccacagaauuuucccauucuuugauucaggaacuaucaaacgucacuccauuaccaccacauccaaaagaaccauuuaauuuccucagucuggccauuccuuucuguuccuucacuacagaucucaggcauugccccccccccccaccagcuccuguaauaauuuagggccucacuacccguguccugguguccugucgucuauacucaccggaaaaugagguagagacacuuggccauuggccuucacacugcgaugcaucucucucuggagcuguuucuuacuccccaugcgguaaggagggacuccaucucua

SEQ ID NO: 6471 - RNA, 746 nt, Mus musculus
auuuuuuuuuuauuccuggaaaauuccaguuaguaauaucagacagugcuaaccucagggagcugaaugaagcagacuguggcacagccuccccacacagcgccaccaaguggggaccacaccaagugucuagaugccagggcuggggggggggggacacuuacacaaaccacuacggaguguaaugcaucauucuaaauaucugagggccaagaagaggagaaggagggcgaagugagggccaagcuggaagccacuagacuuuggauuuugaccucaagcucccugcucccagcugcuucgggaauguccuugugccugcucagagucuugcaucuggaagcaggaugucaggcuggguggaaagcgcugccuuuauauccuguuccaagugcuuccuggaaagacagaagaaagcagaaacagaggcuguuuagucccagcuugcuucuccucacggagcagugagugagucauuguugggaaacagacagagaaccuaccaggguguccugaccacggcaugagaccacagaugucacaggaggcccaggagcuaguccgggugaauguguacagaaaccauguagcuucacagacuccccuuggaacucuacacucucccugugcccacgcccagcgccuuagcugaaguguccagcgguggaagccagugaaguguuagauucggaccgaggagcuggagguuugaauaggcuuuauaguauguccucagggugucucug

SEQ ID NO: 6472 - RNA, 6815 nt, Mus musculus
uaagagcaaaguacuuaagauuuuaaaaaagaauaacaaguacuguccuggcuuucuaagaagggaguggaucacgggacucccaacucauuuguuuuacacaguggaggagcugggguuggggaaggcuuucagccccuccugggacagacagauaucaugguuaauuugccaggggaagcacagcaaguucccaaggggaggcuaaaaccaagagccuucaacuuguuuccagaucuuguuuccagagagauuugcgccuccaugcccuguggagaaugaugaaaucucaaucaauaaggaacuuuguuaauaaccaggaacuaugugauguuucugaaaagcuuuccugccagugccuaguguggucuucucagaaaguaauaacauguccuuacagagaaguuucuauuaacaaauugcuuucuugguuaaucuuuuuuucuuuucaacgguuccagccacuguguguguauguguguguguugcucuuuauauauaauauauauguuauguaugguauuguaacauuuauuuaacauauuguguuuuuuaaaaaacauuuaccuguuuuuacucacauaugcauguguugcuuuaauauauguuauauguugcaguuaguauaacauuuauuuaacauauauuguuuguuuucuauauauuuacuuauugcuuuuacauguaugugugcaugauuuuacccacaugcaugcagguaccuguagagaccaaagaacaucagauccccuggagcuggagcuccagguugucuaggguuuuuauuacuucaauaaaacaccaugaccaaaaagcaagcuaggcaggagaaaaggguucauuugucuuacaccaccauaucuaucauuauucaucaucgagaaaagucagaacuggaacucaagcaggggaggaaccuggaggcaggcauugaugcagaggccaugguggggugcugcuuacuggcuugcuccucauagcuugcucagccugcuuucuuacagaacccaggaucaccagcccagggguggccccgcucaccugcuggacccucagccauaaaucacuaacuaagaaaaugccuuucagccagaucuuuuuuuuuuuuuuagauuuauuuauuauuauaaauaaguacacuguagcuguccucagacucaccagaagaggacaucagaucucaucacaggugguugugagccaccaugugauugcugggauucgaacucaggaccuucggaagaacagacuuacccauugagccaucucaccaacccuuacauccagaucuuauggaggcauucucucaguugagguucccuucauucagagaacucuuagcuugugucacguagacauaaaacuauccagcacguaagugguugcgagccuccugaugugggugcuggcacgaugaauccagccccuccugcaagagcaguaaagcucuccuaaccacagagcuaucucucccacccuugguuuuguucuugacaggguuuucaccaugguagccccaguugacuaggaauccucuugccuuaguccccaacuaccugggacuauaggaaaguaccaucaugucuuuccuaaccauuccaugaguauggcccucagcauuggaaaaccacuacaguccuuccugcuuuggcguccaccugaccccugaaugaacacgguaucuaugguauccuugcuucucuccaucauagcacuugucacacugucuuauaccugugaccuccaucgccuaccaacccagaauguacucucuuggaggcaagggcacagucaaugcacuuguguucuuagcaucuucucuggccuauaagaaaaccucaguaggugagugcauauucauugaggguaugaugucauuggcuagucuacccuuugcuugcacuucugagggcuauuagcuggacuuagagaacacaaggugaaugaaaacaagggcgugaccgauccgaggugugggugaggagaaggguuuuauuguagaaauaagagaacagccagcugcaucuggaagaguccagacuguacugggcgugagaagagagggggaagggauggagagaggaagagaaaagagagagagggggccagaagccaagaguagagggccaagagagugcauggccaaaaugacagguuuguauaggaaugagaagggaaggggaggggaggggaggggaggggaggggaggggaggggaggggaggggaggggaggggaggggaggggaggggagggaagggaagggaagggaagggaagggaagggaagggaagggaagggaagggaagggaagggaagggaagggaagccugagcaggagagguuuagaguagaggagagagaguuagaggcagggggugggggaguggaggguuggggaggcuagagagagagagcggugggcagaggaggggggugcuugaaggagcacaggccacagguacuuagugagucuuguucuggguuucuuugggaccugaguucaggaucaagggugagggagaggugggaggagcuuucaguucagacucauuugucaaacccagggucccaagguuugcuauaugcuaugccgauuugagauagcuacauaauuuauaugaugggcuacucaggcaaugaaggguacauauugcauauugccaugggauuggaggguugggauacaacaguauuucuucaaucuucaaugcuuagacaucauaaaacuugcagggggcaaaguuaagacacacaaccaaguugguucaagcaaacauauuuaaauguuuucuaguaaaugcaucuguggcacgugucuuuccauucaaguguaucacauuaaauaaaaauggaaaguucuguuacucuuagccacauuucagguugccaauagcuacauggagcuguuggccauuucuaaacagaaagcagacaacaggagcaagugacuggacgagagacagguaauucuaggcagaugaaauagcccaagagccagcgugcgcaaagcaaagacguuuucucaaaaccaaguggcugaggcaggagaggcaggauucugcuccaauaggaaggaguuuagcucccagcucaagaggucaggauccuuccucauuacagcaagaaucaccugugcacuaggagaagucacguggugcuggugccgaagagaugagccaucaaccagagggagaguggggugugcugagguagugccuggcuauguaugagagauuagaauccuuugggggucaugacaaagcccaagucaacaggacauagauaguaguuuggcuuuuuaggaagggcgaagaaagggguggggguggcucuccagagguggcuuggccgaaaguuuaaccagagugguuuagccgacucccagggacaugaagcagaacugaagcuuucccuggagucuggauuuuuuuuuuuuaaacaaagguguaauuucuaacuccagccccacccucugaaucacaagggugacccuggacuuuacccggagucugagauugugagagacacuccuuaguccuugggaacuugcagugcugaguccagccugggacagaaguaagggcccuuuguuuucagaagccaggacagcagaaaagccuacugcuuccugccuagcuggcucuugucccuuucucccugggagaaucuucacuccucagaugacuucagguuuugcuacaaugaaaggggaggcucacuucacuucccuggguuucccucagccucccucuuaucucuucgacccuggguuccucugaucccaucuucaugugugugggacccagaucagaggcuggcugcaggcacaguuggggaagugcaagcuucaauguggcacuauccacaagugugaggcgugccugcuuugggagagguguugugcccauguaugaggaguuuauugugugcaaggcagacagaccaaccugccauuacugugcucagggcucugugccacaguggcaacagagacaacugcccaggcugggagaguuggaaacucagaaucaucugggggaugguuccugggcuguggagcaauauggggugaaggcaugguggcuggcccuuguuuguuugucuuuugggguuuuguuuuucuucauuucaaaagguguaugugucuacgugugcaugugugugucugugugcacaugugugugucuguguuuaugugucugugugugcaugugugugucuguggguauaugugugugugugcaugugugugucuguggguauaugugugugugugcauguggguaugugucuguaugugugucuguguaucugugugugugucuguguguguguguguguaucucuguguguguaucuguaugugugugugugugagaguguguuauguguaucagauguguguaaggaaguccccaugacucugucuccaucccuauagcacuagguuuauaggcacaugccgucaucucuuguuuuuucccugggugcuugggauucgacuucaggcccucaugcuugcacaucaaguguugauacucagagagcacuucugcagcuccccucccuccaggacccacccacucaagucucuguucuuuucccauguucuuuuuuguuauccaugagcaaauuuucaaaaucuuuuuauuuuaugaaaaagaaaagcccauauuccuuuuaggacauuuuguucugcuuccaccccuaagacguuaauucuuuugucauugcagcugcuauguccuccuugugguaguuuaugucacauacauuuuauucccuuugugguuaccuccagcgauagcugacuuugccccaggcucccaggaggucugcuaugggucgugaaauggacugcgugaaaagugugcuucuuucaaagcuguagaguucucuccauuaugaggucauuucucgugguguuuucuucauuuagaacuccauuaacaugcguugucagcuuucaguucaaggguauggcccgucgcgguggguaaggcagggguggaggcaacuggacauguugcaucagcagucaggaagccuggcuugguuucggagacaggauaucacuauuuauauagcccacgcuggucuggaacucacuguguagcccugucaguucuugaacccugggugguuuuuccauguggccucccaaauguuggguuuacggagauaugcaaccacggcagcucugcugguuccuggcuuccuggucucuugcugcguucuaggcgccauugaagggucucucaucuguuaaguagucuccuguucugcaggagaaaacagagacuccccgacccuacaguacagcugcccaaggucagcuuucaaggagcgacguggauucaaaucgugccgccccaaccugcaucaucuugaacaaacccacugaugcgcaaaucaugggugcuccuuuugggaacacucggggaguauuuagggaaccuacaccaaucuucauuaaguuuuauuguuagauggguggacagauaucauacaucaggggccucuuguaacauguccuuuuguuaaugggagaaugaacuagaagagucuccuuccccuucacuuucuuaguggugcugggcauagaacuuaggacuuguagugcccugugcaaguaugauauuaccauuguacuacaucccucaccccaauacuaaaaguugagcgguuagcucuccaaaccacccuccgggcuuugcuuaaacccugaguacauccuguguagugucugcugugcucagggagucccccacccccacucugagccccugggcugggcagggcugggcagaaguucccucccagugcuggguugggcacugugcccagacguaggcuuuucuaggucaggcaguucuaucuucagccuggcccuaggauacagcuuguguaaagugcagacaucgaaggcaugcuguguaaacacagacuaucucccucuccaaaguuuccuuuuggggaagcuccucaaacugggagacuccauuccaacuccuuaucggcuucagcuuccuacgcugauagaaggaagcuauuaaaguucgcuuccugguauugccuugacccuacggggacaagcuccugaaaugucccucggaggagaauuuuuuuucacacuccucaaauccauuuacucagccuaaauccccacaucaaacaagccugcaggaacuuugaacauguuucagccaaacccuaugcccuaccguuuacugucuuacuccagcuggcuuaaauguguuuguuuggcucuuguugaacagucuccucugccucuuccacucauuuauaaacauuuucccuucucagugucugccaauccuuucacggucucucauaugguuguuuuaagauaaaaaucauguguguguguguguguguguguguguguuguguguguuguguguguuguguguguuguguguguguguguuguguguguguugugugugugugguauguguguguguguguguuguguguauauuguguguguguacauucuuggugagagugcagguauguauaccaugcuggucauguggaggccagagaacaacuucaggcaucuguccuuaccuuguaccuugccugagacagggucuccuguccacugcagugcccacaggcuagcuggcuucucagccuccguggacucucccgucuuuaccucacaacuugccuuagggacuggagacaugcucucuggcucagcucugagugggugcuggcuggcaauccacacucgcuugggucuucacacuugcccagcaagcauuuaacucauuagguca

SEQ ID NO: 6473 - RNA, 38584 nt, Mus musculus
uaccaggucauuuauaaauguuuauuaaaugucaguaauuuuuacaaagcaaauauuaauaguagagggacaaacuuuugcaaaauauguacaaaaguaaaaggccuuuaugcauauuaauuuguuuggugaaaugaaagcauaccuuuggacucuuagaucuaccuacaggaauaauuuacggcgacucuugaaccaaaucucugaccaaaacccaucuuuuuugucuacaacuguaaccagcuuaguuucaggaaaguuuuagaaagaugaauggagaaacaaacaaacaaacaaacaaacaaacaaacccuaccagacacaaauacuuuuauugaguguagcauaaaccaugucucguuaggaacaccgucuauaaggucugcacugugugccucuacuaaggcuucuugggccuugugagcucacguguaagagagagaagucauucaggauauuuugcgaaucugcuuucaaguaagaggugaagagaagguacacaguauaugcuucauuaccauaggcacccaacaagaacacacugccuccuccccugucauccccggugccauugaagaggcacgguuagugucaaaaucgucacucccuuuggcaacguugcaucugugaauggagcaaggauugcauaccgagaaggugguuuguggccaucagugacccucacagacccaaaacuucuaccucguagauucagguaggcuuuacaccaucuggcaauuucaucaagauuaacauagcauacgucauaaaagucacaucacagcccacuaaacgcuaucacaugacuagugcuuuauuuaaaaaacaaaaacaaaacaaaaagacaaaacaagugguaaucucugcaguugggaaguugagccaggaggaucucaaauucaagaccacucugggguacccaaggagacccugccucaaaagcacaaauaugcaagccaacagauacaaaacaaugccaugugccacccaaggcacucaaaacuggcuggucagaccugacugcuugcucuacggagggaugagcagguaaauuccggugcugaucuacauccgggaggacggcacaauguuagcggaugaacacugcuuugaugaaucugauaccugcccgccugccgggcacggcuagaagcaucuagcugaugguaucugaggagccaccaucagguuuugacacaaaauucaauccuauuguaaacugacuaagcccuaaacucguaccauaagaaaacgggcaucacgugcccucaugcuuucugggcugaaaagccaaccacauuuuuuuuuuuuaaaaagaaaaggaaaaaaagaaaaagcagaaaaaaacuuucauucaagcagcaagaaccaaagaucccuugacucauggaauuuaacgugcugaaaucucaggaaagagacagauagccaaagucugauuuuuccaaauaaaaggaccugaaaagcuucacucuccgucauucaaauaaaaugaaaagaaaugagaggguaaggaagcagccucucuagguuuauuaggggacgucuuacaaacguuugacugggccuuaaaggugggaugcagggguucauacaggaaauucaaauuaacacugacgcuuggucuucucaaacgagaaaaauaacaucgcuaacaaauugcaccucggagucagguuucagaugguuuguuugggguuuugccuaaauguaucauuaaauaaugaaagcgccaauuugaggguuuuccaaauagcuugagucucaggauauaaccgcauaacuuggccauuuuauucuucauauaaacgaggcauaaccggaugugaauaccaacacugagaaaugcaugccaucaaaacagaugcccaagcguuugggcauacacacuagaagguaugaguuacuugggggcauaugcuuuuugcuggaucuaacaauucuugucacuucugguacuaaugguggucuuacucuuacuuuaguaacagcaacagcugccacuaacguaacaagcauuucccuguugagucccaacuugagaacuucaccagaggacccuuuggguguggaguacccacaaugcacugcgauaggaaaacaaacaaacaaacaaaaaaacccaacaugcuccucuucaggacauccugucuggcuuggcugaagcuucucuuuggcuaucaaguacccuuuccagauagaaaaccugauagggaggcuucuauugaauacagacaggauuuggcagagagcaacaucucaggccauuacagacagauaucuggguggcacaucuugaguugagaguauaagaaaauguggaacaaagcccuuuccccauuacaaagaaaauuaaggucuaagucuggguuguucucuuauuuauaaggcaacucugaaauguauaaaaagauuucgaagucaaccaagacacuugugugguucucugucaguaagcaggaaggcugcgggauugaaggaggagucuggauuaggcacagucacuccaagcacccgagacauacacagaccaaugccccacagagccucagcuccaaggcauggcucaggggccaggagggagaagucagcacacggaggguuaggcaccuuuucaauucuguuggcuaaauuccaucgcccucuucacacaacaguauuucacuucacaaaaggaccugacuuucaggguguguaagugucagacuguaaguguggaccguggcuuucuggcugggccucacuguucuuuaaguucuaaccaauccuguggagacggcauguaaguaaucuaccacgugagaauggaucuagaccgcacuggguucuaagaugcugcacgcuccagaaggaagcugcagggacccggaaggaugcugucucuagucaggagcucugguccuuucuuggugacggucacaauggaggaagucagagauccugcucugucaggcagaauuucugugcucaccacagagcuuaaauguaaccagacacaacugcuuucuggugggacugacuucugcugccuucacugcacuuaguuguggccaaugcacaauaauguuugcuaaauuaacacagaacacauuacugcacacacacucaaaugcucaucagcauuggagugaugcuaaccauacauuuaaaugacauaucuuuuuuuuuuuuuugacagaaaaaggaccagauguagaaccaugaauuauggugaauuaugcuaacaacaccugcacugugauacugacauacaugucuuaagcucaugauauuaccaaggcaagaaagcacuggacuuuauaaccagaaugacagugaaagcucaaauccaggacaagucaggucucucaaguauacauacacuagggcccagcucuggcacccuccagcaagaaaagaagaaagccacugcuuuugggccucauagucagccagucuuucagggcgcaauuucuugccugagaauagucacacaguaaaacaggcuucacugcccucgugugcucuccagggacagcagggacaagcucagguucuacaaacucccaggccaguuggaacaugccaaaugguuuuguacaccagccacuguauuuuaucacaagcuaccucaugggcaugguuuaaguuagcaauggugugugugugugugugugugugugugugugugugugugugugugugugugugugugugugugugugaaggcaaaccuccuuaaguaugggccaaaaaaaaauugcuuauccuuagaugcauccuuaagacauuugaauguaccucaaugaagcugugucucacacacgaugacacacacaacacauacaaacucugucacagagagacacuaaccagggacaggguacugaaaggaugccuuuuugaacaguucacagggaaaugcugcccaccaagcucucggggacaagagaagcccgagagcaccacaguucagagcugcugagguugagacaguggggcuaaaggaagaagacccaacagugguucucuccagcaaggcacaaaguccaaggagacaggaccagaaagucacacucuggggcugcuauggugauguccgucaccagggugcuugcccucuccagauguuguaacauggcacauuaaguuagugacagcauguauggcaaaggaaacugcgugucacugcucaucucagaucaacauagcacauguaccauuugugaccgcaucagcaucaggcugagauccaucuuguaaacuuaagcaguaagacauuaccuucagaaaguaaagagacugagaaaaacaaacuacugcuguguguguagggggccaagccucugugggcugagacugcugcccuacagaaauuagagaaauugagggaaaacaaacuacugcuguguguguagggggccaagccucugugggccgagacuccucccuaaaacuuuucucuaacagcccuuccagaccagggcucacauagggaggcaugucauugcuggguaaggcacucucucucuuuagagcugaauuuucauacucucaucccuacaaguucuuaaagauacugccuauucuuagaacugcaggacaguuaugagaauucaaggccugaaaaacaccuaguguaagguugccaggaaguuauaauuggacuugaagguaagccacagugaaaccaaucaaagcccaaauucuagcagauauuggcaauggguuaauucagcagcugucagccacaaacuaaaggccacagaugaacuaaguucuccaagaaguuagacacacacaacugagauucuucuaacugcuguuguaaacugccauuuaaagagaaaaacaagacaaacagaaaacaaucaaaaucacaacaagguauuaaaacagcgagucuugucaucacugcagcaugagcugcuucagguugucaugaaggaucguguccuucacgucccggaacacgaggcggauguucucuguguugaucgcgguggugaaguggugguacaacggccucugcugcuggucccggcguuucccccggaagcauuccaccagaaacuuuuggacgucucuuaagcaguggggguccccuucaaauucuaggaaauagucuuugaugcuaacaacuugcacuuucuccucgagcaagucugucuuguuuaagaagaggauuauggagacguugcugaaaacccgauuguugacaauuguuucaaaaauguucagagauucuguaaggcgauuggucuggcgguccuccauaagcaccuggucaaauucacuugaagagacaaggaaaaguaucgacgucacacugucaaagcauucaaaccagcguuuccguucugaucucuggccaccuacaucaaccauuuugaaaggaacauuuuuaauuucaaagucguacucauggaugccuuuggugggccuucuggcaagcaggauaucuugcugugauggaauguaauccuggaagagagaaggauugauuuauacuuagaguccacaaguagcaaauggcccaguaaauggaugugcaaacuaaaugauuaaaaccaaccaagcaacccaaggcuggccucgagcaagggauccuauugccucagccucccaggagcuggaguuacagguguggcuccaugaugggcacacugcccacagcugacacccaccugcacuaccaaccagugcccacuccuagguuaugccagcguaaucucacugucccagcaucuccaugcugguccucgccccucuaaacacaggaggaucugaggcgguaacuccugaggcucacuuccuaugcuugguucugaccuagucuguaauucauuacaccaucuucuuuacugaacacaccuccuucacgacugggauaaguuccacacugucacccacgugacaagugaugugccacaugcauuucugaccuuaggccguggugcaagagcucucacucacugaggaaaagcacacucugagcaccaugucugcgggggaacaggacguucacaccugcagggcacucacaccuagcacacuugucaagucugcuagcucuucuggaccuuuauguaaccaccgcuauagugucagcuggcauugauuuugucaugauccuccugucucugccuuuugggugcuaggauuacacauuuauuuucccacacaaguguguguguguaugugugugugugugagugugugugugugagugugcgugugcguguguauguguguguuuaagguaaagucuuacuauguugucccggcugaccuggaacucggugacaguucuccugccuuagauuuacaaugcuaagaucccagaccgugacaccaugacuagcuuuccagaccuugugaccugggaaacaguaagaucuugaacagaggcaacugcuagcugcaggggugagacacugcacugggcggcacacuuccucacauccccgacuggcucuuccuucucgggcuguacuuuuccacaagucauacggcucuuuugguacuacucaaacaagaacaguuugaauauuaucuucauguucaaaauauguuaaaagucaaggaggaucaaaaaccgugacuuuacaagcuguaugcauuuuaugcccuucuaagggcucaaucagaauaggguuucuauagcuuuagucgaaugcaguucuaugauuuguccuuaaguucacagaugggugauaaaauguagcucagccagccucauucugcucucuccaggcugauuauguaaucucuguuccccuguagauguggcuucagaacuauucucacccuaacaguuuaagcacauacuacacggguugagaguggacuauacuauuuaucuaugagcuauuuguugauugccuacuuugugccaggcacugucacuaggaaccagggacuuaacuaacucuuguaaucaagguaggaaguccugguccucagaaaggauggauaaaagaaaaacuaaguaaccaucagcaugcuggauguaacaaggaagcaagggcuguugcagacagggagagauggcagcuguguuagccaagccucccucuggccaugacagcaccagggcggacuucaaggucaucuuuuacuacaugguagguucaaaucuagccugaacuacaagaaaauuugccucaaaaaaaaaaaaaaaaaaccaaaaccaaaaacaaaaaccauccaaacaaacaacaucaaaaccccagcaacaacgaaaaggauguacaucaguguugugcuuagcaaaccugccugaaaucagaagcacgucaaacaagccaucuagacuguaagaaagcacucuuaaauaccacuauccaggcauugugguguaggccuuuaauuccagugggaggcagacauaggcggagaucucagugaguuccaggccagccuggucuacaaagcagguuccaggccuacggaauaagacccggucucaaacaacaaacaucagagcuggucuggggucuggagaggcugcucuugcagaggacaggguuuagaguucccagcauccacauggcagauagaacucuaguuccaggaaacuaacauccuuuucuggguucccagggcaccaaguaagcacaauagugcacacacacaauagugcacauacacaauagugcacacacacacacccauacaaagcaaauagaaauaaacauguaaaaacuguucaaggcuggggaggugagcucacuaaaguguaugcauacagcgugagccucagguccuaagucugcauccccacccagcacccacauaaaaagguggcugcuaacagcaccaccuauaauccuagagcuggggagaggagauaggaggcuugcuggucggcagucuagacaaaugugugugcucccaguucagggagagacccugucucagacaaggcaagagacaacugaggaagacauacaacaucaacccuagccacucugugcacuagugugugcacaugugugugcacaugcaccccucguacgcacugcuuuucucugaccguguguauuaugugacaaacuaaguuauaaagaacucaaguucuaagagauaauuauauuugcgggaagcagguaaaaaaaaauauuccuugaaaggcaacaaauacaauuaaaaauuuagguuccuuuuuuuuaaauaggcuggccuuaaacuuaugauccuccugucucaguuuugacugcuagaacuauagauguccaucacaccuagcaggcaaauucuauuagaaaacauaagcaaaauguaaaaaugaacuugguagagacaauaauacagugcccuaagacggcggcaucugacuuccuuucuuauagcaggucaguccugugccauccucagcaccacagcucgucuaacacgacacaucuaagaggcaaaggcagcggcacugggauucacgacuaacaaacaccccuggggcaggagcucuaagcagugaaaccuggaauuccaccugaccuucacaacagagcgaaggaacguaccgggagcgcucacucucugccugucauggaaacugggagccaugagcacgcccaguugaguuacuggcucugaggcaaacaguggggagauaacagggucuccuuccaagcuggcucucucuuaccucagucuccucugcaggccugggacugcagccccagucacuggacuccugcacaagcgaguucugcucuauuucugcuacagaaaacccaacaacaccaaagaauaauagauagugugaaaucucauuuucaacauaaaucucuuccauguugacaaaacuuagaaaccugucaauguuuguaggaggacaacucaagccacuggcacugaaagaaaaagaaaggcuggcugccugguagacucuaacuuuccugaccugcugccccaaacagaagcagugccauccccauuacugccuccaaguaucaacuguugaaggcaaaaccagaacuauuguuuugaaacuuaccgguacuccaaguuuauccaaguuauccaagaaauacuuuacagacucacccugaaaacaagaagaaaacaaaguuaggacggcuugaaugucacacaguuuauguaguacuguggggcuguacacuuggucuaaauauacuuugguuagucacauucagagaagcugaagcagggggauuaccaagugugagaggccaagcugggcuacauagggagaccucuuucccaaccaaaaaaugaaggcaaacacaaaacaaagagcuugacaaauacuaacuuuaaagaacuacuaacggggcugaguggugcucgcucggcaugcucaaggcccugguccgucagcagcacaaacagcccacagcuagcacaacacaggcugccccguauggggaaggaaugacugcacgaccucugcuccugcacuuggccugugaccacaggucagccugacugaaagaaaggaaaacaaugucuagccccacaaaaaugucacugcaaaaguuuucaggucaccgcaaagaucuuuguugugacaucaaauuuggcaggucuacucccugaaggcugggcuccuaugggacuaguaacucuaccaaugagcuucucagauccugccaugcuagggcucugucugccuguccucugagugggucuuuaccuggccacagcucagcagcccccggaacaaagcguaucauuuaaguuaugcaaagcuuucaaugcugguauguuuuauuauauagcauuuaaaaccauauuugccaacaauucuguccauuuuaucagguuugugggaagccgcugcacucacucacuguggcagacaaaccugggguuucuauauucuaacacuuggcugaaagccuaagcuuuauacuagcagcaacauaaauccaggcuauuuuccuugaaauagugagaugaccaaggcgucccagugccagccauucccuuaggcaaaagcagccugucuugaaaagggaaaagggcagucggacggagcagcuugccaugagccgagucauccugcaguuucucccgcagggcuccaguuuccgcuucaauccauacucaucagaaagacacucaaagugaagacugaacacaaggacccaguauacugcuuaguccaggguauucuucaauuuggggugugugucauguccagauacacuucuggucacaaaaacaggcugaugaagaacauaaccaauauggucugaggcucacacacugaucugcugcucuucaccugagcugcagauggcugugagcugccugacagggugcugagaaucgaaccuggguccucuggaagagcagccaguguggagccaucucuucagccccaaacuuccccuuucaaacuggguagcauccuuuuccccaagcaaccugugcuguuuguagguuuagaauccccuccacccugaaaacacacagugaagccaccaggcaucgugggagguagagcauuuaaccugccugaauuaauuugaagacaauuucuacagcugaacugaacauaaauggggaacugagcauaaacacaggacagggcacuuguaacugucauuuacuguuucucccucugucucaacugggaacacagugacuuguuuucaaggaccugguaaggguaaaaucaaguugcuauaaaauugauauuucaagagccgggcggugguggcgcacgccuuuaaucccagcacucgggaggcagaggcagguggauuuccgaguucgaggccagccuggucuacaaagugaguuccaggacagccaggacuacacagagaaacccugucucaaaaaaaaaaaaaaaaaauugauauuucauaguaaagagcagggguuaugccaaugucuccuggccugcaggaacuagauauaaugucccguuugaacacacacacacacacacacacacacacacacacacacgaaauaaauaggacaaaagugugugugugugugagugugcacauaugugugcagguacuuaugcuuguguaugugaagucagaagagggugcugguaagccaccacccccccccccccccggaguccuuuugaggcacaguuucucucugaacccaaggcuugcauuuuguaggcuaggccagcaagccccagugaccuuccugucucugcucacccagagcugggacaccugguuuguuauaugggugcugggaugccgagcugacucucuaucgcugaguacuaucuuauuuaaacaacaaauaauuuuaguugcgugccccccccaucccaagguuuugcuuucuuuucccucccucucuccuuucuuucucucuuuugaggcaggaauaaccaggacuggcuuugaacucacaguagcaccucuccugggugcuaacaacacaggagugggccacugcugcaguuuuaauaccacuuugacgauaaacagccucggauacacaacuuucuauaccuuuccaaacuauauguacagugaugcucuggguaagaguccugcuaagcucuccugggcccuccuccccacacaggugaaaacacucuucaaucgaggcucuagagaaggauaaaauaauccgacugguggcauggccugaaauccuggcacagaagccaacggguggcucgaccugccauccuggcaccugaaaaccagcucaaggugauucucagacagcaguucaaagucagccuaggucaugggaggcuuagcuagcuagcuagcuaacuaacuagcuaacuaacuaacuagcuaacuagcuaacaacaacaaaguaaaagaaaagagguuccucauccagucaacaguagaaguucaacgccauaaaaagcauuugaaucauguaucuuauggagguaacauaacugaaaguugaaauacccucacaugaguauuaucugagccagccgccccucuuccuuacacauaaauacuuacaccacccuaccguaugagaggguuuacagaagccuguguacacagccuuguggcauuacugaucuauacaaaccucuuagaaagccaggagcauuaugucccauaaagcauuuaauggccuugucugauccaaggaauugcucagcauaaacaacaggaugcacgcaaagggacagugaagcugggcgauggcccacacuggagacuugggaauccgccagaacgaugagcuuuagagucaguuugaagccagcccaggguauguaagacccugcuucaaacacucccccaaaaggaaagaauacauaaaaugccacuuauucagugauacuuacaacaauaaaaucuggaacauuauuuuuccacauagaauuaagaaagaaauauaauaaaucugaauauacacacauauaaaauaccguaaguuaccaaacauaaucaucugauaucaguuacauaugaaauacuugugcuauuaaaugcuaaacugaaggaguagguuauaaagucagagccuacacccuugaccuacaaggccuucuuuaacuuuugcaaaugugggacaauacucacacagcaagcagcagagccugcccaagcuuacgccaggccuuuaguuguuuauccuccaugacuaaguuaguccaauguuuucaugcacagaaacggcggucacugucuguaugugcuuggccuggccuuacugucauuugagaaaaccuuaacucucuauauagcacaucuuaauucaaagaucuacgauacuauuagcucagcuguauauuaaauuaacuccuuaaaauacgggcaaagguaacuguguagcacugcaauaucuuuuucuaagaaugagagcuaugccugguagcuaugccuguaacucuagcacuggagagaccaaagcuggggaauggccaugaguuuggggcuagucuacuguaugaggugaauuccaaacaagcuugggcuaucuagugagaccccuaggaaugaaucagagagugggggugggaaauuccugucaugugucuucuuuuggagguacaaacacuuuaagugguucagcaugcaugcuagucuuccagagacuagcuuggcucccagcacccacccagcaggcagcagccacacccaguggcucacuagcaauucuuuccagucuaggggauuggacacccucuuguagucucuguaggcaccugcacuugucagcucauaucugcaagcauaauuaaaagauuauuuuuauaguauuuuaauuauauguguacaaauguuugccuacauguauguuagugugccacguguguacacuacccacagaagccagacacccuggaacuggacuuaaauauggcugucaagcgacuacguaagugcuggagacugaucacaugggaacugguacaucugucuccccaauaaaaauaaaucuuaaaaacaaacaaacuucauacacacacacacaccuuccgcuaccuucccgccucugucucucagugccgggugucagcaggcugacuaaagggauucaucugaaaucuuauggguccaaguuagucuguguuucauuuauuacaaauuuuaaaaucucaugaaaaccaagugguguagugaccacagaaaaaggcauguaacacagaaacaaaacaaucagacaaaaaagggcuacacagugagguacugucuucuccacggagaagaaaauggugugugcgacugcugucaacccucagucucuagugauacuacagagagcaagucuggacuuuacacauucaagacuuggaaauuaaauuauuuuaaaucccuuuccauuuaaacguauggaugaaugucuacuguuucaggucuugccuccucccccaguucagccacaucuacucuaggacauaaacauucaguguuaaucuuguggcaaacauauuuugguuaaaauuaagucuccaaucaaaaagaguacgcuggggcuggagagaggggacaaucuggcuucauucucuccucuugccugcugccccaccccuuucugacagggucuugcuguguagccuaagguggccuugaauucaagauaguccuaucaacaccucuaaaguucuagaaauuguuaucagcagcuuuuacauuuuauugaggagagaaaaaccauagggaaaaaacacuuuuuaugaucucaaaaaguuuuuaaaacaaccaaaaaaaaauguguauaaucugcacauuacccauggacacauggcagugacucuguacugggggccuaggguuucugauggucccugcugauguguccagugucuggaucuuuccaagaccaugugagaacgaagaaugagcugcugagagaaggcugcccuaacuaccuuuuccuaacaagcucauacauuucucucucuucucucuccucucucucucucucucucucucucucucucucucucucucucccugccccccaugcugacaggaaggcaagcuucuuucucuaacccggagggagugauuucaucaagucuccaaacuuccccaggucccaauguccccaaccgugaaggaaggaaaggaacucagugcuucagcagccacccccuuucugccuaaggugcacugacuuaaacuuggaguuucuuuucaguauaggucaugcuauuaaucugaauuuugcuucuguuuucucauuauucaagugaugcaccuuagucucucugcaaguaaaauacaggauuuuauggaauacagaaauacuacagccuugagacuugaaauuggguuagcucuucccagucuauuuauucucuacuacugagagaauuuuaaaucaaguuucagaucaaaauccauuuccuaguuaaacugaguuaaauguuacuugggaggcagaggcaggcggauuucugaauucaaggccagccuggucuacaaagugaguuccaggacagccagggcuauacagagaaacccugucucgaaaaaccaaaaaaaaaaaaaaaaaaaaaaaaaaaaaaaaaaagaguuuaaaugucaugguguuuuaugucaccucugauucuuuuuucucuggacauuuaggcuccaucuaaacaauggcacuguggcaugcagacucggaucuagccccacauagccuguuggcaaagucaauggcauucacugggcuucaguuacaccugggaggcuacaaaccuuacuucaucaguuuuaucaacuuguaccuaagcuggaaauagcgaucuuguuccucauucccaagaaucauuaaaguaugcuaaaacguacuuucuuugcuugaaaagacacacugguccaggaaucuaaacgcugaaacucaagcucagaaguaaguuccauaaagcaaacagacagagcacguucacgggacaccuacugcccaaacgagagauguuaaauccaagcacucuccuacacaccuggaggaggcaaagggcaagacuuaguguguguuguuuccugaagaauaaugaauuuuaccuggagagucuaagaauauacaagaaaaaaacuauuuuuuuuuuuuuugaggaaaaaaacauacuaaaacuacuggcaguuuuaugccaauagggaaaagacaacuuuacuugguagacaggucaugaagcagagguuuuaaagccuucgccaggguucagugguuaagagcauuacaaaugcagguccaaguucagaucccagaacccaagucagguacgugccucacaacugccugcaauuccugcuccaggggaauccaaugcccucuuccagccucugugggaacugccauauacgugacgcaggcgcacacaauuauuauguuagaacgcaaucuggcgguaugcagcaaugccuuaaaaagacugucaguggagcgacagcacaggagucuguaccacuucaaccacagaagucaauugcuguugaagagaagcacuggauucuuuuauuuaucuagacugaagaucagaugucuacuacccacaaaugauagcagcccacaggccaaauccagcccacugcuuguuucauggcucauuucuaagugauuggggaaacacgcaaaggguauuuuuuaacaugugaaaugguauaaagucaaauuucagggucuaaaaauaagacccuccuggagcgcaggcagccccacucauugacucauccagcaccccugacugcccugcccugcauccgagggagcagcggacgaagagcccacaggcgagcuuucaaagccuugcaccacugcacagggcgcugggcuucacauggcgcgaguaccgccagcccauguuugcccuuugucucucucacgcacagguaaguucacacucgucacaaaaagaaacagaaugggggguuggagugcuaugcuuuuaauaugcaccaaaauaccaguauuuguguuauuguugaguuagauggggaagcaucauguuuccuauguaaugacacuguagcuaacucaaagaacacaaugcgggucagcacuuguagaccaaccaucgcuaccuauuuccuugcgguucgcuguuaucccagcaaggagugcuguccacugcuggagaguuaaguccuguuugacugcagcagccaaacaaguuugugcagaggcgacagacuguuagcuuuucagugagaacagauguucagagcugaggaccucagaacaaccuaaauaccagguggauucucuaggaguucgaggccaaucuggucuauagaucgagucccaggccagccaggucuauacauugggacccuguuucaaaacaaagcuauuaacaauaagacagauuagagauugccaggacuuuccucacucuugcugaacuuccuaccaagggugcucaggcagcuguuggccagguuuggaguaccugaagagccagccuggacagacagucugcacgcauaucuauuuacccaaggagaaucuggucaaagaaacggagacaacucuaacugagcacagcugccacuggacucugacaggggacaguagagcggagcgagaaggaaguggugggacaagcgcacaaagcugugaguugauguggcacucaacuccucacuaacagguacuuuguuggagacacacaaagucuaccagugcuaagaagggauuuaaguuacucuugugacccgaguaucacuacgaccaggaacuugucagaaguaagaggcgcccacugcucaucugggaaacguagcucaguggauggaaucaucugccuagcaugcaugaaacccuggguccuaccccagcacccaagugcaguggcacacgccugaaaucucagcacuuggacagaggcaggagaauuggugggggggaggguggagugggguugagcccauccucugcuucacagcaaguuugaggucaaaauugacaagaugagacccacccaaucucaacagagaaaugacagagguagacagggaggacuaaaauaauuauucugacaugcaccuuguaaguucagugucuugggcuggagagauggcucagccauuacaggcuacgcucaugaccaaagcaacagucaguggcucaagagugaugaccgcuuacuaaauuuucugagcgcugggaugaaauacuugguucuucugcacaagaacuacccuuaaccacggucacucagcacugggcuuuggaguuagcuuugggaagaguagauucuauucuugagaaaguccaaccuaaaauuauaaggcaaagcagccuuuuuuggagaagcuuauacucuggacaacucaucucgacaacgggcauuaagacugaaucucuagcaacgccaaacuguuuuuauacacucuccaguggucaaaggggagugaaaccccauccacacacauuuucgaugcacauccauuuccaaauuccaacucccaauucagcaucauuuagguccaaaacccauuuaacugcaaauuaaagcuccccagccucccaggagcagugaugagcacacuaagcggcacuggggaaaggaccugaaugcuucugaagaccgacuaggcccaauaagaucgcaugcucacggggccgcggcuacccucaugucgcugcucugaagauggacagggcuucacacgugcugggugagugguccaccacuuucaaggaucagaugugcaaaacgugauuacagaucagcauuaauggguggacauuuaugacugguuugaagguaauaaauaggaagcacugaacccaaagaggcaaaauacccaauucucugaccagcaaaaccucucuuacaaaaggcccuacacagcuuccuuacauucuguaggagcucgaauucucucuuauaaugugaauacuucugugauguucuucauuuuaugucuuggcgugagaagucucuaccguauuuucuaguccuguaggaaauguguucuagaaauguagagacuuguauaacucugacuggccugacuuacuacuauguaaaucaggcuggguucaaacucacagagauucaguggccucugccucagacuuuaguauauggugccacuucaaguacuuuuguuuugaggcgagucacgauccuccuuacucagccuccaaaguauuagggacuagucacacagcucaugcugccacacccaacuuagauaaauaguucuuacugguauaggucagaacugcuugaugugccuauuaaaagaacagauucccuggcuuacuacagaccugccauucgggacucuuagcaagcggcaggaaaaugacugugagguagcuauccuuggagucgcuucacacugacgugcguuuuaaaauuaacgucagcuuuugugacuaucggaaguuaacuuuuuagaagccugauaaagguuagcaagauggcucagggguuaagaggaccugcugcucuuuagaggaccuaugguuacuucccagcagcuacaucgggcagcuuacgaacaccugcaacuucaguuccagaggacccaaugccacuggccuccacagaaccugcacaaguacacacaugcauucauuuaguuaaacuuaacuaaauuaaaaaguauaaaaauaaaucuuuaaaagccugguaaaaggaguuagcgauugcucagugguuaagggcacugacucucuuccagaagacccagguucaauucccagcauccaugugguagcucacaaccaucuauaauucuaguuccaagggaccugaaauucuuuuagucucugagggcaccagguauuuauagguauccauucaggaaaaauacacauaugcauaaaaauuaaauaaugaaauaauaaauaaaagccugauuuaaaaugccaagcuacuaauaaacuaggcuagaaauuuauuuuuauuuuauuguaagaauagguuuuaagucacacugcauauucuucauaauucaauuaagucagacuuguaugaacacucacacaaauaaagacuccauuugaguuuagggacagccuggucuaaaaugauugaaugaaugaaugaaugaaugaaugaaugaaugaauugcuaguggauagggucaaacacaggucuaauauugagaaguuccucugacuagaaauugguaauauacaaauuuuagagaaaacucugggaacaauaaaauaucaaggaucccaucuacguauguugguugguuaaaaucuaccagucagcuguggugagccaugcaucccuauaauaccaggacagucugaaguaggaggaucgcgaguuuaaagucagcugacaagcuagaacuauauauacauauaaagacccuguugacaaaaaacuagcaagccagcauuucguauuuaaauauuuagcuagucccaaaagaguauaccaucuccuauguucuaugcuauacuauuauacuauacuauaauuauaguaaacuguaacauacuuuuauauagucucuuaaaaaugagcccucaaguccggcaugguggcgcaugcuugugaaacacuugaggcugggacagggaagaugccgggagcucugggacagccuagaauacacacugcugagaaaagcuugcguuccaaccaaaggccccucccugugcaucuuucucucuccugggccuggcacgagugccggacacaacuccuuucauuuuugucugaggaccucauaaggagagaugaagagauuuccaguagaagagucugcagaauagccaauccuguccguuuuauagauuuugaaaagucugaaggucaauaauuacacagcuuauccaagacuaauuuaggggauaaaaauugaaaggaaacuauuuuaguaacaagaacugagauucuuguuuuuucucccaguaagaauuaguucuugaagaacuguaaacugaagauacacucauuucuacucuuucuucccauugacugcgguuuuuaccagcugcccuugaccucaggaauagccuucuguugucugccugucugagagucugaaccuuuccaagccccucacuuugaacuaugguccuguacagaaauaccuagacuccuuuccuguaucucaggccaggauuauuaucucguacauagcaacagcuccaggaccaucuguuggaugcuuuguauuguaacuuccccuuuccgacauccuguuuccaucuuguauuucuccaaacgucagucacugaaaguguagcauauggaaggauggucaucucaguaaccaugacugcauuaaaucugcuuauaaagaugaaagcguagacaagagaaaaaacaagcaauaaaccuaaauguauacguauaucucaguucuuucaagauauaauguccauuuauuuuuuucaguauguuugaacgucaugaaaagcacuaugggaaguuacaguaccaagaugcuauaaagauaacaaacauucaaagaucuucugauaugagggcaaacauuaaaugcuacuaucaauuaaaaaggcaugcaagaaaaguaauaagagcugcaaaagaggacauacaaguagaauuuaaaaugacauuuauucaggugagugcacacuugcacaagcuguggcacauguguggaggucagagaacaacuggcaggaguugguucucuccucccacagcauggguuccagucaucucgcuggcccucaaauacgacuugaagggauuagaugaugguagaucuucagaauugccuuuuucucuaaguagauuuaaguuucuugucuucuaaccaagagccaggcaggguggggccuaugucaggucuccaucugcagagauuaggaacagccacagauaauaucgaauuugaaaggcuucuugccacaagaaguagauauucuaaaugcuaacaccaggacauuugauaaaugucaaauucugcuaacaagaauuguagggacuauuuaauauguauuauauaugucuuaacuucaugguacuggacuaucuuuacagacucugaugagagucagaagacaaacugaaaucugccauucagagcuuguuugaccucuaggaauuagcucagugguacaguguauaacuagcaagcuuaaaccccuaaauuugauccccagcacuggaggaaauaaaauguuuuugaauauaaaccaucauugcuuaaucucauaaaaugugaaaaaccuaaauguuaggcaauaaguauaucucuaaauaaaaagaacuuugcuuugaaaaaaaaaaugauuuuuaaaagaucacauuuuuauuuacugaaggucuuuuaguugcuaccacuaucaccuaaaagucuuuugcuuaaaaauaaaauuauuaaaaauauuaaaauuaaauuaaaaaaaacccuuccauucguucaauauucacuuugcagggucugguagcauagcuauguaaucaaucaaucaaucaaucaaucaaucaaucaauuuucccuuuguagggcuagugacauaggcaggugaggcaggaggauucuagguugaaggccagucugggcuacagaaugaguguagcuugggccacagaauggguauagugcgagcuacagagcaagauccugacucaaauggaggagacaggugcacugcggacacuucuauaccaaucuguuccauuucuccuuaucucgccaagggacuuuuauugaucuuagagauugcuuuugguuuuuuguuuuaaaaucuuucauuauuuuacuuuucucuggggaaaaaaaguauuugauguuuuuugucaaauacaguaccaauuucaaggagggugguauugacugucaacuuuguaaaaaaacacagaaguaaagcacucccaugcugguuuuuuuuuguuuguuuuuggcuugguuugguuuacaagaaauauaacaauauuuacugauagcaaaaaaaaaugugauuuuuuccauuguucugucaauauucuaaaaccaacuacacuccaaguuaauaaaauuucaaauuucuuuagagcuagaauuagucaguuauguuagcccucauuauuugaaacuuauuuuuuucaaaauaaaacuuucuaaaccaaccuaagauaguuuauaauaaucauaguaaaauuuuccuaaagaauacuaucuuuggcuuucugaaagcucagcucaguccaguucuucuaccauggaaacuauaccagcaauaggcucacacugucagcaauaggcucacacuguaagcaauaggcucacacuguaagcagacgagacacccgggggaagaagcacaacaccgacuuuacucugcaggcugccucugacuugccacucugccuguaaaggcuucuuuaugucauguguuguccauuuaucaccagauaaauguggcuaguaaucuuaaugauguaacuuaucuacuaaacaguaauucuccuacuacaaaagucacacaaaccaccuuauguuaauaagaugccucuuuauccagauccucucuuaagcguucugaggugcacacacauccuacaaaggugcucgauucuaccucucaugaaaguaaaacgucacaugggaaggacuuuuauacugcagaagugggcuagcucugaccaacaggacagcaauaugguaagacuuaucucauaugguaucgcuagaagcacuacuuuugcuuccuaagacucuggcuuaaguaaaaagugcacacccauuucuaaagacucugcugguacugaguaaaaucacugccaggaaacgcuaauguugcaaccauaauggagcaggauaugaagcuggacagagaguacaaaagaguuuaucucuauacccaacguggauucaaauuccggaggaagauaaccaaaaugucaacagaggcaucucagcugguggcccagagcaucucugugcgccccaccccucggggaacacggauggcuuagaauuuaaaauuucuuucagaggaccagucucauuucccaggucccagcaaccacaucaaagcagcucucugugacuccauucccagggguguucauucccuguucuagccucuuugggcacaugcacacacaugauguaccauguguacauucaggggcacacaaauaaaaacugauaaagaaauauuaaaauaaaaaucaagccauucccucuaaaaaguuaauuuuccuaacucuucaguuuucacauaauacauuuaauacaaucaagguuaggauucugagcuuugaaaaaugcuucaguguuaaauaugguuuugaaaagagccaacuguacacuguacagaaucucaacaacugccuccaucagauggcacgcaggagagcgcgcagaacaacuaauuaacgaagguaggaggguccagcccucucugugcagccgcguggucugagaggagcacagcacagggagcuggcaguaagaagcccgugcuccacucagcuccugccucuagguucccucccgccuuagcuuccucaaugacaggcuauaaccuguaaaauaaacccuuuccuccccccauguuaguuuuggucgguguuuuaucacagcagcagaaaagcacaacgggacaguggguaaaagcgugugcugugcaaagcccaagcccacacaguaggacagaaucagccucacaacugcccugugaccuccacaugucccuacacacgcacaugcucacaugccucuuacacacuacagggggguggggaggggagaggaggggaaagggagaagacagggaugaaagagaagaggaaaauuuuaaaaagaaaaugaguaucuaauugggcuuugccacuagaagacuucaguaguacauugguuuuucuuuucuuuuuucuuucauuuuucaaaaauuaaugaccucaacuucaggcaggcaggaagaaagggagcuaagagcaacaggcagcauucugacaucccuuccccugguucaguccccugauucugacaucccuuccccugguucaguccccugcagucuccacagagcgcugccaccgcacagcuccuauggccucacagcagauggaggcuuggcucuaccaugauauacuacaaacccucaaacucaaacacugccuaggaauuaacauuagcuacuaaaugggaagcaggugucaggaaaauccagauggcuuuaggcccaguuuagcguugacuccauauuccuaagcucucuugccaacagugaguuccacccagccucuucgucucagcccuaaauccuaucagacagcaaagcaaggugaccugaaacuauuucaaauacugcccgaugugccuuagcucagaccguaucagauacaccaguuccugucucuaggcugugaucugauuaacucuguuagcaagagaggcagaaaagcagggacugauuaacaggcacggcuauggggcccuacugccuugggucugaauugugaacucccugccuucucugagguccucuaagccagggaacacagcaaacagcacagugaggaacagcacugucaacugaagcccugcugcacuccucucacaugacaguucccaggaaggcaaaucagcaaugcacucuccuauggucucgucagggcccgaacauauuacauucggcaaaacuucaaugcaugcuuaaugaagaccugaagggcacaucccacucucaaucacuaauuggaaagugaucaccaagugcagucuguauccacagguuccacgaccucagucuggaaaugccaggaagaaaguuucuaucuggagccaggcgcggcagcacacagaggacggcaaauuagaggcuagccuaggcuacacagaaaagcaagaaacccaucugcacugagcagacucuucuccucgucauuauuccccaaacaauaaagcacaauagcuacucacacagccuugcgcuguaagagacaguccgaguacgcuagagguaauuuaaagcacauggcagguugugcuuagguuauaugcagauacuagaccauuuuauaccagcgacugcacacugggauucugucaucccagggguugguugucagacccugaggauacgaaggaacagcuguacaaaaugaaaaacucuuguguauuuauuuacauaauaauuauuuugaaacagaguucucucgugugucccaagcuggccuugaacuuguuacaucacugaggaaaagaacugacuuccugccuccaccucuuaagcgcuaggauuauagugugguacuaccacgcaccguucacguggugcugcgaaucaaccccuaggcuuugggcauacuagguaagcagucuaucaacuaaccuuaccuaagucacuaacuaacucauguaccucuccuugugagugcuacucaaagacaccacggucuguuaaaaugguaagaaggucugaaaaaaaacgacaccucgcuaacuaagccaggugguugaaagugcugcaaagggaaaugagaagucgccugacuucaagugaaucugcucugcucccucaccuccucccuccucaggcacuuccagucuggccccucccccccccccccccugccugccaccacagcacugucagcucagagcacuuucccaaguccuugcagcacuuguucucuugaauagauacacaaauaaacaauauauauuuauuuuuucagaaaugauauuacuaugcaacuaggugacuucaaacacgcuauccuccugacucagucucccaagugcuaugccaguacacuccagagcauggcuccuuuguagagagauuucucccucuaacauucuuaaaagacgcuaagguuccuuaagacucuacuacaagcagcccuguuuuacacccuuacacugcaaacaaaagcucacuaaugucucccucuagcccuacacucucccuugggcuccagaccuagcuaggggcagacucuccucucucucccaugcgaggcacuguuccuccugcaacucccuacucaccugcuggacccagggccagcccaggagcagggcucuccacacaacagcuucugggucuugcccaagguccuccaaugaacauuugugacuaauacagagauuauugguauuugguccucuagcaaacaagccuucaaagagaucccugucucaucaauggcugugcuagggcacaugacggugagccuguccgcccggugcagacagagaccugcugggaaccuuccugaggccugcaccaagcuuuucuguuaucagggcuuccccaccuccagcaucuuucuacauuugcuuuuuauuuccacauuagaggagaggggaaagaaauagauuauaagaagcuagacaauuuuuaaaggaauaacuccauaccuuaauaccugcacacacacaccacauauaaaagaaucagacauacaacucaauguuuauauaguuaauaaaacauggccaccaugcaacaaaaauuagacauaaacaggauaauucuacaaaaauuuaaucacuauaaaacgaccuuuuaaguuagauuaagauaucguauguuagggucacaagggcaaauacuguacagcggguggggacuuugggucucuaaacugcaacaucauuuugguuuuuuauuuuuuguuuuuuugagacaggguuucucuguguaguccugauuguccuagaacucgcucuguagaccaggcuggcccugaacucagagauccgccugccucugccuccugagugcugggauuaaaggcgugcaccaccacugccuggccuguaauaccaacuugcaaacugggaauaguuuucugucaacagagcacaagcuaaagucaccugagaggaaggaaccucaacugagaaaaucccuccaaggaucuggcuguaggcaagcggcguguagagcuuucccuuagugaccgacgagggagggcccugcucacugugagcggugucagcccugggcaagccaugaggaguaagccaguaagcagcaccccuccaugggucucugcaucagcuccugccuuguuugaguuccuguccugacuucgaugaugaacagugauguggaaguguaagccaaauaaacccuuuccuuaccaacuugcuuuugguccugguguuucaucacaggccacucaaauuuagugucacauguggugggugacuugcacaccuguaacccaacacuggggagacugaggugggaggauagcugugaaucugaggccaaccugggcuacguagugaguuccaggccagucugcauuauagaguaagacccugucucaaaguaaauuuaaugagaaucugucucaaaacaguaagaagcggaacuaggcacaguagauaagcuugacaaacucuaggccaggcugagcuauauagugaggcccucucucaaaaagccaaucaaacaaaaaaaccaaagagcacuagggauguagcucagggcagagcauuuugucuauuguucucgaaucccuagcauugcaauaaauaaauaacaaacaaacaaaggagggcuggagagauggcucagcaaccaggagcgaugguuauuacuccagaagagcccaggguugaagagcccagcaacacaagucggcucccaagcgucuguaacucaggagauccuauucccucuucuggccucugagggcaccaggcaagcacaugcuacacagacacaaauucaggaccccccgccccccaggaaugaauaaacaacuaaauaacuaugcagguguggcggugcaugccuaccuauccucccaucucucaugccgagucaggguuagcucaagaacauccuuggcugcauaguucaaggucaguccgagcuacacuaggcccuaccugagaacagagagcagggaggcagagauguaaagcuguagcugguuggggcuggagagauggcucgauggguaaaagcacuggcugcucuccuagguucaauuccuggcacccacauggugaccaaucacccagaacgccuauccuaagggagcugacaccccauuuuggccuccauguacacugcauguaguugggcacaaacucaggcaggcaagacacucauuaucccgggauuacaaaugaaaguucccuacuccaaauauuaauuucagcucuuuuucuucuuaaaaaaagaaauuguucuaacuaaacauaauuacaaacuaaauauaauugcucugguucaaggaacccaaaaaccuuuggggaugucaggcaggauagaaaucuuguuuauuaauacuguuuuaaauacuaauguuuuaaauauuauuaaguaauauuauauuaaauaauauuaguauuuuaaauacuaauguuuuaaauauuaaugcuuuuaaaucaagggggcuggagagauggcucagugguuaagagcgcugacugcucuuccagagguccugaguucaauucccagcaaccacaugguggcucacaaccauauguaaugggaucggaugcccucuucugcuguaucuuaagacaguguacucauauauacauaaaauaaauaaaucuuuaaaaaaaaacccuacaaucaagggcuauuuucuuuuucuuuuuuuuuuuuuuagagagaacaaaugagaaauguuuuucuuuaccaagagcaaguagaaguucucagugaaacuaaugggguuucuaaaaguuaccuuuguauaaaaugcuaaguuuauccuacaaaaaguaauauaaaaccauuguuaacacugagcauugaaaaaauaagaauguuagaauuuuuuuuuuuaaccuuggaaaugaaggcuaauuugcccucugaaacuugggaacucaugggaccucuaccaagucacgggcagagaaauagcagagcaggaaggguaggcuugugugcauguggaagggccauggaggggacagagacgacggggcaggggacgggagugagcacucagugggguggcaagcaaggcaccugcaccuguggaagacagcucagcacacgucagcagggcccugggauuccagcccuucucccuacacggcuagagcuucucaaagccacggucuccaaacugcagaacucuggcuacaaguaucuacgucacuuuuauuuucaacgccaguagagcaucugagaucuaagucuccaagcacaagcuucugaagcgcugacuugcugcugcaagugggagauuccucgccuggccucacgugacaaggcucagucuaaacccaggcgcaccugaaaagcuauacaguugccuucaggcuacacacaaaguguguaugaaguauacacacuucauaaaggugaaguucaccugcaggcuuggguuucaucccuuacuaugucuguaaauauuugaaaagauggaaaaucagaaacccaaaaugugucugaucccaagaauuucagacaagggauauucaaccugaauuauauuugauuucuuuaggauuaaagaauuuauuuuuaaaacaauucacaaauaugcauccaacaguaaguucacaacugccuagaaccugaguucuacugagaggggauccaaugcccucuucugauaucugugguacgguaccugagcgcauguggugacacuacuuguacaugaaugaacucacacaggcacacacauagauauuucuaucugagaaucaagcaagcgauggccucaguccuucuggagcugugauccuccuggagacaccaagaucagucacacauuccacugacucagaacccagcacuguuacagcagcagucaaguccagaagaguaaaaaccagucaaagcuuacugugcuucuucugaucgccccuuaugugcacgugggcuauaaggaaugagaauagcuaauaacaauaccgcuaaaaacgccaggcagcaugcuaagguuuuacauggcucaucucacgucauccucacaguagauaacagaucccagagucgucuguauuuuauagucacuggaaccaaauccaagaggccaggggacuugccuuagcucacagagacugccagccugggaagacugguugaccagacuccuugcucuacuuuuaacccuccagccagaaaccaugucaaacaucuagggaucacauuaacaccuauguaaaaacguucagacuuugaaaguaguuagcuuguuaacuaguaagagaaaaagaagcauaagcaggcacacaggugaaauaaaucaacagaaauuucacccaagggaucuacauccauuacagacacguuaaggaugagaaggcucacccaccgcacugauucugugacuugggcaugguguaaagagccuguacuccccgcacucagacgccugagcgagaggauagcaaguucaaaaccgaccgguuuggaguaucccaaacaaacaaaaacuuggaugcauuuuauaaaagaacaacaauuaaaugugaagacuaacuacccucacuaugacauaucaccaacguuagcaucacaaguccacaaaaguucaguucucacacucuuucuuagaucccuaucggcccacuggccuacugcucugcuccuguggcucugacaaagccuugugaaaagaagcaucaggcugacaaagauaggcuuagauacagacaaagacacagggcauugucaggccagagcugaagaugaaggaugcucaugcaaggagauaaacgagacugcaagugugcggaaauaggauuucuugaaauuaggucauuucugacugaaacacaaagcugugacaagcagcaaucugggugcucacacgcacacaguccgggccggugauggccuucaggagaagaaguguaucaaagaguuccgugaaaauggcgggucccgacaguccuuucuccaaagcaaaagccaaucugagaaacagacacaaaccaggcacuagucugcagugacgguuccagaagugcccaggcuucuguucucuuuaaagugagcucacaaacacuugcccugggauagcuccacacaccaaguagaauucugaaacuaaagcccaacucucgugagacgaugucccugcucaaucacuuucuuauuuaauaaaccugucaccagcagcaccaauuccuuaccagaaacucugcccucaaaggugauagaaagggcagcauacuacccucuaaagcauccccuaggguuacuggcucucccucuggcucucucuguccagggucuucaauacaacccuugaagucccuaugcagccgaggcgacuuuccaauccaggauccuccugccucagccuuaugagugcagcaauuaaacaggggaaugcuucagugccuggccuuaaucaucuuuuaacacaaauccaaauuuguguuaaagaauaaacaaaugacucagaugguauucuauucccaguaugugcugcaguaccgguaaaaacauuuuacaaaccagaacacaagaucccaguuuuacuuaguugagacucagcuccuguuuacagaccauucaugaagcaaaacagcuccuuuguuacacagagagcagaagacucugucuucaccaauaaccguacuggcucagagaagcaaagccauccccaagcacaaacuauaccaccugacaggaaagcucaaggcccacugaugggacaaucaaugauuagcaaggagaauaguuuugguuucaagagcugcaaaggcagacuggccauuacaggaagcuguacuaaugcugacaaaguuaaacuguuuacagaaacuaggaagcuguccccuguuccccccacugucacacacccuguccuguccucuguggccaguguugcuuauacugcucaacuguaacuguaaacugaacuaagagacuagugggcggugacucccaggcacugguuggucugacuguguugccagcugugucauauccagccagcccuccacccacccagccaaccucaccuagacagucacccacauuaccacaugccccagccacccucagcugagcagcucaagggacauggcucacaugcacagugguaggacuccauggcugacgccaaggucaaggagcuaaaggaccacuccuuccagaucaccuacacgugccagccccaggcagcaggccacccgacacggggacaacacggggacaacagugucaugcugcugagauuucucucuccacguaaguuguuuaguuucccacaacagaaacuaaccagaaaaggaaaugugugagaaaaaucauauuagcacccaaaaugagagcuaacaaaugaguguucuacuacagggucacuuccaucaucuuugucugaaaaccaagaggcacucacucaucuuaaggaaaauguaagaugugauaggcucucuaaaaaggcaacucuucucauuucaauuuccauaagaagucuaauacagucaaccacagguugaaagaaaaacuuuggaaaacauuuauuuaaucacugaggagagcagcucaugucacagcuugaguguggagguucacagacauccguaaauucaguucuaggaaaucuaauaauaucuucucuuauaaccacccauuaaagaaaaauaaauaaauacaauucuuaaaaugugauuaccacuacuccaaguacagaaagagcugaugugcacauguggcccagaagagccauggcagaagaacuauauaaagagagcuagggaagugcaaagucaggccacgugggaaugaagagguuauaggcuaugugcggcugcccaucaauuauacuguugaaaucauggguaagccuacuggagccuuuacccacaacaagagguacguucauucuacaggcauaggaaaccaucagcgcucgcucucugagcaaucccaugcuguuucagugagacuacuucucaaguuugagagagacaaagaacaacacaaaaagcaagaagggaaugagcaccccagacuuuacagaagagaagacagcaccuggcaucuguccuaugaggguaaggcacagacagugacuucaagggagaguuuaaacaaccaaugcgcuuucucaguaccaacaccacugcccauucaaaaaauacaaauagucaaguacccaccauggcugggcaccacagacagugcagaacacacucucaggguaggacaauccuugccuccaguuuacaaguggaugucaacuuuacucuucucucuugugccucuuuuuuaucugggggcggggcggggaugguauuucuggaaccuaccuuucccuggugucgauagcauucuucuacugaaacauuagcuggcucaagucaagaacacacaggccuuucuccugaguggguuuguuuauuuuuaaauaaaacauauacaugcaccuuucucaccaaggacacagaccuuccuucauaugagacuaagaugugaaagcacagauucaaaaucuguccguggcaucccaacuucaauuagguaggcuugggacaaacagggaaguuucucucacacagggagggaacugucagguccacugcccugccuuuauucacccagggaggguggacugacgcugcuuucucccuggccuuggaagauaaacaucugagagaacaguggaaagugugucuacugagaaaagaaaccaagaaggcuaagaagccgcccuuaaacagaagggcggagaagaaagcaaggaaaggggauauguggagagcaagcaaguccacagagaacacaaugacgacagggaccaaaggucacagagagccagaaaucuggugacuccaugucacugaucaaguuaaauucauacuuucugauguacaaugcugccagacacucaguacgagaauuugacaugauauacauacaugaugaacuguacuauagccagcacacgauacaugcuacacuaaggagcauaagacauggguucagcaaaaaaaaaagcuaucauaaaccguucuuguaacuuuucuacaacagccuagacugauccuggauacagacugcaccaaggaaggcugguggcugugcaucucugucuagccacacccaugagggucacuucaauguucgugacaucaccaaacaauuuccuaagcgguuuuacuuugaacugacacucacucuacucacuacauuacaggaaagcgcucuggaucugaacugucucuaaacugcucacggucacauggcuacugccgauggaaccuuucuggucuucagcaaacagaaccaaaugcaaucaaaccgcucacaauuaaauuauaaaauauuugauuaagaacuccgucucaauucucauuuucguaccuuuguuuuuuaagucagggccuugcugugucacccacgcuggccugggacuugugaucguuccccuugugcuuuucaaggagcugagauuucaggcacgagccaccacagaugagccaccaccaggucccuggucauguuuauaucuuuaacccuggguuacaucccacuuuccuacucuuucuucauugguguguaacagcuaccaaguaucuuauaaucuuuuuugaagauaaaggagggaaaaccaauggaaauuauuccccaugcggaacaugagcacagaauagcacguuguuucuuauaaaaugaguucaguuucuccccuagccacagagggacucagcacuuaggaggcagagaaaggaggguugcuaucaguuuaaggcuaccuggucuacagagcaagaaaaaaaaauauccuagucucucuauagcaaacucaucagugccacugaauaagugacucaaaggcuagcuaacagauacauaugaacaaccacacuccugcaccggacuuccauucuaaagagacaaaggacaucacugaggaagaacauggcugcuauuguaagaaaaacaauuuuuuaaagagaacaaaaucagaaugacuagggaaagucauuacgaccuugcuuucuaaccaguaagucaguucuauuacaucuauagaguugaccuuauuuuuuaaccuugcuuaguaaaaggcacacacagcaaaccaaguauccaaggcuacaguuuugaauugguuacacugugggagucuguaagagugcgcuaaaacagacauugcuaaaugucauuaaauaaaagcacacuucagggcuaggguggcucagcagguaaacacuugccaccaagccugaggaccugaguuuaacacccagaaccgauaugcuaguggggaacccacucccacaaguguccucugaugucugcacaugugcuggcaugugcacguacccacacgcacacagaaguaaaaacgcaaaucauaaaaauauauacacaaaaacacauuuuggagaagcggaugucuuaccagcuggaauucccggcgccgaucguaggcauucuguauaccacuguccucccauaaggcucugauagcaggaagauacugcaggaacacucgagucuccaccauccccugggcagccaugggggcgcggguaucaaaugccaucaacuugucuccauggagcugguuuuuguuaucuccccagggaauaugaagcuucucucgggcaucuaccagcacccucauaccuuuguuuaaaaagagaaaaaccgugugaggaagagucaugaagauaccaucagaggcuuuggccccaggguuacucaguauugguuccuuaauuuuuagcuauuacagaagccccacuuccaaaaugggagaccagaaucaaaacaaaaccuuuaucuucucagagguuugagaaacaaguguucacugucucaaaaccagaagccuugaaaaguuaauauuaauaacaaaaaccacuuuggggaggauucuaauaugcuacgauucauaaaaauccuuucugguguagacggcagucaaaaccggagacagaaaaaauaaauagugcugccuaggcuggugccaggcuaaagacggcccggcccgagcuaaggacagcugacugugcugugugcaguccggguccuccagguuccuaccaacacugucuucuaggacgcacuuaaccucaaggcuuccucagaccaaguuucucuuuuaaucagugcagucacacacuggcuuuagucaccuaaaaggaaaaccaacugcacaaagacccaagaccgcccaugaggcuuccacuuacacaggucagcucaaacuccugucucuaaaacuguuacuucugucaucaucgggaagucauuucuuuggauacaagaaaaaauuguuaugcuuucacuuuucugaccaugccaacaaaagaaaauaagaugccucccuagacuucaaccugaucacacaaucauguucaaagggacucuuaggcccaguguguguagaaaagcaggugauuugccucgcucacaagugacuacuugagucuguucauucuuuaaguucaucuguaucaggauacaaagguaccuucaauuaagggcuggcaagguacaguuuacagucuuccaggagacuuuaauuaguucugugcugagcauuaaggcagacugaacacagccauccuuuucagcuuuacugcaaagguacaaggguaagggcaagacauggacugugagcuccuggccucgcccucuccccucucugccuggcaaagcaucuucucuagucuuucccuacuugaaacacugaaggggguggggggaacggacccaugagggaguuugcuuauguucuucuugaacaacaaaaaauaugcuuaaaaaaaagucacacaacuccuugaaaagaccuacaaaauuaaaguuugcuuccaagcccuagauuuaauagggugacuccuuaaccacucagaaaucuguuuucugaugugcugcugugccucaacucugccaacuucucuuagguagaaaauaccugacacuaaagaaaaaaaaauuaaaaaaaacaagaugauucuuuuaaaugauaaaaauaaaagccaccucugcaacuuauuugaacacuaaggaauaaaaauauugggugguuuucacuuaaggaacaguauuuaaaauacuguucaacaggauuugugaagcccaccaugcaguccagcacauguauuuaaacauaaauucaugaaagcauuagaaaugauaugaaaugauacuguuuuuuucuccugucucgaguuauuaagaaaaaaaaaagugugcaacauguugaacugugauuacaaacauccuguagcaaugagccgauaaaaccacucgcgcuaauuuuuuuuaauagacuuuccugaugccaguucaguaaacgugaguuucauacucuugccccaaaaggcucuagaggcugucacucuaugcccuugacaagagucucaggguaaaaaaaaaaaaaaaaaaaaaaaaaaaguuuccucauuacaaccguuccagaacuugcuuaagucaagagguggccuaggaagcccaaagcuggaaggguaacauacccgguuacuagggucacccaccagggacgggcagaaaggaaagaaggauaggaagggauagggaguguaggaccuggggcuacugauggguggucuugcccggagugcagggaggacacaaguugccccgcugccccgagucacccuacucgccgcacuucccucuuggagggggcgaggccagccgcggagugcugggccgaccgugacccucaccgggguagcacgggggggacagcggggcgucccggaucgaagggaccagggcaacagggcgcacagaacggugcccaaggcgcgcccacccgcucgcccguccgaucugaucccguucggucuccuccgacuggggacccggcggaugagggcggugcccggcccggcuccccagggguccccgagccccgccgcgccccgcaccuuugaucacguugcuguagaugguggggcggaacuccucgcgcgcgcgcuggucgaaguccuggccguggaugauccgcaucugcuucaggaagguggacuugccgcucucgcccgcgcccagcagcaggaucuucaccagccgcuucacguaggucuucucccgcgacaggcauuugucgaucuccuuggacuugcgcugcugcucggccucgccguucgucagcacgcagcccgggaagcacacggacagcacggagcgcgacggcaggaaguccgccaucuugccgccgccgccgccucggcgggccccugcggcuccuccaccuccuccuccggcagcgggcggcuccggcaaggcggcuggagggcggggagcgcagcggcggcccgagcgcgcccggggagggagggaacccgaggacugacucgccagggcgggccgcgccggccgggggagggug

SEQ ID NO: 6474 - RNA, 4428 nt, Mus musculus
cggauugggugguggggguggggugaagccuggaauacgugaagaaagacugacccagaaaugaggccaaggcuuagcgcgcagcgucacaaaugcggacaaaaacaaaaaaccaacaacaaacaaaagccauccagacaggaacugaggcuggauucucaaguucuuaggaguucaccggaagaauccaccuuugcaaggauccuacagagaagagggauagcuaaauacaauugcuucagccccgacgagcacacugcguucccccugucacuccacaggagaacugugugugcuggaacccacagagacuagccaagccucucuucacggccagaacauccuggccacacagaucaucugaccagaguccuaucccaggguaagaggagaugcuaacucagucaacucccugcugacuaagguagaaguucucccagccucccuugccaaugcccgcgguggcugcauacaaagucgcccugcugaagguuucagcggggugcccagggucaugcauagcguggccaggcuugagcuggagacucggcuucggguuuacagguuacaauccccagugugugugugugugugugugugugugauucaucccaaaugugaacugaaacccucccuccguucaccuuuuuuccaaauugccuccuuucaaaugucuacgcauaacuucuugcuaaaacugacauuguacgcucugagaaagagggcagugugacugauaacaaggaaggagaagucagggaaguagaauuuacucucucuuccucuccaccuucaguccucccccacguacuccucccaggggagggcggggcuuaaugugugauuggugguugaaauggaacccugucuccugucaggcuccugaaguccugaaguuuccucuaucaaaaugaaggaugcagcggccucaguugaccccaguggauaaggaauggcuuugggaugcuaacucacaacucugugggggagccuuggagaucaccccagagggaagugaagccccacugguuuucucagcagcuggcuuucucaagccagcucucccuagaacaaaaacaacccugucagaaaccauaaacagucaggaaaacacacagccagacaaagggaggccauucaguggucccagcauggucuccuccacccgucaggaucauugacccaacaggucagaaucugcuguaaaacuuggcaggaagaaaucugggcagagggaugagggaacaaagaugagaccaagccucaagcauuaucuuuucaaucguuuuaagaucuauccugcggaaagggugcuguuccaggaggcaaagaaauaaggaacugcaaguuaaguccccuuuuaggacuuuccagccaagugacacgacuuaaaacccagcaccaguggggucucuaaguuugaggccagccuagucuacagagugauuuccaggagagccaguacuauacagagaaacccuggggugggggcagcggggcggggggggggggguggagggacacuuuccaggcuaggcaugaggcucaguugguagaacauucgugaacccuguguaagauuccccagacacagcugugauucccagcucuagagagacagaggcagggggacuggauaucagggucauccuggacuacuuuaaacuaagccuagaguacuugauucagucaaucaaccagccaaccaaccagguaauaggacucccuucacaacuacggaugcaaaggcaaaaaagggcguggacuguuuuaaauccaucuaagacucuucuuccuccuaccugucuaaguggcucuuucaucacuauucuacagguugcccugacgccuauccaaaguuucuaagugcucucucugucugucucugucucuccccucucccucucccucucucucucucucucugugugugugugugugugugugugugugugugugugugugccccucauuccauccuaguaagugucugacuucaagugccuccucucugcugaauccaagucucuggaguuuuagcuaagcuuuugccugaguuuuuuauugacggcucaccuuuugaguuaugugucuccaacccauugacaccuucaaugucguacagacguaguuaccuacauccauccauaccggguaucccuuuugcccacccucaucucucaacacccccucaccuguaucuguuuaucccgcuucucugaaccugucccuuccuugcaguagcucugccggcaagucggcaccaugaggaugccuuucagcauuugcuucaauagugugccuucucugacacgaccccacucauucuccacuguauaaacugacuugaccacuccaugguauaagaauguuuuguucuggauaugagaaagaaagggcagccagaagcaucuggaagaguccagagcagagagagaaagaagcgagaagagagaacagaaagaaguagaccucaugaacauggccggcagacuggggguggcugggugaucugcgaaugagccaagggauggggaauagagaggguguucugaaaccaggaagagccuagagaauagcuugauuauuagaaggaugaggagcucagaggagggaagccugggagcuguauggaguuaggguaagggaggggagaggagggcuaggaugcuaucacagacugaaauguguaacaggugcuuaugguacccagagagccuacacaugaguuuugauguucugauaggcaccacaggugacuucugacagagguaagagaauuggcuucacuagcuccugaggaaugcuggcuuuucacuagcugcuacaaagccucccaugguccagguggagcucauuucuagacacuuggauugccuuuuggaucuuggagaucagaauuuccuuuggacccgacaccucucaccucauguuggucacccccuucccuccaccauugggaccugaauuuucuucuaugucauuagugaucugucauauuguugugaagcuauggcugcucugagcuaagcuggaaucacuuuggaguuaagggacacaguuuguuuuauuggacaaucaccagagcccuggaguacaaaugaaauguguuugcugaauauguaaaaagacugaaggggggagcaggaaaggaaaggggaagcagggggaaggaaggaaggaaggaaggaagaaggaaggaaggaaggaaggaaggaaggaaggaaggaaggaaggggaagagggaaggaagagaggggagggagaggggagaaggagaaagaagagaaggggagagagaggaggagagaggggaggaaaagaggggaaggagagagggaaggaagacaugggagggagaggguuaggagagauagagaggggaaggagagagaggggaagagagaaaaggagagaggggagggagagaaggggggaaagagagagaggugacugugacugaagagguuucucaaaagauauccuaacuucuuuuucuacuuccuucaaucuaaauauuuucccuuucucaaagcuuaaggauuuaccucacagauucuuuucucaauugcauuucauuguuuauguuuggguguuuggccuguaugugaaucuguguaccacaugcaggccaugccugcaaaggccagaagaggggaacucccugagacuggagcuggagacaguugcgagccgccgccacgugggugcuaggaaucaaauccagguccccgagagaagcagccggugcucuuagcugcucugcuaccuccccaucuuucccuuuacagguuugcaaaggaauaauuacuuauuuagugacccuggauaaagguacuguggugguugguacugucaacuuggcaaaaccuagaacuaggagacacaucuggaagggauuauugcuauuggaagacucaucuuaauuguggguauggccauggcugcagcuggggauccagaauuguaugaagugaagacgaugaaugagcuggggcacacgagcguguacgugugcgcaugcgcgagugcgagugcgcucaugcgcaugcguauauugcucucugcucuacauuguggaugagauuuaaccacuggcuucaaguucuuacuguguugacuuccccacaggaccgacaguugccuuggacugugagccgaacaaacccuuuccuccuuaagcugcucuugccggggcauuuuaucaccacaacaggaaaggacacuaagcuaggugcaccuuacaaaccaaagggagaugccagucugaaucaaccacagaacauacaugucauaaggaaaaucacgaauucaucugaggggauucugcaaguaaaggaauugggaacuaaaugauucccaaaugauuaaugauuaaaaaaauaauaaauuaacgauaaacagaaaaauaaaaugguaauaaauuca

SEQ ID NO: 6475 - RNA, 974 nt, Mus musculus
acuccuuugcaguccugagcucacagucccaggguuugguugcugcguccuuggcuggcgucagaaaaauggcuacaaacuuucuagcgcaugagaagaucugguuugacaaguuuaaauaugacgaugcagaaaggagauucuacgagcagaugaacgggccugugaccucccagcucccgccaggagaauggugccagcgugauccuccgagacauugcaagagccugagagaacagccagaaauccuuggccuggagccuccaguggaccugguggagaccacagugagcucauugugaggauuaccagucuggaaguggagaaccagaaccuucgaggcaaggugcaagauuugcagcaggccauuuccaaguuggaggcccggcugagcucucuggugaagagaucaccuacuccccgagccacgaccccacagacccaacacgucucuccuaugcgucaaguggagcccccaaccaagaaaggagccacaccagcagaggaugaugaggacaauggcauugaccuguucggcagugaccaggaagaagauaagaaggcuaccggacuacgggaggagaggcuacgccaguacgcagagaagaaggccaagaagcccacacugguggccaaauccuccauccuuuuggauguuaaaccuugggaugaugagacugacauggcccagcuagagacuugugugugcguuccauccaauuggacgggcugguuuggggggccuccaagcucguacauguuggcuaugguauccggaagcugcagauccagggugugguggaggaugacaaagugggcaccgacuugcuccaggaggagaucaccaaguuugaggagcacgugcagagugucgacaucgcagcuuucaacaagaucugaacguccgagagugugugguuucaugugugugaggaccugcugagauuaaagacugagacucugaaaagaaaaau

SEQ ID NO: 6476 - RNA, 570 nt, Mus musculus
aagaaaauaagccacagacaaaaaugacugcccaaggccaugcagcuggcaggacagggcuucaaaccagcucucccugauucauuccaaaguccauguuccuaaucgccgcagccuaucuggccugccaggcggcacccaggagggcagaguuuuaacucuaaaggacccaggaagccugauggagacagguucaaguagccaaaggaccccacaauucuauuucauaugccaccuucuucuuucaaaaucgcgcacuuucuugacuuuaguuaacauaagauaauucucauuauaaacuaagaaagcaaggucagcacccacaaucucucccaaauaggaaugcucuucauuucuuucucuaacuuuuuauucugggauaauuuuagauuaaaaagaaaagaugaagagauuauuaaaacucccucugccucuacucaucucuggcccacguacauuuuuuuacauaaucauggcauauucgcccaaacaaagacauuagcagacacaggggucgagacagaugguucagagguuaaacacacugcugcucuugcaaaggacaggggu

SEQ ID NO: 6477 - RNA, 6417 nt, Mus musculus
uagauuggacugacugugacguggcgaguccuuuucuucagguucagcguugugguaacuguccaccuauacuagacgcacacgaacuagcuacuugggcuuacaaacacgggacauguuugugugaccggggaggggagaauauacaaauguaaauaucagaucacaagauuuacguaacguguuagcacacauacacacaggacuuugauuuaguuuugguuuuuccgguuucugccgggcagcuguuuuccaccaggucacacccaggcaaugaugucuuccgcuccggauugugaauugucugccugcacgaaaacguucacuuuaggggagacgugaccagagggguauacuuucggacaagccagacucaaauccuguucucugaacggggugcguguagaacacagcucuguucuagaagccgggugugauggauaggggaggcgggaagccagggaaugggagacacacugacaggagucagggcuuggcuagugugugugcauguugcguuccuggguuguucagauacugguuuggaggucuccauugaggaggguccucugggucuccguggucucauucagccgggauuuguccugcuuacugucgcuccucuccccauccuccguaccacucaccuugaccaagcaaagaacauucuggaagcucuucuugaaguugucagacaagaaggcguacaggaugggguuggcgcagcuguuggcauaggugaggaucaccacaaagucaaacaugccuuucagggcuggggugggacugauggccacagacacggaagagacguugaagauguagaaggggagccagcagaagaugaagacagccacuacgauggacaccaugcgggucaccuuuuucucugacuuuuuccucuuggaugaucccacucggauuccagaggacuucaccuugaugaugaugaacagguagcagagacaaaugaugguaagggguaccaggaaccccaggaugaaggcguagauaaugaaaccuguguaccacgccccggauucgccuggccaguugaugguacagcugcuccugccccacugguugcuccggaggccggcguauaucaugaugggcaaaaugacgagcagagacacacaccacacagcuacauugaucaucuuggcuguccggggucgccuccauuuggcugacuuaauggggugcaccacggccagguagcggucgaugcucaugaccgucaagcagaagauacuggugaacugauugaugccaucuacagucaugaccacccggcagauggccuugccaaaaggccaguggacuagcgccaccugcauggccaagaagggcagcccuagcaugaagaguucaucugcaauggccagguuaaggauguagauguuggugauggucuucaucuuggcauagcggaggaugacauaaaugaccagcguguugccgcacagcccgacaacacacaccacgaaguagaugaacgugaggacggcguugcuugucaugucguaguauggcucggucugguuggagccauugcuuggccccagugagccguugaggucaaauggagaggacacccacacuuggcucccauucaacugcucagagcucaucuccauggcugcuuuccacuccgucuagaaccaagcugccuagagaucuuccucucgccucacaggacucugggggccaagauucuacugugacaucugggaaaagaagcagaaaaaguagccgucagucccaggcuacuuaggcucccucuguuucuuguucaucuucuuaguuucacguuccaugcccccccaauuccucuuuuuuuucauguauucaugugugcugcugcaugguguauguguguguuuguguguguguguuuacauagguuugauagccucacccuuuuuugagucaugauguuucaccauguagcuugggcuagcuguucagugagcugcagagauccaccugugucugccucccccacggcugugauuacagauauguaucaaauauaccggcaguuuuaugugguucuggagguugaacucaggucuucuugcuugcaagucaggugcuuuauugacggagccaucucccccucuuccucccuccuuccuucuuuucuuuccuucccacaucacucccucucucccuucuucuuccuccucucuucuuccuccuccuccuccccucucucccuccucccuuuccccuccuccuucuuccuugagcugagcuagccuggagcucacuauguagccuuagcugacuuucaugcguagcacucccaugccugggccucugcuguuuggagucacagugagcuaccaaucccuuguuccccuucuaugcauuuuucaauugaaaagcaaguuuuuuuuuuuuuuuuuuuuuuuuuucugucuagcugccagcccaccugucagccugaagacuuuuugaggucuuuuuuucaauggugggggaaggguuugaguuaaaccaucauccuagaugacacacauguggcagacggcuauggcuucaaacacauagacuuugaccccuaaggaauugaccgauccagacuggaaaaaggcagaucuuggaggguuucagccccugucccuggaggagucugacaccagcauuuggggaccccaagaacaacucuaugcuggcuugaugucugccaccaucagagauacccccgcccccguggugggaaaacucaagaaguuaaagggagaacaaacuuuggcuccagaguugagccccacgugaccccaugcccagcccuuaacugcuguaacucuccuuugucaacacaggggugucaugaagguuaaacaagagaaagugugugcaaauccuagcauugugcaggcuuauaaucagagccucauaaacguuaccuccccccgucuacugucucauuaucucuaauuuauugaagccugccuacacagugaaucaaguuauagucuucaauauuaaaaguaagagucuggcuuuuuuuuuuuuuuuaaugaugcuuuaggcccucuccucuuccucccucuucucuucccccucuuucucuucuccuccuccugguucugauuuuguaacaucaauguucuccauucuccacuccaucucugcuugggaaggcucucuccuaaagaccuuuugccugcaguucucugacuuaggacaaaaaaaaaaaacccagggaacuaggggagggauguaggcuuuucaugaaugucaaagaugcuuuuauuuauuuauuuauuuauuuauuuaucuaucaagaauuaaaguguuucuugggcuggagagaugguuaagagcucugacuacucuuuuagagguccugaguucaauucccagcaaccacaugguggcucacaaccauuuguaaugggauccggugccucuucugguguguaugaagagaacaaugguguacucacauacacgaaauaaauaaauaaauaaauaaauaaauaaauaaauaaauaaauaaauaaaauaaaaaaccggauggagucuagucacacccauuguccccauuguccccaggaggugaggauuccguccucccucaguggaaacugaggcuuagagaguuaaagugcuugguggagugagcacuuggacgagaaccagcuggccccaagucuucugugauuuucaccaugucccagcugaugcucagugggucgaagcugguggcugguaccuuaggccuuaguuggaagccacuggcucaagugaccuccaugcugagaaaauaaugagaauucuguuggcuuggcuuaagaugugaagcaccaggucaacccacaauuaagcuaucuaucacaguuauaaaaugugugugugugugugugugugugugugugugugucacugucugugcugggcaccuccagcagcuaauacuucaauggggggggggaagggcaccaagucacauaacaugugaauugcguggaaaugagccuaugaauaaaggaugugagcgucaggacacagcccuucccagggggcuucucaggaaguuaggggcugggucuuggguguaggaagaguuagguaagcguuugggacaggagguccagccagggagagaagaacuggucaagggccgaaguguccagcaucucuaguucacgugccugagcacguuucauugaagcagagggcuucuccaagugauugccuaacacuggucgaggcugcagggauguuaaagauguagcaagcaacaggcaggugcgauugauucgugcccaccucugucucugauucguucucacggccaagugauggccuggcuuuucuuucugcaguaauuuccccagcacaugcuuggucagugaggucuaggauuuucgcauuugcauuuuggggacccauggcauugugucuacauuggguaagcaagcagaagcaggcagccauuacaaccagaagccauaaagaaacuccuuuuaguauccccagauuaacuuggguuauuuccccugucuuccccccacccccuucuuucucaucuugucagugacuuaauucuauagacccagaauccuauucaggcucccuacagugagaccucacaguaaccaggagcucaugccaucuauggacagugauaggguacuucaaugucugacuaggacugaagaccuccccugggcuguagaaucccugucuaaagccaaaaggaggagugggggagggggaggaggaggaagaggaggggaaagaggaagacagaggugggacaaggccggauguguuucuucagcccucacugugcagaaccagaaugaauggcggggggucuagggguguguguggagggggugucaccuuucucugaaaugagcugagacacaucuccacuuuggggagggaagucugggaagguggguggaggucauaugcugggaaccccaugucugaggaagacacgagcuuagaaccuaggcgcccuauguaacaagcccaagaccuccaaguggcgucuuuuccuuuuccaaucaucucacugcaagugaauugcaaaugccaccgggcgauacuuguugaauugugcuuaaauuaaaugcccugggaagucaggcucucugcuuugcugcuaaauacuggccuguagcuugguggguggcguccccuggcuccgauggaaagaaggguuuccacucaggaacccccucuuucccucccacagacugcuccacaacuagaggagggacagguggguuuaguuucuuuccagcaucuuucuguugugagcccucaagaccuccccaucuccaagccuaccagacaccuacacacacacacacacacacacacacacacacacacacacacaccccuccaagaaucugagguuggaacuugcagcagcccuguguagcccaccacgaugcuagagugccccucgccauuggggcgaagguagauaagcgaggcucaggacgauggaguuagugugaggaaaauauuuagggucauaacucgcugacucuggaaacaacguguucccuaagggaucuuuaccguuucuaggcagacugagggagaguggauugcggugccugcaauguccagcuucgaaacgcagaggggacugaggugccaggggcagcuaggagcgcugacagucgcuuggggaccugaccauucaguagcugguucucuccaaucuagacagauucucugccugagggcggcgggugggggggggggggagggagggggaccugaccgcagacgaauuugggcugccuccccaucagggcgauaaagagcccugaagaaucugcuuuccuucuuuuucggugacguccccaucacugucccucccuaacuuaggucucagacuguggacccugugguggcacuuggcaugucccuucuccuuuagcuggugucucuuuccucggaccagggcuguuucgcagguggcuaggaaacaaguuguccccaucggacacgcagggcacacgccacgguacuugggcauuuucuuugagaacaaauccgucccagaacacacuaccuuuccaccccagacaccacgauaugcaucuuucauccaccugucaccuccaaaggcacaaaaacagagaauuugcgcgccgggaccaacgugcaggucgccgggaucggcggucuauccccagaacagaugcaugcaggugcccaaagugugcuugucccucccuccaucucacggugacacacgcguaugcacacuggcaccccucaccuugguuuuccucgagcacucgcuucccuguguucucuagcacccagaagcuguucuuuuacccagcugggcguccaggagcacagcaggcuuagcggguguuuggcgcucagcaguggcucccggggcucccagcuuccuug

SEQ ID NO: 6478 - RNA, 944 nt, Mus musculus
cacaguuaguugguccagaugguggaaagccuguauccaauaccuggaguggugggaacaggaagaggugaggacagacaggugaaauuucucaguaaugguucugugaagggggaagaaggggugucucgcuccacccaaagggagggcucagggaagggaagccuaugacuucaucacugggcccacgccaaugacaucaccagaagggcaaggagccaggcucagcaaguuauuuauggaaacggcuggcggccaggcacagcuccugagcuguuucagaugugguuggauaaagcuuccagcuggcccaguggggccuccaaggccugcaggcaggcggaggaggaaggcuggaggaauccagcagcugggggcagggcuccagcagagaucaucagaguuccaggcuucuuccuucuugggaucugcucaucucuacccaugcucaucaagggcuucccugcagaucgggcuggcugaacucagagaggacagcaugugugucugccuucgugugcaccgagggcaugucugugcacaagacuguaguaugggcuugccgguccauagggacacacacucugcucccuuccacacugguaccuugagugguccugagugaguauacagaucugugccuccuugcacguguaugugcaugcgugcauggggguugggaggcagagugcccagggagagcggggaggagaagagccgcccgggagcgagaucacagcaggaagcuggggaaauaucauuucagcccaagauccagaggcacuuacagaagcuucagcaaaaccagacaaaacuuccuuucaauccauuuaucaaaacugcccgcagcuccgcuucggagcagguacaacaagaauaaaauauugagcacaaccagcaaccgcgagacuggaggaggccaauaaauaagaaguuacugagga

SEQ ID NO: 6479 - RNA, 5505 nt, Mus musculus
uaacuucucuguugcuuuuuuuuuuuuuuucuuuuugccuuucuuucaaauaaaguccuacugggguuuugacggcuguguugggagcuguggaaugugcagcguggggacucagacugguccagauccuggcccuuucucucccagagccucaucucccauggcccaaaccuacacacaacuggggaauguuuuuucuucaaguugccaagacucucccucuccagaaaaaaauggggcuagagcuaggucuaguuuuccgcccucucucaagaccuuuccacuacccuggacccuucacuaaggccagggacuugaagggcaguggcagaaugucccacaagccacaggggcugcugcccccuggagacugcagcucagagagcaccucggcucaaauguggaaguuccuauccaagagggagauugccaggaccaaagcccuggcaaucaaucuuccccgcccuaauugauguccagguggggugucuggcagggaggagcuaguggaggguaugugaaccccagacauuuuuugagacccgggaguugcuucaguaccuggccccucugagcaucgguuuauucuguaccaagaaugcugccuucaaauuagcuggagaaggcacuccugaaaccacagccauuuugucuaccacauucaccugccuuccacccuagucccaaccggcugcaccugaucacccaaggcccgggccaacagucacuuugacacccuggugcgccauccaggccuagccuuauuucucaauccagagguuaacugggaguccggaugagggugugguacaccggcuugacaaugagauggagaugcagcgcauucuccaccagguauuccgaguugcgccucugcagaucugcgugggccaggaagucgccagcuucuucgcugcuuugauggaagcuguaggcguggcgcaccaggaggcggcccugauggcgcgcacccaccagcacugucuucuggaagcucacgcccgccgcaucgccaccgcugcuagcuggcgugaccacuagucgcggccucccguccucggggcgcgcggcaggcagcgcggugcccgcggcguccgcguagaccggccgcaagcugacgggcagccagcgcggggagaagagcacguuccagguaauccggcgacccgcgucaugaccacugggucccaacugcgucuggaaacuggugcugcgaucgucgcgagccggguuguugaugacccacggggcgccccaggcuggggcgagguaguugcgcggcagaaaggcgcugccguucacgugaaaaaacuuggcguaaugcaacggcgaggcggcguggaacugguaagccugcagcaagagaucugccaccgccgggccguggcgcgccagcgcggccgagcgcgccugcagcuggaaaagcugugcaggcggaaucaucggguagcggauggcgcgcagcgcucgcucggccacgguggggggcggccgcgcgcggcccagccacgccuccagcgcguggaacagcuccagcucauccugcagcaccagguccgagcgcugcaggagcugcgccagcaacucggggcucacggcuccccacuccgcgcuccccgccacggcagaaagguuccaagccaggaacugcaggcagcucucgcgcagagccucauccccggugcuaacagcguagugguaccagcccacagcggggcccacgccucccgccaggugugcgcgcauguagucggccacgccucgcugcaaggaugcuacucgguacuugguggccagccugugcagcgggauagccugggccagcaguacagucagcucaccacaguacaaauaccuggaagggaauuggagaggggcccgcugagagggcacagcaguuaagagcacuuguccagagcaccagaguucgggcuccagaguccacauugggugccuuggaaaccaucuguaacuccagccuucuucuggcuggagcaggguacccauuuacauguggcauacacucauacagacacacaugcuaauaauaugauuuaaaaaauuagagauaggaagaucggcgggacugaguauugucaaggccacccacacuacccuugcaaguuuccccagaacccaaaggggacacagccauuuuuguaagaaacaaacaggaugaauggaccuugaggcuuccuauguuuucuucuuaaguucccuccuggccuguucagacaucuuuagcuucuggugcugugaaaaucacauguauuuacuaagcaucuacuucauagcuaacucuaagcucaaaccauaagaggccgccaguaaccuugguauccacacagucuggauuuagaugccuaucugacuuccuccuugcugcuagagaaggcaaguccuuuaauuuaggaaucccaagaugccuaagaaaggggaagagcccaccuccagaauguugucacugugagaggcucagaaaaaaucucguuacacagcacacaggcaacccaggcuacuuccuguucccugucggcuucucuuugcuuaggcuuuucagcugucuggauucccucucccucucagccauuuuacugucccuggcucucuuacagugcugcccacccccuugccucauucuuccugacagucccacuggcacacagcaccccgcuuggcucuaugugaaacccuucuguuuuaucccucuuccuguugccuggaacuuggggguguugucuggaauccugcagccaccuugucugagcccuuagagcgggguuaccuccuuagagcauuuuacagucuuucccuaugcaagaaggagagaggugaccgagccuguugaccuuucugcuccuuagcccugugguuucaaagucuuguggccauugaagacacuugggaccaacuaagaaucuguugauucuaucagugcucuuggcuggguuuggaaguagcucagaagggacucccaaaggccagaaagggacacaggccacaacagggagggcaucggaaggagggauaaaggaagccuguguuguaugucaugcuaggacuuuugaaagucgauauaauaaccaguaaggccagacuucugcgccccugaagguggagagacagggagccacggacaggaugcaggacaggaugcaggacggugcccuuccccuauguaccugaugaacuugucaaagacagcagcacagucccgggacucccgcagcauaaccucacucugguugcucagcagcucccggaacagcucacugugcagccccagcaacaggcgauggguguggaaggcucggaccucgucggugcccacagccuggacccgcaggaugacaucacuggcauugcccuggcgcagcagguccugcagucgcuggagcagcaugugggagugguugauggcggugccugcugccuccccacccacaucggcucucugagcugcagcaggaagggacauggcagagccugagagggcacccggccuggugcuuccagcuaagacugcagagggaccuacugguggcacgguggcacugugugggagaaggguggggagccuacaugaguguccacaagcuagcucaugcugagugagcauguuggccccaggcagacuugggguacguucuuagcagaauauguucgggucaggcagaagucguggacuaguuaauguuucugugaaccuauugauguccauggcacuugguccccagggggagggugacaaaaccggucagagguggcacagccuuggguacugagaacuuacguggcugccauguggcauugaaugaaccuaacccaguucucauacucaggaaagcucaagggggcagaacagacacauaguaaauacacacaggaaaggguggggaguucaaggccagccuggacuccauagccaguacuagaucaaguguuaagcacacacacacacacacacacacacacacacacacacacacacacacacaaaucaauuuuaaaaauaaauaaaugcacaagugagcagccuggaaccagccagagacaaaggaauacagccagcccuaaagaccugggcgggaaugaccagguggagcucagggccagggacagcaggcauagcguuucuuucugucuuuguuuguuuguuuguucucuuuuuaguuuuuugagauggggucucuuauaguucaggcuagccuugaauucaugauuagcugagguugggcuugaacucuugauccuucucccuccuccauccuuugugcugggauuacaggauugcaucaccacuccacaaugaggagcacugccccggcccuacucggugagacaguaagggacccaaugaaguaacuugggugaacagugaaggaauaggauuccagggguaacaguguugaagcuagcaucucccuuccagggaggccuguuucuuguguucucagggcagcucuggggucagauagggacacaugcugaguuauagaaaagacaccccccuagacugagcagugcagugagccuugcaaacugggaaaagcaggcgguuaauagucugacaauugcagaagggcaccagcaggcagcucuuguguacacacacacacacacacacacacagagugggcacagggccuauguguggaucguugaaaggaaggcucacaagagugagcaucugugugugggagagggagacccagcaggggagagagggagcagcugcugguggugaauuucccagccccgccuccuagccccgccuccccagcugucacuccgaaagaccuaaaugcugauggcguucucuugcagccucugccuggacccagcugucggagacaaugaacaauagagggucuuuuugucauuaagacuccugccugcugcccagccucuuucccuggaaggcuaugugccccuuucucucugucuuuggagagguccagucucuccguguucucuggggcuggcuggcuggcuccaccuccuggccagcucuauguagcuccuagcagaaguuccugcccccaacccuuaccuuuuuccuuaccaggcaccugauccccguacuuuccacucaccugcacgagugaccagucccaccaaggccagaauagcccagaagcugccccaggacccaggcuugcaggaaccuuuucuaagcaucuuugugcucugucccuaaguccacuggagggacagucaaguccagagcacuccgaucccaucccuccuccuuauauaggauccagcaaggggacaguacccgcuucccuccuaaccucccucccccuaccagucucugccauggauugguugaagcuggucccugcuguugccuaggcaacuacuuaagccagaguguggcagccccaggggcuauuguguuggccugggcccccaaggggaacagauccggacacccuccucccccaccucuucagacaacccagcaaagcuagcuguuccucucccgggaaguuuuaagcu

SEQ ID NO: 6480 - RNA, 9032 nt, Mus musculus
gugaagucuccaaguugauguuucuaagcaagcgggaggcgaggcuuggggcggggcuccagugaugggcggguccagaggagcguccucggcgggcugcuggaccugcgcucagcacuagagucauugcuagcucuuccgcuugcugguugcacuucucagccauggcuccucgcugcuggcacugguggcgcugguccgcguggucugggcuucggccgucucccuccaggagcacuccgaguaggagcagggcucuugggggcugcaccagggcgaggggaggccugugaucaagagcggggguccgagcagagcugaggcggggcuggagaggggcaaagcugaacgugucugcucuugcgggagaaaugggagugauggagaggggaggaucugugcaaagagauguaaggcguccuggguaagacagcucaguaaaggcuaaaaggauagaccaugaggucuuuaugugugauacgaggugaacggaggugacaggcaaauucgaggugaggagaugagcaauagaguucugugggggaaagaagggcuagaaaaaagcaaaauagaaacgugaugggcauaugaagacaugagaucacauaaggaaccucucaagaaagauagugcugugcaggacagcuugggggauaagggggucuggggcagauuauuuguuauuguucaugggugagacaugggguucuggauaaagacagcucuggcauucagaugaaauggugaagcuuugaggaacggaaaaaggaagaugcaggugagggugaaggcaaggugcaacuggacagaauugguuuggggugguaggaggguguugguuugacccugcuguccccugcucuaccuagccccaggcuucugccagaaguucuccacacaggagaagaccccucagaucuguguggucggcaguggcccagcuggcuucuacacagcccaacacuuguuaaagguaagcgaggcacuccuuccaggcucccuucuuaccauucauuucuugucccaauucuggggguaggcuccagcccuuugguuugucugacaaggaaggggcuuuugacuaauguaagcuguguucuuucuaacugauuccacagguauagcugaggcgcccuagguccucagcugugagagacaugcauuuguuccauggauggugguuggggacagaugggcagcugucuucugcuuuguagggaagucuuuuucagucuaaugggauggcuuucgccuccccuuaucuuuacgcuucuuuaucuccagcauuuuauauuucaaggcaaucuugucugcagcuuugcgcccuccccacgaccauucucuuccacaaaggccaaggucucaaagcuuucaguauuagucuugccagacagggccucaagguugccagauguacuggaaacucugucucagaccuuaaagcaaaagaggaagggggcgggguacugcagagaaggcuccgugguuaggaguguuuauggucucacagaggaccaaaagaugggaguuggguucccagcacccacacaguggcucacaacucagcuccagggaacccaauguccucuucuggccucugcuuggcccuucauucuugcacacacacaacauacauaacuaaaagugauaaaauaaguaauuuuaaaaaguaaggaauacugagcuugacugagacaagacagugucugaacuuuagaggggcuuguaauaccaacgggacagaagaaaaaacgaugauuauauugauaucacauacaaauguuugaaaggcagagugacccaguggccugguuuaccuggagcugacacuaggagggucucauggagaccucugcugugaagugaccuaugcaugacucugcagcuacauaccaugaucuacacaggucagcgcuaccagaagcugucccuagagaauguauauuugagaagcaccaaaggucaugucugggcuucagcaagcucccagguuccgacaugagucagccuggagugcaaggccacugcugaaggacagccugggcucugggauggagacccagggguucucaggguugggguggguauguggguggugugguugguauuagggaggguacuuguaaggggcacugagguugagggaaugaauaggaucuagaaggcagggcuuuuugugucuucucagugggcggaucuugaccugcaggcacgcggguguguuuauggaccugacaguguagcucgaggaggcugguuuacaagguauuuuagggcuuaagcuagggguaaccccuagcccagucuagagggagaggugugcaaacuguauuuuauggagcauaugagaauaaaauagccucaagaaugaggaauuauguggaugaaggccagaggaaggagaguggcccugagccaucauuccagagccuauuccagaaggccauugaguaucugaggggugaagaggugagggcccagaucacaagguacccagagaccacugaccacguuguagacuugaguggcuuucuuuggacgcucuccauguucccugcuggagcgguuuuaucuaaauaagcauuucuggguucagcucagauuuaaccaaacucuaugacuaggacucucagaaucagcaguuuuaagcaaacucccugggggcuggggguagauccugacacucacagauauaggcaacaggccucagugagucaucucgagcaaauggggagagaggagaugucucagugguuaagagugcauaccgaccccucuugaagaaguucugaguucgguucccagcacucccaacaggcagcuuacacccaucuauaacuccgggggcucugaacccaccuucuggucucuuugggugcuguucucugcaccccacauauggauaacuuaaaaaaagacauuuaaggaaggaaaagcaaggaagccuccccuagggauggaacacagggccucgugagugaugggcgggcacccgaccaccagcagcucccccagcccacuugucacugggagugcucucucugauggguagaccuuaagcagggcuguuugcccagagagcaagagagugggggaggaaaggauguugaccgaauaggucaaggugaaagaggaggccaagggccacgacuggagcuccagggguggagggaaaggaaacacggauagaggggaaaggacaggggucaaggaaugggcuucgauguguggagugaggcauccuggaucucagaugggaaaagagauagggugagaggagggggaggggagauagagaggccacaucaggccuccaagauguaaggucacaggagggaguagggaagauuucccuaggacacaggacauguaaauucaggaagagcaggggaccccagagcagaauugcuuuggggauuguccaucuuaggaaaagggccagagaagcaacaguuggugggaggagagagagguuucugggaagaugggucugcgugugagaucagggcuacugugggcagggggauggagcggaagauggagaugaugaggugagguuguaucagggauggcuagcaggcugagcaguuugaacucugaccuguggccauaagaaggacagggaaagccacagcuguaaggaaccugagugagucccuuguguccucacacugggggagccucaggcugagcucuugagccugacucauucagccuugagugugguccagagggaccagacaucguacugagcagaccccucccucgugacccagcaguugguggcgggacaaggcuuggcucuguggcuguggacuucacggcuacacucuccauugaguucuccauagcuucaguuuccauggcgucugagagaggccauuugggaggcugcuuagggucugaccaaggacaaaaaggcagaggggcuagaggggcuggccuuagggcaguugguggaauagagggaaacaggauuuggacgaaggccaggggagauaagcagaaacccaucggccuugaguccuucugagcugggugggagaggucagggcacucucuucccugacucaccuuccccaaggccucccaguucacagagaaggagaccgaggcccaggcuuguucuaggacuuaccggguccgugccauugguggcagcagagccagaccaggcucauuuggcuaguuucaaucucagaccuucccuguacccuguaaagugccuugggacacaggugacauggggcagcugaaauagccagacuuguuuuucuaaagcugggaguaggcccucugccaccccuucuguccccacaugccccagcuguauccccauuuucucugaccccacaugccccagcugugccucauuuucucuguccccacuccccacuuggcuaaucccugacacaguagcaucaucuuggagacuuagagcuaaggcagguccucagaucacauggccagcaugucaugaaggucuucgaaggucuacaucugaccugaggaugaaguccugacacuuccaauuccucacguucucuguuggaagucccugagaucugaccucaguuucucuugcugcccuguuccucgagagcccuuaucugggcagaaggaacgcuggguccuuguuucugcucauggauggguagagccagguuccuuggccauuugaacuggguuuucuugcucugccaugggaagggugacccugugggggcccagcuucccccuugaacccaccggcuguuuuccucccucagcaccacacccaugcccacguagacaucuacgagaagcagcucgugccauucggccuggugcgcuuugguguggcaccugaccauccugaaguaaagguggguguugccuggugcggagggugguguuggagacgguaaagaugagaguagagaggcucccugacauacggggcccauuccgggcaucgagggcggugggcaggggagggggugagagugagacuggcguguucccuggaacuacccuaccuucuaacguuccccucccgaugcugcauggcagaauguuaucaacacauuuacacagacagcccgcucagaccgcugugccuuccagggcaaugugguggugggcagggacgugucgguuccagagcuucgggaagccuaccaugcuguggugcuggugaguucccguguggaaggggugugguuauaagaggaggggcugcgggaggcaggaggcuggugcugaggcccugggcauggguggugacuucgucuuccuucagaguuauggagcagaggaccaccaaccccugggaauuccuggcgaggagcugccuggaguggucucagcccgggccuuugugggcugguacaauggacuucccgagaaccaggaggugaguuugagggggacuccugcugcuuccggcuggagucaggacaucgcgccuccaccccaccccccuguucgacuuugaggucaagguagugaggagaaagcugagguugaugugagacaucaauggcugaggcaggccagcuguggagaccuucuguggggcugagggagagggaagugggauggaguggacugccuaaggcaggcugggggcccagcagacguggccuaaggugucugcggaugagauuagccuaauuggggcacccuaucaagaccuuucucuuccagcuggcgccagaucugagcugugacacggcuguaauucugggacaggggaauguggcucuggauguggcccggauccugcugaccccaccugagcaccuggaggugaggggucagucagaggccggagagauggagugggaacgcauugaggagagaaugccccugaggggguggggggauucgggucuuauugcucccaacaggagcccaggcaagguaccuucacaccccagugugcccugggcauucacacacucauucuccuuccucggaacuucuggacugaccuccugcuagcuaagaaguuacauuccuuccacuucucauucuugccucagcuauuccuucugcccagaggucuuccaggccguccugugcaggugucccuuagauaugggcuuagccacuaguugccuuuacuuccauuccauagccuugcuucacgacuggguuuacaccgacgagaacagaggaguauaucucucccuacaagauaagaaccauguaagguuuuaaacuagccuguuuagcucagacagacuguuauugccuccguaagccccuuguccuguugcggaccugugauaggcugucagggaaaccuuacaggguggaaaaaagugcuguuaccuaggagccauuugcaggauuggcgucaaugcucuguguggccaccagggggaguuggcgguauagauuuuggaccgaugguuuucucuggaucagagugggaaggagaccgacuagccuugcaagucccccuuuuccaagucaaguccuccuuccccuucguuugaaucaaggucagauauuuagccguggcuggccggaaacucacuguguggaucaggcuggccucgauuucacagagauacgcaugccucugucuccugucccacuguaccuggccuuaagcgucuccuuuugugccagaaaacagacaucacagaggcugcauugggggcccugaggcagagucgggugaagacuguguggauagugggccggcgugggcccuugcaaguagcguucaccauuaagguacggggcccagaaggggaggagccaggguugccuuggaguugcugcagggcccuugggaguggcugcuucccuggauggaauggggaggaggcaggucccagaggcuuuccccacacugcucaugguuucucccaccagggcugaacucuggugggcccgggagugcucagcgcucuggaccugaccucccccucccccuccccccacccccacccucaaggagcuucgggagaugauucaguugccaggaacccggcccauuuuggauccuucggauuucuugggccuccaggacagaauuaagggugaggggccaaguccagcccccccagcucacaggaaggggaugucuuagguuaaauaaggcuuggggaagggcgaccagagggacaacgcugcaauauuaucccauguugcugacagaugucccccguccaaggaggcggcuaacagaacugcugcuucggacagccacggagaagccaggaguggaagaggcugcccgccaggcacuggccucccgggccuggggucuccgcuuuuuccgaagcccccagcaggugcucccuaccccagauggccaacggguagcaggcauccgccuggcaguuacuagucuagaggugagucucguguuacccagacuuccccuuuuuaggcuucccccaccccauccugguguuacccacauucuccccaacaggguguuggggaguccacucgggcagugcccacaggagacguggaggaccucccuuguggacugcugcugagcagcguuggguauaagagccgccccaucgaccccagcgugcccuuugaccccaagcuuggagucauccccaacacagagggccggguugugaaugucccaggugagauggugagcgaaggcggggcgucugaguccggugggaggcugucgugccaagaccacaccaucuaccauggucuaagacacagcuuugagacaggcccuccuccugcccccucggccacaugcucaggcaagcugggacaucauugaguaaaaauuugcugaggccuucucugggccagugcugaugcuggcgggagauggcccccuguccuuggggagcaucagucggcucacccgucuuguucauucauucaguaaauguuccuaagggccugcagaaccgugaugagaaagucucagcucauuuguguccucagggagcggcucuuccacauggaagcuguggggagggacgguggugugggugaaacaagacucugucauggaccaggcguaauggugcccaccuuuaaucccagcacucgggaggcagaggcaggcagaucucugaguuugaagcuaaucuggucuacacagugaguuccaggacaaucaggacuacacagaacccugucuagaaaaaccaaaacaacaacaacaacacacacacaguugugauagugagccgguggcuguaguaagcccacuguguggucuacugggagacauggaagacguguauguguguauaguucaggauacagacuugcuaggugguguucagcuacgcucucucuguugacucucucaggccucuacugcaguggcugggugaagaggggacccacaggugucaucaccacaaccaugacagacagcuuccucaccagccaggcgcugcuggaggaccugaaggcggggcugcugcccuccggccccagacccggcuauguggccauucaagcccugcucagcaaucgagguuggagccuaaagcugagggcugagggugggccaguggcuugucuuuggaacuuuacccuuugagaggagggcccuaaggggcugagaggaggugacaggcccaucuuuguauucgccucaggaguccggccagugucuuucucagacugggagaagcuggaugcugaggaagucucucgaggccaagguacugggaaaccaagggagaagcugguggaucgaagagagaugcugcggcugcugggccacugaaccugggccccagccccuaccgugcaagacaagagccggacagucuggguuggacucuucucucguucauuauguuauugacggcccuggcuuagacgccgaaccgugcccuuuccaggggccucugagcucugccuucugcaagcugaccucccaguguggcuugaggccaaggagggaaccugaagcuagggauggauggagauacagacugacccuacccguccugcuuccuuucugauggaccuuggagggccucuagaacggaacacaguggaaauaaaacagaugugccuaagaccca

SEQ ID NO: 6481 - RNA, 12200 nt, Mus musculus
aaucgaucaaacaaacaggguuuauggaagccggaaagaguuguugggcccugccuggcagcuaaugaaugagcucauuaggagaugggcguguggggagaugggcagggcugccugccaagcuuggagugcugggguuugagcucucaguuggaguucugagcuucuaggaugucccacagaaggacucaaccucuuccagcccccagacgccacaauuucauacugacccucacagccuuuggcagccacccgggguacauccuuggccuguugucaagaggcucaguuuccaagccccacccuugguuuugagcuccaggcaguauccucuccuccucagucagguugaggauaggucacuuugggaaccccaggcagguuucugcaccucuugaugcgacgugucugcccagauacucccgaguuucuuuuucugccuuggcacuuucgggguuccgcuguggcuggguuccucgggcacucaggcccccagguagaccuccaccagccccccgacagagugcaugcgguagaacacacccaggggcaggccgaaguuaacaauggugaaccagguccuguagccguaaaaauccuuuuccagcccguucucaaacucuggguguaugccgaaggcgggcaucauccacagcuggagagagagagagagagagagagagagagagagagagagagagagagagagagagacugagacugcuguaugaaucucaggaugcugagcucaggcgaggcugaccuagaacuggcauuuccugcagugcuacacccuaccucaucauccugggccuugcagagccggguucacagccaagagucuuucucagucccggacacagagagccuuggccacccuuggcuuacccgaggccaggaugagccccacaaggcugccucuauacguggcacuuggcaggaccucccugcuagcaaccuguguugcccagcuggacuguuugugcucuaggaccugagcucagacuuuacuauuucagcuagauuacagccacccguauccucuccugcccaccugugagaauucuacccaucucccaaagcccagaucaaccuuaucaaccucccugaaaaccugcccuggcucuuggggcccauacacccgucucugaacuccugacacagcuuaaagccaauuuaucacgucucugcgugggccagcuguuucacaucuggaauguguuuucggugcuuuuagaggguuggagcuaaacaacccugaguugucccguggcugccacuuacaggcagugagaggaaggggcagaucagaaacauaagcuuuagucugucaagggggggggggggaugggcaguaacguugccugucauuuggagguauggcaauggcugaagggcuaggggcccaugccuuagcagccaccagaagcuaagagaucaaugcaaccucuucuacuagggauuaauagaaaacaagcaguucugggcugccccuuuggccaaauccaauggaugaagaguucaguagucauuuucuaaccaacccccugucguuuuccccaccuagacugcaagucagaaucucacacauuuguaaagggcccuuugcuacguguggagcacauuaauucgcgccaggcagcuugcagggagcugcuggagauauuccuggcucucaagaagaguaaaggaaagagaacagcgccuuccuaaaucaggggcucuggagccacacaccacgcccacacaccacgcccacauaccuuaccacgcccccaccacacccacgccuaugccccaugagcuucugcccagacacucacugugauguugcagaggaugaggaagagagagaucuccuugagcauccugcguuuccaguugagguggcugaaggaguggauguaggcccuugaggcucuccguagguccugacccagcucccgcagggagccucugcgggguagcucaacauccugcuucuccaucacaccugagaccgcaggcucccagagggggcggcggugcaggcccucgaugaugaagagauucugagugaugugcugcaggauuagcagcagugaguaggccaggauaagcugguugaguagcucgugcggcuggguggccacgauagccacgauggagaaguaggcgaugcccaucuggcccagugcagcgcccaucaacagcaccacauccaggcugcgugugggguuuuugagcguguccaauucgcgcuccuccagcccauggauggcuguaccagccaggcacgccaggcucauggugggcagcacagccacauagaacgcauaguagagggugaaguacuggcgggcuaugucagggccacucgcuucgauuuggaagagcacaaagacacauacgccagccaccagugccaaaaggcccagcaguggcccaaagauggucccgugcaggcggaagggugaucuguugggaugggcaccugugugggcugccaggcugcggcucacguucuuccacaugacgaagagcacagcacagcagaugaggcaguacucagugcugaagggguagagcaucagauagcccuuccggaagaccucgcacacugugguguugaggcacaugcaaguguuggucccguuaccugagaggagauagggcaggaaaagacagcaucucaggcagguccugcacugaagaacuuaguggccccagucacucucacccacuccuggagcauacgggauuuggacaggacccagccagauguucauuuuacagauguggaaacaucugaggucggaacauagagauuguuaaucauaaagugauugcuguuuuacaaagggauucaaggacucuaggugucgaacuuccauaaagcauuucagccaugcuguccccgaggucaagcauuuucuccacauauugcuagguuggcagagcaaacccaacauuugcaaagagaaaccgggcugcuacaccugaaugcagcgaccaaccccagcagcccauacuaggguaauuagaaggcagcccuucuggaugaguguauggagucauuggggcauaugggugccagaaugcuugagcugaauccaggucacagucucggugggcuauacauccaguucuaggaaaaacaggggagagggaaggagcuaagugccaccacugggaagcgaaugaaggaccuuacagucauugugcugguuuaaauagguauggcccccauagagucacguguuugaaugcuuugccauagggaguagcucucuuacgcgguguaggaggaagucugucacuugggggugggcuuugaguccucuaugcuaaagcuacaccuagugugacacacacucccccucugcugccuuuggaucaagauguagaacucucagcuccuucuccagcaccaugucuuccugugcgcugccaugcuucucuccaugaugacaauuggcugaaccucugaaacuguaagccagcccuuauuaaauguuuuucuuuauaaaaguugccucagucauggugucucuucacagcgauaaaacuagggagcuggagagauggcucaguggguaagagcaguggcugcucuugcagagauccugaguucaauucccaucauccacuugguggcucauaaccaucuauaacuguagucccaugggauccagugcccuccucuggugugcaaauguaugucauauaaauaaauaaaucuuuuuuuuuuuuaaagaacaaaaaaaaaagaaccuggggggggggcugugaucaugauguuaaaugaauaaaaaaaauuaaaauaaaaagaaaaccuaagacacuuauucuuagaagggggaggaggaggaaaagaauaaggagaagaagaaggaggaggaggaggaggaggaggagguuggagaaguagcucaauggucccucuacagaggacccagguucagguuccagcacccacaucagaugcucacaaccaccuguaacuccaguucuaagagauccgaugcccuccugccuuauaagacacccacacacaugugcacagaccccccccucauacacauagccacacauaaaaaacauauaacuaggaauaaaauaaaugacuaagaaauuagaaucuuaacggacgugccaggcauggugacacaaucugcaacuugggagaccagaucggaaggaucucaaguucaaggccagccugggcugcauagcuaaacucuauuucagacagcuaaggggguuagcaaugugguucugugguaaagaacuuacuuaaggccccgaguuugaaccccuauacugcaaaaacaacaaagaagaauuuaaacuugaaacaauauaucacaccuggaaucccaacucgugggaagcuaagggagaaggaucgggaauuuggggucagccuuggcuaaguaagacagcucuauuuuguauuugacaugcgugugcacaugcauaugagugcaugugugcguguguguguguguguguguggggaguggcucaauguuuguuggucuuccuuaauuauuucuccaccucauguuuugagacagggucucccacugaaccugcagcucacuguuuuagcuaaacugacagcccacugagccuuuagaauccaacaauaauaauugaagccguggguguggcucagugguagagugcuugccuaacaugaaaaaggcucuguuccaaccccuagacacacuaacacacacacacacacacacacacacacacacacacacacacacaaugcauccaugaugucaccgacuaaagcgcccucuuugcacagaaggugagggguggucacacgugcaggcaugccgugauucauggccagggugugugaaugcaugugagcuggugcacacaggucauaaugccaccuguggguggggcagacacaaagguguggcugaaucccacagacugcaagcuccucguguggauuuaugggauguugcuuuaagggcagacuauacagguucgggauuggcuggaugggauaaccuagggagcauuuucuacccacaagucuccccucccucccccucccuccccguacguuuagauacuaagauugcauuaggacagcacuccuuucagcccaagggcuuuuaagucucuuacaaguaaauacaaauaccauagguuggaugcaugccugaaagacuccuuaguggccaacucaaccaggauuaguggcuggcuugcugcugauuguacaacagguaccagacccugauggagcaugaagaacugugacguuggaacucuguguguguguguguguguguguguguguguguguguguacauguaaauagagaucagaagacacccaacugggugucaccccuuaggaaguauaugguuugguuuuguuuuuugagacaaucucucauuagccuacaguucaauuaggcuaggcugguuggccagugagucccagauugaucugccaggccaucugcccuagcuggcuuggaacucacuagacuaagcuggccuuggacucacacaaaucugccugccucugccucgaaagugcugggaccagaggugugcaccaccaugucuggcucugcauagcuuuuaaaaugcgggcucccaaggaccaaauucagaucucuguguuugugugacaagcacuuuauagacugagucaucuccacagcccacauauuucuguuuaacaguacaugaauacacacacacacacacacacacacacacacacacacacacgcacagagagagagagagagagagagagagagagagagagagagagagagagagagagagagagagagagagagagagaugugaugggggaaguucugguccccuuuguaccugagaacuucuccaugagggcgucgagcucagccucaaucucacggugcauggagucauuggucacagccaaaacccacaucagcaaguuuguggccagagucagcaugaguccacaccuggaggaagggcuacagucugcucacagccccaauagcucccagggacccguccucacccuccacucccacuggggugaccacucagucucagaggcagaccccaagcuguggcaggauucuaggagcccuuagggggucacuugggacgcagcccacacuaacccacaacuucaggcuccuccugucuggggaaauuggagaacgguggaaacagagaacucugggagacuccauucagagagaugucuuaccuggugaaguuggucugcaccugaacacaguccuuacagugucuccagagcacccaugucugaaagagacagggccuugagcccaggugcuagugauguggugguacguagggggacaccucaguugugugguguguguguguggguguguauguguuuguuugcaauggaagaccuuguaaggaagccuggguuggaauccuggcuuagccauuuucuuuuacugugugguauuaggccagcgguaaacaucucuguguuguagcucccucagcuaugaaaagggacucaauuacugcugcuugaggaggaggagaaggaggagagggaggagaaggaggaggaagaggaggaggaggaggaggaggaggaagagacaucuacuuggccagaguaagggugauaugccuauagcacagcagagacucaacagagggagaagcagggacaucugggugcuggguuuaaguguaugcaggcacacauagucaaguguguuuauaggugucuccaucuaggagacagguauguguagagguguaugugugcagagaagucuguguggguguggauacauggagggggcggcaugugauugaugugugucuacaccucggggcauggagacauugccuuugugguggcugguuugaguauaggcugggugguaugugugucccuggagguaugggggugugagagauccaucaccugaauaaucauaaagacaaucucaauggccggaaagaugaguuccacuucugacuugcagugaauguggcucacgucauaacccauucgaaauauguucaggcagacgguacagcugccgaagagcaccagggagccugaccgggagagaggguggcagauggggacagacgcugccugcucagugggcagggucuccuuccccagcccucuccauccaccuagcacccaacacucacucaccccucacccagaugggucccgcguggggaucacgguacaggacugcguggggcuuccgggugguacccacuguguaguagaggagccacaacagggagaggaccuucagugcagccagcaggauccacacgucccccagagugacagacaccuuguugaauaucaugcuacagauaaaagccccacccaggaauaccacauugagagccaggagcccggagaagagcugcccggccuucugggccugucggucucuccgcaacagcagggagaaaugccgagccagccaggacuucugcuucggggggcauggggaccccgcaugcuuagucuccaugucugcuuggucauaggaggaugcucccucaguggucuuugcuucuggagaaggcaugggugcaggcucagcaggggcuggagagggagagagaguaaauagaucggcuggcaaggggaccuggguuggaauccaucccagcuccuaugcagccucucuagccgggacaucggaguuuccgauauuccuuaugggaccuaagguugacacagaucaagcgauauacaaaagucccuccugcugcccaugaacacaaaggauugauuauuuugaacacaccaaggaccaccucucccuuccuauccaugacugggccagcucauuucugaacucaauuucucauccuaaaguggguugauguuuugcccagggagugagggucacuugaguacugcccugucacugggccucuuucagagcugggaccucuuaccagcaaaagucggugugaaccugcuaacuugugaagggacuccgcccaggaaauccagaggggugugaucaaccacaguguucucuguugaguagaaccccgaggcugaggcugggcuuggcaggaaagaauucuguggucuggaaugauacucucuuauggagcguccauagaugcuggcaaggucuaggggacacccacuggggucacaauagaguuucuuucaggggagggaugaagggaccggaggaauuuccucuagcuucagugcucuucuucuucaucuuuuuuaaaaaaggguuuauuuauuuaauuuaaauaaauaguauaugugagugaguauacuauagcugucuucagacacaccagaagagggcaucagaccccauuacagaugguugugagcccccaugugguugcugggaauugaacucaggaccucugaaagaacagucagugcucuuaaccacugagccaucucugcagcccacccccaguguucuucuuaaauaaauaaaauuaccacuauaauuaaauuuaucuuaaaaucccuugaaaguggaagaaaagcucuguggucgauuugcaaugucugccacaugcacaggauggguaaggaucagcacuugacuuuugcugccucaacuucuguuugcccccccuccacucuacucucagcugcaugcauagcaagaggccacuaccgugacucucuucuuuccugaaugucucuugucauauccuugcucaucugaugcuuucucucagaccagccacuugcuuggacccaaucuugggccacucaauagcugcagugcugucccugggggucacuugagcauugcucccccccaguggggcuggguugcagcacagaaggcagugggucuacugcuugccagcucugcugccccaacagagcuccugacaccaggcauggugaccucuggacucugaguucauaccaacccaccuccugcuuccuaacgcucacaaucccagagggcuucuguguucacaucuccuggcagugagcugagcuucauccuuguuucuguccagacucugcaucccaucagaccccaagccuguucaucccagcucccauucugccugccuucuucccuucaucccucuugguuucucucuuguuagcucuuuuucuuuacagauuggcucuguagcccaagcuggccuugaacgcucaguguuccugccucugccucccauguucugggauuauacauaccuguacauacuuguaccucuaugccucccuggcugcucagaucaaccacuacuuuagucuggagccuaucugcuuucuccugggcuggccuuccugaucauggugccuguucccuaauaagaguccugcaaagacagccaggugcccucaguauaaaguccaagacuuguggggccuuucugagugagacgagacugugugcuaaugagagccuggugcacacgguguucaaggaacagugguuccugcuccacuguugcuuccuguuucugccuucaccuacccccccuacccccacccccgucuccagcacaagcucaggcccugcugcucuccccaugggcugcagcauccugcuauaguucccagaaugcccuugcuaugcucaccucccuaucuuugcacacacccuaacccuuugauaugauucccacccucuggcucuuuggugacuccagccaguucuucaggcugggugagggucuuugcuugccacucccagcaucccuugcucacggcauuguccagcauacucuaucuucauugcuggagcuuuguucugcuuguuccucaagaccaacgcuuuucaaccuuccugaugcugccacucuuaaauacaguuccccguguugugugggugauccccaaccauaaauuuacuuggguugcuacuucauaacugcgauucuguuacuguuaugaaucauaauguaaauaucuguguuuucggauggucuuaggcaaccccuguggaaagaccauucaacuccccccaaaggauucgugacccacacguugagaaccacugcucaagacacucguaggagacccucaccacacuggcccuaaccacagccucuccggcccauuucucaacaugcucccugggugauccugagaaauguaccuuccagucuaugggacagugaagaacuaaacuuuggaacugcuucaagauaguaaaaacaacuuucucuccuuugcuaagccauguugucauccguggacccagccuaccuccucccuguccagccccuggccacaccccaggguccucauauccauucagacccagauagaagauuccauguuucccacguggucucugggcucuuucugcuguucuuucucucuugccugcccgcugcuaccaaugauucucaccaagccucuucauauggcagccuucccucuguccaagcagacucguggcuacuuuggugggccaccccucugcugagugugacugugcaccaucguaggcugguccucucaagaucuggaugccucugggcagagaugagauucuacuccacuccacucuccaagucuagcacagcccuaaagcccaccaaaagcguacccuggacucuggcuguuccuggggggauuucagcaccagagcugcggacagauacccugcucauuaacccguuccaucuuucugcagcugaggaggcguuccagaugguuaucuuuugcaucccucacccagguugagcaagguaaagcucccaggacaccucccugccccuuuucugccagcucugguggcuccaccuccuccuccucacauucuguccuuccuuccccacccccuacugaucaagagcccagauggcauuuagcaucucugugaucuuggcuaagcuacuuaguuuuuguagucuggauccuuuguaguccuuucagugaaguggaugagcaacuauggaacacuaaugccugguucucucuguuucacccccucacacuccaucuaguucccaucccgacauccccucccccgaccucccccuucaccccaacucugugaauguuagaccagugcaguaccgcugagcuguaucuccagcccgacaaguuauugaaugaauaaauaaaagaauggauacaugauaccuacccucaagaguuuugucagacuuuagcgauuugaugcaugaacauacacgaagagccaugcccgauagaagugcaugaaccuuccuauagaucaagauccuagagggacuaaaggguuggaguuuucgcucagacugcaggccuugggaacuggaaguguggagacaguggagaaccgaguuccagguccucucccuucaaagggcacucuggugguuuccccuguuccuugguucagugcucuaccagcgguuaucaagggggccaaugcuagguguuagggugagcaucaagggguccagaaaaaaagagcuagaacgaacgcacuuggaaccaacuagaacucugccacccuuggcacgccucuuggcacgaugccaguucaagagaaguccuagacaccaaacugguuuaugggcugcguucagaggcagccaacgaaaggagaugagaaaggagaugaaccgucggggccaugggaccggugcuccgagggaggcugcaaagcacuggcagggaaacuucgggauuuuguucagagcaacagguugggggaggccuaggcagcuugaguauucuuuuagccaacuauauauccagguuucugacuucguucaggccugggcacccucuuugagcugugaggacccuugaacccaggggugagguagggagaaggauguaggcgcagagccagaguuggggugacacagagggaagagcuuagggucgucccacucacucugcccuguccaauccuuggagcgccugacucaugaacccccacuuuggagcagugagugugaggaugggcuuccaggaaagguucagucagcuguccucgggcgcucgggguggggggggagggggugguggagaucccagcucaagcuaaggaauccuaccugaagucugcgaagccauggucgcgggcuccccaccucuuggguugcagcgcggauccuccgucuugguaaggucccaggugccuugagacagaugccucgacgcccuuuccucccuccgacccccccgcgagacugcgcagucgccgcucgggcuccaaggcccaucgauu

SEQ ID NO: 6482 - RNA, 1526 nt, Mus musculus
gugugugugugucuuuaugucacugaggguauaaccugauuguggaguccuggccucuucucccuuucugugcagucuggugaugaaacaaaugaucauguuacaucacgugcuccuauuaugaugagcugccuugccauagcccucaaaacugauccugggcugaaauccuccaaaacugugggauaaaauauacuuuuuauaaaucaugggguagcuuucuaucacuaugacaaaauacugaaggugaaacaauuucuaaggaagaaagguauguuuuggcucaguauucaauucaucauugcuucgccccugggccuguggcaaggcagcucacuguagugagagcacauugcaaaggaaccuggucaccucauggcagcccuaaagguuuuaccagcucccacuggcaccacagacuggugacccagccuuugucacaagggucuuuggaacaccuggcuguguguuuagugacagaaagccaacuaacucacacacucagcaggauggcugcagcacuuuguuuuaacuuuagaggacagaaagaaaauagcauugucaagaauaaugaccaucuguaauguccccuacuccuggagggaaugacaucagggcaaaccaccuuagaaagcggcuugguggggucaguaagauggcucgguagagaaaggcgcucgcugguacgccuggugaccugaccuaacagcugcugguuuuuccuaguuaguuuuguuuguuguuucaagcucucucugggcagcccuggcugugcuggagcuugcuauguggaccaaacuguccuugaacgcacagagauccuuuuguuucugccucccaagcgcuagggugaaaggcauguguuaacacagccaaccagaugaccugggaccuacaugguggaaggggagagccaacuauuguaaugugugcucugacuuccacacgagugcugugccacaccgaaacaacaauacacauacacagaaacaacaauaaauaaacagagguggagagcuggcucggcaguuaagcaguuaaggacacacugcucuugcagaggacaugaguucaguucccagcacccacgaggaccagucacuccggcuccagaggagcugcugcccucuucuggccuuuuugggcaccuguacucagauguacccacacacacccaucacaaugcacauaauuaaaauucaaucuuuuuuucuuuuuuucgagacaggguuucucuguguagccuuggcuguccuggaacucauucuguagaccaggcuggccucaaacucagaaauccgccuaccucugccucccaagugcugggauuacaggcaugcgucaccacgcccggcuuaaaauuaaaucuuaauaaaaaguacaguguggaauguuuaugugacagaguguaucuauaacacaguacauauugugaaacucugggcaagagaugccagacacaaagaacaaauaucuguauucauuucuucuguguuagacugucucaaauaaaguggcuugaacau

SEQ ID NO: 6483 - RNA, 1731 nt, Mus musculus
uggguaaguaauuuuauugaaaaucagacauuuuaggcuaggugucuaacucagugauaguacuugccuggcgugagcgagacccuggggucagucccaagcaccacacacaccagauugauugauugauugauugauuuuguuuuucgagacgguuucucuguguagcucuggcuguccuggaacucacucuguagaccaggcuggccuugaacucagaaaucugccugccucugccucccaagugcugggauuaaaggcgugcgccaccacgcccugcucucauuuaccagauuucuuauguguuccuucuaggucucuccagaccuaugaaaggcagaccagcugugagugcggaaggagagucuuugcagcacagcuuagauagcaaauaaacagugguguggccgcacaugcgcacugcacugcuuaccgcacauacgaugugcuuggugugagacugucuccgugauauaaugcuugagagauguaggaagaaggaaggugcagaagaguggacgagccacccugugugcuccacauacuaccgagucuguaucccucuaucuccagaguccuguugagaucuagauauguagccaaaaaggcgcacaaaaccugcauguagggcgggaugugguugaacagugagaucuaaaaacaacaaacuguccuuacagugaggucuucagagaacaaaaggaagacuucggugccuguggucggcacagcugaggcgcugaacacucgugcugaacacucgggaggugugggcgggaggagagcuguuaaguuugaggccgugcucugugaugaguucugugccagcuggacuuugguuugaaauccuaucuaaaaaggaaaaaaagaaaagaaagaacaggaaaccaggcagccaggggacagaugucuaaaacucccccauucauuaguuuuagaauucucugucaaagcuugguguggugguguggugguguggugguauaugccuguaauccaucacuugaaagaugaaggcacgaggauugggaguucaagaccagccuuggcucaauagcaaguucaagaauagcuugagcuauaugaaacccugucuuaggacaaacaaacgacaaacucuguccuugccaaacagucaggcuuucacagauguggccucgagagcauugagcuccuccaacaccuuggguucuucuugagauauguucuuacuauguaacccaggcuagcuuggaauucgccguauagcccaggcuaucucauaacguccuccuaccucauuugaccaucuugcccagcauugaucucuuuaaagucaaaagguauaugacucuucugggcuguuaaacagaggauaggcagagauguguuucucugugguucuuguuuaugggacuucaacacaggcauaggacacccaguggccacagagccaagguacuguuucauggaagcagaccuguauccugcagcugucuguggggugucaguggagagggucagggagaacgggagaccaagggaaguaccucauucuggucucugggaaacaggcauucugcuccgugaacagcaguugccucuccuggccuccugagcuugcuggaggauugcauggcauuguuucagcagacucagcugcagccggcaugacccacaugaguuuaaugcaagcuugcuaggcuccauagugcagccaucccccugcaguaccaggcaccuguguuaucu

SEQ ID NO: 6484 - RNA, 15147 nt, Mus musculus
ggcucaccccacgucuaaggccacgcgccuuccuguccucgccgaggaccagcuggaagccauuuugauuaugcuccaccaaagaaggaggacaauacagccccgcccagagccaggcgcgcccccgcggcgggacuggugcgcguguccgcgccucuucccgccgaccuggcgggcgccuggcccaggcggcggaggcgcgggccgugggggggaggaggaggggugguuauguaagcguugcgcgcucccgcgaagcggcagccaaugagaagccccggaugcucgugcucgcgcacgcagggcggggggagggaagcgcacgacgugcgcgcgcccucugccucguccaccgcugccgccuccuccugccgcuccuggugcugcuugugcgcucccucagugcggacccggugccucuuuugugaagcggcagcugaggagacuccggcgcucgccauggccgacgagaaacccaaggugagcucgcggcggccggcugcgccucaccgugcggaccgguggguggcgcggcccgggguccggccgaagcccgccgcgggcuucccugccugcccggggccccccacggggccagcggcggcucaggcccggcgcuccgcgccauuuuccucucucgcucucuuccucccgcccgcgcccgaggaggcccggcgcccucccccgcccccaggcccucggagcgcgcgcggcgcggcgcgaggcgggcaggcggcgcuucgcgggagcccgcgggcccggcggccccgcgcuggcuccucggcggcgcccggcgcguguaaggaaagcguugggcgcgcggggucuggggcggcggcgaaggcgggagucgugcggcccgggguuucccucucggggcuggggccgcgccggaucgguggugugugcuccggcaaccccgagugggggauuccagagucgguccggcucgaggcccaaggggcccgcgggggaggggcugcgcucuccgccgugcgcccagaaacccgcacccuggcgggaaccauguggcuuguugugguuggaggcuuaggugcgagcagagagacacgggcucaacuugagaacgcgcccucggaggcacgggcuacucuuggcugcggacuaggggaccagcaucaguccagggcagggcacucucuggccccgacucuauuuggagggggacacaggauggacgaaucgaauccuuggacauaaacauuugauuugcugaacugcuguugggguugcaauguacgggaauacuugcacgaagacuguauugcagccaugacagcaaaggagagggggaaaauaagcucugaacugaaaaugaagcaguuauauagucgaacguuaaucggaagauguaaaaagggagacucgggauaucccucaguugaguguguucgguuuuuuuuuuuuaaagauauguucauuugauaucauugagcagaguuugcuaacuuuuaucaagaagguagcaguaaaauuugaaauacaagguaugguuuucucacucccaccccaaaccgacucuaguaguuguagcuuugaaaagagaaaggacacugguguuuaugggaagcgacaaauuugggcgaugacaggaaauaaugccauuuuagaaaauuuaaccucagaugcaucacaaauuaugcaaggaguuucuaaguguauuguugccuugcuaguaucagugcuucuguaccagacuuguaacacuuugugcaggguuucugaucuuucagcccaggggcugggaacagcuguaugcuguuggagagccugagagaaaccuguugauucugaagcguucgggcccgcagcuucuuuaaagguguuuguguuucacaguuuccaaauuacacucuuauuuuucuuucaacaggaaggagucaagacugagaacaacgaucauauuaauuugaagguggcgggacaggaugguucuguggugcaguuuaagauuaagaggcauacaccacuuaguaaacuaaugaaagccuauugugaacggcaggugaggaauugauaaguguacuuccacuuaauaauccauguacacagccgaauuaggaguagaaaauguaccaucacaguauugcaugacuauuuuuguuaagaugcaugugauuauauuguauguacauuugcagguagguuuaauauuaugauucuugugcuaaaccaguaaucccucauuagauccauaagacuacaaguucccaaggagaugucugcacuugaaugaggggggaaaguggauuaguauuuggugggguuuuuguuuguuguuguuuuuucccuuuuauuauuuagacaaugcauucugucaaaauauuugggugugguaguacacuccuuuauuccccaggacuagaggcagccaggaauacacagaaacauacccugucucaaaagagaauuuuagccaauuucaauuuggguauugcaguuuuucugaaguauguggauuuuagcacacacacaccccaaacacacuuuuuuuucccaauaauuguagaggucauaguaugguauaugcuaagccagauuacuguauccuaaggaaguugccuacccaacccagagguuagaaaauuguaaucauuuuugagaaaagcaugaacacuuucauuuuuuacuaugaggaaaacucuuaagaagaaauagaaaauucugugugauuuggguguuggguuuuugucauugcuuugcuggcugccuagaacaugcuauguagacuagacuggccuugaacuugggccguccuccagccucuccuccucagugggguagcaagccccacugauuugcacaaauauggaaaaucagugcaggauuuauuagagcgucccuugcaaugcuaaguuaauaaagcaagggcaacuucgaagaugacaguucucuuucccacacugguucguuagcuguaguaauagcagaaguaggauuuuucuuguuuucuaagaugugaaaauuguggaauucauuuugaguuucaagaaggccucauuugugguuagauuggccuggaauucuguuaggaguauaggcaugugccgccauauuuucuguuuuaugcccccuuuauaguacaauaaagaacugccuccagacuuguuuaaguuccuguguuagcauuuuauuuaugucuggccugaaacucacagagaucuacuugucucugccucccaagugcugggaucaaagaugugugccaccacauugcacguuuuauauucuauaacuuuuugaaacaaucucccuaaagaauuagucaacaaagaaauuugggaaaggguccuuuugagguggcucugugagccugauuguacccaguccugaagcccacaguaggagagagccucugacuuaagaguugaaguuguccugggagcugccuccacuccuguacaagacuagaaucucacaugccaggcaagcagucuacuaaugaccuguuugccagcacucgacaugcuuccacacacaaacacuuagucaaguuuagggaucagcuagggaauagccauaguguagugauggagcauuugcccaccaugaggaggcccaggguucuguucccggguagaggugguuaccaaagggguuuacuguguggcaucuuccauugaacauucaucacccacagguuugccucugccucccaagugcugggaugaaaggcgugcaccaccacgcccggcuuaaauauuaugaaaacuuuaaauauuagguauuagaaaaguaauucgaggugcguuaacucauauuucaacauucagcaggcugaggcaggagaauuacagaaaaaucaaggcuaguccaggcuauauagcagcaaggcuuugucugauaaaaaagaaagcagaagaaacuggguaugcuggcuuacucuaaccccagcacuugaaggauaaggugguagaaaugcuuaaaagucauucugugccaagugguuguggcacacaccucuaaccccagcagcacucgggaagcagaagaguucaaggcuagccugcucuauaguucuaggauauccuagaacugcacagagagaccuugucucaagaagccaaaaaaaaaaaagugucaggguggaguuaggguaagaaucucagucuuauuauaccaagauuuuuauuuuugguaguacuggguauugaaccuaaggccucaugcacacggggcuaucacuuuuuaauuucaauuaagagggaguuacaugugucccauaacugguuucuuaaagaguuagagguagaggcucggugugguuuuaacaccuuuagucccagcacuugagagacagucagauuucugugacaagaacagccaaugcuacacagagaaacccuguuuuugaaaagccaaaaggaaaagagggcaggcucacuguauaagagccagaggaccuggguguaguucccaacaccauauggcagccuacaacuuuccauaacuccaguagcagauccaacaccaucagacauaugcagccaaaacacaaugcauacaaaauaaagaugaauuuuucuuucuuaauaaggauguggcccuggggucuguugauaagaguugccuaauaaugugcaaagcucuggguucugaugcacugaacaaauuugauguagcacuagagaggugcagacuggguuaggaaguaaaaugacaugcuccucuauaaagugaguuugagggcuuucuaagacccugccucuaaaaccugaaguagguucgagcuaucaaaagucaaauuuugugcuggagauaaaauuuacuguguuugcccagcaggcacauagccucagcuuuuuaguccuugccacuaaaaaaccagaacgcuaaguuccaggccaaccaaggcuucacaguuacacugucuuguuuuuugauuggauuucuaaugcucaugaucaaaggggcuucuguguucacgucuccuaacagugagcugagcugagcuucaucuucugucagauuaugcgucccaucagaccccaagcuuguccauucuagcuccuuuuuauuuuucuuuucuuuuucuuuuuuuuuuuuuuuucaugguuuuucagacagaguuucucuguguagccccagcuuuccuggaagucacucuguagaccaggcuaggagaugaucugcuucuguguccccaguacugggacuguaggcaccacaucccuagcuuggagucaguucaucccauccauccacuuuuccgugggucccagcgauugaacauggguugccaucuugcauggcaagcccuuuaccugcugagccaugcugccuguccagacuuuaauuuuuaccucuaggaaucuuucuggaauccccauucuguacuguugaauccaaaacgcuagaauccuuaguacuauuguuagcucuaucuucagauacugaucuguacuucauaucuguguugauaauaauagcuagaagccauaggguacagugacuacuuugcuguaaaagagauuacccacauuuugaaaauguaguuuaaaaaauuaaaugccuuaauuuccccauuuuguuuucuuugguguguuuugucuuuugucuuuuauuauauuuuuauuuuuuuguuuuuugagacgguuucucuguguagccccggcuguccuggaacucacucuguagaccaggcuggccuugaacucagaaauccgccugcgucugccucccaagugcugggauuaaaggcaugcgccaccacugcccgcuguguacuauuuuuuuuuuuuuuccuuuuuuuuuuuuuugguuuuucgagacaggguuucucuguauagcccuggcuguccuggaacucacuuuguagaccaggcuggccucgaacucagagauccaccugccucugccucccgagugcugggauuaaaggcgugcgccaccacgcccggcuuacuauuuucaaguagaucauguauauccuaugcuagucucacauuugauacuuuccuccggugcugcuacuauuauaggcaaguguguaccaucuugguuuugaaauagguucauuaagaaacacaauguuuaucugcauagaaaauguuagcauauuggggaaguuucauagauacaagaagagagguugaguuuuucgugauuauaugcuauuugcuuuuuaaucucuuguuaggguuugucaaugaggcagaucagauuccgguuugaugggcagccaaucaacgaaacagacacaccugcacagguaaaaauaucucuacuuuuaggaaaguuguguuuguguguguguuugcaaauuuuuacacaugggcauguguguaugugcagaggcuacugaggacaucaggugucuugcucuauugcuguacgcuuuaaucuuuugaggccuuuuucugaaccugucuaucuugugaauccaaacuccaguccuucuacuugcuaagaagcugcuguuagccacuggucuauccagccuugguuuuauuuauuuauuuuuuuucagacaggauucuucuguauaaccuuggcugcccuggaacucuguagauagucuggccuagagcuaacagagaucuuccugccucuacacuggccucccaagugcugggauuauuuuuaaagcagcuuuguguaugaaugucaguguuggaguauugaauuauagccucuucuuucuuuuaauuacuguaccaagugaugggaagugauggguuucauuguauuccccccccuuuuuuuuuuuucuuuucucuuuaguuguuugguugguugguuuuucaagacaggguuucuuuguguagcccuggcuguccuagaacuaacucuguagaccaggcuggcuuugaacucagaaauccaccugccucuaccugggauuaaaugugugugccaccacgcccgaaucuguguucccccuuuuaaagacuuauuuacuguguugaguguuuuccuuacaugaaugugugugcuguguaugugcuuagugucugaggaaggcagaagaaagggcauuggaucccagaauagaguuacgaucugugcacuaccacauuggugcugggaauugaaccuuuguucugcagcagcagcuuaaccucggagucgucucugcagccuguuacuggcauuuucauauguauuuguuuuguucauucuuucugguucgucuguuuucccuuuuguuuaugcaaaaucagguuugacuguuuuucagucucaagcugaccuggaacuugugugucuuaggacagcauugggacuacugauuguccugcuucuccuuccugaaagcagagauaucauccuccagcugcauuuucuauguguuugguguuggggauugaacccaaggcuucagacauguuaggcaagaacuaucgggggcuggcaagauggcucagugguuaagagcaccaacugcucuuccgaagguccugaguucaaaucccagcaaccacaugguggcucacaaccauccguaacaaaaucugaugcccucuucuggaguaucugaggacagcuacagugaacuuacauauaauaaauaaauaaaucuuuuaaaaacauuuaaaaaaaaaaaaaaaaaaaaagaacuaucacagcaucucugcuuguuuugagacauguuuuugcagagaccaaagcugugaaauaggccagaaggaaaaggaaggacuagaaauaucuucagaacaugcaguggcuuucaguuaaccacuuacuacuguguaauagguauucaguuaauugauucaauuuuuuuuauuauuaaaaugaauuauuuggcugggcagugauggugcauaccuuuaaucacagcagaggcaguuugggaucucuugaguuggaggccagccuggucuacagaucaagccagaacuacacagagaaccaugucucgaaaaacaaaagacaaaacaaaaaaaaauuuuuuguugauaaguaaagcuuuguuguuuuuauuuauuuauguauuuauuauauguaaguacacuguagcugucuucagacacuccagaagagggcguagauaucauuacagaugguugugagucaccaugugguugcugggaauugaacucaggaccuucagaagagcagucagugcucuuacccacugagccaucucuccagccccuuuguuguuuucuuuucuuuucuuuucuuuuuuuuuuuuuuuuaagauuuauuuauuauuguaucuaaguacacuguagcugucuucagacgcaccagaagaggucgucagaucucauuauggaugguugugagccaccaugugguugcugggauuugaacucaugaccuuuggaagagcagccggugcucuuaaucacugagccaucucuccagccccccuuuguuguuggaguguauuuuguuuucuguuuuguucuuugcugcuguaauacuuauccagcuuagaauuaccaggccuggccaggcggugguggcucacgccuuuaaucccagcacuugggaggcagagacaggcggauaucugaguuccaggccagccuggucuacaaagugaguuccaggacaaccaaggcuacacagagaaacccugucucaaaaaaaaaaaaaacaaaaaaaacaaaaaaacaaaacaaaagaauuaccaggccuagaagaguucuccaugguagcuggcuguugagccugaccauuuaguuccuauauugaagugaaauuuuaaauugauucuuguggggauauuuuugguucuuauuuuaaacuauauaugggggguguaguaugugcaccugagagcgguuguccuggaggccagaagaagguaucagauacccugggcuggaguugcagaugguugugagcugccugacaugaaugcugagaaaugaaccugggguccucugcaagagcagcaggugcucuuaaccacuaagccacacuuucaucucaguuuucaucuauucuugucucaaucuguccacuccauugcucuuguuagcuguauauguagaugacucuuuacaaacaugaacuguuaaaagguaaugcucugacuccccuaauguuuuuacagcauugugggucgccugccccugugauuuuauaguauaugguugucuaccuaaagcauuguauccuuuuccucuaaagcuucccuuuacaacuggaagggaaaggagcuuuggcucacugaaaaaauuuuuuucucuuaaaauagguuuucuuuguauagccuuggcugaccuggaacuagcuugaauaccugccucugccuugugaauguuugaacuaacgcagaauucuugagaguggaaacuuaacuuugauccugugagcuuuucaguugggcuaauuuuuuucauuuguuuuuuggguucuauagugaucacgccuugaccuugaauuuacaggagcauaccucaccuuucucugagucauaaaucuaugccguuuccuaagcuuguauugaagaacacuaaguaggacuccaaggaguacaaagugugauccaaugccugauucgaauuccaccuuuaauucuccauuuaaaaguuggaggggagcugaacauggugaugaacaccucaauuuaaucucagugcuuaggagguagaggaggugcuucacugaguuccagcccagccugguguacauagugauuucugggaccccugcuucaaccuacccuauggcucccccacacaaaacacaaaacgacuagaggggaguggcugaagcugugcucagcaauuaacagcacuuggucuugcuaagucuguuuuuauaaaucgggcucagcaguuaagcacauugucugcugaaccuggguucaauucucagcauccacauggcagcucacaacucuaguuccagaggauccaacacacgugcagcauuaaauaaacaaaacaaaccaaugcacauaaaauauaaguaaauuguugauaaauuuaaaaggcaguguuggaacuagagagauggcuuagugguuuaagaaugcuaguugcuggucuagagagauagcucaguggguaagagcacugacuguucuucugaagguccugaguucaaaucccagcaaucacaugguggcucacaaccaucugugaugagaucugacgcccucuucuggugugucugaagacagcuacaguuuacuuacaaauaauaguaaauaaaucuuuaaaagaaaaaaaaaaagaaugcuagcugcucuuucagaggucuuuaguuacauucccagcaaucacaugguggcucacaaccauccuguauugggaucugaugcccccuucuagcaugcaccauguaugcacagagaacacucauacauaaauaccuuuuauaaaagguaggugaaucauagcaauuaagggccauggcuauuguucgagaggacccagguuccuuccuuucugagcaccaacaugauggcucacauacaucuguacuuuaauacuugaacgauguauauacaaaacauugauucuuagccgggugguaguauacaccuguccuagcacuuuggggguggaggcaggcagaucucaguuugaggcuaaccugaucuaugcagggaguucccguuucaaauacacucucucccccaaauuauacacaagagguuuuuaucuaaguugcagucaaggaagaacgccgaaggccuucuuauaagcagcacucuccaguugucuguuuuagccauaaggaggggcugugcaaugccuucuuguaaaugcaggcaaaacugaucucuuacucgggaacuuugugaaauuuucaaguugaauuugaaauucaauuuagaaguguucucuucugcugucauccuaagauuuagaaaacuucuuuuacauuuuuguguguauuuccagaauugagagcuuuugcagagcaguguuggcucacaucuuuaaucccagcauucugagguaaaggcaggggugaaccucugccugccaaaccugcucuacugagcaaguuccaggacagccagagcuacacagagaaacccugucucaaaaaagcaaaccaacaaacaaaaauacuuguccuggagugguaguuacaugccuuuaauaucaggcagaggagcucugugaguucaaagcuagccuggucucauuuguguucucagaaugacucuggggaugcaacucggguucucagauccaacaccucuuaucuuaucacucaaccaucuuaucagcccaccauuuuugagauaaggucuauuuguauagcuuagcuugccuucuucuuacaacacaguccagucuaaguuuuccauccauccuucugcuucacaaggugguuccacugauaaacgcuacaguugugguaagacaauaccuuaaaaagagaccagcuguuucuuuuuucaauuaaaaaaaagaaagaaagaaaaagauguuuagccaaguuuuaggauguaauacaucccauguuccuucccccaaacaacucuagagcagcucauggagccccaggcugguacaaacaugacuuguugaagaugaucuuaaauucuugcucuuccugucuauaccucccaaaagcugagauuaucaaccuccauuaggauuucuagagucuguguggcagggaguggggguggggaagucaggauaauuucaggcuucaguucucucuuuacauuguguucuggaagauucaacucauugucagguaguuggacuuguagggcaagagcuacuacccacugcgcugucuagcuugccaaaaaaagaacuuuuaaagagccaguucacuuucuacaaguguugcuuucuguguuaagaccuuacucuggaugcagagacugguggaucuggugaggcuggugcgaguuugagguuugagaucagcuuggucuauaaagugaguuccaagacaaauacagaugcaauaauauaauuuaguacuguguaguuugggauuuuugcuuuuugagauggucucacuguauuccuggcuaaucucaaucacagaggugagccacugugccuagcuacugcauaauuuuaaaaauuugauuuuggucugauuguuuuguuuugcuuuguuuuuuuuguuuuuccagacaggguuucucuguguagcccugaauguccugggcuacagaaauccucgaccucagaaauccuucugccucugccuccugagugcugggauuaaaggcgugcgccaccacaccuggcuggucugauaguuucuuuugaggcuauuuaacaaauaugcuauuuccuaagcauauugugccuuguuuuuaaaguuuacauuuacguuuuacaugcuuagccuuuauuuuuuuagguuuuuuuuguuuuuguuuuuguuuuaguuuuuuuuuggagacagguuuucucucuagaccaggcuggccuugaacucagaaauccaccugccucugccuuccaauuaaaaaaaaaaaaaguuuuuuuuuuggaagacuggguaucacauaaguuguagucuaggcuggugucagagucuagagucucaguacccuggaguucugauauuguguguguguguggccaugccugaugaugauugggcuaaucaaaacugguuuccaaugcagugcuuagcugacugaaaguagguuuguaagcauuugagaccagccuaugguugucacuucauucauuucccuuucuugagcuccauaaugcugggcuuuuagacaaguguguuuccccaugcuugguuuucuugaaacugaugucuauaguagugaagccuggguugguaugggacauguacuuaaauuuaauaugaaaaguagacauugaaauuuuuuuccucacuggucuuaaauuuguuuucuuuucugugcuaguuggaaauggaggaugaagauacgauugauguguuccagcagcagacuggaggugucuacuaaaaagggagccugcuacuuuacuccagaauuuuguuauagaccaagaauacauucucaauuagaaagccacaauuuggucccaccacauccugacuacuacaguauaguuuucucucuucuuucauuucccuguccccauuucuuuauuguacauaaaguaacugguguaugugcacacucauagugcucucucuuucuuuuccuuuuuuaaacuaaaugaccgauguucuguucugguugacaugagauggagauggucuggggaaaaauacuggguuugugaaaauacccccuucuccacuaguggcaugcucauucagcucuuaucuuuauauuccaguaaguuauuuugcucucauuguuuuaacaaaagaacccaacaacaccaaauccuugcauaccuuguucgauuggagaauuuuaauguuuuucauuuaucauuguaaaaccaaggacaauuuuauaacuuuuuuguacguagcuguuacauguagggcaaucugucuuuaaguagggauaaauuacucuugaacaaaaugauccuagauaguuuucccuucaagucaagcgucuuguuguuuaaauaaacuucuuguuuaaaaugagcuguucucuuuauucugaagaauauuaaauugaaauguuuuaaggccagguauguuggcucacaccuuuaauccuagcacuggggagauagaggcagguggaucuuccugaauuugaggcuauccuggucuauauagccaguuccacaacagucacgacuacauaaagagacauugucuuaaaaaaaaaaaaaaaaaaaaaaaccuaaagcaaagucaggaggggugucacaugccuuuagucccagcacuugaagcagaggugggcauauaacucagaagcaaccuggucuacauggcguguuuccuaccagcuggggcaaugcagugagcccuuaucccauaaaauaaagggcaggggaaggcugaggaguugagcauggguuugguucucagacccuauuugggccucacaguucugguugcuaaauuagacugacacccuucucuggacuccaaggacagaacaguguacacaaaaaucuguacacaaaauaauauauaucaaguaaguaaagccagggauuuagauguggagaaaaaugaagcagaguguccugcaacucacuguguagaccuguugaccaggcugguucugggaugaaacccagccuuuagggcauguguccuuacccgcugagccaucucacugguccauuaucuucauguguggccagguauaggugaaugcaccuguaguccuagcucucagaagcaggugcaaauuuuagggcugccaggguuaaacccuuagacuauggggcagggaguaggccggagagcauagagcuggcuuuggccuuggcucauguuuguuuuuugguuucuuuucaagacaggguuccucuguauagcccuggcuguccuggaacucacuuugaccaggcuggccuugaacucagaaaucugccugccucuggcucccaagugcuggguuuaaagggguccgcugccaccgcccgguuuggcucauauuuguaagaagguuugaguucagucagaaucagccugggcuauggagugauaauuuuaucacuuucuaaaaguuaucacuggguacaauuuuaaauuugagauucgaucuguaguagagcacuuagaauaggagggccugccuagguuugagccucuguguugcuccaagaauucaaaguuuauaacaacauccugagauacaguaaaauccugucucagaguuuucuguauuccaagcuaguuugugguuuacaauguagccgaugacgaccacaaaugagcuuuuuguucucuuccuauagagcaucauggauuaaacuacaguagaccugguggcacuggucuaaggcacgcuguguauuuaauccaguucuuaauaaaugccaggcuagggcuggugagauagcucaguggguaagagcacccgacuguucuuccgaagguccggaguucaaaucccaacaaccacaugguggcucacaaccauccguaacgagauuugacucccuuuucuggagugucugaagacagcuacaguguacuuacauauaauaaauaaaucuuuuuaaaaaaaaugccaggcuaucagcugaucuacauuccuagcccuuucuaccuuccauuauuccuugggagggagaagguugaggcagugucuacuauguaacccuggauggccuggagaauaaauacugu

SEQ ID NO: 6485 - RNA, 36828 nt, Mus musculus
gagaaaagaagaaagaaagaaagaaagaaagaaagaaagaaagaaagccagcccauaucaugucaauaaggcaaguguuccuuugguaaauuaucauucaaaaauauuauuuaagaaugccuuugacuucaaccugagccaucuaugacuguccuugauaauaauaccuuuuaguguuuuucuuauaaacgucuuuauuuuaugguuuguuucugagauuggaugaauguucauuauuucuauugcugcaccaaaccacacccccaugaauccaugacuauauaagccacacguggccuuauuuauuuauuuauuuauuuauuuauuuauuuauuuagguuuuccaagacaggguuucucuguguagcccuggcugucuuggaagucacuuuguagaccagguagcugagaacucagaaauccaccucccucugccccccaagugcugggauuaaaugugugcgccaccacuguccgacuuaaaccuucaauuccaaugcuauuuauuuauauuuuggucucugauuacuuauauauguuugccaaaauauuucuuuucugaucccuccugaauuuuuguuuuaucuacugaggcuguuuuguccucaauuacauucagagcagaguagauuuuaacaacaggcauugaaucuuuuaauugcucugaagaugagugucuuagaguuuuaccgcugugaagagauacuaugaccaagacaacucuuauaaaggacaacauuuaauuggggcuggcuuacagagucagagguucaguccauuaucaucaaggcaagaaacaaggcaguguccaggcaggcauggugcaggaggagcugagaguuccaaaggcaaacaggagaagacuggcuuccagguaguuagaaugaggguauuaaagcccacacccacagugauaaccuacuccaacaaagccauaccuucuaauagugccacuccauaggccaaacauauucaaaccaccgcaaagaauuucucagaugcugacagggaacuauugaguuaaauuuggucucuagcccugugagaggcacuuccuaacagcaaagaguuuccuugccuauuccuuguucugcauucauuaauccagugcagccaggcgugguggcucacaccuuuaaucccagcacuugggaggcagaggcaggcagauuucugaguucaaggccagucuggucuacaaagugaguuccaggacagccagggcuacauagagaaacucugucucagaaaaaaaaaaauucagugcaggccuuugacauacuuucuguauacuccagaacacuugggccuucuuuuuggauuaucucaaaaacacauuguuggggcuagggagauggcucagugguuaagagcacugauugcucuuccagagguccugaguucaaaucccagcaaccacauaguggcucacaaccaucuugcccucuucuggugugucugaagacagcuacaguguacuaacauauaauaaauaaauaaaacuuuaaaaaaaaaacauaguguuucuaggaaugccuugacuacaaucucuuacuuaccacaucugccauuuuaauuucucuuaaaacuuuuagaaauuauuucccuuaugagaguagcaucuuauuaaauuugagaucaaauaucagucauauuucuaauccauuccucuaugggugcugaucuuguauuuaaaggccuaauuguuuuguuuuguuuuuuucuuuuuugguuuuucgagacaggguuucucuguguagcccuggcuguccuggaacucacuuuguagaccaggcuggccucgaacucagaaauuugccugccucugccucccaagugcugggauuaaaggcgugugccaccacuacuaggcuuauuucuugauuuuucaaccuuguuucaagcauuuaaagcugcugaaggacgaggugugacacucacauucaagcugccuuuguaacucagcauauugaccucuaccuagcaacugcucuugggagauauuaauacuucgaaccccguuuccuaguucuacaguucuagcuuccacuuuccaccuuguuccccauuguaauugaggaccagcuuccaaaauugcuguugccaaucuuuccagucucgggggaugauucuuaucugaguuaccugugaauuuaauaucugauucacauagggugaaugcacacuauaugaaauaauagcuuccuuaagucuccucuaaucuguaugucuauauuauucccuuuaauuucauaaccuugguggagccuaguauccacaaguaggccuuguauaguaaauggacaaaugacaguugauugguuuuucuaacaaccuaaggcugccccucuucaguuuucaucauauggugguaugguagguucuugucuaaauuacccugucugugucugagcauuuuuauuauuuuuaucucuaagacuuguaacauauuaauccacuuuucauguuuggcagaaaaaagccgacuguggcuacuaugaguaaaauaugaauuaccaaacugauuguauaugaucaauuuugauugauaugucaauuuuagucacaccauuuaccuuuucauuuucuauauucaaaccaucuaaaauaguucccauccuuaacauuggggaaauauuuucccuuuuaauauuacuuaacucuguaaaagccaaguuuuucucccauccccaagcuccuggaauaaugacucugauacucaaaauauauuuacaaacgccuuaaccuuaagcuuugccuuauucucuaacuagcucauaaauuaauaucccauuuauucugaucuaaauucugccacauggcagguuaauucugcucagguuccaugcauccuccuucagguuuccaggagccaaauccuccugugccugguucuaucccagaauccuuucuccuaucagaugccccaccuuuugcccuacucuuucauacaggccacaggauuuuuuuuuauugacaagcaagggaucuguacaauauacaagauauucucucuacauaacucucuccuugagggcuucucaggugucuuaccaaauuuuauggcuucucaguuuguccacagcuggcacgauuucucugucccuguggugaugucacauguugaagcacgaaauaauguuuuuuuuuucuuuuaaaacaaaaucucaaucauucaauuuuaccaauggagacuuggaaaccagaugcuggggugaaagccugcuaguuuagaaagccggagaaagaacccacauaaucuuccuccuuagcagaagcaaucccauuucucacacugucuaaaaaaaaaaaaaaaaaccaaaccaaaaaaccuccuucaaacugaauuauuuauaagugauucacuaccaacacucguuucuuaauuauccucaaccgcugucaauaguagcuuuccuaagacuagggcuucagguuuagcuuguuagguuugagccucaaaaaucaggaguuugaauucaagcucuucuaguaucagaauaaaacuuugaucauagaaacagucugcggagagacuggcaacauuacugauccuucaccauuauaggcuauuguaguuucuguauggcugaguuuaucuaaacagcucaagcuuaaaagacagagaagcuagacacauaucagugugaaccugagugcacccuaggauuucauuaucaaacauauuuuauuuacugaacauauacuguuacuuaucuaaauuuucuagcagcuugguguugagcaauuagcaaagacauaaguaauuagauauacaucuuaaauuagcuuuuguuaauuugaauagaccuuuauaaccuugaaauuacaucaucauauacagaauauuuuaaaccagauuugagucauguauaagguauguuguagcaaauauaaccuugaacuucuaucaucauacaaguuuaaaauccauaccaauuuaaaauauuugagacuuguugcucuccuagucuaaaaggagauucaauaaccaaauaaggguuugguaaaauugagaaguuuuacaauuguuuauaucauguggucaucuuaagaugguguaaugauuuguauauguguaugugcuuggcccagggaguggcacuauuaggagguguagccuuguuggaguagguuugucacuucgagcauggccuuaagaugcucauccuagcugccuggaagucagucuuccacuagcagucuucagaugaagauguagaacucucagcuccuccugcaccgugucugacuggaugcugcauugcuccagcagccacagaguggcuaacaaccaucuguaaugagaucugauacccucuucugguguguuugaagauagcuacaguguacccacauacauaaaauaaauaacucuuaaaaaaagguuggggggccgggugugguggcgcaugccuuuaauuccagcacuugggaggcagaggcagguggauuucugaguucgaggccagccuggucuacaaagugagcuccaggacaaccagagcuauaaagagaaacccugucucgaaaacccaaaaaaaaaaaaaaaaaaaaaaaaaaagguuagggggcuggagagguggcucagcgguuaagagcacugacugauuuucugaagguccugaguucaaaucccagcaaccacaugguggcucacaaacaucuguaaugagaucugacgcucucuucuggugugucugaagacaguuacaguguacuuagguauaaugauaaaucauuaggcugaagcaagcagggccaaggaggaacaagugggucuaaccagagagagcagagguccugaauucaaauuccuagcaacuacaugauggcucacaaccaucaguacagcuacaauguacuccuauacauaaaauaaauaaauaaagaaagaaaucuuuuuaaaaaaaaaaagaaaggaaguagcugacauuaacuaauuaccaaguuaagaacuaguuaaguccuuaggccucaaaagccucuaugagaauuaucuucacagagcgguugcacaacuuguccccuacucugaaguaguggacaagaugaaugcaggccuugugaccaugugaccuugugacccugugacccugugacccagaccucagaccucagaccuuaauguucauagaaggcagcagagggacaaaaauaaaaaggccaauuggugguauauaccuuuaauccuagcacuugggaggcagaggcagacaaauuucugaguucaaggccagccuggucuacagagugaguuccaggacagccaguaguaaauagaaaaacucugucucagaaaaacaaaagaaguuuaaaaagauaaagaaacuaaaagaagacuaggaauguaacucagaugguaggguauuugacuagccugagcuaaacucugcuuuugaccaucugaauaaccggcacaucauaugccuuugaugccugaacgugggagacaggaacacguggaucugugugaguuccaggccagcgugagcugcauagugagaccuuguuucagaagagaauaaauguuaaggucagccuuggccauauaacaaguuugagggcagcucgagcuauaugagaucaguauaccauaagcaccaguuauuucccaucaguuaauagaguuuauggaucaaaagggauuaauggacguggggguacacaccuguaaccagaacucagaaagcugaggccagauuaaggagugcaagguugugggcagccugggcaacauagcaaggcuaaccagacccuggcacaaacauuuaaaaggagauugaaggucacucuaucuucucuaucugcauguacaacugcaugccagaagagggcagcaaaccccauuauagaugauuaugagccacuuugugauugcugggaauugaacucaggaccuccgcaagaauagcccuggcuguccuggaacucacucuguagaccaggcuggccucgaacucagaaauccacuugccucugccucacaagugcuggaauuaaaggcgugugccaccacugcccagcgccuugugucucuuuuaaaacauuuauaauauuuauucauuuuuguuccguguguauguucaacaucacauguauacagugcccuugguggucagaacagcacauggauuccccuggaacuauaguugugagcugccauguggguugcugggaauugaacauggauucucugaaagugcagucagugucuuaacaguugagccaucuuuccagucccauuuguugcucuaauagaggacccagguucaguucccaguaccuaugugauagcucacaaccaucuauaacucuguucccugaggaggaaguagucucuuuugaccuccuugggcaccaugcaugaaguuuaacuuucauacacauuaaauaaauuuuaaaacacacacacacacacacacacacacacacacacacacgcacgcacgcacacacacgcacacacagauacacagagaaacacacacacacacacagagauacccagagaaacauacacauucagaggaaugaaugagaaugggguuguagaguaaaagcuuucauuacuagagguuagcuggaaccugagcgugagaaaucuaguucuucugagaacauuauuaucaauaaauguccagguauggugguguauacuuauaaugucagcacugaggaggaauucugagguagaggaucugggucugagagcaauaggagcuauguagucaaucugggguauauagaaaggaccuggcucucuaaauucauauauauauauauauauauauauauauauauauauauauauauauauauauauaugaauucauauauauauauauauauauauacacguauauauacauauauauacacacugcauacacugcauauacaugcauacaugcauacauacacagauacaugccugcaugcaugcauacauacaacauacauacauauauuuacauacauacauauauauuuauauaugcauauaucuacauauauucauauaugaauauauuuacauacaugcauacacagcaugccugucugcaagcauacaugcacacaacauucauacacacaugcauacaugcauaauacauacauauacacacacaugcuuacauacauacaaugaaaggaaauuaaauuaagagaucagagaacaagaauuacagagccauuuauuguagugacauuuuugaaaauucaggaauuuuuguuucuuacaaaacacagaaacauaaaaacauguuuuuguuuuaaucccaggugugugugagaugcaaggcugauuaggccugucugcagcagcugacuaugauuugccucaugcucuagcagaggcaugguguugcuggcugcagauaauuucuacgauugugugacauuuggaauucuggggacuuuucagaggcuauauaaaugcuaggaccuugagaggaaugauugggggguguuguuguuguuguuuuggaggagggggguugagacaggguuucucugcguagcccuggcuguccuggaacucacucuguagaccaggcugaccucgaacucagaaauccaccugccucugccucccaagugcugggauuaaaggcgugcaccaccacugcccagcagggugguguuuuuugauuguucaagaggguuggcugccauuuguuaguaguagugcucaacaaagaaauaagaagaaaaaaguagauucagggaucucuagcucugucccugcucucccauuuucucugcucucucgugauagggggugcaaaugggggcauuaagggugggaaaaagaaggacccacaaaguagaaaggaccagcuacauuuuuuuuaaagauuuauuuauuuuuuauguaugugaguacacugaagcuguacagauguuuguaaccauagcccaucucgcuccaggccccacucacuucgggccugaucacagggcuuauuuauuguuauguguaaguacacuguagcuaucuucagacacaccagaagaaggcaccagauuucauuacagaugguugugagccaccaugugguugcugggauuugaacucaggaccuuuggaagagcaguuagugcucuuaaccacugggcuaucucuucagccccagccagcuacaauuuauauccuaucacacaacacacacacacacacacacacacacacacacacacacacacacacacacgagauaggguuugucuccauaacucuggcaguucuggaaccuacucuauagaccagccucucuguaguagaccugucuacucuguagacuagccucaaauucagagauuuccccuggcucugcuuccugucuugagugcagagauuaaaugugcacacuguuauacccagcccauuuagagcguugaacuccccucccccacaccccagccaggaaacacguauaaacaaauucacacugugaaugaaugcuagcugugcauauuugacuugugggguccucaaucugccucaugcaggaauccagagugcuagguccucaguccugugggaagccugcaggcacgcgcugaugggguccgcaagcaccuuccaaccuucuaccuggguuauuaaaagagaccggaaaccuaagauuccgacagcagucagcaggaagaaccaagcuuguggccauuuaaacgcaacagcugggcggcuggagaaaaacgccgggcucugagguuaagaguccgugcugcucucacagaggaccuggguucaguucccagcaaccacaucaggcagcgcacaaacacccuggaaccugauggugugaugucuucuccucuccgugggaaccuucacauucaugcuguaugucuauacacguagacacacgcagagacacagaacaaacacgaagauacacacguuaaaugugucagucggaguguggcauauagggcacuacugugcaucucauaauaucaugaguucacucugguuuucuugugucuguacccccgggggugaaacggagaggcacuggauaggcaaccaucuagcacugaacucuacucccaugccccguccccugaauguuaacccuugaguuguuuuuuuaaaaacacuugauugcuuugugggggagucuuuauuucauuuguuuguucuguuuuuguuuuuuugagaucucucacagagccuggagccguacuguccaguucagccaagaccagcagcaaaccagccagccucaggaauccuguccacgugccuagugcuggaccugcagaaucacacugccaugcuugcuuucauaggugauugcuggagaccgaacaccaacaccucgucaugucugcccagcaaacacaucaccaucugacuugacucaccucagcaacuccagggauaaaacuuacauacaggcaaaccaaaaaaaaauuauacauuuuuuuaauacuuuuucccccucuuuguaagcuuggaugugcugggacucacucuguagaccaggcuagacucaaauucagauccaucugccugugccuucuaagugcugggauuagaggcgugcaucaccaugacuggccacuuuuuuuuuuuuugaguacuuuaguuuuauuuuuugauuuuuguaugcaugugucugugugugguuugugcacaugaguacaggugccuucaaaggccaaaaauacucuucuggugaauggaagcuggaguuauagagggacauggggguugggaacccaucuucgguucucuggaagagcauuaugugcucuuggcugaugagcucucauuucagcucuucaaauagcaaugguuaagccacguauucauugacuggaaacaugguggcauacacaagugaucccuggacuugggaggcagggccaugaggccugcuacaacuuucaggcuagccugggcuucuuagaagaacuuugucuuaaaauagaaagaaauguuggcaagaucguucagaggguaaagacauuugcugacaaagcugaguuagauccccaagacccagguguuaggagaaaaaugaccccaaaaacugcccuuguacauccacauaugcaauguggcacaugcaugcucuccccgcccccauaaaaaacaagcuggcgggcuggugagauucagugguuaagagcgccgacugcucuuccaaagguccugaguucaaaucccagcaaccacaugguggcucacaaccaucuguaacgaaaucugaugcccucuucuggagugucugaagacagcuacaguguacuuacauauaauaaauaaauaaaucuaaaaaaacaaacaaacaagcuggcgccgggcguaguggcacacaccuuuaaucccagcacuugggaggcagagacagucggauuucugaguucgaggccagccuggucuacaaagugaguuccaggacagccagagcuauacagagaaacccugucuugaaaaaccaaaaaaaaaaaaaaaaaaaaaaaaaaaaaaaaaaaccaaaagaaaaagaaaacaagcuggcaagguggcagugccuguuuuuuuuaauuccagcacuugggaggcagaggcagguggauuucugaguucaaggccagccuggucuacagagugaguuccaggacagccagagcuccacagagucagaaaaacaaacaaacaaacaaacaaacaacaucaacaacaacaaaaaucaaaacagaagaaggcuggagagcugguucuguauuuguuuuugagaguguagcucuagaggagggucuggguuugguuucagugcucauaccaucuauaacuccaguuuuggggaaucugacauuugcuuagggucugggaaggccccaggcacacacacaguagacaucacacaugcaggcaaaauacucagacacauaaaauaauguaaaucuaaaacuaagcaaaaauggggaugggggucaagcaaucuaccuggcuguggauuauauaauguaauuccaggacuuucuagguguggagggugaucaggaauucaaggucuguccccuuuaaucccagcacuggggaggaagaagcaacuggaucuuugugaguucaaggccagcuuucucuacauggugaauuccaggacagcuaagguuauguagaaagauccugugucauuuuuuuugucuuuucuuuccuuccuuccuuccuuccuuccuuccuuccuuccuuccuuccuaucuaucuaucuaucuaucuaucuaucuaucuaucuaucuaucuaucuauagucuccccucccccagccugaaaccugcuugcucagggguggagcuucccgcucaaucuuucugccacgccuacugcuggaaccugcugcuuugcuguucugaagccaucacgugguuacccugcuacuggaccccaagauuauuuggcuggaauugggccucucccccuuccuuuauaacugagugccgaaauaguaaaaauugaaccuugagcagagagcuuugucuugguuccuuccuuaucuagcgcagcccagucccucuucucuuccagguuuccaaaaugccuuuccaggcuagaacccauguugugaucuacuggccagacacaacaucuaucuaucuaucuauccaucuaucuaucuaucuaucuugguuuuucaagucaggguuucugaguguaaccagcuggcuguccuggacucaauuuguagaccaggcuugccuuaaauucacagagaucuguuugccucugccucccaggugcugggaucaaagaccugugccauugugccuagcacuuguuauuuuagugaugcuauguguguguguguuguguguguguguguguguguguguguguguguguguguguguauguaugcacauaaguacaaguacccacagagguccaagcugucagauccccaaggaguugugguuaaaggcaauuguaagccacauggccauaugugcaggggauccaacucagguccgcaggaaguucaauaugugcucuuaaccacagagcaucucucuagccccaaagacccuguuucaagcaccaaaaccaauccccccucaagaaacagaguucaagauuagacugggcaagggagccuacaccuuuaauuccaguacaagggagccaaaggcaaguggaucucugaguucaaggucaacuuggccuacccacuaaguuccuggacaguggacagucagaacuuuauagagaaacucugucuggaaaaaaaggagcuggggaccauugagccuggagagauggcucaaugcugagaacauugcugcucuuuuuuuuucuuuuaaagauuuuauuauuauuauuauuauuauuauuauuauuauuauuauacauaaguacauuguaggugacuucagacacaccagaagagggcaucagaucucauuaugggugguugugagccacuaugugguugcugggaauugaacucaggaccuucggagaagcagucagugcucuuacccucugagccaucucacuagccccauugcugcucuuauagaggacucagauucacuucuguacaccugcaucagaagguucccaagugucucuaauuccacuuccaggggaccugauacuuucuucuugucuguaagaaucaggcaagcaugccgggcagugguggcacaugccuuugaucccagcacuugggaggcagaagcagacagauuucugaguucgaggacagccuggucuacagagugaguucuaggacagccagggcuacacagagaaacccugucucgaaaaaauaaaucaaucaaacaaacaaaagaaccccaaacauucacuugacuuuguacagcuuacuucuuuuuaauuuuuagucuuugagauguaguuuucuuggacucaaagucauggcaauucucuugcuuaagccuuucaaauucuggaauuucaaggaggcaucaacaugcucugcugauauauuuuuuaauuauuuauuuaucuuauguauaugaguauacuguagcugucuucagacacaccagaagagggcaucagaucccauuacagaugguugugagccaugguugcugggaauuaaacucaagaccucuggaagaacagucaguacucuuaacugauuagccaucucuucagcccucagcugauaauuuuuauuuaaccugucucgcuuuuuuuuaaaaauaauuguugggccaggugugguggcacacgccuuuaaucccugcacuugagaggcagaggcaggugaauuucugaguucgaggccagccuggucuacaaagugaguuccaggacagccagggcuacaccgagaaacccugucuugaaaaaaacaaaacaaaacaaaaacaaaacaaaacaaaaauuguugggcuggcgagauggcucagcggguaagagcacugacugcuccuccgaagguccugaguucaaaucccagcaaccacaugguggcucacaaccauccguaaugagaucugaugcccucuucuggugcaucugaagacagcuacaguguacuuacauauaauaaauaaaucuuuaaaaaaaaaaaaacaaaaaaaacaaaaaaaacaaaacaaaaauuguugggagguaauggcacacacaccacgcaggaggcugaugcaggcaggucucuacuuuaaaacuaaaaacaaaauuuauguuuuauauauaugaguguuugccagcauguauguguaacauuaaguauuguggaggccacugauuccaugaaacuagaguuccagacuggcaagcugccuacuagaggcuggaaauugaucuuguguccucuguaaaaguaggaagagccucugagucgagucucuagccauauguuuguuuauugucaagugugaguguauaucagccucacuuacaugugugcuccuuguuagugagagaguauguaucaagggaauaagacaugggccaggcaugguggcacaugccuuuaaucccagcacuugagaggcagaggcagguggauuucugaguuggaggccagccuggucuacagaguuucaggacagccagggcuauacagagaaacccugucuccaaaaaaaaaaaaaaaaaaaucagggacaugaauaguguaugaccccaaugucuuccucuggccucugcacuacuauaaauaaauggcuaacaauaccuguauacacacauucacacacuacugguuagcagacacaaaaacacauauacauccacacacacauccacacacauacucacauccacacaaacauaccuccccccccccgggggggggggagaaauagaaguauuuuagagucagacauaguagaucauaucugacaaagaaauguuuuguaggcugagacaggaggacaagugugaauuugaagcuugucuggguuacauagugagggcugggcuaaugacuguugucuuaccaucuuuuguuacaaauuaugcuacugguaucauagguacauuuuguugaggagacagggucugugauauagcccaggcuggccuugaacuuauuauccuucugccucagagauccaaaugcugggauuagaaacaugagcuaccaagcucaguuaaucacuacuuuuuuuuuuuuuuucgagacaggguuucucuguauagcccuggcaacucacucuguagaccaggcuggccuugaacucagaaaucugccugccucugccucccgagugcugggauuaaaggugugugccaccaugaccggcuuuaaucacuacuuuuacuugggaaaauguuaaguuuuuuucuuuucuccuuaaaaaauauuguuggcaccauugcaucaagauuuuguugaaaggacccugauauaacugucucuugugaggcacugccguggccuagcaaacacagaaguggaugaucacagucagcuauuggaugucucacagggcccccaauggaggagcuagagaaaguacccaaggagcuaaagggaucugcagcccuauagguggagcaaaaauaugaacuaaccaguacuccucagagcuugugucucuagcugcauauguaucagaagauguccuaguuggccaucauuggaaagagaagccccuuggucuugcaaacuuuauaugccucaguacaggggaacgccagggccaagaagugggagugggugugugugggggagguuugggauagcuuuggaaauguaaaugaagaaaauaucuaauaauaaaaaaagaauuguuaaaacaguaaaaaaaaauuguugguagggcuggagagauagcuuagugguuaagagcauugacuauucuuucagagaauugaguucuauucccagcaaccacaugguggcucacaaccaccuguaauuggaccugaugcugucuuuugguaugucugaagauaguuacaguguacucauauacauaaaauaaaaaaaacauauuugaggcuagagagauagcucaacacauaugaguacuggcuguucuucuaaagggccaggguucaaucaucagcacucauauggcagcucacaacugucuguaacuccagauccauggcuucugacauccucacacagacaucauguaggaaaaaccaacggacagaaaaauaaaaacaagggggcuggagagauggcucaccaguuagaagcacugacugcucuucuagauguccugaguucaauucccagcaaccacaugguggcucauaauaaucuguaaaggaauuugaugcccucuucugguguucucaagacaguguacucacauaccuaaaauaaauaauuuuaauaaauaaauaaauauugucacuggguggugguagcacaggucuguaaccccagcacuccagaggcagaggcagacagaucucugacuuugaggccagcuuggucuacagauuagguucaaagacagccaaagcuacaaagagaaacccugucuugaaaaacuaagggcuugccgggugugguggcacacgccuuuaaacccagcacuagggaggcauagggcuauacagagaaacccuguaucgaaaaacaaacacacacacacacacacacacacacacacacacacaaaacagaaaaaaaaaaacccaaccaacaaacaaacaaaaaaauaaagacagacagacuaagggcuggugagauggcucagcaguuaagagcacugacugcucuuccagagguccugaguucaauucccagcaaccacaugguggcucccaaccaucuguaaugggauuugaugaccucuucuggugugucugaagacagugacaguuuacucacauacaugcaaucuuuuuuaaaaaguuaauuauaaaauuuauuuuauuguauauauacugguguuuuguguaugucuguguacuacaugugugugccugguuccacagaggccagaagagggcaucagauugccugggacuguuccacauguaugugagugcuuugaauugauccagguuccccgggaagaacagcguaugcucuuaaccacugagccaacacucuagcucccuaaaucacugaugauuaggauuuggauaaaaauuugacagaaagguuuuccuuuauuuccuuaaaguuugugggaguuugguuuuugagucugggucucaguuagccccgaugcgagcucaaccuugccauguagcuaaggcugguucugaacucccgauuuuucagucucuacuucccaagugcugcaucuuccggcuuauguuacuaugcccuacuuccaagucauguaugaccaccaauuuaagguagaaauaguucagaauaauccuaaagaaagaaaaguugccaguacauaaaagauugaagucccguuguuuacggaugucauguguccgagacuaauuccaaaauaagcgcauuauacuggucggaguucggaaaagggacugagaauauucuaauaacagaccaggagggagggaucacaacuaccgcuaagagauaaaguaggauuacagagacggaguagcucuccaaucgaaauagaugcgccagcacgcuucugcgcaugcgcacacccucccagccaccgccucucccgccaucuccggggaccuuucccucaccuagugugggacugucuguggcgccgccugaucuacugggaacauuccuugaggacccgugggcccuagagccguuuucaugauguguuguauagguuagaauaguggaacaugugugaaaggcuucaaggggcuguguuuggcuaagacgaagggaucuguugcgcuaaggucugcaggcgcugcgcaagccgcccuggaggggguccucuuuggcagcugucugugagcgggaggccugagcgcagagaagcggccgcgcggcagggucccagccgcggggggcacggcgcuauggaggagcucgacugcgagcccgcaguaacuguaagggcgaucggaguggaguggcuuggcuuguugcacugugaggguuacguuucuuuggucauuucaggcugccucccuacaugcgggacgcacgcuucuucccuggacacaguugccaccaucccgaaugucagguuaacugggaacuagguuauggcaauaguggucccuagguccugugaauacuggccggcucgcggaaaccccacugcaucacccuuguuuuuauaaccuuucugcuucucuaguuuuccccccuugggcguuagaaugagauugguguaagccccacauggucacuccaagggaugaguuggccuuucccuguccugcuguccuaguccgaggcuuaauaaaugcauaauuuguucucacgggagacaauagacuaguuucugucgcguuguauucuauuccucuugcaccuagaaaauguuuuuuuaaguguguauaugucugaauaugugcacagcaucauuggauacgaccuaggcuguucgccugguguaugguguucgcaguuacacuuggaaguugaauggacaguuguagggcuaacagcuccugugccuccuuaugucuuacuaguggauuccaggugugaauuccaagaagaagcaaauguguuuugacuggggccccggcgagaugcuucugugugaaacuuccuucaaccaaacagguaggcaguucuuuuucacaucugucuuggcacauugguugacucucugaggcaggaaacuggaguuauuuggcaauauuuuuauuuuugaaacuuuguuuuuuugcuauuuugagacaaguugccccuauguaguccuagugggcuugucuuugugcaaucuuuguguagguuugaauucuacaucuucuucccucgacuuccagagugcugggacuugaggugugugguucaacacuugacauuaaguaauuuuuaaauuuuauagucuguguaugggcauuuugucuacgugcauaacugugcaccacuccgugcuuggugccgcagaggccaaaugagaucauuggauucuaggaacuagaacucuauauuuaugugaguugccauaugggguguugggaguugaacuuaggucuucuggaagagcugccuguguacuucuuguuugguuuugguuuuuugagaugguuucuccguguagccuggcuguccugguacuugguuuagaccaagcuggcuuugaacucagaaauuacuugcucuuuuuuccugaguguuaggauuaaaggcaggaaauuucagccaguugucuuagacgccaaaccaucucuucagcccccuuccuauaauuaaccuuuagaaacgacccauauagcccagguguggagauacgcaccuuuuaaucccagcacucaggagacagagaggcaggugguucugugaguucacagccugccugaucuacagaaugaguuuuaggucaaccagggcuacacagagaaaucuugucuugagaaacccaacaaaaacaagcccaaagaagugaguuagacugccucagcugaaggcaaaguccuggguucaggcaacgcucgcuugcaaccuuagauuuucuacugugcagaagaguuggcggggggaauagagaguccccagcugccugggauauguugccagacccauucucaaaaaccaaggauguaggcuaucacucaguggcucagugauaacuucuuuagcaugggcaguguccuuaauuagaucaucaauaucaccaaaaaagaagucuguguugugcugccugcuuguauuguaaucucagccuacacagaccagaugaagacaaaucuuuuuuucuuuuggcguaaaccugguuugcuuggccgacugugugcacuagucuucccuugaguuuuaauccucccgucucauucccaccgguggagaaaguggacaugugccccaggcucagccgggcuuuguaauuagagaauuagaaguacugggauguuuuucucuuuuggggaaaaugguagauguugaguuacuuuuuuuccuguuuuguuacaggcaaaucagagaaggugccgagcugcccuuuuaucuacaucauacggaaagauguggauguuuacucucaaauuuugagaaaacucuucaaugaaucccauggaaucuuuguuggccugcaaaaaauugaggaagaacugucggggaaguccaggaaagcucaguaaguggugggugcugaggcugcagugaagucgugagagggaggcguccuuauccuugugagugccggggcaccucgggguuccuguucuccuguguaucuucuuaggguguaguugugcauuguguaaaugcuguuggaagacuuacuggcuugauauauauguaucaacucuuccuuuuggauuccuacuucauuuguaugugucccuugaacaccaccaccgaccaaaauaaaaauaauauaaauauggugaaaggaagacucagacagagaagcccuugaauuagaucucacucuugaaagaguuaaaaacgaggcugacagaucuuuaagagcugguagucagcagagugaguuccaggccgcccagagcugcagaagcgagacccugucuuaauaugaaagaaauacaggcgucagcagacaaggcaaauggaaaagaaagacuugcuucucaagcuuguguuuuugacaaggaaucaggauuugguuuuuuugcuuccuuuugggguggcggagcucgagcugccuuugagugcccagcugcugagccgugauacugggccagcccuccaggcuacgguuuguuuuuuuucuuuccuauuauucacucuuuuuuguuguuguuguugugcucguuccuugagcucaguaaguagaugagggugaaacuggguuucauacaccuggcaugcacucugcugacuuguguagcccaggcuauguaugugcucaaauacguguguauccuugaguuucugguccucuugccucuacuucucaagcucaggguuacagacacgauuaccaggcuugugguaauucagugcuuggagcaucgagcacugaauuuuagcagaaauugaugcagaagccguggaggagcccugcacacugccauacugucguggcuugcucagucugcuuucuuucuuucuuguuuuuuuuuuaaaaagauuuauuucuucagacacaccagaagagugcaucagaucccauuacagaugguuuugagccaccacguggaugcugggaauugaacucaggaccucuggaaaaacagucagagcucuuaaccacugagccaucucugcagccccucggucugcuuucuuacagcagccaggaccgccagcuucggauggcaccucccauaucaguuaucaacugagaaaauacgccacaggcuugauuacaacaguagugcuuuuaaccugagccgucuuugcaguccagacuuauuuuaaccauguauguguaggugcauauuggugcagguaccugugggaaucagaagaugacauuggguuucuuagaaccagaauugcagccaguugugagccaucugauaagggugcuggguacugaacucugguccuuuccaacaguaguacgcacuuuaaaaccacugugacaaagcuguuuguuuguugugugguauggugugaccacaugaguuuauauguacuggaggccagagcacucagagcuccuggaauugauguugcagcccgucuccugucuuuugauuucucucuuucuagcaucaagauacgguuccaugucaucuuguaugucauuucauuuuuuuuguagauugguucgagugaguaaaaauuaccguucagucauacgggccuguauggaagaaaugcaucagguugcaaguaaggacccuguguguguuugaaguacguuaucuggugcuguuuucuccagaggccuuuaaggaggcugcugugcaguucauaauagguccuuguuuuaaugugugauccauaagcguuucacaugaaaaugggugggugguaaaagaaaccaaggcaaaaaccguauggggcuucugagggcuuaggagaugagcuacauucagugcagguugauugacuuaagguguuuuguauucugcuaguugcugcuaaagauccagccaguggccggcaguucagcagccagguaagguguagcugcuuucauuguauuggcaacaucguguuagugcguagggugguggcuuuguggucccuguugcaggagggcucuccuuuucagguagaucagcagcucuuugggauggcaaguauggcuuugaaaguguuggucaagguuuuagcccaugggaacucaggguuuucauugcuuguggaaaagaugaguccuaacacaugguguuugugaguugucacuugagauggagaaccgagcuucuaggacuacugcuuggucucaugaacucagaauuguugucaagcagcaugugguuauaacucagcaggacuagaaggcgacaucuaggacucuuuccucagugagaccccagagcuuuucuaacucaugaacagggaaaauaggcuuucucugaugggcacaguaugcucucccccuggaacaaggggugauggaggggggugggguggggugggggacguucaucuuccuaaagcaucuuagguugggcuuugcuuuuucgguuguugcagugccuggucuugguuccaguguuguaggugugcuaaguaugcacacuguugcugagcuaugcccucggcugacaugucaccuuuuuaaaacaguuuuuauuguguguauguauguacaagcguaccugugcaugcauguggaggacagaagaagauguugaauguccacucucucugcucauucucuuucuucuugauccugggaguuguguuauuuuggcuaugcuggacaccagcaagcugcagugacccuccuuucuguucccuuuguagcugaggccucagaugugcucaggucuccagcuuguuaucugugugcuaugauccaaacucugcuccugaugugugcacagcagagucuauugacugugaagccaucucucuugcugucuguugcuuugcauucgaguuucaguaauaguuucaguuaaaacuagucuccguuucuucccuaggucuccauuuugucagccauggagcucauuuggaaccugugugagauucucuuuauugaaguagcaccagguaaccccaauuuguuuguuucauguagccucacuuagcccaggcuaacucugucuuagcaucacaggguuccugucguccucuguccuuccuaguugcagggaauaaauagcccucuguccagucagguccucugcuauaaauccacguccgugucuguacuuggguggaguggagaugccgcagaugaagcugagcucuuuugugugacaugagucucuccucagcuggcccucuccuccuucaccuucuugacuggguccgacugcacgugugcgagguggacaguuugucggcagauguccugggcggugacaacccaagcaagcaugaaaacuucugggaccuggugagugugcgcggacggcagccgcccgcccugugcacucugcgcgcugcagucggcugacugggaggaccccugcuccagccuuggcucagcucucugaguuuaugauuguggaguagguuuugcaucuuuccuucucugcuccagagcaguuuaaaacuaauuuagcacggggagcggugcuugguaaacuugccgucguuucaggaggauuuuguuuguaggucugaggaagagagguuauaaggggaccaagcgguugauggggugcacaugagcauaaguggucugagguagaacacucuggggcaacaguucacaaccuguggcucaugcucccaggggauuugcauaucagaugcuuacauuacuauucaugacaguagcaaugaaauaauuccauggcuggaaguuagcacaaugugagcucuguuaaagggucugggcacuaggaaagcugaggcgcacugaggaaggaccuugagguggcauuguagugagugccuacauagcaucugggagaccgaucuccagcaccacaaggcgagaaaggaucuuuuugguuacuuuguuggcuuauuuuguugaauuuauuuauguauuuuaauucaggguuucuuuguguaggcuugucuguccuaccagacuggcuuggaacccacagagauccaccugcuucugucuccuaacugcugagauuaaagguguggccaccauugccccauuauuuuuuucuccaugagacaggguaucucuguguagcccuggcuguccuggaacuacuuugguuugcuuuuugagacaaggucucacuguguaacccuaccggccuggagcucauuucuaaaccaggcuggcuucauaauccuaccuccugaaugcugggauuacauaugugcgcuauauaugugccugcugugccuugauuucucuuuagacggucuugguauauagaucuuuguuaacuuguauuuucugaggcaauauagggaaacucuuucaaaacauaaaauuggucaggggacuggagauguaguuuagugguagaguacuugccuagcaugcacuaguccuuauguuugauucccaccaccacaaaaagaauacaguuggcaaggaauaugugagaaaaaggaaggugggugugugcaucuggugaaggagaaggaauggugcguagacacuuauucaaguccuaaguuuagaugcagaauaggucguuggagauuugagucugucugucagaaggcgauuuggggacuugaguacauaugcucagguguguauguuacuaggagucuuuguauguuuuauauacgcuuacuuguacagucaggucauuguuuaugggcauuagagcugcccucaaccaaacugcuaaacacugaaccauugcacauggcugaguuccacugagccucuggucaccuuaugugcugggauugaacccaggaccuugauagucuaggcaagugcuuauacauggugggaaagcuuuccucugcuaaugagcaucaucccgucauccccaggcccuggucaguguugccagcugggcagaugguagcgcauucuucugguuacaguuacugggugguugaggugggaauaccacucgaccuugggaucggagacagccugggcaguaucgugagaucccgucucagccaaccuuuguuuggauuuuuuguauuguaaagauuaaucaguuucaggcaauggugacacucaaccuuuaaucccagaacucaggaggcagaugcagguggaucucugaguucaagaccagcuuguucuacagagagauuccaggacaccagaguuacacagagaaacccugucuaaacaaaucaaccaaccaaccaaacaaagauaaauguguuuuuagucauaugaguauacauaugaguguauguauuuuuuuuuuuuuuuuuuuuuuuuuuuuuugguuuuucgagacaggguuucucuguauagcccuggcuguccuggaacucacucuguagaccaggcuggccucgaacucagaaauccgccugccucugccucccgagugcugggauuaaaggugugcgccaccacgaccggcgaguguauguauguuauguaugugaacuguaugugugcuaggcagcugugcgggccaagagggugucggagccugugaaguugggguuuagaugauugugaacuggcacgugggugcugaaucuggguccucugcaagggcagagcgcacacuuaacuagugagcuguuucuccagccccaaaaaaguuuguuuugguuuggcuuuugguuuuuuugauacaggaacuugcauggccuugacugccauugagccaagcaugagauggaguuucugaucuuucuccuuacacgcauuugccaccauuuugaguuuucugucaugcuggggaugaccaggaccugguggaggcuuucuaccagcugaugggcauaccuaggccauagcgugguucgguguguuucugcucgcagcaggccccuguguggggccugugucuacuuguugguuugcuuguguuaguaucugguguuuugagagaaagucucacauuguacuggccacucauggcaacuuuucuuccucagcucucaaauacuuggauuacacacguaagccaccauguuugacucucagaagugugugugugugugugugugagagagagagagagagagagaaagacagacagacagacagagagagagaaugaauuggguuuugucuguguaagguggacuuucugacacugagcuauauuucuggccaaacauauauggacaaacauauuguccccccacuguggggcucaaagcagagcuuuguacacacuuaucuaacccuuaauguuucuauggauuuuauucugauugcucugagugagaaguauucucacucuucacauuacuggauggagcuacaugacaguaccaacuucugaguccuguuugccucuugcugggauuauagcuguguacuccacaacucacauguuuacgcuggucuucagcuagagcucaggcccuugaguuugcaagaccugagcuuucccgacugagucaucucccagcccugagcucuucuuuuccauugaaaaguuacuuggcaguuuuauacgugucuauaaugaauuuugggguuggauguauugcucagcgaucaagagcauauauuggcugcucuugcaaagcaccaaguuuaguuggucaccacuuauguuggugugguuggaaguucagcuccucuggccucagaugcaugugccuccccaguuaccuaccuaccuacauacauauauacauacauaaaacuuuuuuuuuuuuggagacaggauuucucuguguagccucagcuauucuggaucucacucuguagaccaggcuggccccaaauuuauagagauccaccagcaucugccuccugagugcugggauuaaaggcaggcaccaucaugcccaguuagaaauguuuuuuuaaauagugaauuuuaguaauuuuuuauuugcuuuuuauuuugggguguguguauguuugagacaggguuuuucuguguagcacuggcuauccuagaacuagacuaucuguagaccaggcuggccucccagucagaucugccugucucuggcuccugagucacaggauuaaaggugagugucgucaccuggcuagaauuuuaguaauuuuccuucuccguccccucucauccucuuucucucccauugaagcccuucucccugacaugucucccucuugcuuuccuaucugugugucugccucacugauuuucauuagggcugcuugcaugaguggguagggggguauuuuccguaguauggacaacuucccaguggcuguacagcugaggaaacugaccuccugcuuugugucuggguuuaguguggacaggugccuuaaagucuucucuguguuuuccauacaugauuuguaaauauuuucucacuuguugguaacacuugacacuaacuugauaauccaacuguccuaguaggguuucuucuuuuuguuguaguuguuuaguuuguuuuucuauuuuuguuuuugaagauacaguuuuucaguguaucccuggcuguccugcccuggagaccaggcuagccucaaaaucacagagacccaccugccucugcuucugucuucuuacugcugggauuuaaaggugugcaccacugcucacacugcucagcuuucuuuucuuuuucuuuuuuuuuuuuuuuaauuuuuaaaauuuuaugaauguaaguacaccauugcugucuucagacacaccagaagagggcaucggauccccauuacagaugguugugagccaccaugagguugcugggaauugaacucaggaccucugaagcagccagugcuuuuaaacaccgagccaucuccccagcccacuacugcccagcuuuaaucagugcuucuauugcugugauaaacacugaccaaagcaaguuugggaggaaaugguuuaauuggcuuacauuucaacauaguuguuuaucagcgaaggaagucagagcaggaaccuggaggcaggggcucaugcagaggucauggaaggugcugcuuacuggcuuguuccucauggguugcucagacugcuuucuuuuuuuuauuuuuuaaaggcuuuuuuaauuuaauauauguaaguacauauagcucucuucagacacaccagaagagggcacugcauuccauuacagauaguugugagcccccaugugguugccaggaauugaacucuagaccucuggacgagcagucagcgcucucucucucucucucuuuuuuuuaaagauuuuauuuauuauuauaaauaagcacacugaagcugucuucagauacaccagaagagggcaucagaucucauuacagaugguugugagccacuauaugguugcugggauuugaacucaggaccuuuggaacaucagacagugcucuuaaccgcugagccaucucuccagcccucagccugcuuucuuauagagcccagggaugacaucacucacaaugugcuaggcccuuucugucaguuacuaauuaagaaaauacucuacgauucgacaacaaaaggagaucaaacuagacaaacuagaaaggaagaagucaaaauaccacuauuugcagaugauaugauaguauauauaagugaccccaaaaauuccaccagagaacuccuaaaccugauaaacagcuucagugcaguagcuggauauaaaauuaacucaaacaaaucaauggccuuucucuacacaaaggauaaacggacugagaaagaaacuagggaaauaacacccuucauaauagucacgaauaauauaaaauaccuuggugugacucuaacuaaggaaguaaaagaucuguaugauaagaacuucaagucucugaagaaaaaaauugaagaucucagaagauggaaagaucucccaugcucauggaucagcaggaacaauacaguaaaaauggcuaucuugccaaaaacaaucuacagauucaaugcaauccccaucaaaauuccaacucaauucuucacugaguuagaaagggcaauuugcaaauucaucugaaauaacaaaaaaccuaggauagcaaaaacuguucucaacaauaaaagaaccucugggggaaucaccaugccugaccucaagcuguacuacggagcagcugugauaaaaacuguaugguacugguacagugacagacaggaagaucaauggaauauaauugaagacccagaaaugaacccacacaccuauggucccuugaucuuugacaagggagcuaaaaacauccaguggaaaaaagagcauuuucaacaaauggugcuggcacaacuggcgguuaucauguagaagaaugcagauugauccguucuuaucuccuguacaaagcucaagucuaaguggaucaaagaccuccacauaaaaccagagacacugaaauuaauagagaagaaaggggaaagccucgaagauaugggcacaggggaaaaauuccugaacagaacagcaaugccaugugcuauaagaucaagaauugacaaaugggaccucauaaaauugcaaagauucuguaaggcaaaagauacugucaauaggacaaaaaggccaccaacagauugggaaaggauuuuuaccaauccuaaaucugauaggggacuaauauccaauauauacaaagagcucaagaaucuggacuccagaaauucaaauaaccccauuaaaaaaugggguacagagcuaaacaaagaauucucaacugaggaauaccgaauggcugagaaacaccugaaaaaauguucaacauccuuagucaucagggaaaugcaaaucaaaacaaccuugagauuccaccucacaccagucagaauggcuaagaucaaaaauucaggugacagcagaugcuggcgaggauguggagaaaaaggaacacuccuccauugcuggugggauugcaagcuuguauaaccacucuggaagucagucuggauguuauucagaaaauuggacauaauacuacuggaagaucuagcaauaucucuccugggcauauacccagaagaaguuccaacugguaauaaaaacacaugcuccacuauguucauagcaucauuauuuauaauagccagaagcuggaaagaacccagaugucccucaacagaagaauggauacagaaaaugugguacauuuacacaauagaguacuacucagcuauuaaaaacaauggauuuaugaaauucuuggacaaauggauguaucuggaggauaucauccuuagugagguaacccaaucacaaaagaagucauuagauaugcacucacugauaaguggauuagcccagaaaacuagaacauccaagauacaauuugcaaaacacaagacaaucaagaagagggaagaccaaugcguggauacuucauuccuccuuagaauagggaacaaaauacccaugaaaggaguuacagagacaaaguuuggagcuaagacgaaaggauggacuauccagagacuaccccacccggggauccaucccauaaucagccaccaaacccaggcacuauugcauaugccaccaagauuuugcugaagggacccugauauagcugucucauaugaggcuaugccaguaccuggcaaauacagaaguggaugcucacagucaucuauaagauggaacacaggacccccaauggagaagcuagagaaagcacccaaggagcugaaggggucugcaacccuauagguggaacaacaauaugaaauaaccaguacccccagagcucgugucucuagcuacauauguagcagaagauggccuagucggccaucacuggaaagagaggcccuuuggucucacaaacuuuauaugccccaguacaggggaaacaccagggccaagaagugggaguggguggguaggggaguaggguggggggaggguauagggaacuuucgggauagcauuugaaauguauauaaagaaaauauuuaauaaaguaauauuuaaaaaagaaagaaagaaaaugcucuuugggcauguguacagccugagcuuacugagauuuuguaaguugagguuccugucccucugacugacuauaggcugugaugagcugacauacccaaccagcauagggcaugucugggagucagcgcuagaagggaggagugcuugcugacuccgggucccggcggccuggagaagucagcacuuggagugcugggccuugugcugcagcucauggucccaccucucucugcaggugacuguucuggugcuucagggccggcucgaugaggcacggcagaugcuagccaaagaagcugaugccaaccccucuugugcaggcaugugccgcguccuuggggaccugaugaggacaaugcccauucucagcguaugugggagcugccuugccuaccuggucuugggagguagggaucagggagcgugugggucugggcagcugagagucucacagccaaccucuccccagccuggcaauacucagacacugacagaguuggagcugaaguggcagcacuggcgugaggagugugaaagacacuuacaagacaacacauuugcagccaacccccgucuggagucucucugcaaggugugggaugggucaggucagggcuggggaccuuccuugggacccuggcaucccaggcaucaaggagcuggcuucuccuuggagagagcuguucagucacuuggcugugaaagagggaacuucuugucuuauugaaacccauggccccagaugaaggggauccuccccguguggacggagcucagacgaugucucuccucagaucaugcugggagaugaggccgccuuguuggagcagaaggagcuucugagcaacugguaccauuucuuagugacgaggcugcuguacucuaaccccacagugaagcccauugaccugcacuucuaugcccaggugacauagugacaguguguguggccuccaugcaucaggaaggcucuuuuacuucaguccuuugggaaggaacuccuuuuuagacaccccacccagcagucuugcccuccccucccccucaagucucggcuucugucuuggcacugacuugguauccccuuuuccacaguccagccuagacauguuucuuggaggugagagcaguccagaaccacuggacaacaucuugauggcggccuuugaguucgacauucaccaggugaucaaagagugcagguaggauaccccucauuuucacuuuuuuugacuuggucucucuacguaccucugacuguccuagaacuuucuauguagaccaggcugaggagggaagggauaggggguuuucggaggggagacuaggaaaggggauaacauuugaaaugcaaauaaggaaaauaucuaauaaaagggggguguccagcucugucuuuaaacucuguagccaccucauucacuccacagugcuuguucuucucagcuuuccuuucacuuucuuuccugggcuuuguuccuuuuuaugugagggcuuguuucacugguuuguuuauaugagugugugcacucuguguguggugguuagugcccacugugagagccucagcucuaggccacagcucuguugccaugacauugacuuacugagccagcagcuuacugucucugguugguuagcaagcucuaggaucuacuucuguccauuccucagugcccugugggaggcauccacagcuccccuuggcuuauuuccugguggggucccucaugcuuguagggcaagcauccuuaugcaccaaccaucuccccagcauguuuuguguuuuugggcuagcuugguacuacugacuguguaggcagguaggcagcagcugcaccacugaaggucugcugguuuguauuuauuguuggauagauacuuguuuucucacucuucuagagacuggaagucuaaagcaaaggugaaaaaucuugugauaguugugcccugcuuuagugauaacacauuguugguuuggugagacagucucaugccaucgcuuacuguaaaggaauucacuguggaggcaggcaggggaggaaugcucugccucaauugguggaaagggagagacauagccuauuaaacuccuuuguaaauuuccugcauuuuauuugugaggaaggacucauucucaccaccuacaggccugucuaucuaguacugcccucagagccacaguuaggacuacccagaacuccuguuugaccguguacaaacagauaauggcuucuaaggaauuggccauuucacugaagugaaauucccugugaagugaauuucacugaagugaaauuccuuuuuugguuuuucgagacaggguuucucuguguagccccggcuguccuggaacucacucuguagaccaggcuggccucgaacucagaaauccgccugucucugccucccaagugcugggauuaaaggcgugcgccaccaccacccggcucaggucccuuuucccuuagccauuucucuguucgacccauuuagucuucuuucuuucuuucuuuuuuuuuuuuuuuuuuuuuuuaagauuuauuuuuguauaaagcauucugccugcauguaugccuccaggccagaagaggguaucagaucccauuacagaggguugugagccaccaugugguugcugggaauugaacucaggaccucuggaagagcagccagugcucuuaaccacugagcuaucucuccagcccuccuuccagucuuuuggcagcacaggauguguggguuuccgacuccucagucaugugacuuugacuucuuucccuuuuugccuuggugucuggauuuucagcaucgcccugagcaacuggugguucguagcucaccucacagaccuuuuggaucacugcagacuccuccagucacacaaucucuaguaaguuggccagaugcacugacccuuucuuacaucaccaggcuuuugaggggggcggccaguagacuaggagcagguaggcugcaggagccacaaagugagugggcaggcuugcaguccuguguuguuguuuuuuccccaguuuugguucuaacaugagagaauuccuccugcuggaguacgccucaggacuguuugcucaccacagguaggaggaagccccacugcuccgugcugguucagagggcugaggaggaugagcgucagguggcaaugcccagagccauagggcaaccagguagccucucaccaucugcauuccuuccaccauagccuguggcagcuggggguggacuacuuugauuacugcccggagcuaggccgaguuuccuuggagcugcacauugagcggauuccucucaacacagagcagaaagccuugaaggugcugaggauuugugagcagcggcagaugacugagcaaggugauaaggcacuucccccaaccuguccgcugggcugucagggcaucccuaggcugagcagugcuuacucugugacagcucgcuucugcauacuggagagacagugugcaguacaugccaagacaucagggagggcaggagagccugcugggguuggccuuugaaacaggaaaauccggcccuuugacuuuagguucucagagccuguggucagagcugagaguccuauguaggugggagguugcuaccagcaaagccuggaccaguggggaagcuuggcaggagcacacagcgauaggaauaggugucaacagcuuugugccauccucccacugcugcugaaugagagucacuugcacacaaaggaagaugagauuuguguggucucaggacagauaacggugggacuauuaauguggaggaaaaccaagaucuuuuuugccacccaaggacaaacacucagaaagccagucuagugagugggucaucugugguaugagcaaaggaaagacaaagaauaaacggaaguuucugguuuucucacuuagcuguagauugaguacuuuagguuguagugaggcugucggaaggccgagccuguccccacagggcuuuucacaggaggauuauaaggugugagccuuugcccuuuguccuuucuccugcaaguuaaaagcaucuguaagaucuuggccaugaaggcuguucguaauaaccgcuugggcucagcacucuccuggagcauccgugccaaagaugcugccuuugccacacucguaucugacagguaggugaggcuuugugguuggcuggagcuugaggugggccuaggauugcugcucucaucuuuggguugggcccugcagauuccuccgggauuacugugagagaggcugcuuuucugacuuggaucucauugacaaucuggggucagccaugaugcucagugaucgacugacguuucugggugagucuugucauucuuuccccuggguauuccagaguggacacuuggggagauggacagccagccuuugcauguguuagccuuugcauaguuuaguaacauuuuguuucccaauaauuccaaaauuagggaaauaaauagcaugagaaacacauuuuauauacacuuuucauacucauuuuuugaagacaggguggcacuguguaccucucuggcugcccaggcuagccucucacacagagaaguuuuuuagcuuucccuccccaaggcugggauuaugagccuggaagaguuugguaugguauccauguccaauucccaucaugcuuccaccagagauuuuuuuguugcuugugugagcuggcaguucacugcaggaagagauuagugucucagacccucuaccucauguacaucaccaggauucguggaguauuuuaaucuucuuaaacuuuuguuuuguguaugggugcucaccacauauuggccugguguuugcagaagcuagaggagggucccaugggacuggaguuggucaguugugagcuggcauguggguguugggcauugauucaugucuucuguacaagaagagugaguacgauuagcagaaccaucuuuccagcgcucuaacugaucucucacugcacuacugacacuuccccaaggcuggugcucauaaaaauccuugaauccuaccuuucauugauuugugaacuugaaacuguucuagaaacaguuccagguauauggaguccuaguuuaaagccaggauagcuuuucuaaguaucagguaaguagagaggaauuuugaggugaacucacaccccucaacaggaaaguaccgggaguuccacagacuguacggggagaagcgcuuuggugacgcugcuucucuucugcugucccucaugaccucucagauugcaccucguucuuucuggaugacucugcucacagaugcccuuccucuuuuggaacagaaacagguaauacuugaucacaucugaccuaucuguucugugccuuugguggucuuccucagcuggcuucugcagccauacagaagcucauuuacgccuaagcaguaccguguacacguguccaaggcucgagcaccaauccacuauucauuucagaacagcuggaagaugccucacuagagggauggauguaagacuuaggagcauaccagcagcccagggcucuguaugcaaauauuucucccugaagacuuuggagcugugccuguggagcagcugagugacgcagccucuuuccccuaggugauuuuuucagcagagcagacauaugagcugaugcggugccuggaagacuuggccucagggaggccagaguguggugaaccugaugcccagcgacugcaggucauuuuaacuccugggaagaugauuguguugaaguggggaaagauuucugucucaggauuuccucccauuauccugccaucuugaaacauuagccuuuuuaugaauucaugugccuuuuagcuauuaaccuguucuguaacaccaacuuuuaggagcaagucuucccacugcagagccaaacuuaguaugcuauacuggucauauucugaacuguaaucguagguucagauggcuccaugcucuccuggaaugcugccuguugcuccucacacuguuuuucugcucuuuaggaugacgacauagagaccaccaagguggagaugcugagacuggcucuugcccggaaucuugcucgggcaauuauaagggaaggcucacuggaggguuccugagagaagaugaggacaguugcaauauaguaacuuuguauggcaauguaaauagauuuuaaagaauaaauuguuuugcaaauauaagaccaauuguuaauccuaccaaggagguuuuaaaauugucuauucugaaccugacauugcaaaaugaacaauaguugccu

SEQ ID NO: 6486 - RNA, 5469 nt, Mus musculus
cagggcgggggcggggcccgcaugggggccugagcgcgccgagggcugcgguccacgggcgcgccggaccgcgucggaggccgcgagggcgaggaugugucuucgcuucuuccucagagggaaccucugaagggaaacccacgcccgaggaaagugcgcaggcucucauccguguccugucgcucacucacgcaggcgcgcugugggcagcccuccgagguccugacagcggccaagauggcugcccccgcgcugcgcgcuccgcuucgcugguccgggcuggcccugggagugaggugcgccgucuggaaccuuccagggugagaaggcagcgcguagccgggaccgccgcucggaccuucacgggaggaccuggggaaaggaaagaagccgcaggcgagcugcgcugaguucuggcgcgggagggcacuaacucggggcgccgagauggcugacuccagccauuaaacgggccgguuugggggcuuaguacccuguccuaugccugacaggccgggaugaccuagaucgguucuacccggagccgagagugcggcccugcuagagaucggagaacuggcuugcgacggaacaguggccaguuucggggugggggcugccuaccucuugggacaagggucagaacugcugucagguuagcaggcggucccagcgccaccgucccucgucagcgugauggcacuugcggcuuacuguuaagucaagcuuguucacuuuuguggagucacagauucacccguaggguucugucugcuuccuccucgccccacucccaggcucacacaggugagggggagccgcuaugcccccgaauuccgggagcccuugauugacaaggaauauuaccgcaagccgguggcggaacucaccgaagaggagaaguaugaccaggagcucaagaaaacccaguuuaucaaagcugcggccgcgacugaaaccagcucgguguucgcagacccggucaucagguuuggcgcaaaugcuccucugcugugggcuggaacucaccuggggcaguuuucugcugagggauccggaguacagcccgggaaagcuaaccauguuuuucuccuugaagcaaauucaccaacaugaugaugaagggaggcaacaaaguucuggcccggucucucauggcucagguaaggccgcuucuuccucuucagcuugucuuucuuuucccucaggcuuggugucugcguuuuacaccauggcuucaaaacuagaaaacagguuucuauuccugccauuaaaauuuccaagaucugagauugguggugcccaccucaaaucccaucgcuggagaaggcauuugaauccagcacucgagaagcagagauaagucaggccugcuugagcuacagagugaguucuggaacagagcuacuuagugagauccugucuuaaaaacaaucaaaacagagccagagguaggcagaucucugaguuccagacagccagagcuguauauuaagauccagucuuggggugggguggggggacaaccuaacaauaaaagaggcagaguugggaaaaguuugaggccaggauggucaaaagcuaguuucaccccggccagagcuacacagaguccccagaaguuucccauucugucaacauuaaaaaaaaaaguucuugccuggguggugguaguucacacuuuuaaucccagcauuugggaagcagaggcagguggaucucugugaguuugaggccaacgugaucugcacagugaauuccaggacagccaggacuacacaggaaaacccugucucaaaacaagaacaaauaaucucggccuguucuuggggucauggucuagcagagcaggaggcacuuaaacucuggcuuuccugaaagagggucucguggaacacagucuagccugagcuugcugugcaccugaggauaaccuucaccuccugacucuccugccuccagcgccccgugcagucaugagugugcagcacucccaggugagcugguuaaacuuagggcccgagcagccucuuccgucucuugcagacucuggaagcugugaaaaggaagcaguuugaaaaguaccgugcugccucugcggaggaacaggccaccauugaacggaaccccuacaggaucuuccacgaggcacucaaaaacugugagccugugauuggguuggugccgauccucaaagggggccauuucuaccaggugaguggggagccugugugugagacgggucggggugggagugugugacgggagugcccagaguuaggccaaguauaauaacccuagaaauuggggacugucagaaucugcuugucugaggcccaccguguaaaugccauagguagaggacaaaauguccaguguccuguguagccuaagcuuugaacucuugguaaaggacugugcuuaccugccauugucugggcuaguccuggacccaugaccaugcaucaucacugaacugaaguaguggucccuaucucagcgguuaacuacuuaauauuacucuauuaggucauuuuccccuuuaauaucagcagcuaagaccaggggauuuuuuucccggugucuuugguguguggccugaagugggugccaggcaagcgguuccuguacugcauucuuaggcaccuuugaucugaaguagcuggcuuggcucaggcagcaggauuuucccaguugcugcuuaugucaacucgacaaagcuucugcugcugaaggaaagugcucaguguuuauuacgugaauguuccuuagacacagguuucugagauacaagaaagucagcucugugcucagggcccauccuagaaauagcacagagacaguacaugguaacucugucaggcgcaaaucaacuucagcuugccucuguccagguccccgugccucucgcugaccgacgucggcgcuuccuggccaugaaguggaugaucacagagugccgagagaauaaaccgcggcggacacuuaugccagagaaacugucacaugagcugcuggaggcuuuucauaaccggggucccgugaucaagaggaagcacaauaugcauaagauggcagaggccaaccgugcccuggcccacuaccgcuggugguagcaggagaggagaggugggaaaggacacacugccacgagaaaccacccgacggcuggagagguggcucagugguuaaaggcacucacugcucuuuccaaaggaccugguuugauucccagcacucacacggaggcucacugaccaccuguaacuccuguuccaaagguuucgauaccuucugaccucugggcaccaggcgugcacaugguauacagacauaggugcagacaaaacaucuauacguacaguaccacuaauaaauguugagcuccugcuguccuguuggaaaguucuggaaguuaaggacggagagugcuguuuguaaugcagucuuccauucugugagucuuugauucuccaugcuggcuagaaguuggccacaacuugagcaaaacugccucucacacagugagaugcacucaaaggaccacguguuaucugguaauccaaauugguuccccugcucccccccuccaaccucucaaagacagaaugugucucagagauuuccugcaagaaacucagguccaaucuggacuagaauaaagaccucuggggcuggagagagagcucagugguuaagaguacuggcuguugggguuggugauuuagcucaguggcagagcacuugccuagcaagcacaaggcccuggguucggucuuuagcuggagggggggggggggaggaggaguacuggcuguucuuccagagguccugaguucaguucccagcaaccacaugguggcucacaccaccuguaaugggcucugacgcccucuucugaugugugucugaagacagcugcaguggacucauaaguaaaaagaccucuuccuuuggcuugggguacaccuuuggaugcuauggaaauacgcaguuugguuucagaaaagauuuauuagaaaacccucaccccaaccuggugaggcagucacucaugacuggaggaaacaggcuuccuccacaaaagucucucuauaaaauauauaaaacaccauuucuuguaacuugcccuuaacaucccaaagcauuccaccaauggcuaaaauugcccauuuuauagacaggaaaacugaggcaccaaggucauguugcaccaguggcuacacaguucaguguuuguuaguugguucuccccugucaggcccaggaggaagguggugggaagauaacaggacuugaggggagaggaagacagucagucuucagccaggagacaaguccagauugagggaagggaagacggcagaaccacagcagucaaaaaagucuagaaggggcugaagcaaggauucuggugccagcuugaaaagagggucacgggaaggcaugugcagaccugggcuuagucagagaccucacuguaguaauacuugugggcagcaggaguggucuuccagccagcugcccggaacucaaucaucuccagcagcagcagccgugccagggagcugaggucugucgggagcaggaagccgucccggauuaggauaaagagcucauccaugcgcugcccguucaucuucuccagcugcuccccgacccggugcagcugcagcaccaggcaguccaccugcaggggcaguggcaaggccuacucagccagagggaggagcagagcaacauggcacaaggaggugacagcaccugcugaguaccgcgcuccauucugacaccaaggggcauggcccaaaucuuaccaaaaggggcuuuccagaacauucugaccaggcugaacuccaaaccaggccugccuccacaaacggucgcuuaacccucuuccauauacccgacucugagaugauuucugggccaucugugcccacagcuggccacagcuuuugccauuccuaguacaaggcuccaauagugaagccuuggccucuaugugcuggauaaauuccagccacuguaguuugucuagugaugccuacaggccuuagcugucccugccgagcaccuggcugaggagcagugcccuccauggcugggcuccacagcccugucaacagucacucaccuccucuucccugcucagacucucaggcugggccagcuggaagagacagucauagacaggguuaaccagggccaucaugggcauguuguucaccuguggggagagcaaaggcggcggggggagcugcauuggugggagcugcagucaggagggagcaaaucagccuuggccuugggacacaggccuucacugcugcgcaggugacuucccuugccucacccucagguagucaaagauguugcagauaaaggugacauagcagacccagcccugcagggagcaugcucggagcugcucccgcgcaucauacuccuucugcagccgguugagga

SEQ ID NO: 6487 - RNA, 5469 nt, Mus musculus
uccucaaccggcugcagaaggaguaugaugcgcgggagcagcuccgagcaugcucccugcagggcugggucugcuaugucaccuuuaucugcaacaucuuugacuaccugagggugaggcaagggaagucaccugcgcagcagugaaggccugugucccaaggccaaggcugauuugcucccuccugacugcagcucccaccaaugcagcuccccccgccgccuuugcucuccccacaggugaacaacaugcccaugauggcccugguuaacccugucuaugacugucucuuccagcuggcccagccugagagucugagcagggaagaggaggugagugacuguugacagggcuguggagcccagccauggagggcacugcuccucagccaggugcucggcagggacagcuaaggccuguaggcaucacuagacaaacuacaguggcuggaauuuauccagcacauagaggccaaggcuucacuauuggagccuuguacuaggaauggcaaaagcuguggccagcugugggcacagauggcccagaaaucaucucagagucggguauauggaagaggguuaagcgaccguuuguggaggcaggccugguuuggaguucagccuggucagaauguucuggaaagccccuuuugguaagauuugggccaugccccuuggugucagaauggagcgcgguacucagcaggugcugucaccuccuugugccauguugcucugcuccucccucuggcugaguaggccuugccacugccccugcagguggacugccuggugcugcagcugcaccgggucggggagcagcuggagaagaugaacgggcagcgcauggaugagcucuuuauccuaauccgggacggcuuccugcucccgacagaccucagcucccuggcacggcugcugcugcuggagaugauugaguuccgggcagcuggcuggaagaccacuccugcugcccacaaguauuacuacagugaggucucugacuaagcccaggucugcacaugccuucccgugacccucuuuucaagcuggcaccagaauccuugcuucagccccuucuagacuuuuuugacugcugugguucugccgucuucccuucccucaaucuggacuugucuccuggcugaagacugacugucuuccucuccccucaaguccuguuaucuucccaccaccuuccuccugggccugacaggggagaaccaacuaacaaacacugaacuguguagccacuggugcaacaugaccuuggugccucaguuuuccugucuauaaaaugggcaauuuuagccauugguggaaugcuuugggauguuaagggcaaguuacaagaaaugguguuuuauauauuuuauagagagacuuuuguggaggaagccuguuuccuccagucaugagugacugccucaccagguuggggugaggguuuucuaauaaaucuuuucugaaaccaaacugcguauuuccauagcauccaaagguguaccccaagccaaaggaagaggucuuuuuacuuaugaguccacugcagcugucuucagacacacaucagaagagggcgucagagcccauuacagguggugugagccaccaugugguugcugggaacugaacucaggaccucuggaagaacagccaguacuccuccucccccccccccccuccagcuaaagaccgaacccagggccuugugcuugcuaggcaagugcucugccacugagcuaaaucaccaaccccaacagccaguacucuuaaccacugagcucucucuccagccccagaggucuuuauucuaguccagauuggaccugaguuucuugcaggaaaucucugagacacauucugucuuugagagguuggagggggggagcaggggaaccaauuuggauuaccagauaacacgugguccuuugagugcaucucacugugugagaggcaguuuugcucaaguuguggccaacuucuagccagcauggagaaucaaagacucacagaauggaagacugcauuacaaacagcacucuccguccuuaacuuccagaacuuuccaacaggacagcaggagcucaacauuuauuagugguacuguacguauagauguuuugucugcaccuaugucuguauaccaugugcacgccuggugcccagaggucagaagguaucgaaaccuuuggaacaggaguuacagguggucagugagccuccgugugagugcugggaaucaaaccagguccuuuggaaagagcagugagugccuuuaaccacugagccaccucuccagccgucgggugguuucucguggcaguguguccuuucccaccucuccucuccugcuaccaccagcgguagugggccagggcacgguuggccucugccaucuuaugcauauugugcuuccucuugaucacgggaccccgguuaugaaaagccuccagcagcucaugugacaguuucucuggcauaaguguccgccgcgguuuauucucucggcacucugugaucauccacuucauggccaggaagcgccgacgucggucagcgagaggcacggggaccuggacagaggcaagcugaaguugauuugcgccugacagaguuaccauguacugucucugugcuauuucuaggaugggcccugagcacagagcugacuuucuuguaucucagaaaccugugucuaaggaacauucacguaauaaacacugagcacuuuccuucagcagcagaagcuuugucgaguugacauaagcagcaacugggaaaauccugcugccugagccaagccagcuacuucagaucaaaggugccuaagaaugcaguacaggaaccgcuugccuggcacccacuucaggccacacaccaaagacaccgggaaaaaaauccccuggucuuagcugcugauauuaaaggggaaaaugaccuaauagaguaauauuaaguaguuaaccgcugagauagggaccacuacuucaguucagugaugaugcauggucauggguccaggacuagcccagacaauggcagguaagcacaguccuuuaccaagaguucaaagcuuaggcuacacaggacacuggacauuuuguccucuaccuauggcauuuacacggugggccucagacaagcagauucugacaguccccaauuucuaggguuauuauacuuggccuaacucugggcacucccgucacacacucccaccccgacccgucucacacacaggcuccccacucaccugguagaaauggcccccuuugaggaucggcaccaacccaaucacaggcucacaguuuuugagugccucguggaagauccuguagggguuccguucaaugguggccuguuccuccgcagaggcagcacgguacuuuucaaacugcuuccuuuucacagcuuccagagucugcaagagacggaagaggcugcucgggcccuaaguuuaaccagcucaccugggagugcugcacacucaugacugcacggggcgcuggaggcaggagagucaggaggugaagguuauccucaggugcacagcaagcucaggcuagacuguguuccacgagacccucuuucaggaaagccagaguuuaagugccuccugcucugcuagaccaugaccccaagaacaggccgagauuauuuguucuuguuuugagacaggguuuuccuguguaguccuggcuguccuggaauucacugugcagaucacguuggccucaaacucacagagauccaccugccucugcuucccaaaugcugggauuaaaagugugaacuaccaccacccaggcaagaacuuuuuuuuuuaauguugacagaaugggaaacuucuggggacucuguguagcucuggccggggugaaacuagcuuuugaccauccuggccucaaacuuuucccaacucugccucuuuuauuguuagguuguccccccaccccaccccaagacuggaucuuaauauacagcucuggcugucuggaacucagagaucugccuaccucuggcucuguuuugauuguuuuuaagacaggaucucacuaaguagcucuguuccagaacucacucuguagcucaagcaggccugacuuaucucugcuucucgagugcuggauucaaaugccuucuccagcgaugggauuugaggugggcaccaccaaucucagaucuuggaaauuuuaauggcaggaauagaaaccuguuuucuaguuuugaagccaugguguaaaacgcagacaccaagccugagggaaaagaaagacaagcugaagaggaagaagcggccuuaccugagccaugagagaccgggccagaacuuuguugccucccuucaucaucauguuggugaauuugcuucaaggagaaaaacaugguuagcuuucccgggcuguacuccggaucccucagcagaaaacugccccaggugaguuccagcccacagcagaggagcauuugcgccaaaccugaugaccgggucugcgaacaccgagcugguuucagucgcggccgcagcuuugauaaacuggguuuucuugagcuccuggucauacuucuccucuucggugaguuccgccaccggcuugcgguaauauuccuugucaaucaagggcucccggaauucgggggcauagcggcucccccucaccugugugagccugggaguggggcgaggaggaagcagacagaacccuacgggugaaucugugacuccacaaaagugaacaagcuugacuuaacaguaagccgcaagugccaucacgcugacgagggacgguggcgcugggaccgccugcuaaccugacagcaguucugacccuugucccaagagguaggcagcccccaccccgaaacuggccacuguuccgucgcaagccaguucuccgaucucuagcagggccgcacucucggcuccggguagaaccgaucuaggucaucccggccugucaggcauaggacaggguacuaagcccccaaaccggcccguuuaauggcuggagucagccaucucggcgccccgaguuagugcccucccgcgccagaacucagcgcagcucgccugcggcuucuuuccuuuccccagguccucccgugaagguccgagcggcggucccggcuacgcgcugccuucucacccuggaagguuccagacggcgcaccucacucccagggccagcccggaccagcgaagcggagcgcgcagcgcgggggcagccaucuuggccgcugucaggaccucggagggcugcccacagcgcgccugcgugagugagcgacaggacacggaugagagccugcgcacuuuccucgggcguggguuucccuucagagguucccucugaggaagaagcgaagacacauccucgcccucgcggccuccgacgcgguccggcgcgcccguggaccgcagcccucggcgcgcucaggcccccaugcgggccccgcccccgcccug

SEQ ID NO: 6488 - RNA, 1382 nt, Mus musculus
acagcgugugagucccuauucuuaacguagguggaccugauugucauuucuugcugcuagagaguaauagaguaauuauugagcaccaaauacugugccaggccccuuaaaugcacuacuuugacauaauucucaugacacugcugugaaaucucuauugccacauccauccuaagggcgaguagccgaagcugaaaaggacaaacaaguuaccaagaucacucaguguuugauacguguuagagacuugaacccacagguguucauuuaguuugacacuuaggcucuuucacagugagcuauaggcggagcuggcccuuuaaggcuucugcuccugauuucaggucagguguuaagaacggucuucuuucagaaacccauguauggaaugaugggaauacagagacucuuagaaaaaugucauguuccuggcugcccucugcacugccgguuccagcuggccacaguuaacuucccucugguuguguuggcagaagaagguaauaggaacaauccccuucuggguccuggugacucccgcugugcgcuuaauaccuuauucagccccugcagggguggagcgucacggguuccucagccauagccaugaucaggguucaggcugccuggucaggguggccuugggcaggagugauguggccucuaaggauccaauuucaguuggcugccagagacugaaugucacugcguugcaaggccacuuccagcaucacugucucugaccccuccggaauggcucagcucugauuggaggugcaggcugaaaagaaggaguggggagagacuuggcagcauggcaggugacaucagcuugggucccgccuugaggaauugggugggauuugggaauggaguuggugucuucagaccugggcucuccggccggcccucuggacauagauuuuuaauuguuucuggacagcucuuuuaugggucagcucuccugggccucugauuccucguaauaagguuggcugcaggcccccccgagggaacugcccucaucagcagguuagugcuuucugcaagaggaggcuucuggcuccaaaccagauuacucagugccacucuuuacugagaacaugcccugaucugaaauugugcaagucgagcuggcugccaggauggaagagugagggucggggcucagguggggucaggcaggcugcugaggauccaacccagggcagagcacacacgcuaagccuguguccugucacauguacauuccggcccccgcgcugauugcauuucccacauaccuguuugacauuugucacgcugguugucaggguggcuggcugguucccugcagacuucugcccaaggugccucugucuagaacugcugucacccacaca

SEQ ID NO: 6489 - RNA, 6306 nt, Mus musculus
uaagagagggagccgucuggggauccagagagcagaguggaccucuaggcagggaaaggcauagggcgugaagggcaagucaagcucaggggaggacucccugggcuccuccucacaacuguaauuugacaccuagaucuccaggacaaccaacaacaaaaaagcugaagcgaugaggcgcugaagcuggacagcagcuggcugucagcaaccgggagcuagcaccaggaggugcccgagugagaagcagccgccuaggcaggaaaguggcagcgcuggugaagaagucaaaggugguggccaaaggacuuccaggagguacauagaggcucuguacugggacaccucuucgaggcuccccacuaucugagcucccagguaagagacacuggcuagaggugacaggaucgggaaaggagggcagccagggucucguaucucuggcgaggagucacagcuuagcaugagcucggagaggaacgucuugggggauauauuaggccacucuccuaugggaauuuagucaccuccucuguguguauaccugagugcucuuccccugggaccugguacuagagaagggggauguacugcuacucgguguguggcacaggggcugggggcugcuggacacauccauuuaaaccuuuucuauucagugaguuuaggauauggcccccaaucuugcugagccuccauuuccgaaaggauuagggcugagcccucccugguucucaagaaggcucaggacaaggugugcccagccugcugaauggccucuggccccaggagcugguagagccagcagcagaacugccuacuuggaugcuggacaagagcagcagcuuuccugucuuuuggaguucugaccugcucaccgcugugugcuuccggcucaggaucauccuagggaggagucucugcacccacuuagauuaccaggaccccugauccuccuuuggcaaugaucucugaaaacugagccagggauaugcacccuaauucaaaccccaaguuuggaaaggaguuugugacuacaugaaugaguuuggaaaagaccccagagucucuuccacacuaacuacuguaaugguugcccccagacagcucuucucuucaguccuugugcagggcaagcacaaccuucuugggcagggccucacgagaggaggcugcuaagcccuucugccuccuguccucacacugggguucaaguccccgugagacgucccuuccaaagcaaacacacuguuauccaguaagaaagaaaaacaucauucaguuuuggaaaccaaggggagggccgagagucucuuuggcucagcagagggggugcacucugguuugugugggacugggaagcuaacuccugugguaauacuaacaagugugcaacagagggacugcacugcagcugagccacaucugggacacacaggcuccagcagucccugagcucagagggaggcccagcuucuauggcugcaggagaggagcucgcuuaguuucuauuggccaccagagcaggaaguucucuccauugucuagaaaacuuggggaccagggcagcagaaccaccaaggcuucaagcacccacuuuugacuccaaaccggagccccagcacugauggaguugcucaaacacucaacaggcacagugggcaucucugcccugcugguuaggcucugaccucucaggucucucacaucuguugguuaugucucauucgagaugcuccucaacggacaaaaggggcugagagcccccaugacucuuaucaggcacagacacgcugcuugcccucauccguguggggagcuggaguuggaugaucaaguagacaaggaggaaguagagaaacugugggaccaagcuucugcugucuggccuacaggacacuuacuauauagcaagaaccuccaugucccaugccacacccaggaacacuaaucggucccccagcucggccaguuuccuucucuguugugcuagcucucugaucacugccuguggagcauccacagaagguuccaaaucugcugcacaagcggccugggcaccagugggccucaguggcagccaagccuguucucccuccuggaccagagaaagcuaccauuuguucuaccaaacauagcauuaagagagacucuaguucccccagguuuggggcauaaagucugguuuagaaguaauuggacaaaccugggacugaucguuuuggaaacacaaaauuaccaguagcuuugcuuggcuucacccaaaccuaggguguauccagucaauggggcccagcuccagggcucccucucccccugaccacggcuggggagcaagguuauauugggcaccgagugucuguuggcucugcuuuaaauagcccacugggaagaugccuggagaccugcuggaaugugccucuuuccucuuuggagaacaagaccccuuugcuccccccucugagaugugcuuguuauguugggucagagcuuaaaauaacaaaacacuaacugccaagcaaagaggguuccucuucagcccuuugagggcagagagccauacucugcagccccguuucugcugguaacacagacaagagcuaacgccccaggucacaucccaaggcuggcauagguggccacguuccaccgagcuuccaguggggaugacuauagaagcccugggcacaaaguuaugaggcugcucacaauaggugguccacguucuuacagagaagagcucaggugcccggggcacaggucugcaguucuccaacuccacaagccaugcauaaugcagagaggaguggggaaaggcacaagggaaaacacgagagaagcugggaguaacugaccaacaaagccugacugcccugcauagcaggcccagccccagccuccugccuucuuccugcucugggaauugacacugcuagacccuucagcuaggccuagggucccaaccccaccaacccugacagagcuggugcuucuucccccccuaaccgccauuucucuuuaggucuuaggguguggcacacaagugagaaagcucuccugaccaccaacuccugccugcuucugcuuuuaaggagugucuccauugggcuugugaggcaaugugggcacagugccagucagacugaacaagccagaccaaacauagaugaagagggaggguaagaaacaacagcccugguucugaaccuuaugcacacuauuucugggggggggggggggggggcaggaguguuacagaggucccaggguaggagggcgaauacaucacuguccuucugcaagcauguuccaacuggcuaggggcagcaucuccuuuguucucaccagaaggaacggucuuagguucauaacagcaggacacacagaucugugccuuuagugacaacacaugcaguucucauaaagccuggugugccccacucugguggugaugaacugauaaaaaccgaugccccaggcccacaaaaggcaggcgguauugacugugcucagcccaugggcuuccaaauagcuacagccugguucuugcacaaagucaggaaggccucuaucaagagcauaugggcagcaggaggggcacuggcuaggcccauccuugucuuuccuggcacuugucaggccccacccagagagaguuccaggagccaggccccucccuagggcuucuccucuccacuacagcagagauaaagagccuguccaugcacaggagggggagggguugagacagcaggaucguggcaguucuacgagggcagaaguuagaggguaccacaugacuggaguguagcuccacggcacaguauuugccugguuuaagaaaggucccagaguccauuccccaguagcacgaaaaggaaaacuaaacacacaacaaacucagagaaagcaccaugugcuuuacagaaaggaaguccaaauguuuggcagcugugguccaguuccugaagaacuguuagggaagaagggcagcagccggggccuacucgacuaaggagacguggaggagguccgaaagggccuggccuucuacacugggcagcuacaggcaaccaggccucucacuuucagaggcugcacaacacacaggcagagagcacacguguaggaugacccaaucacaugaccuucagaguaguuuuagaccagcuaugugccaggcaggaguaaugggagugaccagugucacacaucacagcagaaggaaccaccugcuugguugagaccagggccaagguagcaaucauugaagacuggucaccugccuccaucccucaggaagaaccaguuuggacacacuggcacaagguugucccuguucucacucacaggacagauguaaggggaggaggcacaccuucaaagcaaacucugcugagaacuuugccuaggcucucuccaggagcccuggaccgucaccacucuacacacaggucuuuucugguuacaacugaacagguccaggccaggaggggaagaguugguugagccaguccuagaacuuccccucccaucuagauaaaugaggccuccaggggauaccgcguggucccuucuugcuuacacgacaguaauaugagugaagacacuggccugggaggagaagggggguuucuuggggacucagcuucauaucauucaagcacacaaccccucacucuacagcugauuccagcuagaguccucaugaaccuguucuuggagucugauucuccuccuacacagaauccuaagaccugucuuguuccccggagggcaucuaggggaggcaccugaaaaacaucagaggcgggccaggaagcugugucagcugaggcaccccagcaaaaccuggugcugcugucucaagacaaaggaaugcaacaguauaaucugaccaucugaugcucagaaccuuaccugacagccccuuagaggcucucuccaggucacaauuaucacaagguucccuugccggggcggcuccaggcaggugugggcugagggcugccacugagcagacuuccaugacucccugucucccgcugcgcugccucggaugcacccgugguacagggcugaaacagacaaaccuguucugcaggcuauggugggagagguuguucacuggagcuaccucccagccagcgagcagggacucuaggcuucucacugucucuguuguugcagaccggcaggagcccuaccaccauggcagccacagacuuugugggggagauucgcucugugggagagaggcugcugcugaaacugcaacaacucccccaggcggagcccguggagcucguggcuuucuccaucauuguucuuuucacaggcaaguggggcaucuguccugacccuuagcucugucccuuagugucccaauaccugggagaccaaccauggugccagcuggaaggcuggcgagucuccuucaaagaaguaggaaaagcagugucccagaggaagcuaagggauuugccauauccucugacacugccuaaguugcuaggcagugcuggggacuggaaaccaccaggugucagccaugaacugaaaggagucaaaaagagucacgagguaguggagcgugacaacaggccucucagccucuccaguccuucagggguggggaggagggagggucucuagaaggaggguggccaucacuucugucccuggccuuucagcucugggccuuucucucccuucagcuacuguccuggugcuggggcugauagccugcagcugcugcugugcucacugcugcugcucugagagcagacagcggaagaucccggugcggcccacaaaacccagaugagggacaacagcgagcugccuggagagaagcuggacaagagccuuccaggacuguaacccaggcuauuaccauggccacuuuacucuucuagacaaagguuaccuggccccaguuguggcauuucccaggugacaggacagacaucuggagucuuaucaaggaaacaaguguugccccaucugccggggacacggggcucuguuggagcugaugguuucacacucagaccaccaccuggggcaucugcuaagcugacccuuuuaagggucccgcacuucaauagggaccagcucaugcuugucaggagcuggcuccugaggcucugcugaccuaugccaaagagaaguaagcuagcgagggacucugugcacuuuaucagacuccaggccuccugcugagggggaggaacauggcagcauucugguuaaaauuugucugcuuauuuccaaguaaacacuuuuugguuauguguuuaugag

SEQ ID NO: 6490 - RNA, 5858 nt, Mus musculus
cugagccauacagcuuuguuuuaaucagguuuucaggagagaaagaagccauuuccuuccccucccugccuuuucuauuggcagacuccuauuuaacccuuccuguaggagccaccucuggcucugguuggugagccgagccuuccugucugagcuucuggagucagggcaacugcagugcauccauuguggccccaccaacuuccgcucauuuuccagcuaagugcagugucuccaucccuggcugggccucgagccugagcaagggccccggccugguccacaggacacaacuggaggaaauguacugcucaugggauuucuccagagcgcuccugugugggagccggcuacagagcacaguggcaauguucacacaguacugacuuuuuguggcgucacuaagucacagggcuguccuccacacgucccauucaugccucuuggggagccuuugcggguggguggggagaggauugagacaagaccucgugcagcucagguuggccuugaacuucugaucgauccucuugccuccaccucccaagugcagugauuacaggugugugccgccacacagagccccuuuugguggcuguucucaggcucccaggagggcucccggggugacaccacagugaagcaguaguguggccuggugguucagaacacuuugcuggcuauugugagaacuaaaugagaucauuaguagaaggccuuaccauaaaaccuaaaugguuccccacuaucaauuuuuuuuuuuaauuuuagccuggcugcuuggccuguugucugugacagaauaaaucuucagugaauuauuuauggaauaaguaagugagcuagcuguccaguaacugucuuuugcuacuuacggcuuuguucuuuaucuguguagguuugccuugaggcaggguuuugcuaguuacccagacuggccuuacaccugcgcuaaagugacuagccuauuaguguagguaggacuucugacaagugccaccacacccagcuuaaucguguccugcuccccaccccggcuuugucucaggauuuaaaagcauuagguugaauccugagagaagcugcaggauaugauacggugguacaggccuagauuucuagcacuccagagacugaggcgggaagguccguaaguucagaaguucugggcuaaaaaggcaagacccugucuuagacaggcagaaaagguguagagcaagaagugaccuuuagugccccucccugccuucucccagucucacaucaaucagccuuucuuucuuagaccccuuuuuagcuaccuucugccucuuucucauguuuucagggagcccagacauuggaacuagcuagugcuaaacauguuuggcaccuggguucucuauuacauagcagcugaagguagccaguaaacccugcuccacacugaagaacaguggcaggcgacggcuguaugcagcaccugugguggccaggcauguugagagcacagaagguguuguggaagauccucaccugucaggaagguaaaagugcaaggacauuucucaggccgaagucugagcuuugcauauggugugcuuucuagguuagggguagcagagagcaggccuguggacgggggacaggagccuucaguaggggcugggcugcugugacgauucauucgggagggagauaauggauuguuugcugugcuuugcuuugcuuugcuuuggucaaccuagacaagccuugaacucagcaacccaacucucucugcaucuucagugcugggauuacaggugugagcuuuccauuauuuuagucaagucugcucauuaaauaaaauggccuuaggacuuuauggcuucaggggcuugcuuggggccacuucuccaguccuccccacugccagguuauaguguccagccaggagcagucugcuuugccugcccugccccuugcaugcugcccugugcccaaugccuucccuguacuuaacgcucccagugcugugaagaaagcauggcauguggacuggcagaauccacacgccugaggcuacauaugccgugacucaugguuccccaaagggcugauggaggcuggcuguauauacacugccauucagucagccagagccugcugcuacccagugcauagauccucuuggcucacacggcagucucuccagcuccgugggucuggaaggcucuuccuuccuucugccugucggcucugucucuggccgagccucuguauccauugcguaggagccgcuuccuggggacagcaaggcuucuuccacugaccugcaagugggguucgaauuauuggaaacgucccaacgcaguuucacagcaccauccucugaccucuguggccaccucaggagguuaagacgauagcuuuagaugaaggcugaggacgggaagggacaggacagacagaagagagguccucgcuucagaacuggcguuucagucucuccuucccucuccuccaucuuccuuuuuggccuauuugagacagggucucgcuaugucucuguaguccuggcuggauuaaaccucacagagaccagcucacuucugccucccaagugcuggguuuaaagacaugcgccagcacacuuggcuuccucguucucuucuuuaagacuggacugggucuuacuaauuacacuggccugccugccucaaauucuuggguguguacgaccacacuagacucuuaguaggguuagucugaccuacaauuugaacuccaucugccucagccucuggauugcugagaucccaugacagugccaccaugcccacacauacaugcucagcgugugaaccuagucauucucuccuccuuuccuccucuggcuucguuugccaagcugugggguuccugugucuucacugaacucagacuaaguggagaggcugaguccagagcugcuacaggcaccuuucaccuuagaggggagagccugaggcuggggccuugucuccaccauggguucuaggucccccgcuaauacacacaucugucggggaaauggucucgcaguugaguuaacuuugacuaauugaaagcuauuaauuaguucagacaggaaucccgugggcauuuggaaacccugcuuuagggaaggaaagaacagagggguccuguuuucaccuguguccucgugggcccccucccucucuggcccuuuuaaggguuggugagucccucuccuagagugggcuugaagcuguuuccuuaggcuguuugcuguuguaaggugucaguuuccgucuccugggcuaucugugcagagcuuccucaccuauguucccgagcuguggccagcuucaccagaggucaugggugcuggguucagacuccuacggaacucagcaucugagaggcugaagggaggcuucucuauggaucuuggcuugugugugacacccauuccuccccgguggcugggucuccguagggucauugcacucugcuacaggaguuucuacuuuagucguauuaaacuugccucgaugauaauugguggcacauaguuguaacuuuggagcaaggggugggaguggaguguuuggcugcuugccuucgaagggcuggggaucaaccuccggagugugcaggcacucugccacugagccccggauccucaucggcauugggccccuuuccugcuuagcuucccuccccgaugcuggcugcuccucucucuauugaagaaccgcagauguggcuccgagccccucacuggacagaaggcugagcuuaggaaggcuaagaagccacagaccguagggccaggaaaagggagacuguguuccuccugugguucucaccucuaacagcauuguaguuuucucccagagacagggcagaacuacccacuuagcaauccagccccaagauacacagcaggcuccauccccucauccuaccauccuaccacaccugcccugucguccccuuccaacuccaaggucauaaaagauguuuaaaaaaagaaaaaaagccccagggacacuccugccuucuuaaggcaucccugaaauaauauuuuuuuuuuccuuuaaagaaaugugauccacuuccugcugcugugggcagacacuguacuauaauucuagggacucucuagcuguucccccagcucgcuggagaacgauggcccccauaugggucugugugugcgcggaugaaggcaggaccuccaacugacgguuuccuacagucgacacccaggaagcugucuccuaguggaaaaacacaagggaauuuuacagucccacgcuggccacugaaauguuccuuagcguugaauucucccauugcugcuacaaaggaguuguuguuggucccugagacacugacacuuucugaacaacaguugauuuaugacuccaaccugaacuugauguggcaauccuccaggaccaccucccagcccuccucuuugcccaccugauuggcaggggguggauagugaggagggacagacagguugcuaagcagccugacuucuacauugugcccuugcaauuugaaugaauagcugcaguguucagaaaagaggggauuuugggccugucucagaaucaggagggacuuuuuggggaaggggucuggucuuggcacagggucaugccugccuugggagggaguuuggacucuccacaccccuucccugccuuccauggugccaggggccuaucucugcagcuguucucaugaggagauccuggugcgggacuguugucuugucgccucccuccccaagcaaaggaaggagaccagaccugacaccuucgugaacuucucugccauuuagacauuauuuccucguggcacuaaacaucccugaucuuacugaguucaaggacauuugggucaacagaggcaagggugaggccuuaaaccuauaacuuagcggucagccucucgaccuugguuugguuaggagaagcagugaagucagacauuuguauucaguauaaaaaaaaaguguuucucuggaccaaauauaaaaccagaguuaggagagguaagggacaaggagagccagagaggggccaccucaagcugggagauuuggggagcuucauuaagacacugaagggcuucuuagagcugccccuuaaugcucaugauaaaaucucccccaaugguuugaaguaaaauagaaaaacugccaagagcaaacucccaggagcagucggucuccagagucuccugaaggauccucagcgaugcgaucggauaagcucucccaacccaggggagccauggaagcaaggaagagucacacagguggcagggcacucaccugaggcucaccugaauggcucaaugcuguucccuccugggggccagaguuguggggugccaggagccuggaagcacuguucacugugagcaugcugccagcacucaccuguucagccuccaugaacaguucgggugccuccacgaagagaguacggcccacaaaccuagccuuaccuuugugugguucuucucuugacaggauaacacagaagcagagaagcgggauccccaggaauuagugggugaguacccgagggucauacuuuugagccuuaccccagcaagcuggcuuauuuaugccaagccucuguucuuuucggcaucucacugcugagggcaguuucccuucauacuccgaggccuuuggcauuuccuagggugacugggugagaccuccaggcaguggucuuugaaaauggcauucucugugcgcuuuucugggcuuugguugguugccaguguugucaaggggguucagagccccuggcagccgggagcucaucuuggccuuuacuucuuucacuggugcccugggc

SEQ ID NO: 6491 - RNA, 2319 nt, Mus musculus
uagguaucagguaucaccugacuguuuuguuuuauuuauuuauuugaugguuuguuuguuugcaagacaggguuguacuguguagcccuggcuggccuggaacucacuauguagaccaggagggccuugaacucugucuuugcccccuaagugcugagaucaaaggugcacaccgccacaccuggcccgccuuauuucuuauuuguguguguguacacacguaccucgguacaccuguggagaucagcgagcaacucuguggagcgggcuuucaccuuccaccuucaugugagcuccaggauugagcucagguccagaggcacccuuguccacagagcuaugcagcugcccuccgcuucacuuuggagacaggauuuuacacuggcuagccaccugccucuucccacuggggcuacaggagcgugucagcaaccccagcauuuccgugaacacgguuucucaugcuugaauggcaagcaccucccuggcugggcaaaacuagacucauccaagacucugauccugaagggaaaaaaaaaaaaagucaaugugaagagugaaaaacuaaacuagauuaggaaggagacguggucagauguguguaacaggaauuagcauucaaaauggauuccaaaggaaauccuugugcuagacaugcccgggcaguuaggaaaauguaaacacaggcugagucacgggugaccuaacagacacggugcuguucguuuucccaggcgaaucagccugagacagggagaacauacagagcugggagggggcucccuguggggcugcugcacagacaggagggccugaguucagaccccuagcaugacgaacuaguaggugucucucaucacagucuccuugguggagaaaucgcagacgcucacaggccagcuagccugacguacgcaguggcaaacaagaagaaacugucucacgucggaaggcaaagccaagaucugaaguuggccucugaccuccacaagccagggcauacauacacagauacagagauuuuaaagacaugcacacaaauagacauauagaaaaagccacauaaacauauagcaguguagaaaaucauacuuugaggauagacgguaaaaagaagaauauuuuuugugucuuucagcauguuuuuacauuuguguguacaaauauguguguauccauauuuuacacaugcgugggguuacauguaugugggugcacaggcacauggaaggcuaaggcugcuaucaggaaucauccuuccacuggacucaucagagcuggaucucucacucagacccagggcucccugauaagcuaggcuugcuagacagcaguuuccgggauacaccccgcucucuccaccuucugaggcuugaauuauaggaggggcuacuucccucaugcugaauuucauuaagucuggggaucugggucacauggucagacuguggcaaaguccagcacaucccuggagaaugcaguacagcucaugcgggagagccaggaucuggaugcugcucgccaugggcaggugaugugucucguucacauugcagcucauuaaacacuuguaaacuaagcgauugaacuaguggauaaaguuuuauuuuacagaggcuaagagauggcucagugguuaagagcaguggcuguucuuccagaggaccugaauucaguucccagcauccucauggcagcucacaacugucuguagcuccuguuccagggaaucugaugcccucgugcacauacaugcagucaaaucgucaguguacagaaaaauacguuuuaaaaaaguuuucucucguguauuacuaaggauggagccgagggcccgaugcauucuaggcuaguggcacauccguggccauuuauccauuuaugugagacagggucuccaaaguugcccagacuagccucaaacuugccacacagcccauggaagcccacagcguuagugcuccuacauagucucccaaguagcugacuguagaccacuaaaccccauagcuauuuuacuuuuaucaaguuaacaugcagaaccagcgagauggcucagcagguaaaggcauuugccacucaggccuaguggccugagugccauccugggaacccacagaaagaaggaaggagagaaaugacaacacaaaguugcccucugaccuccaccuguuugcacacaugcgucauggacacaggaacacacaaggauaaagguuuuuugggacagcauuucucuguguacuccuggcuauccuggaacucacagaaauccaccugcuucucaagugcugaaacuaaaggcauguaccacuacug

SEQ ID NO: 6492 - RNA, 8426 nt, Mus musculus
ccuccagucacuucguuuuuacuauuucacaguuguagcaaacaaaucaaggugcaaacaggguuuauuucacauuaauauauuaacuggacauuuugugucaaauaaauaggaauucucuuuaaauaaccaucuccucauuuugugucuggaccaggaacgaacaagagcaauucuuagugcauccagggggcgugaagcuuacagaggggcagacugcagguuagaggucacauaguuggaaggccucagucccagaucaaagggccuggcgggacagacaugcauucucuaucccuccugcagagcagcccccuguaaaggggagaggagaggaggcgaauaauucccagaaacaguagcauaggggcagaggggcuuccucuguaacacaguggcuucaccucugaugccagccacuggaagcgcccagcaaaaucccuggaagcucucacaaagaacaagguggccggguaagugugacuggacugacagucugcugggacagcggccuuccagagccaggagcacaccagggguaaggaaugugaacaggguuuggcagggccuguuggggagacacauggcuggucuuaggagcccaagagaugaagaacaauggucaccaggcugaaggggcugggcagcagugaggaguggccagagagucccucuguaugggugggggcuaguaucaugaggaacgagggucaccccgugcuccugcgagcuccagagauggugaaagggaagcugggaagaagagcgcugugagcugagcuagggcgagaagcugggacgugccucucagaggccaggaguuccaccuuucuaucagggcuagcuccugcuaacuuuauacucaggccuggggaagaacagggcccucccuggccuccuggaaucccagaugcagccccacgggaggcccaggaaggggucucuggguaagaggcgggaagugggcagggucuacugggucuucuugucuucugggggguaguaggguggugguggaggcuggcucuagagaaaaaaaaaaaaaguucacaugagacaucacaggacuagcugugcuggcuuccaacgccagcucccaggcugcgugacuaagaaggcgguccccugccaacucaccgugggcauguagacauuguguggguugccuggguuguaauaggcacuggcagcggcuucugcagccuuggccucggcuguuaaagcaaacacauggggagauagcagcaagcggugagccccuccuccgcccucauccaagcuccuaggcccauuuguaggcgagaacacugaguuacagaggugaucuucugacuccaaaaaggucaccauaagccaagaagccacagaguccucaucucaccguaccuuuggauuuguguucuguggcaccugggauagagcccaggcccagcccacucaagcaagugcacacugaaccacacccagcccuuggauauagcucuucaccaccaggcuaccacugugcuggugccuuuuggguggucuguaacccagaggcccuucaucauuugaccgucaguagucuccagccauuguugggaguucucugcaagcccuuggggaggagaggacuggucaugaaggacugcuggcagcugagaggccucaccugcaggaguagcgggggcacuggggccgcugaccggaggcuccaugggcccaggauagggugguggugggggcuguacauagcccauggccccauccaucaugggagguccuggauagaacucugcucgggaagagagcgacagagacagugagcagccccuugguuucauaggacuacaccugggauguccuaacuagucuugggaugcccucuaaacucuccaagucuguuagguguguuuccccucugcagccugaaggugugguuaguggguggguggguggguggggucugagucugggcagcagaggacacacucaccgggugggggugguggauagggguagccaggagggcagggguacauuccauuggcgacuggcgggggaaagacauaggccccgcugggcauguaaggguacccauaggcuccauuggggacuucaccucuggaggcuauaaguacaaggggagagagacaugagugucaccugccccagggacugaugggucccaggacugugcccacagaugugcccuaccaccauuccacugcccaccccaaggggucugccuaggucaccauguggugaggggagggugggaaaaaggacaaagggcaacaugguggggucaaggccaggugugagggaaguggagggagagauguguuggggaagggugagggaugagggggaggggaaggagcgagaggggagggguguugagcccagcacugggugauuuacaauggcuacuggaugguaguucaggagcuggguuuuuuguuuguuuuucagugcaaacauuucugcuaaaauguugccugccugcucugggcagggaagccucagaggagaauuacagguuucuuccccaacuucccaguccugucagcugggcccagagaguuaccuccuagugugaacgauacaaaauaaaaggacaaacaaaaaacccacaugucugauguguccuuagccccgaguuuuuaagggcuuggauaccuugagaugccaccuggagcauccucugcccaaacucaauggcgcccccugcugugaaggucagcuuguaggaggcggagccuucccagccaccugagaaggacaaggacagucaauggugagagggaaacagguucagugcagacagacggcuuguccucuucuggccaccgaugagcacuaaggaggccugugggcaagggugggcccugugcuguagacuggcccagcuccugcuugggggggggucuuauccucucagcaggacuuuccccacccccagccaaguacccacccagcacaaaggcuauagaguugccuggacagccagcagcaagagggagguggggaggucucuaacaaagcacaaagcacguggcagcucuccugguaacuggcaucaagguccaguguagaacucuccugguaaggggccucaagacaaaacauggccccucaagcccagagggaggcucacacagaacccccuggagucugggaguuagccacaaagcaggcccuggcagccucugcuggagcagcugccuuucccuaccucucaugaaaggccccuccuaggaacaagacacaacuccuucccaaaccuaaaaccuggguccucccuggguaaaaauaaacacauuuaguucuguugggcucacuuucugagcaaaaggcugauuuuaacccagcacuucccagcucuugguaaccaagguccccaagcacugcuuagccauuagccuggguaucaaaaguuaauucacgcuagggggcuggagagauggcucaguggcuaagagcacugucuguucuuccagggguccugaguucaauucccaguaaccacaugguggcucaaaaccaucuguaaugagaucuggugccuucuucuggagugucugaagacagcuacaguguacucacguaaaauaaauaaauaaaccuuaaaaaaauaaucucggcuaggaagugaggcuuggacaaggaaugugaaaagggcguuuccagguggcagccagagaggcuaagcuugucacccaccuccugcuucagccuucacuauucccuuaaugaaguucgcaccaaacaccggcugcuuaaucucacaguccuucaucagguaaaagggcaucaugaaggacugcauggcguccuuccccuuagacagaaagaugaccuguggggagaggagaccaggccaucagagccagaaccacagccagcucagucacucauaccugccacuuucugugugcucggucucuuccuagugacagagcagauagcguaguccccuccuggcagccacguggcuccucccacaugcuggaaacaaacaucccaggagaagccagacucaggugugcacaggaggaaccugcaggccgcagaaugaguggggacgcacugcugugccuccagacacaggcugccagacucggugcacauaggagccuccugugcuaggugcuaggugcagggcagagcaggcggaggaugcugggggcagaaggcacaggcugugcccauacacaauggagcauaagaguccaggaggaggcauccuugugaucuccuguaggucacacuuugccugacagccacaucacuuuccugucccauaccuggaaaaccccuggguuuccuauuuucuuuucuuuucuuuucuuucuuucuuuuuuuuuuuuuuuuuuuuugguuuuucgagacaggguuucucuguguagcccuggcuguccuggaacucacuuuguagaccaggcuggccucgaacucagaaaucugccugccucugccuccugagugcugggauuaaaggugugcgccaccacgcccggcuccuauuuucuuaauuucauuuauugauguuguauuugugugggugggugugcacaugccacagugcacacacggaggucagaggucaguucucuccuuccacuuugugggucaaccccuggguuuccaaaccaccagacacucaaccuaauggacgacgugaacaucagcccccagaggugagggaguugugggaggugucaucaugaaaacgugcccaugugcucaucacaucuccccugggggagggggggcgcgacgacacaaccacacguggcacuccuuuccuaaguucccacaggcagggccccuuuccuaccuacucgcuuuuauuacucagagcccacacggguuucccucagaccaggcagacucugcagccuggcaccucucacucugcaggguucugcugggcucucugcccagccuggagguugcggcccugcuaccauauucuguuugugacauucaucacucugaccaugcacaggagucgcaagggcuacucuaggcaagucaucccggcagcuacauccuaccucagagagaguuuuguggaauuugcauggcccaggucaggagagcggcacaaagggccaguaugcuucuagaauccaggaucaugugacagaaaaacaggccgagcaaggcgcuaacaguccccaggguucaggggccacuggugucacaaggcugaagaagacacgcacaugacccucugaaagcacagagccucuaguccaaccauccugcuguacaacuuacccgguacggaguaagguagacggugccuuucuuggucccuuugaaggccucuggcacauucuucaugucguugaagguaagcuccacaugaucauaggacauuaggaugcugugaagaaaacaaaaauacaguggccagaugacaugcugucaguuauucuagacgggacagagucauucagaagagugucuccacgggagcuaugacgaaaccaucaacacagcccaauggagaggaacaagccuggucuaugaaucuccccacauucuaugucuacagccccacgugaucaagaagacaaccaccuucaccucugcagcugcaucgcaucaccuggguuuacacuuuagugcgcucucaaguccugugagugggguucugucuggggguguuuugggggcaggguuucuuauagcucaggcuggucaaaacuugcuaaguucccuccugcuuccaccucccaagcuguugguuuccugaggugcuagggcggagccuugggcgugugcugguuaugagggcacuccaccaacucagucccagccagagcucuuuugucaguguuuguaaaagcuaaucuacgccggguugugauggcccaacuuuaaucucugcacucaaggaggcagugguguguggaucugugaguucgaggccagucuggucuauagaguaagugccaggauagccaaagcuacacagaaaaauggucucaaaacaaacaaauaaauacaagccuaauauguaaauagcuccaggcucauccccagcaucaaucaaucaaucaauguauguauguauauauguauguauguaaaagauaugauucuauauuugcuuuggacccccugaugcuggaguuacaugugguugugagcuguuccauauggaugcugggaacuaaaccuggguucucugggagaacaggaaguauuucuaacugcuaaaccagcucuccagccccuaguccaagcuucucuagcugcagcagcagaaaacuucugcacauaaagcccuuaagauaggggcgcgagugcgugugugucuuuguguguguauguacucaauucucugggaagaguucacaacuuuucuuuuucuuuuuucuuuuggagacaggguuucucuguguagcucuggcuguccuggaacucacucuguagaccaagcuggccuugaacgcacagagaucugccugccucugccucuugaaugcugggaccaaaggcaugcaccaccaccucccggcaaguucacagcucuuaucucuaucagugguuugugaauuaaagauuaauguuuacaaguuuaaauuccaaaguuugagcaucauacuuaaacuucaauuauugcugacacauuuguuucagaaguguggcucaaguuauuccuuagaacccuacugguagcaaugagcuaugaaccaggugcugaggcccaggaggguagauaccaccuagguaagacucaguuuaagagacaaaaaauucccaguaugguagcacaugccuuuaaccccagcacucaggaggcagagguaggugaaucucuguaaguucaaggccagccuggacuaccuagugaguccuggacagccagggcucuauuacacaaaaaacacugucuuggaaaaacaaacaaaaaggaaucacucccaaauaaugaaacuaaagagcccuggugaauuccuugcacuuaaaagccugagguaggaggacugccucaaauucaaggccaaccugggcuacaggaaugaaaccauaccucaaaaaccagagagacugguagaaguggggacagucauuagauggcaucagaguacuuggcucagccaaagaacuggacaaaguauaccagaaaacaauguaagguuucucagauuacaagauaaaaagguuugaguucguaugguuccauucagcugucuccuccugucccaaauauccuuucuuggugcaauaaaagaggggcagcucagguuaaagaaguggucaccaggcacaugugcuggccagccccuucccaagaccuacgcacacgaggucagcagaaccuggccuugucacugccaccuucuccucugagucagcuucccaggugacaagucccaagaugggugccugucuacacugggugugggcucugaccuccaucaugucucucuuggcucucaaguuaauccaagcccggauagugcaagucaggagagucagaauuccaaggaacaagaaacaagaggaacagagaagcccagcaguucaaggaggggagagaaaaaaagaaucuuaaaguugggagaccuuuguucggggaacugacacaagccauuaagaauucaagagaaccaggcaagagacaagccuuuauaagggucaccggguuaaguaguugacagacauuuaguuccaccaccucuagggccucagccuuucuuuuggaacuugagaaguucuggaauauacgagaaaacuguacaggaguaguuaagccuauugacuuuggggccaaguuaccuuccuucaauuccccuucuguuacucacagcacaauggucuaaguuauuuuaaccucauuaggcgucacuugcccuaccuguaaaaugugucuaauaguuucugcggcacaggauuauguauuaccuaagguagagcugacgcagcauaguaaagacguagugaacgccuaauaaauagcaacuauguuuuaagacuucguuugggaagggguucaagaaaucacccgugggccucacucggcuucccaaacaaacccugacaccauucucuggccccacccccacccaucaccccagcugaucagcacuccggcccuccccaacgacccacccacucccuccagccccgccuccggccguuaccaccccuuucucccucuuuccuccccccccacgcccccccccccacagcgcuccaucaauuuccuucuccaccauaucccaccgcccaccacacacaguggccgacacccgcccuucaagucuccaggauccuuccgccguguuuucaccucucaguguuguugacgaucacuccgccgcccucugagugauucuuguugagcgccauagucucucccacuggggucccgagacucgcaacgcucugcgcuugcgcuggucuuuggcccgccucuagug

SEQ ID NO: 6493 - RNA, 933 nt, Mus musculus
gagagggaaacgcaggaggauucugagauggaggccagccugggcuguuuugguaacugaaauagaaaaaccggacagcaggcaccacucccaaacccagaagagcaaagcgaauguuggaauucuugcagcaggaccuuucuuacagaaccccccaccagggccgagaaggccccugugcccagugcuggugcaucucugcugcugauccggguacagcacaugcaggggcugggaaaacagagucaggguuccagagcugcuagggaacuggaccugcccuggugaggaucugggaggcagcgagcagaccggaagcagugcacuuucccagagcuccagcgcuccagcagccuuggagacaggaaaacuuuccaagaagagaaccuuagacacaguuccucacgagggagagcuccaggcaaagaucaagauggagaccaacaagccaaggauugugacugccagauaaggucagcaagccgucuaccagauguggaucauuccuuccuuguaccagggaggugggacaguggacacagagaggagcucuugggcucccacagagggucccaaagaaacagcccuggugcguagacugugugaaguguugccaauuuccccguaccauagagggagaagacgugacccccagaagaacaugccugagguuaaauuccuuaucuuuuugguaaaagguggcuuuuugguuuccucuccuguugcugugauaaaguacucugacagacacaaccuaagugaaaaaugguuuauucuggcucucaguucaagaguacagcccacgggguggcgagauggcucagugguuugagagcagguauuguucuugcaggggacuggaguucaguugccaggaccgccucaggcagcucacaacccauaaaucaauaaagaaaaaucaauaaauuaaua

SEQ ID NO: 6494 - RNA, 7054 nt, Mus musculus
uggcaucaggaaaaaaguauuuuauucacauagaaucgaggcacauccacaagccccuggguguccugggagaggccagcaugggacugucucaguuggcuucagauggcucucuccggaggugugaccuuccagcugcugcgacaguucccccucggagaugaauguacugagucucucaguagauuccauaggugggcucaugacugucccuguaucgguccagauagcguaggggcugcucgugggggaagcgcuucuguuuggggugguaaggggguggccguacaaauucaaacacagguucccgcaugucugcaagaaaaguaaggggagagugguggacuucugcugaccugggccuccuuccuugccugugaggcuggaguucugccagggacuuuuuuggguuuuucgagacaggguuucucuguguaucccuggcuguccuggaacucagaaauccgccugccucugccucccgagugcugggauuaaaggcaugcgccaccaccgcccggcucacccuggcuuucaaaggccaucuccuggcauggcaggaaaggucuuuauccccaggccugccugaccacuaagcccuuaccuagaagcugguggaaggugugggugacagagucaucccagcggcacuggaaaaaagccagaccggcuggagucauggcuuccuggugucucuuguagaaaucaaaagugcggaagguccucugggccagcugguagcuaugaggagaugggcagcaugugaggggagggagcaggcaggcaauccugggaaaccccuggagugcacccagcacgcgggacugcugccaagcgcaagaccuacaccaagagcaggaaagagcaagagccaccaucccagagagcuggcuugaggcucaggggacaaacaggggugucgcuuaccagggugagggacggguguccucugagaaguugauuggcuuguccugcuugaagagcaagaaggcaaagcgguggaagccagagccucgagcagggaaaggagggagguagggacaugucuccuguccuucagccacucuguugcuugggauguugguucugguaggaggaaaauacccauuaguugccaugccaacaagguggcaggggaaccccaauguugcgccccagaagcagucacucccagggccagacccugaacacuccugcauucgaugaccacaagccgaccucagggacaugcugcaaacagauuauggggcaguuguaguucagaaaccugagaggggugggaaauggcuugguggcuaagagaacugacgacuuuucaggggacucaagguuccauugccagcacaaccugcagguggugcucacaaccaccugcaauucccagggcacaggcaugcagguggugcacauguaaaacgcuuaaacacaugaaauauuugucuuauuuuucgagacaggguuucucuguguagccuuggcugucuuggaacucacucugaagaccaggcugacuucaaacucauagagaauugucugccugucucuuaacuccccagugcuaggacuaaaggcauguaccauuaccaccuaccugauauaauaaaauuaaaucuaaaaaaaaauaagagacuggguuugggauccucugcaauuuacuggcauuuguuaaaaaacaaaaccccguuguggcuggaggagcagcuggcucacuccacaugguaagcagaugucugcccaucauuuaggucaggaagccacaccuccuuugggcugcuuuucucuccaugcuguagggccugaagcuccaguaguuacuguacccucuaaccugccacgacccccgagaacccugcuaaauauguugguugcuguaguugaggggguagggggaaggcagaagccagcuucccagguacuagauucaguuacagggggaucacaaagcucagggcacccguguguccucugcccccuagccugugcuuggagcugaagccaacaaggacugcucagggcagcaacacccacgggcccagugucuggagaugcuggugccaccaugagcugcuccugguccuuuucuccacugccugucacagcaugugcacgcacgcacgcacgcacgcacuguuuacccacagguaaagcguucagcaacaccuccagguucacaggacagaaacuaucccagagcaaugaagaggacuggccagggcuaccugcaccuuuuuuuuuuuuuuuuuuaaauacacuaggucccauuuguaauuucaaacucgccuccagggcacuaggagucaaggcacgcaacaccacaccuggcuucugccgcuuucuccuguacuuggguuaaguauauucuugaauugaauauucccaggaccugacauucccaggaccugccggaauccccuagcuggcuucccacgcagauacucacagcagccagugaacauacucagcguccggcuccagcagguguccgucugcacagaaacagagauagccuuuuagaggaaccagagcugaaacacgccacccugcccagagccacgaguucuuggcucaggggagggagaagcgggaggccagaggccagugacccccauacaccuacccaaguugaugaauagcaguguccacaaggaauccuugucugccucauaggucaccucuggggcccgggaagccuaacagggagagaucaaggcagugcucacccucgccagggugcaguuucucuguagagggcuggagcgugcagggguccuggagaaaggagugugcaccccagcucaaaccaggaccccugagagcuccucacaagugacagggagagagaugucuguaaagccugccgagcugcuguccugagagcugaacuauaaaggccaugugccaagaggcauggucagggaggucacgacaguggcaccgauggcucuucucuguccuguuucugaaacguucauggucgugauuucuaggcagucacagacaguaacaaaacuucaaaccuagacccugugaagccgccaugauagcugugcccauguauucacaaagcugggagacaggcacgggagcaguaccucggucggagucacuucauugccaugauacaccgggaucagguccucuucucccacggcguaagccacguguagagggacccagggcacaaaaguggcaccguggaacaggucucgguagaggccauaguacucagccagacgcugcuugugguagggcccacacguccucucccacucugcccgcacugccuccagugggaugcuagcuggggggggaacagcaucguuuggauacaguguggagagggugcgccgggguccccuccucugggaggcucacccgugcggaggcgggcugcccguucuucuuccacauuggcacgaaguucccgcagaaagugcuuccgcuccaguagcuuuuggguccgacugacucuggguggggguagcccaaugucaauuuugucuuugggaucuagagaaguaagacauguugggauaagcagagcccaaucuucucuuuaaauuugaguccuuaagugugugugugguuguaaauguccguguguguguaagcaagagauugaaguguuuugcuccaacgcccuucauuccacacugacccccaacaccccaaucaagguagcccuggcuguccuggaacucacucuguagaccaggcuggccucgaacucagaguucugccugcuucugcaucccaagugcugggauuaaagguguguguguguaugggagcuggagagauggcucagcaguuaagagcacugacugcucuuccagagguccugaguucaauucccagcaaccacaugguggcucacaaccaucuauaaugggauucgaugcccucuucuggugugucugaagagagcaacaguggacucauacauaaaauaaauacauaaauauuaaaaaauauugugugugugccaccauggcuggcccucaguguuagcuuuuuccccugagacagggucucucauugaagcuguaacuugauuuuuuagaccggcuggccagugugcuccaaagaucugcguguuaggccaccccuugugggacaaguggaagcgugucacagacaaaaacugggaauguuguauggauuuaggagccccgguguucucauaucugagaccgcaggcguuucaucugcuccugaccugguuccuugaguacgugaccacgacaccucacauggggauggugaccacuagucacacagcacggaacaguucuccaugauaaucuggaugggcuggccccaaggauuuagccaaugaaccuuccuggacauuccuuccuguuuagucucuggucuacccugaguaaguuguaugcauccacugucaccaccaaugaacaguauggacaagcaaggacugucucucucaucaagaagccuuagucauauggagaugccccaccuaagucucccacagaaggcccugcagcgcuccaggacacucaccccucagcuaagcaggacacccucccccccagcucaucacaggcccugcaugcauuuccucagccugccucauuucucacccagguuggggaacuuaggcuacguugguaaccuaacaccucccaucuugucugccugagcagaguucacaacuccaguguugaaacggaacugggaaccacaaccccuagcacugggguuugaagcagacacugugccuggcuucuguguggaugugggagagccucacucgggucuucacgcucugaggguggggugaguacagcagacacuuuuccucacuggaccaacaccccggccccaaaucaaacaucauuguugagcagccugacuuuaucuaguucugucccccugauacuccaggaaaggaugaaacacuugacccacuaagcugaccuaugcagucugcuucccggaacugaacagggcucagccauacagcaaaugagauauaaaguaaaacucuggcaucuggaccccagacugggucccagcgugggaaacugaggcagauggguuuccuaacugguuaucagaaucaccuuucaaaugacucaaagguagcugggcuauggagguuuggucuguugcuguguauugcaaugcuaaauacuggcucugguugcccccagggagaagggauucucagguagacccuagacacaagugaugcuauguaaccuugcccccaaaguuaucccugauuggugaauaacgaugccuacagcugagcagaagggagcuaggugggauuuugguucccaggcugggugucugagguggggacuaagagggagggagagagagaaaguggacacagaagaugccaugggguuagggaccaugaaaacuggccaugagggcaguccagcuggaggaagugucauaucucgggguuacuggcagagaaguagacauaacaguauugaguagauaugugcccagcucuagugcuuuaaggcuuugugacuuguaucuaggaguugaaugaucaaaggugaguagaaaccccugacugagauuaaauaauuauaacacugggcagugauggcacacacuuuuaaucccagcacccaggaugcagaggugggcagaucucugaguucaagggcagcguggucuguaugaguuccaggacaggcagggcuacacagagaaacccugucuuaaaacaacaacaaagaaagaaagaaagaaaaacaaggaaagaaaaacaugauucaaaggugguuaugaacacaacacacaccuaagucuuuuuuuuuguuuuguuuuuuuuuuuguuuuuucgagacaggguuucucuguuuagcccuggcuguccugaaauucacuuuguagaccaggcugcacacuuaagucuuggguagaguuaguaauaguuuuaggcagauuuaaggagauggggcaccagcugguggcaaaugcuuuuaauuccaaaacuugggaggcagagagaggcagguggauuuguggguugaggccagccuggucuauauagugaggcccuaaucucuagccaggccuuggugguucccagcugcacucucaguuaacugggaggcggaacaaggcaguccuccaucauccucguuacacagugaguucaaggccacccugggcuaauaagacccuaucucaaacaacaaaaaccaaaaagccaaauaaugcaucuuuuuguuuuguuuucuuuuccuuuuuuguuaauuuuuucuguuuuuugcuuugucuucauuuucuuucguuuucaaacaaugcaucuuuacuaccccauacuaccaccuccauccccaagacaggguuuuuccgugugcucugacugucuugaaacucacgguguagauuaggcuagccccuaagucaagagcuccguuuuccucugccuccuaaacgcugcgauuaagugcgugggccuccaccauccggcugagucucaguuuuacagacagauuaagcuaugcguauaucacuuggacguuugcuuaaauucagaacuacacgucugaggggcacgcagguccuucucguuccgggggcccacggggaccaaacugggggagaauacgucgcucccgcaccugucuccuucacgaaaugcucccgguagguccgccaccagugcggggcgcgcgccuccugcuccgcccggcggcgguaccgcucgaagcuccgguacuucuccagccgcuccagguugcucacgucgauguccucguugggcaugggcccgagcggggguguccggcggcugaggaaggcugcgggcacagacagggacgucacgcaggcuuaggaccgcgaccggagcuacagaggcccaagagcuccacgaccucacaccacucacccgaggugcugaagccccggcaucucccaauuccgaaaaacgccgcacgccaccagggcgccgccaucuuucccccaggucgccaaagacgcccguaggacccagacagagguggccggagagaagccugcgcguccggcgggaggcuccgccuccaua

SEQ ID NO: 6495 - RNA, 1227 nt, Mus musculus
augagaacagucauguccccacuauggggaacagcugccauucguccaggcugcuuacccggccuguccacucugccucuccugcuguggggaggacacagguggcuguggggggucauggaggugggagggcuuucugggcuguaggacgcagaccuuccugguagggcugaggaccuggcucuucugcagaaucugguccgugagggccacuaugggccugggauggcagagcuggaacagcagguggccgagcacaacauccugcagagagaaaucgaggcuuacgggcagcagcugcggacgcuggugggaccgguggguacaucccgggccggccugguguggaucccccuuccucccaucacaaucaggcuagauauucuggccuuaaagggagaguuaaaggggaucaaugcgggggcuggagcacacgggggugcuggagcaagagggagaaagggaauggggaaaggaaaaaagggagugauguugaugggggucagccuguauguggggagcugucacacuaaaccccguuucucacuuuggcugaggcaggaugcaaacaccaucaggaaccaauaccgugagcugcuggugagcuggggccgggugcuacucuuggugggaccucuuugccucaagccuuccccggggucacuugcugagggcccugauacuauggccugccacccccuucucuccugagcacagaaggcggccucguggcgccgacagagucugggcagccuguacacccaccugcaaggcugcacgaagcagcugagcgcccuggccgaucaacaaggccgcauccugcagcaggauuggagugaccucaugccggaccccgcuggcgugaggcgagaguaugaggucuguggggacaggcucaggcccgggcagcgggggugucucgggccaucuucuugcucauggccgucucgcuucaaucguccucagcacuucaagcagcaugagcugcuggcccaggagcggagcauaaaccagcuggaagaugacgcagaucgcaugguggagcuugggcacccggccauugggcccauccagguguggggucccgccccuacgccccaccccuuucccugugcuccccagacagcguagggagcugguggguguagcgggauuucagccuagggaacugguggguguagcgggauuucagcguucacccugccgugcuccagguccaccaggagg

SEQ ID NO: 6496 - RNA, 29055 nt, Mus musculus
ugcggcggaguccgucaguguaccaucggcccagccuggaaagugccgcucucucucgccgcuggucgucucgccugcuccguuccaucgugcuuugcggcucaggggcaagauggcugcugagaagcagaucccggguggugguagugguggugguggaagcggcagcggcggcggcggcggagggagcgguggcggacgcagugccggaggagacgagaauaaagaaaacgaacgcccuucagccggaucgaaggcaaacaaagaguucggggacagccugaguuuggagaguauccucgagcgguggccuaacucgcaaugacuacgugucgcucggagggcugggggcgggcgaggcggcgggggccagcaccgggcugcggagccgaggugcgccgcugccuccugcccuucacuuucggcauucccgugugcaugguuugccucucguccuggcuuuccggagcuuguuuuugcaagggguauagagaugguaggcaggguucccucugugccccucagauguccaguuggagggcugagccgggguugacacccugcccaccccacagagcuccuggucgguaccuugagccaccggacuguggaggggaaacugcagccuugacauuucagcguggagcuguugucggacagcugucgaacccugggucauaaaacagcgagaugcuuugaaaauggagggagagugcucuccaggaaagcugcugcuuaccuguuuugaauaguaguuacuuuaguuuguuaauaucauguguauaguuuuuuguuuuuucaaaaguaggucuguaaggcauuuuaucuuguuggacucuucucgaagaacuguaggaguuacuuuuuuuuuuuuuuuuuugaguguccaaguccgcauggguauggguguagguguaagcgcuggugcugugucugcaggucacaggucaacgucuuccuaauucucuaccuuugagacugggucucccuccaaaagugcagcucacuacuuggaauagacuguauggccagugggcuccagggaucuuucugucucuugccaucccagcugugggauuacgugugcaaacaacaguauggccuuuuuacguggguucuggggagaucccaacaugaccucaugcuugcuaacagcaaguccuuuaccagcugagcagucuucccaacccucaggaaacauuuucugguuuguauuagcuuauauaucauuugugugguucuaauagcauguggcuuuuuuuuuuuaacguguuauuuuaaauacuuuuaaauguugcuuuaucuuauuuuauguguguguuugccugcauguuuguguaucacaugugugccuggugcccacaaaggccugaagaacauauggaucuccaggaauuagacuuacagauguuuaguuccuccacgugggugcugggagccgaccuggauuccuccagaagagcaggaagugcuguuaaccacugagcccucuccagcugguuuguugguuucugagacagaguuuggcuguguagcccaauuuggcccugagcugcuucucaucgcccgccguccccucugaugcugagauaauaggcauauacuauuguuggagucccuuguggcuuuuugagaugcauaccaaauggaggugguuuagaggaauuucugaaauaaaacaugcacuuuguguguguguguguguguguguguauguaaauucucguggauucguacuuugcuuuuugcucugguauuauuguucuuacuacauguuagaaugcccaggaaaaagaaaaacuuggauuuuuuuuuuuaauggaaauuggcguaucuugguugacacugugcugaucauagauuuugagcguuacaagauguaaauuuggcaagcacuggcugcggcauauagcuguguaguuagaaccugacauuuauaacuggagucuccuugcaugugagauccagguggguaccucugaggcagcauuuagaacaaucugcuggguuugagacucccuaccaguacugcccucuaguucugucugaaaauaguaacaguugggacaguucauaaaaguauaaacuuagccuuguccuuugauaaagugacuauuggaaaguuacaaaaggaucggaggcuaccaucccugggcucccacaguucagugugccguuggggcagcgccugaccugcugucuucucaccccggaagcuuuuccuugaccuaggcucuaguucugcagaucauuaaggagucgcagcagcagcauggcuuacggcacggagacuuccagcgguacagguuaguguccugcacaccgugcaguaauuguggcauuuucuaacguagcugccuuuguuaaacuccugcucacucugcuaucugggaaaauguaccuagaugguucagcauuauacugcauuuucaaaagguauguauucuaaguuuaacauuuuaugagggcuggagagauggcucagugugaaaagcaccagaggaccgggcagugguggcacgugccuuuggucuuagcacuugggaggcagaggcaggcggauuucugaguucaaggccagucuggucuacagagugaguuccaggacagccagggcuacacagagaaacccagucucgaaaaaaaaccaaaaaaaaaaaaaaaaaccuccaaaaaaagcaagcaagcaccauccagguggcucacaaccacguguggaauuccagucucagagagcugaaagcucucaucuggccccugccugcacuccauguauguaguguacagacauacauucagucaaacacucacacacauaaagaauaaaaauaauuucuucauggugugagugcuugcugaggucuguuugucuuugauuaaggagccagggauauucucccuguaaggucacucuccucuaaguauuuuauaagaaggaacucugaaaucccgugaaugugcauucuuguuaggcucuuaguauauucauguacauuguguaguguccaguugauuuuaugacaucagcuaauauuauuuugaugcuuaaauugacucaggcuuggucugcagaaacccuuucagguggccucuuugacacaacugaccccagucuccccuuacuuagcuagguauccugcagucacuuuuuucauauacuagaaugcgaaugugcccuuuucaaaugcaacuuuauuuuucuggggauagagcccaggucauugggguuggaagaacuuuacugcugagcuacaucccaccuccgggcgggcgcaucugcuuuagauccggugucuggguuagguguucugacucgcaucugcgcuguccacgcuggccuccagcuugcucucauugacugccaagagcucgguuuacuggugggcaccuggcucauguuucauuguuuggcuuuuugagagagucuuacuauauaauucuggcuggcuucugaauugcuacguagcccaggcuagccuuaaguuaggaucuguuuaagccuuaaguuaggaucuguuuaaguuagccuaccacgugguaguugcacagguguggcucuccaugccugccagucucaggcuguuuguuuguuuaugguccugcgggggggggggggggugcccagaaccuuaggcacuuggguaagugcucugcuguguaucccuagaucuugcuuuucuuugagucugacuugggcuggcuugacagauugacucacagccaccuguagcuccaguuccagggagucugcugcucucuucugggcaggugccguggaguagagaagaggguguuggguccccuggagcuagaguuccugcuagagguaguuaugagccgucugaugagcugcugggaacugaacgcaggccuuuggaagacagaacuugaucuuaaccccagagccaucucuccacucacuucuuuuucagugucuuuauauguuuuguguucacguguguuuguauauggguacaugcuugcugaggcacacuugagggggcagcugaggaaguugguucccuccuuccaccaugugagucccaaagauggaacucaggucaucugcaugguagcagauaccucuauccucggugccaucucccuggccccaauuugggccucacugaugaccuaggaagaguggaguagagcggagaacaaggagcugagcaggugcugcucugcaguuccagggacagcgggaccuguggaauguccuguguggagcugcucccuuccugaagggaauucauaacucacucucccuuguuuagggcugcgcuuguuuaucucuagucacaggacuugcgcaucccaguuguuuaacgaggcucugcucgaugacaguugggagcagcucuaccccacggcuuucuuacacaacagauuuucauggaagugcgcucgcuaggcugacaggugcuaguaaccauaugcugauuaucacuguccuuauguuggagauuugucuggcaccgcaacugcugccacuccacagcugugcucuccugcaggccacacuccauagacugucucuccuccucaggccacaccuccacagagacuuucucuucugcaggccacacuccacaaagacugucucuugugcucucuuuucuuuuucuuccagcaacaaaguugaacuguacucagugugcuacauaaugaauguucaucuccuuuucuuuaggcagacuguagugacacaccccuugguugguauuuuuuccaauccaaggcccagggcuggcucuuucuuuccuucuuuucuugaguuccacauagaauucgaauuuauaaacuguuacaacaauagaaccaaaaugaaugaauuuuuuuuuuaagccuagagguaagcaaguaucaugggcauuuugguagauuucaguuuuacacuuuccuaauuuauauauugauuuggcuuuucugagacagucucguagcucaggcugacuguguagaaccccugcuccuccugccucagucucugaguguugugugugcacugccaugccuggcucuguguuuaguagucuguguccuggaaccucuaaggcugugguuguggggcugcaaugguggcucagcaguucagagcacugauugcccuuccagaggacucagguuugagucccaucacccacaugauggcucacaacuacucuaauuccaagggaccugacaccccuuuucuagccucugaguguaccagagugaacaaguaauagacaggcauacauguaggcaaaacacccauacacauaaaccaauuuaagaaaaaaaaaagucuuuuaaaaaacugauaauggaggcagaggcagguggauuucugaguucgaggccagccuggucuacaaagugaguuccaggacagccaggguuauacagagaaagacugucucgaaaaaaacaaaaacaaaaccaccugauaauggggcaauauuuaaguauuuuuagcaagacauguggcucacacauguacucuuagcauuugguaaauggagacaggcggauugccuugaaaucugugguccagccugggcuaucuagugagcuccaggccugcuugugcuguaguguuagacccuaucagaaaaccaagaaucgggaaaauaucauuuuaugucagaugauuuauggguguguagaaacuguauuuugucccagcagucacauuggcuuauguguguuagcuguuaggcaggugacaugaugucaguggucaccaugaacaguccucugaacuuugcccuuacuuuauuauagagcauuauguccaaaguacuaccagcuuggcugaauggaucucguuuuguauuucauugcaggggcuacuguucucgaagacaaagacgccuccggaaaacacucaacuuuaagauggggaacagacacaaauucacggggaagaaaguaacggaggagcuccugacugauaacaggugcaggcucuaagucucuuauuacacacccagccugagccgugcagacagcaccccagccccugaacccccuccugugcccucugagcagcucuguggggaggcugcacggagaggugaagagacagcaguggcuugcucagcagccgcugcugggguugggguguaguucaguagggguagauccugucucacaugcacaaaagccuggccgcgaucuacagcagcacaaaaagguggaugugucagcacacacacccguguguguucccaugcuugggaagggaggcaggaggacugagaguucaggguuguccuugaccacuuaguaauuucaaagagcucucucuuuuguuuuugaguauuuuuaagacuuguguauuuauuuuauguguacgagcgcuguagcuaucuuuagacaccagaagagggcgcugagcaugggcucucugacacccugucucaaauugcucccccugccccuggaagagaucagucugugaaauaauauaaguaauacguacagagcgucuccaggaaaucaguuccuagcgcuucaguucggagcacaugguuuccuugcugucugucugucuguauuaagcuuuguggcugagagauagcuuguugguacagugcuuccauucagaugugaacuugaguuuggauccuuggcaccgcaguaaaagcuggauagugacccaguacugggggguagacacagcauuauuccugggguuugccaguugccagucagccaagagaucugucucuaaaaguaaaguggagacaagcuauagagaugacacacccagcaucaaccucugaccuccagcuguaugcacguagacaugcacacacagguguguuuaccacacauacauacacaaaguaaaagugcccaucuuuaguccuagugcuuggaaaguggaggcucguggcucucuauuauaaguuuaaggccagccaaagcuacauagagaaaccuugucucaaaaagaaaacaaaaaaagauuuaauucauuuaagaauuguuuacguuuuguuaauaagaaaagugauagacugagguccucagaaccuaaagcgugaguucuuuacaaaaaacgucuuagagccaggggugguggcgcacgccuuucaucccggcaugggagguggaagcaugagguccucugaguuugaggcuagccugggcuacagaaguaguuccaggacagcugggucugcacaaaacauccugucuuaacaccaccaccuuagcccaccugcaccucccgagaaaaaaccaagucugaugcaguguauagcuggggcugagcuagaugccaugcugacacaagagggagggguaagagaggccuuugcugagcacucugggucagaugcaaaaccagggagcacuucuaagcauggaggagguaggaggggaggacugagcagggcgcacuuaaugaggaaacugacauggaggauggcugcuggggagggagagcagcuuagugaguuugaggacugaaggaacacuaaagcucugcaagcugcccugugccugggaagugggggcugggagccugguguguggugccugggcagaaagcuugaaauggaauccgugauggaaggagcaggacagagugaugaucccaggaggcccaguuagaauugcuuccccauggccauucugccccaaacuucagccccaagauccuuuauuuugcuuggacagaguuguuuguuuguuuuuuaaaagauuaaguagccugaccugaaggagcaggccuguaaucccagcuauuugggagccugaggcagaaggaucugagauugaagacuuuggugggcagcagagugagaaggccagccugggcacuuaauacgcuucugccucaaaaccaaacaaacugguggcugggcaccuagcucaguuauagagagagcacuuugccaccaucuaugaggcuggcucugaguauacuuuccauuagaagaaagaggggagccaggcaugguaacgcaugccuuuaaucccagcacucgggaggcagaggccagccuggucuacaaagugaguuccaggacagccagggcuauacagagaaacccuaucucgaaaaaccaaaaaaaaaaagaggggaaagaaaguaaugagaccacaauuuaaagccuccugaggaagugcuggcuguggucaguguuguguguauuagcacagagugaggugcagaaagaucgguguuccccagucacacagccuaguaagugaaggcacagguccuccagcgcagccuuucaacacuccacagcauaacugucucugagguuuuuggauguuugcuugcuugcuugcuugcuugcuuugaaauagggucucacucuguagcccagucuuuccuggaacuuaagauccuccugccucaacccugggaaugcugggguuagcagugggugccaccauggccaacagaaccuccuaccacuuaagcacuuguuucugacuggguucugcuccugggguggccuaaccugaggugguagagacuuuuccgugagauaugcccucuagugacuauaacugugagguauagcccuggauggugccagagaugcuguucugggaggaguccugagggaggggcaggaggaaggagaaaagauaagagcacacuguaccucagagugcacugggcccuuguucacucucccagcucucugcuguagauacuugcugcuggugcugauggaugcagaaagagccuggagcuacgccaugcagcucaaacaggaagccaacaccgagccgcggaaacgguuucacuugcugucucgccuucgaaaagccgugaagcaugcagaggaacuggagcgcuugugugagagcaaccggguggaugccaagaccaagcuagaggcucaggucucugucuuaacgaucauccagguuuaccucauuggggaaauuagacacaugacuucaaaacaaaaugcaacuaaacagagcagugucuuacuaggcacaaacuacaacugagcuauaguuccgauuuuucuuugaagggcuaaguuaguguaucuuauuuuucaguuuuuuguuuuuuuauuaguucuagucuuuuaauaaaaacaggcuucuuuuagugaguagguagacaaguuuauauuuuauaucugggaaagcucccaggaauauuuuuggcaaugaauuuuuuuagagaugauauauaauacugguuacgcucaauuuuuuguuuguuuguuuguuuuguuucuugagacaggguuucuuuguguagcccugacuguccuggaacucacucuguacaccaggcuggccucgaacucagaaauccgccugccucugccucccaagugcugggauuaaaggcgagugccaccacugcccaacgcucacuauuuuuaaguuaucugguauguguagcuuuuugccugcaugucuacauucuaugugcaugcuggaagugagagacaaagacaguaaagcuuauauucaacuugguuuuguuuuuaauuauuuuauguaugcauaccaaacgagggaaucagauuccauuacagaugguugugagccacuauguggcugcugggaauugaacucaggaccucuggaauaguagucagugcucuuaaccacugaaccaucucuccagcccuauuuucaauuauuucaugcguggcuauuuuacuauuuauaaaugucuguauaggacaugugugauugcuaccccuggaggucagaaaaaaauguugguucugagugauagacagcugugagcugccauaugggugugaggaguugaaccuggguccucuggaagagcagccagcuguuaacucucuuaacugcugagccgucucuccgagucuacuuuuguucuuuuaaacugggucuuauguaguccaggcuuaaccugcacucaaccaucuagccaagcuaaacaagugccaagauuauagucacgugggagagugcaggcuuuccaucuaguaguaucagguucacacuccccugccucagucucuugaaugcuggaggauuuuaaggugugcaccgucaugccuggcgguguugaaauugaacaaaacugaccacugugucugggauguggguguggguguagggugacaugguuugaggaagaaaacgguugggauuuggguuccagggaucaaacugcaaacugaggcucucacaguaacacuuaccuacuccaaccucugaugcuuaugugauggucuagagaccaguuauuaagugaaaugaacaauguccuuuggcguaugaugcucugcccugagcugugcccugggcauccuuuguuuugaaguucuuuccugggaagaagugaaucauaagaguguaucacacuuuagcauuuuaguaaguuuuucucuuuaaaagucaacuugauggugcuggagagauggcucagugguuagagcacaggcugcucuuccagagguccuggguucaauucccagucccagcauggcagcucacaguugucuguaacuccugugagggggcugugaugcuaucucugggcaucaggcacacauucgguacacagacccauaugcuggcaaaacacucacacacacauuugaauaagaaagaaaagucagucuuauuccaaagcaggaccuuucguccggagcccucaggguagaggcagggggaacucugugaguucagggccagcucgagcuucggagugagaagcugcaugucucucaaaaagaaagagggagggagggaggcagggagggagggagggacauggggccagaacacugggucuuugugcugaggcaguucuuugugggcuaagcaugaagcuuaguggucaggcaccugccuaguauacacagaaaucuggguuccuuccauagcaccccaaaagcaacaaaacaaaugugaaaaguuccuugcuuauuggucuuugcauucucuccaggccuacacggcuuaccucucaggaauguugcgcuuugaacaucaagaguggaaaucugccauugaggcuuucaacaaaugcaaguaaguccuccaguccagaaacgauggcugcucuuaguuacagccacaguccggcugcagaacccugugacuggcuucuuggaaucuaggacauuuucuuucucagagcaugccacuccuccugguacucagcagaugcccucagagggcuggguuuugguuuuaaccacaugguuuuccugaguuuucuuuucuuaaauacagcuuccauauuuuaagaaugucugacaucucuuugcucccagaacuaucuaugagaagcuagccagugcauucacagaggagcaggcuguguuguacaaccagcguguagaagagaucucgcccaacauccgcuacugugcauacaacauuggugagcaggcucugguguggugcuccagugcggugcuccucgccucacuuggcuugcugggaggcuugcgugacuuucccuguguuucagcaucuagccauggccugagaguguuuguuuguuuguuuguuuguuugcuugguuuuggguuuuaccauguagaccaggcuggccucucacucauagagaccccuugccucugccucccaagugcuaggauuaagggugggcaccacacgguacagcuggguuagccuuagauguaaugauaguaauaguagagcugucugauguauacuguguuacacacacacacacacacacacacacacacacacacacacacgacaaugaugaagagcugucuuugacagccccacuccagucuacagaccuuggcuguuuggcuucuguuugaaucccuuuauuuucuccacuccccaagaacaguuuagaauuuccaaccaauguuaucuuacaguuuuggagaaguuucagguauacaguauaucuaagugaaagauuagagaauuuucaaggucucccugaguccaaaccugcacaacuucccuucccaucaucucccugaaagauguuaauauuugugucucuguuccuguccacguuuauguguguuaugcgcaugcauugccuaaggagguccgaggaggguaacacauccccuggauccucuguaagagcagcgaaugcucucacugcugagccaucugcagccccguggcagugcuguuguacaguugcaccuacauuaacaucccaaaguuucuaaaguccacagcuaaacuuagggcucagcuugacauugagcccuugagaacuuagaccacgcuguuagcaguguucccgaggcuccagccaggcucugaacagagucaccuucagagccgauggacgggcugguaguguguuccauuucacuaagggaggaacugucagucuggacuaaauugagggcuugucaagaaggcacaaaacccuaaacgauuccccucccuucucuuucucucccaggggaccagucagcuaucaaugagcucaugcagaugagacuaaggucugggggcacagaggggcuccuugcugaaaaacuugagguaauacacacuccagucucuggggauauuuacuauucuuguaugcauauuuauagcuauaucuacauucagauguuccuuaaauauuuuaaguauucaacuuauauguauguuuacugucaacaugcguguguguauuguauuuuggccuuauuucuguaauucuggcuggccuacagaucccagagaucugcuuagcucugccuccugagcaccaucaaaggcauuaugucacuacacuugauuuauaaucucacuguguagcccuggcuggucuggaucuugcuauguugauuaggucagguuggccuugaacucauagaaauccaccugcuccugccuuccgagugcugggauuaaggugugugccaccacuccuggaaaccuuuucccuaaauauuuacacauuaacuuaguacauaugagugugggugugugugugugugugugugugugugggugcgugugugugcgugcucauucuauaaccuaugcugaccuugaacucaugguaguccucuugccucagccuuauaaguguugggauuacagccgugagccauuauaucuggcaaccuauuuccucccugagcaaguaacacagaugcauagaaaaaguaagaaauuuuaaaacugggggaagaauuuugacuuuccauaaacuuaaaauuuaugauaccagggagacauugaaaaugaggaauuuugcaugcugcaauguguccuuguugguuggagagagagagccuggcaggcuguugucccugucacagagcaacugcuaaagcucugaccuaaacuccugugcaggccuugaucacucagacucgagccaagcaggcggcgaccaugagugagguggaguggcgaggccggacgguccccgugaagaucgacaaagugaggaucuuccuccugggccuggccgacaacgaggccgccaucguccaggugaggaggggacccguggugcucaccucugugaagucaggugugaagggguuacguuuaugggguagauuuacagugacagucaugggaaaaggagucaaagaggcugcucaccgcagagggucacgcuggaguagcaggggcacugcugucaggcuccuggagucugaccugcuguccccaccuccuugcccucagggccaccccucauuccugggccguucacaagagcccgggugaaccagaauaucugguucuguguguggucugcaggucauggccaugcauguacuggaagcugcuuauugacauaauuaccugcuuguggcugugaacaagcagaugucgccccaaagauagggaucccagaguacuccugaggcaacagcgaggcccuuuagagcuccuccacaggaggugaagggcaucuuuaaaacaaugggguacggucaggaguugcgaaagccuggcacuuacugggccugcacugcuacccguguucaugaggaugucaaacauccagacuuaacagccacuucccacccgggcugcuuugggucggaagcagcuuuuuagcaauugaaggauuuuccuuaugugccggccugugcugcguucugcucugccacgguuuuccuuuguguaaagcagaugacacaacagcacugagaaguuuguuuuucuuagaggacuggagagcucacuuuaguuuuuuacguuucuuuauuuugugagugggcucacacacauaaacaaguguuuggauuuuuugugacucagggccgacaucuggauagacacucauuaagcagcuggggcuggggugcggcgugggcggcaagcuacucacgcuggagaccacagaccagacccuagcaccgggaggaaaaggccguucaggauugaccaagauuuugaugacuuugggaagaaaaacaguaaagcggccacaguucagucucaaguaaauaaggaaggaaacccagccaaccauugucaguuccuuuaagucagaguuuaacuguguguuuauagagugaaauggauacguucugucuaucucaucaagcagcuaauagcaggugugccucuuccagccugccuguuagcuguuaucagacuguuauauugcacaugguuguagcgccguaagugaugagucugcagagcuuugcuacaggaagagguuuucagggcugaggucagacccagacccuaaagccugugaggcgguugcucugccauggagcucuaccucggccugcgccaugguugguuuuguuugaaguaggcucucauuccgaagccuggaacuugcugaguagaccaggcuggcuucagacucacagcgccagccugccugugccuccugagugcuggcauuaaagugugagggccacaccugacuuucucccugcuugcuuuuuuggcuuuuugagacagauuucuauguagcaaaugguguucuagaacuugcuuuauagaccaggcuggccucgaacuccuagagaccuaccuguuucugccucccgagugcugggaucaaaggguuuuuuccuaugcuuuuaauuacuauuaaaaauagauuucaagcuaagaacacugucuuaaguuuuaaacuuuuauuauauuuuauuuccuuaccauguguggggccguguguacacauguggaagucagagcacaucuuagaaggaguuaguuucuuccuuccacuacgugcuuucuagggauugaauucaggucuccaggcuugguggcaaguauccuccaauccugccaccagggaggcugaaccaggcagauuucugugaggucacagccauguagggcugcgccgugacagccugucuuagaguacaguaaguaggucgggucugucugugagugacagugacuuuaguuacucugaagcuuucuucagccuccugcucucaaggugaagggcuguccgcagacugucaggguugcuggcggggccuuugugcacggacuguuuucuucaagaagagaaggagcugccagcaaauaacuccacgggaagacaagcucuggaguggggcugcuugggaccuuuuccaaagguuccccagcuccaccuaagggccauuaguguguguguguguguguguguguguguguguacucaagagcucugguguaugucaguaugugguggucagaaggcccugugcaguugguuuuuuccuuuucuuuguguggguucuagggauggaacucagguugucaggcugccauuguuggggguuaagcucuuuaccccugagacaucuugucauugucagcccuacuuaauuaacuuuuuuuuugggggggguggcuguucgagacaggguuucucuguguagcccuggcugaccuggaacucacuauguagaccggcuggcaucgaacucagaaaucugccugccucugccucccaagugcugggauuaaagguguaugccaucacugccuggccccuuaauuaacuuuuuacuugugaaaucauauaggugcuccuuccuggagccuguagugaucaugucaccgaacucucaucgugugguccuagcuagcuucuacguagaccagcuggccucuaacccugggauuaaaggggagugcgggagacucagcacuucccucucccuuacugagcaugauuuacgugcggggaguugguccagguucugugugagggugagucuagaguguagccagcagccugugcccauggacccgaggcugucugcuguauguagcuguuccucaucagcagguuggguguuagcaagcucacgcaguagagacugcacagguggaaacuccauucggggacaccgaacaggggacggaugguuucuguuggucuucauucagggccucaggucaccucuaugccuucgagaugcaggcugcuuagucucaguguccgacaucucaguugauaggguccccuccaccgucugggaaauaggaugccauuuugguagcccucgcugauuucuucccgcuagugaucuucguggcauagaaauacuuaaacagcagcuggaaaguggaagggagaaguaacuggagagauaaaacaugccauccuucauuccugcugucuaaugugcucuguguguguuugugugcgugcgcacgcgcucauuuguuuuguuucuugaaacaggguaucucauguagcccuggcugcccuuuuuuacuuuauuggauauuuucuuuauuuacauuuuaaauguuauccacuuuucugguuuccccuccuaaaacccucucccuccucccccugcucaccaacccacccacuccugcuuucuggccuuggccuuccccuacacuggggcaucgagccuuuucaggaccaagggccucuccucccguugauguccgacuaggccguccucugcugcauaugcagcuggagcuccaugugugcucggugguuggugguuuagucccugggagcucuggggguacugguugguucauauugauguuccucccauggggcugccauuuuguauucuuaauccuuauucagucuuugguggucaccagcaguggugcugugagguuguuugggggcagcucguuuugagagauuuuaaaacauuugugugcuuggucauuuaugccccauucaguucuggguguuggggggaauccaacaaaccuguuuucauuguguuuguuauauuuauuuauuauuacauuuuaaauguauuuuguggggauaggagagaugugugucccacagcacacagcuggugucagaggacaaccugagaaaaaagucaguucccuucuucuaucaugcaagucccaaugauuggccuuccccuucaccagguaaccugacccagcuuuuuggagucugaguaaaauggacagcacuuaccuuccuacccuuacccccauuuuuuaaauaaaauuuucaauucuuuuuauuaaagauuuguuuauucauguaugugaguacacuguagcugucuucagacauaacagaagagggcauuggaucccauuacagaugguuguguaauggugauugcucaggcccucuggaagagcagucagugcucuuaaccacugaaccaucucuccagcccgcucccccccacccuuuuuuuuaaaggaaagaaacaacaacaaccaaacccccuuucuuuauuuccuuaucuuuuuuucuucugagccucucucucagguugggugagacuugguuccuauccccaugauucuccugugggugugguggagagagaauguggccaggcuugccugugugucucuuagucacacaccaccaucuccccaagauuccugucagccagugaaaacaacccagcagugucuauaauagggggagacacuguggugccgugucccugcacuggcuggcccagaggaguuccguugauugauugagaugagcaggcaggucaucauuuccaagcucuagacacugccauuggcacaccgggaacaggguccagugggccacauguuucuaugcagggagugugccauugaguacuggcucgguagcagauguggcaggcugggauguggagugcaguccugccccugcauguugaaaggcgugucucccugugggagucaccuuggcaucaaguauagguucuagaguaaaugagagccguaaauauaugaagacuuccuguuuggagacauuuugcccuaggcaggaagauccguggcaaguucucagauacugguggucucugagucacucagcauuguggguggcacguggaaaacaucccacuaaguccuucccgucagacauaaccuuuuccuugguuguuguggaauaucuucauaaauccuuacugagacauagaaugugggggagcaucggaaguuugucuucagcgcucuggugccgaggcgaccgcagaggcagugacgaggcuuagcguucuggcauccuuugauuuuuuuuuuuuuuuuuuuuuuuuaauaguagagaauagaguuuauucagggcacugugaggggaguugaggggguaguagagacagaaaggcagagagagaguagaggaguagaggccagcugugagcaguggagggggauggaggaggagaggaauggaggggggagcaggaggaagaaaacagagagcaagaagccaagagugcauccucugauuuuaaaugugaacuuuuccuaccgauaggagggaagacagauccucauuuacugcccacggccagacagcucagccccgcccaccugaagcagugcugcugcggauuuguggguucuagggcugacccuuucugcgguggcuccacagggguuuaccugucuuacucgguuuucacaguuccacuggaaccucagagucugauucggugaggaaagggagucuucucuggagucacagcagacaggacagcaccuugcuguguuuguucuauguaauguaccauggucccagcaguccacacugaugcccgcugcauggccgaccucggcuagagcagcuguccauccugacgucuguuggacagcaggcacugcucuggugggaagugagcuagcugauggggugguguuugccuucaggguaccggaggccaugguccugauuuguuucccaaguuaguaagggacaggaaagucagguggcccguaaguggcagcgucugugugguauguauggggcaauuuacaguuauuuccuuacacuagaauguagggaaaacacaagagaucuucagaaauuuuuaucugggcuccuucuccucucacaggaguggaggguguucugggcgggcuucugugguccugagaggccaguugaaggcugguguuuuucaggcugccuguuaguucuguggaaagucaaacaugaccguggaaugcuaacgcuuucacuucagugggucugcucgccgguggcacagggccaucugcuuccugccuuuuguggcuucccugcucagucagguucuuucgguuggaaacaugguguggcaggcauucaguuaaugagucacuuugugguuuaucgagcaguguagugagggugacaccuaguacugggcgaauacugucgccucuuucuugucaaccauuucugcccagaaguuguucucaaagaguuggccauguacaacaauggacccagaaugucuagagaagacaauuuagucuuauauuuaggagaaauaucuucuugguuggauauugauuagaaauuucugucuuuugcucgaaucugaaagaaaccagaaacugcagguuggcucagauuguaaagguuugcauacggcaccucugagccaugcgaugccgugccuccuccaaucugcucaaaacagucucuugcuccauuuugccacuguguaggcugaaagugaagaaacgaaggagcgucuguucgaguccaugcugagugagugccgagacgcccuccaagccgugagggaagagcucaagcccgaucaggucagcccaucuccuguccucccccagucugagcuguccucggggugcucccaggggucaucacugggccuugggccauuuguagaugugaucagcuuguaagcaguagaggccucugggcuccgguucacacuucauacuucauucucuggccauucuugagucauccaguggucucagccccuugucuccaggggcaccgccuuuccuaauggugccuuacugagguccuucccacuuuauaccacacccuagagucucccucccucguguguguccccuacagaugaucccacuaccucagccuguggagggcugggauuuuuuuuuuuaaagauuuauuuauuuauuauauguaaguacacuguagcugucuucagacacaccagaagaggaugucagaucucauuacagauggcugugagccaccaugugguugcugggauuugaacucgggaccuucggaagagcagucagugcucuuacccgcugagccaucucuccagcuccugagagcuggguuuacagaagcugaagccaugacuaguuucuaccuguucuuaaguagcauuuuaacguagacugagauggcucuaaaggugagguggugcacaccuguaguuguaacauucuguagacagaggcaggaggacugcaguuuaguaauugaaaaacacuuaaauauucccacccagagucucuucuaccacaugcaguaacaucuccauggaugcuggaggucaaggauguggguggcuuaggguacuggucacaccaggcauacagggaugguagaauuugggucuacagcagggaggcuauggucucagagccgacaguggagcuguggucucgcugcuuuuuuuguuuugugguucacugcacauugaaccuaggacuuugugcaugcugggaaugucuuguggguuuuuaaaaaaacuaguuuaagccaagaucucacuaaguucccagacuguaauuaaacucaggcucuuccugucucagucgccuauagccaaaacugcaggggggugugccacaccugacagaacugucugacuguugaguuggggacagaacaggaagccucagcuggcuguugucagcuuucugucagucaaggccagguguuggcuuacaguggcaaagggguaaucuuguccuucuguuaauggauuccugggggcaugacagacccuuuuuuuugaguuuuuuuuguuuuuuuuguuuuuuguuuuuuguuuuuuuugagacaggguuucucuguguaucccuggcuguccuugaacucacucugucacucuguagaccaggcuggccucgaacucagaaaugcaccugucucugccucccaagugcugggauuaaaggugugcaccacugcugccuggcauggcagacacuugauagacuuuguggcucuggggagagaacuuuauggcccauuguauggaagggcacugagagccaaggccgaguuuuacuuuauaccuuuuuuaccuuuucagaagcagagagacuaugcccuugauggagagucugggaaggugucaaaucuccaguaccugcacaggugaguuugacuuuuguguguguuuauaugcauuuacauuuuuaaauuuuaauuuauauauacaguugccugcaugcauaucugugcaccacaugugucccugcugcuccuggaggccagaagaggguguugggugcccuggaacuugaguuacagaugguugugagcugucaugugggugcugagacucuaacccuggucuucugcgagagcaccuagggcucuuaagcaccagucuaacucuugagcccuucuguuccuuuuuguuugcuuguuuauuugaggcagagucucucuacauaacccuggcuauucauuguguagaccaggcuagcuucagauucauagagauccuccuggcucugccauguccuccuacaggaggugcccaggugaguggcagcgccuuccccgccagucucuccucucaagccaguccuuggcugcagccuugcuuuugguuuuuguuucucucucucucucucugcgugugcgugcgugcaagugcaagugcaagaucucacugcuagccuaggcuggccucuaacucuuauaacuccuugugccucggucuugagcaugguggaauuugagguaugagccaccacagccagccucuggcagugaccuuggagcaucugugaccuagggcucacucccuacagcucccgagcucugcaguucaugucacuuucacguaaucauuucagcucaauugaauuccaccugcaagccuccgagugagagagaccagggucugccugcuuccucugagcgagcgagcacuggacacccugucugcucaguggccgauucgcucuccccuguguuugcugccacugcuguacuugugcaguaacacaguaguugucuucccuggggcucugugcuugugugcccacuugccaccagacacacgcacucacacacacuccgcccuugucccacuugguguccauucuuggggguuugguauuaguggaugucagacugacugacagaugacucggguccuuggcauaucguacaggguucgccauagauguuaucuguuuagucagccugaggagaaagaggcuccuggagagcucugccugugcaucuauguagcuuagagccccaaacgcagaguugagcucaccugaccuggagcggggccucugaacccucaccuccacucagacaccuucccuccgucagcgccggcugucagguguggcuuuccauccuccuaaguugcccgugguugagagggcagcucuggggcagaagggaugagucaggagucagguagucuuuguauuuugugaauguggucagccuaugccugcuuguguguaauaggaaaaucuuuuaggaacaucuuucccguccccaucaccuguuucucaaauucagcuuauucaguuauuuuaacauucuuugcauauuuacuucucuuaucucucaaaaugucgcugguuuugacuuggucacauguaugccuaguguagcuguguccuccccugcucugcgcacauuccacugagccguggccucucagugccuucucacuucucaucuguguguggucucugugacuagugugaguggggccacaggugacggcacacugcccugugucagagcccagcggcugccacaucagaaguuggcugcugcuuucugaggacuagcaguguccucugaaacugggagcuugugacuuugggaaagggugugaaggaccagaugguccugcucugugauccuccacaccccacuaggucagcccaagucagccuagcguuguuugcagagcgugagcuuccuaagcuggugugugguacguugcagcuaccugaccuacaucaagcugucaacagcaaucaggcgaaacgagaacauggcuaaaggcuugcacagggcucugcugcagcagcagccggaagaugacagcaagcgcucucccaggccucaggaccucauccggcucuaugacaucauucugcagguaaccccuggguacuagaaaggcagcuacuuucugccauguuggguagugaagggcuuuugagagccuagggcaacuaguuggaagacaaaagaaggucuuaugguaauccacagccuaguauuccauauuucuggcacuuugaggucugaauccuugugcaccuacaggcauucacuuagugcuuuccccauguaagauacucuacaggugcuagggcguccagagaccugaauccacguugugucaaccugcuggucagucaguaagcuuaccucguguaagcccugcauggggaguuguaccuguacccuaacaugugggacccauggacaagcugugcaguagauacaaggucugagcuguauaaucuccagaauaaugaaccgagauuaggggcuggggaguccucagcagaggacuugcuucgaggaccuguaaucccagcacuaggaagguaacgacaggaggcucccugggacuugauggccaaacagucuagcaaagugggugagagugucucgaaaaauaaggugagggaggggucuaaaggauggugcugcagagugcuugccgugagcaggcggcgugacucagugguuaggaauauuaucauucuugcagagggugggagucggguucccagcaccagugugggcgguucaccacugugucgcuccaagggguccaacauccuccuggccuccaugagccgccacagucguguauauaaacacacacacacauaaauaaaaauaaaguuacucuucaacaacaacagugcugggcuggagagauggcuuagugguuaagagcucugacuacuuuuccagaaguccugaguucaauucccagcaaccacauguuggcucgcaaccaucuguaauguguuguguguaguuuuaugccacugccuuuagcucugggaggugaccgugcuaccagcccccaccuggcuuccuuugaaucugaggauaaaagacaccccuugccugguucagagaagauauugacagauuaagaaccaauugaggaacaggaccuuagcaucaggacugcccauucaugaguggguuccaaagcccucuuuuggugucucuaaagacaccuacaguguacucauauacauaaaauaaauaauuacaaaacaacaacaaugcugaagacaguugcaaagcaugguggcauacaccugugaucccaguccuccagaggcagaggcaggcgggucucuggguuauaggucagccugggcuacauagauagacccugcaccuuuccuccucuugggagaaccugagauugguucccagaacucaagucagauggcucccaauuccccgagcuccaccuacugaggaucuaaaaccuccucuggucucugugcacugcacauguggcacacauaacuacauaaguaagaacuuccugaaaagaaaaaaggugacaccgggugugagguguaccuuuaauuccagcacuggggagguagaggcagcucugugcacauagugaguaccaggacagccagggcuacauaauagagaggccuugucucaggagggagggagggagggaaggaagguuaagcagagaacaauugaggaaaauacccaguuuugaccucuggccuccaugugcguaugcgcacauguguacgugcauguaaguacaggcaugcacauaagcugacugucaaugucaaguggguggacuaaucugaagugcaaauuuucccguccauguaguccaggaagucucugaagauuggugagagguggguugagugguaagggacaagugugcuuuuggugacaaauggguacagggcugccaggccaccccucacuugacuuccuaaaaggucuuuggggcuucucguggauuuucuuguuccaucuguuguacagaaucugguggaauugcugcagcuuccuggcuuagaagaggacagaaccuuccagaaagagauaagccucaagacccugguguucaaagcuuacagguaagcuccuucaggguuagaaggcugagcucugcgccccagcacucagcgccauggcugguggcucccacaggucauuugcaguuagcugugcugccuagcucugccggggcucucagcaaagauggcagccaggaguuuccagaguucuucaucuaagagagccacagguugcaaaggcauuggcaaaguggagcagccaggucgggagccuaaucugaauuggggaaacugagcaccucagguccucacacaagagcugaguugguguggcucacuugaaaggggucuaggcagacaggggaggagagugugcgugucauaucucgggcuuccuaggcugccccgucuuugcuccugccccucuugcuaugucaagggcaacacuaaagcucugugggcccuguagaauuuuggugugauuuuuuugaaaggcucugguucgagaugaauagcuaguugugguguagucaugcagacaggcgaugagcaggguucuguugguauagucagugcuccucucucgccugccucuagcugccaccauccuggggaacugccuccucugacuucagucacugaaacacuguggcucguguuggaccugcagagccaucugaauugcugggacacuuggaaguuugccugcagggcauuagggugggguuucacaagcaaugauccagaguuaagaauccuguuuccagcuuuaacauuaagccugccaguggggacagcccugguguugggcaacuauugcuuuaaacggcgacucucuccaucagguguuucuucauugcucagucuuacgugcuggugaagaaguggagcgaagcccucguccuguacgacagaguucucaaauaugcaaaugaagugaguucucacggaggagccuccaagaacagccugaaggugagcugggcguuuccaagccagugagggguucagggacugggagggugcagccacuggcagcuccuaaggcagaccuucuccgcccugcacccugagucacuauacuguaaccuacccugcucuggacuugaagaggguuuagcuaugacagaaagccauuacagccugcucucguagaacacacccguaacccuugcccugaagaggcugaggcugcagacucaggaguuugaagcuagucugggcuacagagcaagcucagagucacagccaaagccugucugcaggaauuuggggagggggggucgggggauguugcugcugcuugcagagacacaaaccccacacauuguccucagauuggcugcucacugacaucaccuggcaggguuuuaaaagcuguguccccaccagagugccucugauaggcgugagaucuggauuucacagccugacucuacacccaccuuuguucuuggggguguggcuggccgagccuuuacccuuaccaugguucagggcucucauuugccaaaugcaaguugagaguggccacaccagagugcuggaacguuugcauuaacagguccccugggugucagcuugcacucagagcucaacagcagaguguugcucuucaucauugcucucgagcuaugucagccuuucccacuuggaaggagacagggcagugcugguauugguuucugauguuugcggggauggggucucuccagguuggucucaaacucaacuguguggcugaggcuggccuugaacucauguucucuuugccucuaccucccaagggcuaggauuaaccaccagacccagcauguguuggguuuuuuguuuuucuuuuuuauaguagacauuuuuuaaaauagagacuuuuuuuguuuugucuuuuugagacaggguuucucuguguaggccuggcuguccuggagcucuccuguggagcaggauagccuugaacacagaagagaucugcugccucugccucugaaccccagugggaucagcugccacaggccugcaaggcuccuagcuccaccuggccugcuggugacuguauucucuguuacacaggaccugcccgacgugcaagaacucaucacucaagugcggucagagaagugcucgcugcaggccgcagccauccuggguaagccaccucccuggucucggcuguguccccagacacugcugcuacuccucuuccacacucaaugccaccuuuguacuauaaaaagcaguuucgguuaaucucuuaagauugcuauuuccuagccuuauugccuguuaaacuaggcacugaacugugcgggaaaauuuggaaaacccuaucaaacugucgcugcuccuuagcaucucacaaacugcagcuccuguggguuggccacagugggccccucgcuguguucguccugaccagauugacuugggguuuagagcccuguucaccaugaugaaaagccauacugcgguaagagugugcaaaaucccuguucuuacuaaaucccuguggaauuuucagaugcaaacgacucucaucaaacagacaccucaucccaagucaaagacaauacgguaaggccggcuguggcauccgagggauaagggagcauucugucccugggucuaggcaccccuacgccuuuccuuuucuugcccagacacccacaaacuacucaguggcuuguuggugguccauguccccuagggaaguggaggaaugccccuccagguuacuccgugccaguaacugauguugggacuggaggauggcuuagcgauugcuugcucuugcaggggacccagguuugauuucagguauccacugggggccuucugacugauguuuucaugugucuuccagccucugguugaacgguuugaguccuuuugccuggacccgucccuggucaccaaacaagccaaccucgugcacuucccaccaggguuccagcccaucccuugcaagccuuuguucuuugaccuggcccucaaccacguggccuucccaccccuugaggacaaauuggagcagaagacuaagaguggccucacaggcuacaucaagggcaucuuugguuucaggagcuaaccaggcucuuccucggggcagggagguccuggcuuacucuguauugagacagacccgacaaguuccauggcauuaaauccaguucugcguuggcuggggcagagcucagcacccucagcccugcggccguucaucuuguguguuugugacuuacuuuuguagccugucaucuucugggcccagagucagggucucuguguccccugugccuccuggggacugcugcuguccugcccuuguaagccauggcugaucacuuuuggucaauaugucaaaauucgggguccacgccaggcuuggggggcuugggaguguuugucauguguccucagucccauggauuugaaaugaccccuccucgcugugagaguccagagucuccugaaguuugucaaugacugaaaugcgagcagugucacccagaguuguggucagccuuaccccuucuccgagaacaagcagagcgcucuauuuuuaacuauguuacacucguaaaugacaaaaccaaaucuucuauuaaaaggcaaagaugauggaga

SEQ ID NO: 6497 - RNA, 760 nt, Mus musculus
uauguauaugaacauucugucuacacguaugucuguguacauguguuuuguagacuacgaagccagaagaggguuggaucccugggacuggaauucuagaugguuuugagccaccauucucgugcuaaaaauuaaacccagaucaucuugauagagcaaccaguguucuuaaccacugagccaucugcccaggcccagucuuccuugauauuuuugcuggagaacuaguacuccacacuagcugaucucugaacuccgauggggggaaggguuggagucauacauuuuuuugcaaccuccuuuaguaacacaaaaggguagacugaguuacgcggccagcuucuuuucaccugccgugauuggcacaagacugagacuccugguguacucgcccgcaaagauuaauaaaagucauacuuggauggucacaugaucuagaggaggccacgggucucaagcuccuauuggggacacugccuucugaccgaggccucuucgugugugugugugugugugugucuguguguguguguguuuuaaauaaggucuaacugugcaacccagacugaccucaacucgaggcaauccuccagccucagccuccucgguauugggauuaaaggcguacacuaccauucucugggugcaaggaugcaugaggugggcaucuuucucggguccuccuauccuugguagauuugaagcgaggcuaauccuuagaaaugcggagacccagcaacagccacgaauucaacccagg

SEQ ID NO: 6498 - RNA, 2773 nt, Mus musculus
caccaccccaggcagcccuuuuccuccuguggucuaccugacacuuaaaaaugaaccauccuucauccuuccuuuuuauaacagccaaagucagggaggagaagguagguccaggauuaaggucuggacaacucagaaaggugugucuggaagggacuugucugggaccccuuucaagaagaccugaggcaggucaccauucugugagaagauauuggggccaguucuggggguccaguacgucaucccuuauucuauagucaugggacuagcagacaggaagacacagccuacuguucagcugcucccuucccagugacacuggcaucccuggaaagcccacucagauccuucacuguccuucagcccucaagcccaugucaccacccuaaucuuuuucaccccugccuugaggaaauacugaaaaccugcuuguguauacacacaggacagggucacaacccaagagagcagcgcaugcccauguggcugucagaauugcaagguguagcugcuucagagcugaggggaccuguuuucugggaccaaggugacuuagauuuggagacccugggguccagagugaaagagagaguagggggcaggaacuuucaaccuguauccccagcccagucucugucuaauggaacccacccagccccuggcugaugcuuuccugggccacccauugccugaccuuuccauaucuuccugcacauagaacugcucugcuucugugaagaucaaggccuccaagucaccauggcuacagaauaucuuucugcccaacaucacucuguuccuggacucuggacgcuucacccagagcgaguggaaccgucuagagcacuucgcuccucccuuuggcuucauggaacucaaucagucccgugagugcuuacuucagaguacaggguggcuggcuuccucucuuggguugguucauuucuggggcuuugaauggaacccugcuguguuccagugguacagaagguggugacccgcuucccuccaguucgccagcagcagcuccuccuggccagccucccuacuggguacuccaaguguaucaccugugcuguagugggcaacgggggcauccugaaugauucacguguuggccgggagauagacagccaugacuauguuuuccgguauguucucccuccguugcuuguagauaugggcuauaaugggcgacccgauaaguguccugugcugguuugaauuggaauggcccccauagacucauuugggugaaagcuuggcccauggggaguggccugauuaggggguguggccuuguuggaguaggcguggccuuguuggaggaagugugucacugugaggguaggcuuggaggucuacauucgagcuauguccaguguggcacaccaucuccuucuggcgccuguggaucaagauguagcacucucagcuccuccagcaccaugcuugccugugauccaccauauuccucgccaugaugauaauggacuaaaccucucaaacuguaagccagcuccaaugaaauguuuuccuucauaaggguuggcauaguggucacagugucucuucccagcuauaaaacccuaagacauguccccauaucuuuaucuagaaaauggagugugucuacagcuccugccuccugauucaucuccacaaaaaaaugucucuccuccauucacagcaucugauucgaucuuucuacacagacugaguggagccguuauuaaaggauaugaacaggauguggggacccggacauccuucuauggcuucacugcuuucucucugacccagucuauccucauuuuggguagacgaggcuuccagcaugugccucugggaaaggugagaagggaggagugggcgugaccacccagccccugaacaugggagaccaaugagugcaaaugggcguggucccaccgugccugcucaggggagaaacaagauugagaaugggcauggcuauacagccccuggauaggggagacuuaugagcgccuuguauguggauggaaacuggcucaucccaagcucuguucacaugagggcaagagcagugacaacagccacucaggccaugggagauuuuggggacagucacgagugagaugagggccgcccucaguccaggcuccucaaggcagugcucccagaccacuuguuguccuuggucuucaggacguccgauaucuacacuuccuggaaggcacccgggacuaugaguggcuggaagcuauguuuuugaaucagaccuuggcaaaaacccaccuuuccugguucagguaccccuucccuccuccugcccuggaaacccugccagacugagaagugacugacuucaaaaggguuagucaggugggacugcuucugugacacuuggagaugggauaguggucacacagugaccauaacuuggccuccaccgggccagguaagagaacagggccugagggauccaucucuggccacaggcauaggccucaggaagccuuccggaaugccuuggacuuggaucgauacuugcugcugcacccagacuuucuccguuacaugaagaacagguaaggguaggaagcccauaguggguccgugggccucucauccuuugcuggcuccugacaguuggcaaucuggguauuuugaacagguuucugaggucaaagacccuggacacugcccauuggagaauauaccgccccaccacuggugcccuccugcugcucacagcccuucaucucugugacaaggugagccugca

SEQ ID NO: 6499 - RNA, 24987 nt, Mus musculus
cggguucccucgggguccgggcuggcggccacucggcggccacggcgcgauggagucgccggucgagcugcuggccgcgcuacccgcgcuggucacggcgcuggcgcugcugcucgccuggcugcugcugcggcguggggcggcccgggucccggccccggagagcaccgccucggacgaggcccccggggcuccugcgccgccugaaccuccagagucuugcgccccggagccugcaccggagggaccgagccaguccgagcgcguggcggagccggaggaguccgaggcggaggagccagcggccgaggggaggcagguacgcuccgagaucgccgugggguccccgggagggcgccuacgagccugcuggcuggaccugcccaggaagggccgagcuaguggccggcaggaaaggaggguuccuggggcugggacgcuccauccucccccaaagugccuccaagugccuugcuuuggagcuguccucccuuccuccccguccuggccgucccgggccuuucaaggcccuugacacucugcccugcagcacccuccucuugccuggcuucugcccacccuugccuaaauccacaaacacguguccuacuucaaggucugaauuaaagugagcucucucuugacaacacaguacuuuggggugggaugugcaagaagagaaguugccugucuuuuaggucaacucgaauccagauuccagagucagugugggcguuuugugaggcuggaaggacgggacugaggaaggcacuuacugggaccaugguauuguagcuuucaaacugcuuguaggcguugacaccuccucacccccccacccccugcguugggaugagcccagcuuauaugaaacaaaaggugcaagaggaggcccugaccaucgcaguugauacccccaaacuaccuugcccaccuccuaggagcuaucagcugaccagucuucaggguaccccucacgcguucagucucugagaugcaucuuugcagauuggauccgugcuugcccgggauacugggaugucacagugccaggccaggccacaugcucuggucucuggucagauuucaauacuuuguucuuggguggcaggaugguuaggaagccgugggcuagcauaguggaagcugugggcaagccgugggcuagccgccgugggcaagcuguuggcucucugcagccgccuccuucccuugcuggauacaaugguuuacccuggagugaagcucuugggacaggagaggcggcaaugagacugggcucaggccuuucucugcugagucugccagacucccuacuagcaggcucuuugcuugacaagugggugacuaauugugucauuagaguggcuucuaacuagcccugaauaggagaacuauuguguucagcccagagagaauggaaggcugcugggagcucacaguccuggagugagggccagguggauuugggauuucucucaggcucucccugguuguccccaucagcccuguuucaaaugguucgccuauuuccuauuucgcagcagcagauucaagaucaaaguccaaggugucuuuaagcagggcacaguccugacuuuauccucuggaguagagcaguuuccuacuggauuuucuccgagguguucuucacacgcauccuccaacggguccuuuucugguuuugguugguugcuugacugagacagauucuugacuucuugacauguagcuuaggcugaccuggaacccacuauguauucaaggcugaccuccaacucagaauccuccugccucagcuucccaaagccugugguuuaagcugagugagccuggagauucugccuuuauucuaagcacucgggagacagagaggaacggaucucugugaguuccaguccagcuuggucuacauaaugagacacgcccccccccccauccccaaagaacaaaaccaaacccuaggauuacaggaugcuuugaaggacaagguaccacacagggaguucaagauggcagccaggcuguagugagggaauccacccaacaggauggcaguuucaacauuuggaaaucaggagcaucucuuaugggcaugcgucaacucccucuacuccaguaccgggugagggcccgagacuuacaggugccuuugugucucccccacucuuuccguaguggguucagugcuagaagucgcugcuuagaaauugucuagaaauagacucaggcauuuucaaguguucccagcgcuuucuuccgaugaugauccuacugcccggggagaggaaggaagacugcuccccgggggggaagauaacugcaguugggacaggaagcugcaacuggacgaugcccucagagaaggccugcuuugugguccccaagugaaagaucaaggaccacccuaccugcuguuaguuuagaagccugagaggcuucaccacccccccaccccccaaccccagucuccuuuucauuuucugucagcuuccuuccgaacccagucugcuccugucccagugagggcuggccagucuggggcagcugcagccucugacucacaaagcugauuauuaaaaagggucagggaggcagccuucagcugccgcuggagaucgcuugggcagcaucagcuccugcaggcugggugcccugaaggcuggggccagguggugggcagaggcaguuacagacugaggccugaauggagacaaaaagcuuggugggugggugggugugugugugugugugugugugugugugugugugugugugugugagccaaccugaagucgggcaaggccgccuuccuccucccuccccagcagguuacagccugggcagggagauccugagcgggcagaagauuauuguuacagugugcuuucaucucucugggggcagggggaugacuugaggccagcaguucaggaaguauggugaacacaccuaggucccagagagugcuaugaggcagcaggguccagacaaaagcuggaccuucuuaaagccagggagcagagcuuuuuuccuauuuauuuauuuauuuauuuuaguuaguuaguuaguuuguuuguauuucuagacaggguuucucuguguaucccuggcuguccugggacucacucuguaaaccaggcuagcuucauagagauuggccugccucagccuccuagaugcugggauuaaagacguaugccaccaccaccuaccuggcacgggaccuugaauuuuuaaucccccugauuccaacucccacguguuaggauuaaagacauguacuaccacaggcacuauacuaaauaguguguguguggguggguggggggguauuguuguuguuguuuuuauuuguuugguuuuuccagccaggguuucucuguguagccuuggcugccuggaacuuuacagaguuauagaccaggcuggcccuggacucacagagaucugcucuaccucugccucccgugugcuagaauuauagcuauaaauagcaccaccaccaccccaaaaguguauuuuuguuuguuuguuuguuuucugagacaggguuucucuguguagcccuggcuguccuggaacucacuuuguagaccaggcuggccucaaacucagaaaucugccugccucugccuccugagugcuggaauuaaagacaugcacuaccaccgccuggccagauaguguauuuuuuaaaaauauuuauuuauuuauucauuuauuuauuauauguaaauacacuguagcugucuucagacacuccagaagagggcaucagauuucguuagggaugguugugaagccaccaugugguugcugggauuugaacucaggaccuuuggaagagcagucggcgcucuuaaccgcugagccaucucaccagcccccagauaguguauuuuuuaaaauuauuuuuguguguguguuuugccuguauguaugugcagcacagaagccagaaggcggcgucagauucucacccaccuccuccaacuggaauuucagagggcugugagccacccuauggguguugggaacggaacucuacaaaagcagcaagugccgguacuacugagcugucucuucaacccuagaaaugauuuucuuaaauuugcuacaccacgccuggcugauuuauagccgggcagugguggugcaugccuuuaaucccagcacuugggaggcagaggcaggcggaucuuugaguuugaggccaagccuggucuacaaagugaguuccaggauagccagggcuauacagaggaacccugucucagaaaaaccaaaaaaaaaaaaaaaauuauguguaugugugccugaauauauguaugugggccaugugcaugugaggggcuuccagaggucaagagagggucagaugcccuggaacuaaaguuccagaggguuugagcugccacauguggacugagaauugaaccuuucucuggaauagucagugcucuuaaucaccagacagaccaucucuccagcaccauagagacuaggggcaucugccaccauacccucccuaagcacucacccuuugcuuuacaguggguagcagagacuacaaaagugggccagcagcaugguacagugggcaaaggugugugccaccaagccugaugacccagggucuaaccaauucucacaaguuguccucugaccuccacuugugugacauggugcgcgcacacacacauacacacacuaaaaauuuuaaauuuuuuuuacauuuaaaagucuuauuuuaaauguaugagagcuuugcaugaaaggaucugguacccauguaccaucuauaccuggugcccuuggaggucugaagagggcacuggagcucuggaacuggaguuuaggguagguugugagccaucaugugggugcugaaaacugaacccagguucucugcaagagcagccagugcucuucaccucugagccaucucuccaggcucuaaaauuuucuuaauaauaauaauaauaauuaauaauaagcagagacugaagaaccacagacauucgggagcucccgggauaguuuucuucuguguagauucuuaguuuuugagaacccagaguaggagauaaauugcacagcauagacauaccuccuccagcgcuguuggcugcuggucugcagcaagccucgcucugggccaaaccgcccacaucucccacuccugaagaauccaaaacuggccuacccucuagaugaagccuuaaagagauuuuagaagccaccacccacccgucgcuccugugugggagcgugugucagcaagugcucuagauccaaccuuuuguuauaguccguuuaucgacacucuccagucuggguuucccaaaugaaugacaacauucuccaaccuucucaggucugucuuccucagucccuucuuaacuuucuucucugucuuaaaucuguuuauucugaaaccuggcggcuggacuucagcccagcaucugccccgggaguugggcggagugcugucggcugcccacggggcuuuuguguauuuguuucucucugguuuuaugaagcuggucucuucuaaacccugucaugagagcacugcccaaaacuuaaucugaugggauugagucugucaugccuguucucauuugaacgaguuugcuuaaggccggcaaugugcccuugccugggcuaugcacuuagagccugcaauggaauuuuuggacuggaugucugaagaggguaggggucagggugugagagcuagccguaaaaucgauuaguugguccaucucuagcucauuccucucuggcccccuguauaugcuagccccuuacccagugcauaugugcguguaagcgugcucuugugcuaagauucuggccuuucacauguucuucuccuucucccucccccuacuggaagguucaugucuauaauaucaacugaagggcauaaggguucucuccaccauugcuguccuguagagcacuugggccaccacuguccugacgauagugacggauagccacguccacucaugcagcccucucccaucuccugugggcacccaucuuccucaggcgucugucauagccaguccuccucccccgaucucuccuccuccuccuccuccuccuccuccucuccuuccucuuccuccuccuccuccuccuccucacugcuccuuaccaaagcccaggccugucuugccauccucuuuucucugucccccaagccuucuugccugucucccaaaggaccagcuccccgguuccccuguagucuugcuggcugcuguuccaugcugggcucuugcaggccgccugagagccuuucccaaggcuccugcuguccuaggcaucccagcuccaacaccuucccggcucgcuuuucauaacccagaagucgcaucccagcauccuugcuugaagcccucugcagcuucugcaggaggguagacuccgugauggaccuugaucacaauucucacuguucccgcugagcccacuaguguguucccggugcucaggcccauguccagcagccguguguugacugccugucugcccagccugcaucuuuauaaaagcccuguuugcauccugucaucaugcccuugaccauguuagcagacguuaauaucucucucucucucucucucucucucucucucucucucucucuugucuuucucucuugucugcaucauccuguuuggcuuuccucagagcacuuaaucagcaugaggucaucuuuuauuuuugagcacauugugugugcagaggaaugucuacacacaggaaugagaaaaggccuuugcccacgguguucacugccccguccccacucccaugacaggcccaccacacagcagccacccaugaggucuugaagauaaagagcaugcaaaaaccacaaaaaaaagcaaaacaaaaacucgcugcugguucuucucugaaggcaggcucagucuccuugucucuaaccucagggguugaaaggcaucucccuucucccccugccuguggccuggcuggcauccuccugcugcagaacuuuacucccacacuauguuuuaugucccccacccccagcccccagguagacugcucaguaagggagugagcuccccaacuugagaguuguucaaccagaaacuggcaccauguuuuaauuggguucuguccgugugaucugugguuucugguacuaagcacuucucucccucuuuggccugacauagguagagcucacugcacaaagccaaagagagcugccccauucagggauguccucuuacuguccuggaguucaggguccaaaauagcucuaagcugucagacccugucaucugggagaccucuggccaaacugaggaagucaggggacccaggagugagugacaaagaacagaucacagacccuaaagaugggugucccuagauggugccacaugccuguaauccaagcacuugggaggcagaggcaggaggauggaaguuuagugucagccucagcaaguucgaggccauccugggcugagacucugucucaaaaauaaacuagcuaaaaaacuuguuuuugguuuuuuaaaagauggcuccuugccuaagggcacuggcugcucuuccagaccuggguuugauucucagcacccacauggcagcugacagcugugggauccaauguuuuccucugaccucuguggcacuggggaugccuguggugccagccauccacacacacaaaacagagaauacagacuguaguccaaaggauugccuaacguguucucaaaguaggaggaauuagaagagaaucggcccagggccucaggaaggccugcaugggccagcagaaaauggagaauguggugacucuuggggagugacagggaacaugggagucuggcuggagucuugucugaggcugggaugcaaguguugggcaguugcccagaagagcuggaugggcguagagggcuggcuugggacagaacggcugcuucuguuuccuuguccuaaggagcauaucuucucaucaauggcaagaguagacuuagugagugggguccaaguguccccccagaagcauuguuuggggacagggagguggccaaagucaucugcuggaagcuuugaggagaagggcuccagguuugaacuggcuggcaccgguuagcucugcuuuccaacucuacugccaccccugucaccaugcaaagauggaaacugagccuucuguuagggggagagaacugcaggcagccuccuccacccccaccugccuugcuuuuucuccaggaauuagccacugaagaauugggaccagcuagcugggcaugguggcguacaccuuucauucuagcacuuaguaggcagaggcaggucagcgucugaguucgaggccagccugguuuagagagcuaguuccaggacagccaaggcugcccagaaaggcccugucuacucucugccccacaccaccccaaacacacacacaaagaguugggaucaguccaccugccugguagagcuguuauaaucuagagucaguccagaugugcaucacaucuggcuuagcuuugcuggcuaccacacaguuccugcuggucauuugauaggguccaucuucuggggcagcagauguauacauacacgcacacagauacacacacacacacacacacagauacacccagacacacacagauauacauggacacacacacauacacacagaaacacacauggacacacacagacacacacacacaugcacacacauacacacacuuugcauucuucuaaucagccagaagucugccuguuccauuuccugcagcacugucugggucuuuggggaugcuaacuggagacuuucugucucucacugccucuggaagaagcuaaccuggaacauuaucucagaacaugagcaguuaaaacagaguguguccauccaguuauaccgcacugagacuccacgggaugauugguguuugcuuaguuuuguuuagaaagcaugcagguuuauuuaguacacugcagagagcagcaggcggggcagcaacagaaccaccugugaggugauuggcuuugagccucagucaggccugcugggggaucggccaggaugacaucagccuguguuacagcgucuaguuugcaccagguugguuuacugucaccgggagccugauguauggcccugccagggcugcugcaguaaaaugccgugagccuggggccuaagcaacagcaauuucuuuucucauagcucugggguccaaaguccaagaccaagguguuggcaaugcaucucuucccggagcuucuccuuggugugcauggggucuuuugugugcuguguuucucugugugugucugauaaggacaguggaccuuggauuaagacacauccuagagacugggcagauagcucaguggguaagagccuuucugaacaugcuucagggccugaguuugaauccccaacacccacguaaaaacaacucaugcgcauauaccuguaacuccaaaacugaaggggucagaggcaggaggaucacugggguguaauggcugccagccuagcuccagguucaguagagacucugucugagggaacaaagcaaaaaagugaugcagcauaacaccugacaugcuucauuggccucuacacacacauguguacaaacgcacacgcgcgcgcgugcacacacacaugcacacaggcacacacauacacacgcacacaggcacacaugugcauagacauacauauacacacauacaugcaugcauacauacauacacacacacacaugagcacacauuucauagacacaugugcauagacauacacacagagguacacaugugcauagacacauauaugugcacacacacauacacaaacaccuuuauaccuguccugauggcuuuauuuuauuuuauuuuauuuuauuuuauuuuauuuuuugagacagucuugcuguguagcucugguugacugaccuggagcucacuaaguagaucaggcuggccaagagaacucauagcaguccuccugcuucugucuuucuggugcugggauuaaaggcugugacugcaugcccagcucccucuuuuccuuugagacaggaucucucacugaauccagaguucccaaguugcccaggcuggcuagcuggccagcccuaaggaucugcgucuguccagcccccacaaaccccagcaauagaguuaccacaugcacaaccgcguccuuccuuuucauggcuguuggggauccaaacccaguuccucaggcuugugugcuuugcccaucugcccaagccccuuauaauuucuccugaccccucugcacagucagcaugugcccacgcgcuccuguaucccuacaugguauacaugccuggugacuuuagacagguuaguauuuuggagaucauguuagcuaacugaaucuagcugaggggugcugauaucucaaccagucucuagcacuguuguauagaagucccagauagguguuuccaguuuagacaacagagccuuaggaaugacuccccugaaccaacagggcuaucuccuuuaucaacccacucacgucccuuaggcacaaagauacuuugcugugcaaaacaggggaggugucuggucccccaugacacagccuugccaguccuggggcaguauguuucuauauagcugggcaccgagucuacaggcugcuaaguaguggguacuggccccauguccugagcagcucaagaccccagaauccgcugcuugggacccacuaccauggggcuagugaaagcuuuauuuccaggcucagcuggcuguucuguuauagggccucccccuguagagguuggcugcuucuugggguauuugggauaccccagauccacaccaguguucgccuccccugcaggcaguucacuuccacccacgcccuccccaucaaaccucaaguuuccacacuggcccgcuaggcuuccaagccagauccuccggccucucuuccccugcccacacccucuagucccacauagcuagccagucacaugucucucucauccucaaacauuccugaaguugaagucacuccuuccuuccaccaaggccaucccaggacgggaugccucucuccagccaucuguuuauugaauccaugugugggagagaccaggagaaagggggcagaguuccaguuugggguaaauggucacuaagcugacuggagacagaaaaugauguuggaagaaacaaggaaaggcugccauauuggaauagcuggccuuggcucuggguaguguauccgguguucucagugccucaguaucugguguucucagugccucaguuuacuuacuuaggugagagcggggguaccaggccacuuaccaaaaugguaccuggggcuagagagaugucuuccugauuaagagcacuggcugcucuuccagaggaccugcgcucaauucucagcaaccucauuguggcccacaacuucuauacucugauuccaggggauccaacacccucacacagacauauaugcaggcaaaacaccaaugcacaugaaauaaaaauaaauacaucauuuuuuaaaagguaccuaaauuuguggacaggcucuaccugggaacaacuagacuugaggguacccagagucccccgucgccgccuccucaccccugaguuggcccugacacccagguuccuccauggcagcuggacaugcccaccuuggaccucagagaugguccgucugguuaagcagcacugaccccugccauuguccuucaggaugaagacucagacagugagauggggccacccacugaagaaccugaggaagaagacggugagcagcacccucucccucuccugccugggcugcagucuuugucucccccugagccagucuuagggcagugggaucugagaacugggggaccaagugggugagaggggcaaugggaucaugagaccaaggcucuauucccccuccuccucccuuccccucccuucucuuccccuccucuccccucccugcccacccucuccuccccucccucugcccucccucuccccuccuugcccacccuuaccucccugcccauccucaccuccuucccaccuuccccuccccuucauccuccccuccgauuccccauuccccccuccuuccccucccccuuucccucuccuuccccuccccuucucccuccccucccccucauccuccccucccuccauuccuuguuugaacucuuguuccuggcuuuucugucugugguauaagcaucuuugggugcaggaggacaccccguagagguaaaagcuucugggcuuuuccuggcugcuggguaucuucucccuucucccauccauaccugccuuuccucuuucucugguacauuugauugaggggcccuccaggagacgggggcugcuucuccagagccugggguggcucagauggggaaccacaggaacacauggaaccaagaggccccaguguguucuagacagacagacagacaggcuggcugguuggcaggcuggcugaucugucauauuuuauuuccuucaaagagaaaccggagcaaaacaaaacaaaacaaacaaaaaagaaaaaaaaacaguaaaaauguuaauauuuauuagaucaguacagcuagugccuggcgauacuuuuuuccuuuuuucuuuucuuuucuuuucuuucuuuuuuuuuuuuuuuuuaaagcagaacuggcugcagcuuuaagccaacggcuggcuggcuggcaggcuccaugggaagcaguggguucaggaaugugguaacugagcuagcuacagagcccagaaaguccccaggcccucucgaggagaacagggcuguggguuucuguuggcauagccccuuaggcacgggcagagguagguggggauaucaacaccuggccagccaggcccuugcucucugcuccugaaucauggagauaggaguuaacagcagucccaugagucugucugucugucugucccugcuggcguggcuaccaaaguccuacuggugacuggagcaugcagaagggagguuaaaacuggggcaaaccaagcaggcacaccuacaggcuaccaucccuaacuccgcugacagucucacauacgucaagcccucugcccgccuggccacaugucugcuccggaguccucccacucgucugagccucuguccuuggacagcccccaacauucauggccucccaucuauaaccaggcagaggggagaaaggccagcggucucagcuguuagaaggaagugagacugcccgccagccccccugcuggaagcagcucagccucccaggcuaauugauuaguguugcuaaaaugacguccccaagcggccugaugccuggaagaggaagcccccauccugcacgcacucccuggggacucucacacccggcccucuggcucuaacuaaauuggauugggcccaccgagugugauugaguuaaggccugcguuagggcagcuguccuggcaggcuggaaaagcaucaggcuaaucagacuugucccauaaaccagaacccaggcgcgcaccaagcuggcagagccguuuguguuuauuuuucuagaacagcaacacagcugcccagaugucgggguucuuugguuuugucaguacugcuucugggcccagcgagggggcagcuugcaagcugaagccccgguuguugucccuggcaugcaggauauucagggaucugggauaaacaaaggccuucucaguaggagcugcagcccugggcagcagacugcaguugcucggggaaguuccucagucuccggccacacccuggacuugaaaagcucuugguuccuaugaacuagaccagauggagugggccguccugggcuaugcuuauuagccuggugaggcuucagaccagugugcuggggagcugcagaggagagcggaggguuucugagaaggcaaagaacuucagacucucagagcugcagccucaucgcagcaagggccccgacagccaggcaaaccccaauugaccaauaugccucugucccccucacccauagucagcaugccacccuguacccucuguauaguuggccugaaacuugauguggaccagacuggccuggaacucacagagaccuaccucuucccaccccgaugugcugggacuaaagauggacgaacgcuaccacagccgccccaucggcgcucuuucagcccccuacccacuccgcccacuccaccacccuugccagggaacggcugcugauucgagucuucauuagcugcacacuugucgucuggucaccagagcaccuagaacuguguucucuaaauguagagcgauucaggagcaaagcagguccuuguaagaaguagauugguuccggaggaaagccucgggcccugggcagcuggcuagguaggaccccaguccuccuaagugaggcuugaugaggcacagcauggcucuguggaacguuugggcucugaguucaucuucagaaccuccuuccuuucggcgaggugagaguccuaaccccaguggcuuuucuuccuucuuggcagcaucuguauaucugaagacgugugcgaguggcgggggccugaccuacaguggaggugucucagacucuccgggaggcaguagaaaguucuaggauagcagcuggaagaggggacaccagcgucaccggcuauagccacccucagccggucuaccuuaacagacauuagcuagaagcuggccagccugcccgccaucuugucucagauacagguuggauuaagggacacagaaggcuuugcuuccaagcagauuauuacaucaggacaccccgccucuccaugcuucccugcuucccucugcugggacgccgugucucaugcaugcaugcccuggccuuccucugcucccccuccuccugccagaccugcagaucugccuuucuaauagucugcaggacuggaggcuacucucagaugcuggcaguccgccaagccugugcauuugugcaucccaccacggccccgaugucugucccaagccuaggagaagaaaaggaagguccgagucccugagucccuggggcccagcaugugaaugguauccgcuuuugcucugaucagcacacacugggguggggggaggccacaguggcgcagaggaagcccucccaggcaaacagcuggacuguugacgcagacaggcagacagcucugggcuggcuuaaccuggccugcagagggaaugucaucuggaagauggaagggcauggcagagggauuaguuucucucuggcugucucaguuccaucugugcccaccccccccauuaaagaccaaggcguaagaaaccacaggaguucauagaaaguauaagaugugcuggggugagaacaugacgucacugcgugggggugccuccaggaugcacucaggccacuacaagaacauuguagcuuguuggccucucugacagcaggucuuuuucuuuuuccauuucuuucuuucuuucuguuuuguguuugguuugguuugguuguuuugggggguuggauuuuuguuguuguuauuguuguuguuauuguuguuguuguuuugagacaggguugcuuuguguauuucuggcugucccggaacucucuugguaaaccuggcuggccucaaacucaccuaccucugccuccugagugcugggacuccagaggcacgugacacuaccuucuggcuuuuuuuauuuuauuuuauuuuuucaucuaccgauugagcuuuguugaaaauuaauggagagcugaggaugcaguucuaggacgaaugcuugccugccauguacaaggcccugaguucaauccccagcuacacacacacacacacacacacacauacacacagaggaaaggggguacugcuaagcacuugagagggacugcccccccccccccccccccccccccccggucaucaauaaacaguauucacuguccccacaggagcagccuucuccuuuaaauacagcccugggcagcugaggggaagccaguacaagaagaugaugaccaaagaagaacuggaggaggaacacagguaggucggcuucugcagcacuaauguaagggucaagcaggggugggccuccugcaagccccgcagccccgcccacuacucccucuucccuuuuuucuggggguggggggcggggcguccuuucucguccugggaauauucagccagcuucaaccaaaagaagaagcuaccccgggaggcaggcagcacggagggagggagggagggcgcgagaggagaggagaguccauuucuuguauucucucugcccgaagccuccccaacuuggaaaacaaugagugagaugccaggaaagggcccggagcagccucacugcucacuuaugcguagagucccugacaaaaccaauuugucacuugaggacagagcgggauucuuggugcucauccaucuggcagccucccuccuccggcccccacccucccucacccacggugucauucucuaucuguuccgcucgcucugcgcagcgcugcucagcucucugcgcagcuccggucugcgcagcucugcacagcuccacucugcgccgcucugcacagcucuaggaagcuguauggcuucuggaaucaggacaucuccccucaaccgccagagcccccaggacuucccccucaacguuuuacccggacugcacggguggcugaagggugcucagaagcaguaggauggccaagguggccauaacccacuguacccccaaccccaugugcaccugcugucccgccccgccccccagcagugugagcagagcccuugcguuauagagaagcccuucucagagggucugguggggacuagaccgauucaugagcugacccacagcucagcccaccucccuaggcugcuuccagggccaccaguaucccuccaguaucacaacaacccugugugcaagauccugucucccuaucaagaugcugaguguaaccucugggugcagagggaugucgguguacacagacgggaagaagcccuugcuaugggagccccugacucuuuguaugaggacauugccucucguugugaccccguuugccaccuuuauauuucaggauugagcugaccucugaccucaccucccuguagcgaguccccuagucccgggccacaaauguucuugcaaacccuugugguaaggagguugguuucguagacuagcagugcuuuccuuacauugucugcugugugucccccagcgccacugacguggucuaaaccccuccuccaacgccuccauaaccaaugaaugcauuucgucuccucugaacccaucuuguucuuccugugcacgaggacucccagacacauaaagaaccuuucccaggguuccccaaggucugcugguauaggugcuaguaugauuaaguggggaccauccucccugagccccgggcugcuauggggaugugcauacaucuugugaggugcccgauguggcuuugucucacccagaggagaggcaguuggcuguacaaugcaggacagaaaccccgagaaggccugcacucccucccauggugcagggcuguugaucuucagagcugggccugcagaccaaggcuagggccuccugugguccaccccaugcugguguuaauccagagggcagacagggucauuuuucugaggcuguuuuggaacuccagcgucagagcugagguguugccacagauccagcccuggcuggagaggagagagagggcaggacacccugccauccuaaagaccccuggggaugggagcuuggcagcaccauggccccauucuauccacucagguuaaugcacuguaggccuugaggggcugucauacaggaaagcaguuagaucucgaguuuggggucugccacuguccccugucagagcugaggccaagaaaugaaaaggcaaagucgcuucuaugucauuuacaaagacagcagacuccccacugccugaggaccuucuucuccaagucuuugggagucucuagaccacccaugacucgcucugcuguugacacucaaggcuguucugugagcugcagagugugccaaggagcugcuccgagugaagaaggagucccugacucgcccucugcacagagaaguccucacugugugcaggagggacugguugaggucccagcagggccugaguucauuucauuccauugccccaacccagcaugcuuccuguggcucucccacgcccaucucaccugacaucugcuugcucccucccagcccugcacgcaggcccagccggaggggcauccccugaccacaccucugugccacaucugaugcuggggguugcagaggcugcucagguuggcuucacccuucugucucuggcuuuuagaaaaacgauagcuacaugacagaucuggacccaacgggauuuggggaacggcucuagaacuguccccugaaaaauagcaccaguguauuugcuagcucagagaacaaaggugccugcugccaacccugcucaggccugccgcccugagucugagccucagacuaguucgauaaaaggggagaaccaagugguauggauugucccccaaguuccacaugcacacaaaacaaauacaaauguaauugauaauaauaauaauaaugaaaccguucaucuacauuaccaucaaacuaaugaaccacucucucaagcuggcaggcugcccgucagaccugucccuaccagcacaaugccucuuucugcuucuaggcugauaaacaggcaagcaagcaccuuguuagcagguaaauggugcacucucucccucucacuuugaaucauuagcugggccaccgcagcugcgccuagggcccagcucugcggcagcgcucugcucuguucuccucaggcuugaucacacuccucagggagcagcacugagcaagcuggaugccccaaauggguucuccuaccaucccaacugagacuuucugccccuggaucugcucagacaaaacuccuguccagagccugggaagugagaaggcaguaaccgcuuaaaucucugcugcucugcacgcuaaccuuuuuaaauucccucugggugggcacgcacacuccuccccugcuccccacauuggcucugacccugccgcucuccgaagcuucccucagugugccugggcucauuggauggcagacuuuugcucucccaggccaagaagccuggcuggcuuugcuuuuuagcaggauaucccaccugcuggucccagagagagagaggaacccagcuuguacacuaagcuugugcugccagcccgggccaggccccucacugcugugccugacugucuguaggucuguuaucuuuucacucauggaaauagacaggacccaagaagaggguuuuguaugacauguuagggcaguuagaaaaguggggacccccacccccagccuuaccuuaagaguucaggcucuuccugcauaacggcugaaagcaugcaauaacuccagcuuccaggagagggcgccaaaggcacacaaucagaccucgggccuucagagagucagagaguuggccaggcuuuuggcccuucuggggaaccugcaggguuagguucagagcccucacagcagacgaagacccaggcagcaggaagcaaaaaaaaaaaaaaaaaaaaaaaaauuaucuaaggcaauaggaauuccaucagugugaccacacagccaaggcuuagcaagcucacugaacaucgucucuguuucucagaagcugaaaguggcagagggacagcuggcuuuggcuguggggggggacuaacagagcugugucccugcaacauaugaggagcaaacugcuggucuaagaaagcagcagagccuaccauggccucugcaauuccaaacaucuuccuucucgucccugugcccacccuccuguccugugcugcuucugaaaucgacugaacaaaauacaugaucucucucucccuguuucucuuuacagaacugaagaauaaugaagguguccuuagccucuuccugaaagcuuuccuuccuuuugacauccuaaaagcuugagagauuuaaaaaaaaaacaaaaacacccccccccccccgaggagccaaugcaggcuggggugcgucccugggcuagcaagauccugggcauggccuugucucuguccuccucagaggaggaagcuugccagcaguaugggcucaggcuuugagcuuuucuuaccagccauguuugcuccccacagccuuugugccccccccccacacccuguucccacaaucccucuguguuuuuguucucacugaagccaaaccaccagauuugagaaguaauagacaaaggaagugaaguccacugguacucacggguggucacccacacucacacacacacacacacacacacacacacacacacucacacacacacacacacacacacacacacacacacacacacucacacacacucacacacacacacacacucacacacacacacucacacacacacacucacacacacacacacacacacacacacacacacacauguggggcuggggcacuuuccucucaggccggaaugacucaugucaggcauuagcuuuaauagggccuccguuuugugcucccacccccaccacaggagucucggguccaacccucucaauacuaagaagccuucccaguaguguucuuaccggcucagcccagucuccacuucugcgugcagaagcaaugacaguauuagccuccaggagacuucugggccgugcauuuucuaaguuuuuuuuuuuucuagauggcuuagaaccucagcagauacucacucaccguucccagguuagguuuuuuuagaauuuuauauuugauaguauuuauaccaaaugacuuggaagucauagacuuguuggugaaaacguuuuuuucuaaagcacuaguuuuuuuuuguuuuuuuuuguuuuuuuuuuaagaagacuuccuauuuaacagaagccuggaaaauguccagcaucaacuccuaagccguguauucccgacggucuccucccugauaacucggguuccgggcuuagggcugaacagacgacaaagcagcuguacacacacaaacugugcacacacacacacugccuuagcuagacacagagccacaugaccaacagucacacucaacugucccuaaacagcaauagccaagucccugccuaugcugggaucuccuccacauagaauagcgauuuccucuggauaugguuagcuaggcuuguguggaaccugagcauggcuugugggcagcaaggcccuggcacugcuggcggcuuggcucccuguguucagccuguguucaggccaauaaacaucgaguagagaaccuugguuaccguguguuucuucaguuugcuuuuuuucuuucuuuucuuuuuuuuuuuuaaaucuuuagaaacaaugggcauaaguuuaagccuucccucauuuugaugucuuggacaaucccagcagaguauggagcccuaugcacaccugauugaaaauacacaucccagggcuggagacauggcucuugggcccagagcauuuguucuugcagaggagaugggcucaguucccagcauccagaugaugauucacagccauccguaauucuagccucaggggauccaguucccucuucugaccuccgagggccccaggcaaacacaugauacauauacaugcguguaggugaaacucccauacacauaaaaauaaggauaaauaaauaaaugccauggcccuauaaguaggggguacugguagcaucagcugugaucgcaguaucugcaggcagauuuuacguagcgaauuccaggcuagcaaagucuacauaguuagacccugucucaacaacccugccuccaaaaugaacucuaaaaauuaauaaugguaauaauaauaauaauaacaauuauuauuauuauuauaaauacacagccaucauggcugccaaaaccuuacggacauucauuaagggacugugcuaaccaugcaccugacagugauuucauccacggcucugggggggcauccucucuguucaccauacccauucuucacauaguaggguucagagugcagccuacauggccccucuuccguuuacagcagaacugaugacagaccuaguuuguccagagaaaggaggguaggaaucgggacaucuguuaauccaacugcuagaagccacuguggacagaaaaccauugauugaguggaggguggaggguggaggugagaacucacagcagaaggaaugucauugaaagcacaagagccuggcacacuagcaugcuggcaccugccuuugaucccggcacuccagaggcagaagcagaggcagaggcaggugaucucugcaaguuugaggccagccuggucugcaaagcaaguucuaggauagccaggauuuuacaaagugaaaaccauagccuaagaccugacacaucaggaccaccccuccagauaauccaguuggcaaaagcuuuguggagacaugcucaguuaugacggaccuaaggcacagcuagagaucugagcuguacuguggcuccauggcuucaguucucucuaggucccaaagcaauaguaugucaugaaugggggcaggaacugcagaaucuaugcugcucacagggcacauugucccuggcuucagcugcucagcccacccuugauauuagcgaugggaguccuucugcgcuggucagaugguguggccagagucucacaaaccacaaagcagccauggaaaccauggggccaacacggaggcaucugcauccacacuugcuuugagcacaugaggaaauguuccucucucuaggcagcagaacccaggggcuagauuucaaccuacccuccccacugcccugcacucuggccugcacaucuguaugugcacaucuguaugccuccauuuccuucccuucugguucauuccucuuucucagcaccucaagcuacuuuaaggacauagugguggugguggugguaggguguccuucuuccuugcuccacugugacaugcagaucagcuauaauaggcccaagcagaaagugacaaggguuucaggacugaguguauuagugccaacugccuccugcguuuuaaguggagcuuacacagaaaagcacaagucguuagaaaagaggagagucugcaccuggccauuagcacaggccggcucugcuccgccccgccccgccccugcccugggucaggagcacccucuuccucucauccucucuucucaacagaguucagaaagaacagcuggcugccaucuucaagcucaugaaggacaacaaggacaccuuuggcgagaugucagacggggacaugcaggagcaacuccgacucuaugacauguaggccugucacccggcaagaugugacccaggacaucaugacaacucugagggacucggcccaggcaguuaguugugacucccagaccuuuguuugaaagacugucuuauaaaaacagagagaccuauguuauguaaggaucugcaauuuauauaucacaucagaggaaccuacaucauuucuucagggaggaaaccccagaucgcccuggcuucagcuugcugguguggguucagcugggccguguucuacagacucagagugggugggccaggggagaugaugagacucgguguuuggcaccuaaguauuuaguguagacaaaauacggggcgcuauggggggaggauauaggugugaucuaguaacaccacacucuucauucugcccuaggguuauuucuggaagcaucuggggugguaguugaagcaagcaguagaggagcaauauuuuaguaaaugucugauugaaagguccagccaucacccuggggcagaaccguggggucacugcugaagcuuguccucaguacagucacgccuugaguguguuugucacacagaagauuaugccagauacauagcaggagcccuggguagagcaugugugugcuaagaucaaggccccugaguuccacccccagcaccagacaccuucuuccccacacccuaccgcagcucaaaaaagacaacauaaucagucccuuuggugagaccaauggccuuuagagaaugagaaacuaccagaaagcaucccgguguccucuagaauaagugccaagggagaucacucagcaacgaugggggugggggucacagcagcuccuuuauacccacaucuuguucuacuucuuaucaccccacuggccagaaaguucauaggcugagcagacuugagucaagguuauccuaaggaaagaagaaggaagguuuuuuguuuuucuuuuuccagacaggguuucucuguguagccccggcuguccuggagcucgcucuguagaccaggcuggucuggaacucagagauccaccugccucugccuccgagugcugggauuaaagccuugcgccaccacugccuggccagugggaaagcucuuaagguccguuuuuauuugcuaaaauaaagcuaaauugauauagagacguagcucgaaauauggagaccggaguuaacuaugcgcguguguguguggugcaugugagugcgugcgugugugugugugcguguguguguguguguguguguguggugcaugugagugcaggugccuggagagagggcucugcaguagagggugcuugcugcucuuccacaggaccucagugcgguucccacagccauggcaggcagcgcacagcuuccugugacuccagguccagagcacaggugccuccuccucuucuugccuccccgggucucaugcuuauguccacacucgcacgugcacacagaugaugaaauaaauguaucugcagacuca

SEQ ID NO: 6500 - RNA, 6076 nt, Mus musculus
caguauaaaauguauccguuuuuauuaaauagguaaaggguuucauuggcaccauccacacgccuuugccccuaagacaugaccacagagaaaagccacuguaccacguacuaccaacucccaucugaguguccuuguucucugggugucagccccccaagccuggcugcgagcauauccuggcacagacagcggccacauguggucaccuggaggagcugcgcucuuugcucacacagucauccugggagguaguguccccauuucccaccaugcugcagguucuccucuucuuccugcggugugucgucccaucaccuucugacccagauucacacuggacacagggaggaaaaacaauucagggccgggacaaggacuugacacuaaacuucaggaccuccgcucaaucccuggggcucacuugguaggagagaaccaacucccucaagucacuuucugccuccgcgugugcuacaguaaauacucagauguacaggcacacacguaauaagucaacggaacauccagaaacaucuggagagagagcacgguagccaagagcacuuccucucuucuaaacaacaaaauucacugucaaguuugucuacagaggaacaauguucuuuauagagauacugcaaaccaaaauguuaagauagaaaagaccuagcaggguguggugaugcacaccuguaaucccagcgcucuggaagcagaggcaggcagaucucgguggguucaagagcagccugguuuacagaguuccaggacagccacagccaggaugugagacucucaaaaacacaaaccaaaaccaaaagcccuuuacugccagcaccugggaggcagcuucaggugaaugucugcuggucuaaggccagccuggccugaauggcgaguuccacgacagccaggguauguacagagacccugacucaaaaacaaaaaaaaaaaggaaaaaagaaaaaaaaaaggccagacgugguguuccaugccuuuaauccagcauucgaggccagccuggucuacagacugggguccaggaaagccggggcgacacagagaaacccuguuuuggaaaaaaaacagaaacaaaaaacccucaaaacugaaaucacaaaacaagaauuccauguguggacaagacuuucuucccuuuuuucuaaauuauggaacgucgagcacagggcuuuccuaggcuagcacauuagcaaguggugcuagcagcaaucccucugucauggcagaccaccuugagcugcuguuaacuaaagcaggucaccggguuugccuguuucuagacuuacguauuaccauccacagggaaauuuguacccggggcuucgugcguggucagaauagacucuaaucccugugaucccaaggccaccgugucacaaaccuucacacaccggggcaccucugcagcagacaagcucacaugugugagccgcuguaaaugggugccaucaugggaagggcggcaccuguccugagugaggacacugcgcucgcuccgcugcccuugaacucaggggccuaggcaggcgagggccucaccucugaguccgagucugacgagcuggaacuagaggagcuagaagagucgcuggagcugucagaggcaaugccuguggacuccuggaggucaacugcgucggccaggacugccagcucagggugcuccuguuucaagauccugaagggcaagaggcaauguucucagggcugugacagcugcuggcagcacccgcucacggugacauggacucagagagaaggccuccauugcuuacagcaccuggaaguggcuccagguggcaccacugggcugggacagaccacacaggcuguccacacucgcugaaggaaaacaacauucuagagccacgcgccugugagcaccagccacacaccucuggaggccgagguccuuaagguucuugccuugagacaaacagccccuuuccuacuuuucucccuaaaccuuuucuggcucauuuuccuuuuccuuuuuuuuuuuuugaaaaaagccuuuccuucccaaagcacagugcuagugagggggguugggagcugguuagauuauacuaguaagagcagagauaauuagagucauaagaaauaagcugucacacaaagagaccaccccuucacucagaagagaaacugagcugacuaauagcaguagcccuccccagcagcaaccuaaccuggcauccacugugaccagcgacaaaggaccugcuguaugcuguggccuuggaguggccucucugcagcacaguggccuacagggcagaguaaguagaccucaugcccgagagucaggggaauagcagccaccacccuugcuggccucucagcagggaggcagcgcacugagcaagccagaaucccucucuuaccccgagagcuggucccuccaggucaggguugggacacaguggcacgggguggcuggggguggcuugcacugccgcugcccgugcuguaucuguucuguggauaaacagaggagcuaagucuccaggccaguugccucacaugaacugaagguacuaaguucaaaugaaugcuuccagggaaaauaaaaaccucaacaaaggcuuuuguuguuguuguuguuuuggcuagugcuagcuuuuauguuuaaaaauaacaaacaaacgaauaagaauaaaaagaauaagaaaaaagaagaaaacagcacgaaaacaaaauaagaaacaaucccaaucgugaccaugucuugacugugauguuggccacacaugcagagccagccgcacguacccaagcacgaugccaccuggaggcuagcagacccccugccgacuagcucugaccugggcccuuucuacccacaggucgguaaggcccggcuguccccacacacaacauggcagcagggaccgcuucccuuuuccucuuuggggaaaaagcuggaacaaagcagagggaauaaacgguuucucaccuauaccacuuccuugauaacuuuggucucccucuuaccgucuugugccacacaacagggaaguuggugcugcuggcaaaguucugggugauggcaaugguggugucaagguugaggacaacaugccaccagcccccugaaauccaacaaaugaagaauucagugacgaucagcccugcagaugcagacacccugggggccaacucagcacaggccggccugugcucucucuccacugggaaugggcccuggaaggcagagccgagcgagcaauggugacacagacugucugccuccugggaagccagcugugaccaacacugcaaaagcaaagguucuaggaggaccccuagccuugaaacucucacugcugaaacugcaucuauccaguucugcacucacuccagcaaaaagccagggaaagcaggcagaaccuggccuacuacuggacacaggcaugugggacauggaggugcucucucucccuuuggacuugagucccuaacucugucgccacaggagggagugcacacacccaacagauaaaaagggcccuucugucucauucuaugauucuacuccaaaauggcaauacaggacaaguccggaccagucggagcugggacgaacagguauaguuucuucuagcucaucuauaccugguacaaagacaguuucuccugguuucuguaauaucuccagggguuugaauucagguggccagguuggaagcuguguccggggauagaugacauuaaaccagguaauugcuucauccuguugguucccuccuucuucucgggucaccuugaugaguucucuggguguguuuguugggaagaggcaccaccgcuugugacccugaacuaaggcauuccaggcacugguccccagagggucgaugugaaucccaguuccagaacgcgguggccccaucacaaaccaccuacaggaugcaagcaugaagccaugagagguaaucugaaaugcgugugacauagaagucucuauaauacacaaucaugcaugcugucuucagagacucuacauucugauauacaauauuaagugaacuauauaugaacugacgucuaacagaaaaaauaauggacugaugcaaauuacugcuggacuuuuauugauccacuaggugugguagcccaagcucuuaauaccaacauccuggagacagacacagauggaucuuaauuucaaagccuaccagugcuacacagagaccccuaucucaaaacacccaaaccaagccuggugcaauauugaacaucuuuaaugucuagcacuuagaaggcagaucucugugaguuuaaggucaaccugguaacacagugaguuacaaagagucaguauaagaaaccacacuuguaaaaauagaaauaaaacuuccuugauaaagcaaugguugcacuaaaaugaccuggggcugggcagagacggcucagguuagaagcacucaauuccucaaagcaccaagguucaauucuuagcaccucacaugaucccaauggcucacaacuauccauaauugcagcuccugagguucugaccucaaccaacaggcagagacugguaaaacauauacaugcaugaaguuuuauuuaaaaaaaaaaaaaugcccuggaggaauccagaugccuccccacccccccacccccauggaauccuucuuccgaaguaggacuauaaacaggucaauguguagggaagacuuucauugcuuuuacaagguuagacagaguucugcuaacaggcuugcggauuuguguguguuuauccagagacaggguuucuuuguguagcccuugcuguccuggaacucauucuguagcccaggcuggccuuacaaaaauaccacugccugucacuguccaugguuuuugaaaacuuaacgugaaauaauuuaccuguaagggggucugcguuucucccccgcguauuggaaaagaucaucugugaaaaacuugggcaccuuguagucuuccaaaaguuuccuucuuuugggguguucgccauagcugcuaucgaagauguaaaggggacugucaucgcgggugcucuccauguacucgauguaguacuucaucuucaucuuaaccgaguagccgucauuauccucgccgcacuugaacuucugguuccgguauuuccuuuugaggcgcuccagaguccauuucuccugugcggaccagcccucuugugcauugagcagaaccacgggcuuguaaggccucucguagcgcuccacgaacucuuucaccgacagcuguaaggcaucagcucucuccacguuauccugcgggaacaacaaaagaccugucccguuaggacacuggaacaaguccaguggcggauaaaggugucccacagggccaauuagcaaagacacccgugagcaauggcacacacgagcaaggaacgagcgagccucugcuccuccagggggccggagggacggaaggaggcccacgugcgugcgggcgagcacgucgcacccggagccaccccuucacgggagggaggggcccgaagcucccacgaccgagcgaguuuugacagccgggcugcggggccccaucgggggaccagcggcccucggaaggcgggcagccgucguguggggucccgcgccccgcucaccggcacggccgcgggguucagcggguagcucucguaguaguugugccggguccagucgagcgaguccuugagcuccggccgcgcacuucgcuuggccucgcggaugcgcuucuugcucuugugguucaucgugagccgcucgccguccgguuccgccccgaccccgacgcggcucgcguuuccugccaccaaacgcgcccucccucccuggcuggcgcggccccgagacgcccuucgcuccggcccggcgccuuuaaagucgccuuccagaagauucacuccucagccgccaccggagcuuuggguugggcgaacagcggccuuccuccccgccccaccgccucaugcgguccgccauuggccucagcgaccugccagacccgccuucaugcacgccaauugggcgccauguugggaaggucgcgucgccgacgcccu

SEQ ID NO: 6501 - RNA, 3198 nt, Mus musculus
acauucucaaaaaagcuaacaccaagaaaacacuuuaaucaaacuacagaaacaaugguuauaguacagaauauccauaagcaaaagauacaccauguuuuaaguacuuacaaaguuacaaaccauuugcuuccuuaacauuuugauuuuuuuuuuaaaaguucacaacacaaggaugaucagauuuaccauuuugcauuuuuugagggaagggggguauauuuaucaucagcuagaugugcucacuguaugcuccauuauuuauaugcaaggcccgggugacuggaagugcaguugucaggcauuuuaauaaacuggacagccauuuguuucugcacgacaaggcaucuuuacacaggagcaaucaggagaaaacaggaaacagccaagcacucugcacugcaacacgccaccuuaacagcuaaccagcauuacucaacugcuacacaacugcgccuagugcacaaaaauacauaagagaagagauuagaauuguguuggguaaacaauccuuuaaaaaaaaaauuaagucuuuucaccugaaaagucuuuauacaaauuuggguucagauuaucauauagaccugaagguaaauaacauauaugaacaaauuacaccaacuuucauagguuuuuaauuauuaagaagugaaggcaauguugagucauucugcugacagcuuuaggcuguauguaauggcuguacauguuuccuuauuaagucaggaggccacaaauuagguuaccaaucuguuuaauuucaaacaaaaaagucagcacuauaaacaaaaaugaaauuuuaccucaaauauccaauccaauaaugaaaucugaagucgcucaccucacuaaauuacaagaaauuugaauaacagcaacaaaauggcacauaaaaugaaguuugccaccugaggcagauuaaaacaaguaaaaaguuagacaaauguuacaaaauaaccuuuuuaauagccaguugcuuguuccaaggacucuuccauggaccgauggacugaguuugugguccuuucccccaauguccucuguuaagccgcuugccgauucaucuagguuugaaaagaaagagguucagcuuacuuuccacuacuaaaaagguuccaaagugcacaugguuucauuaucaggcauguacuuacuaaggcucuggugaaacaaguagguuacagaagguuccaccuggccauuaucaguuuuuuuaaaggcccaaaugggaguuuuuccaaaggguaccaccagcauguucggauauaugugauucuuggccaaauaaccaagaccaaaaaaaaaaaaaaaaaaaaaaaaaaaagaaagaaagaaaaaagggggaaaaaaaaggaggcaagggaggguuaaaagaaaaaaaagguaggggggcaggguggggcuguuuccaaacaaaaacuugcuaucagaaauuagucuacacuuuguaagauguuugaaaaugaaacguuuggcaguugaggauguucuuaaucagcuacuuagggcccuuuccuuuaaaaagaaaaauaggaccaaacaauuuagaguuaaagacacacuauccuuuccccacccggugcggaucaauaccuguaacuuucuuuugggguuccaaaaguucauugcuucuuaauugcaauuccuuugccacauccauuagaguaagaagucccagucagcacaacaacaguugcacugaauguuuuucucuaugaggauagugcaucuuuaacauuuaaagacaaaccugcuccaauacacgcccacagaaacuggucccuggaggaucagccaaaucaguuaaaaucugcaauacuggccaauauucuuugauaaaacaggagaccgcagcuuuaaagggggaaaaugcagacguuggauaaaaacagcaagaaauagucauuuucauuaauaggucucaaacagcaugaaacagccauuacuaucuaagcuuuacacaauccucucugcagaccccucuucagcaucacucccaaagcugaguaacuucagagcaguaguacucuuaacaccaggagucuuuaugcuaacaaggcucaaaaaaccuacuccauaccccacgggaguuagggcgugucucagauucccgcagacauuaccauuuucuuaggaagaaacugcucccucuucuucuggagacuugggugggcucuuggaccgcgaccuagacuuggacucucgcuucgacacgggcggagggcuucucgaucgcgaccuggaccuugaccucgagcgggaucuggagacggaggaggacuuggacuuggaucuucgggcagaucuggacuuggagguugaucuggagcgcgagcgagugcgggaccgagacuuggagcggcuguagcgggagcggcuucgcgaccuggaccgacuccggcuucgagaucggcugcgccggcgucgccgagggcugcgagugggacgugaacgaagcgacagggugagcuugcaggccgccggucccgccccgcccgccccgccgccauuaucuggcugccaggcgccauuucccuugccgcgaggcggggucucgcacggaguggcccggcccugcugccaccccggccgcgagggaggggcuggcuccacgugcuccgcguaccuuugugcccguccgccucccgcuccgccccgggccccgcucaccugcggcuccgccgcccguagccgccgccgccguaccgacgggguggcgggccccggcggcuguggugcgagucgggcgggcggccguagcgcgccaucugcacccgcagcucgcggccgucgagcaccgccccguccauggcguccauggcgucuucggcgucgcgcuugucguggaaccggacgaaggcgaagccccgggacuccuugguguagcggucccgcggaauguacacgucgccgacgcgcccguauuucucgaagacgcgccucagggugucgggcgaggugcgguaggucagguuguccaccuugagggaggucaugcccuccacaucgggaggcgggcggccguagcucauggcugcgaagcggcgccgagacccuaacgccccggacaggcccucgcucuccggaaacgcagcuccgucaggcgcucgguagcuacaguccucguggguagggagggagccgcaaggccgccgcagagcacccgaaccugacggacgccugagcagcaacuaagcg

SEQ ID NO: 6502 - RNA, 2175 nt, Mus musculus
gugaguucaagcuccauuuauuuacagccacugaacacagccacuguccucagccagugaauacccaaaaacagcaaaucaagagucaaacccaacagguccaggagcacgcaguagggauacacacaguagggccggauccucacucagugcacgcagacaaagcuucuagucaaaugaccuaaaaaaaagaaaauucaccaccagucgucauuaaaccuggaaucucaacguuuaguuaaaaccaccagaacgcaaaccacgccccaggguggggguacaaggugcucagucuuuuuaauuuccuguccuuccaaauggauaaaaacugcugacacccggggcuggccacccacccagugacuuccagaaccuucucugcccagauuuaacugcaggcuuuccuuggaaaccugcugguugacagaugcagaaacgaggccucugcagcucagcacaacuugaaauccauuccuauuugaccucccuccccuccagccaugucugacuccagcaugccuguguuccugaccccaucuguaccucccucacaggaccgccauagucccugugugcugucucuuuccaauugccuuccaugacuuguugaugucuaccugaacagaugcagagucccguguaacaagcaggaccuucucaagacacacuaagcauaugucuaucauugagccacacuccagccuggcucccgugccccugaagagcaugugacaagccugaacuauggcagauuccucuugucaugguuuuuccggaaguaugccacacccaggaccuucaaaauggugaccacuggccccauguggcuacucaaaaugcaaacgcccaguccuucaaccacacugaagagacaaccuaguggggcccacggucgcucaggugaguccuggggaacgauuucuguuuguuuggguuguacuggugucuuguccagugacgucuggagucacaacuguaugcaucuuuguuuaagcuccacgugggugggacagacacccaggaguagaagacuuccuagcaugcauauagccuugagcuuuauccguacaucccauaaaccacgugugcucgaggaugccggucauccaggcggcuaccagaggcagaggaaggaggauuagaaguucaaaggcugcccucagcuacuuaaugaguaaaggccagccugggcuaagugagacccuaucucagagcgggguggugcaguugcuggagagauggcucagcauugaagcugaacacuuguugcccucuuaaaggaccuggguucaguucccagcauccacaccggggcugacaauacucuauaaugccacuucugggaaaucugguacccucuugugaccccuugggggcaccaggcaaacauccacacucuaaaauaaaauaaaauaaugaauacgucuuuuuucucuuuuuuaucuaaagugaggggcuugaguaauggucaaauauuugcuuuuggaggacugugcucaguccccacagcuucagcagggcuccuguuugcaguaucauacaugaccaccaaacugcugcuaggauguccacaccuguuacugcaaauucuaaccccagggaagagguuccuccuccucugggauuuuacuuuaggucaaggucgggcugucugguacggggcugcacccaccucgggcggguacagccacacaggagccuuuucccagaccgucggccucaggucaccgucccacccccaaggauugacauaccugggccaaccaagcucaagucacuggaaacgcuccucgggaggaaggagcuugugcgugcuuccgucuagucguugggggaugugguucauuuccuggguggggaaauaaaaagacaauuuaauacaauucuguguaagcggacgaacccgugcggcgccugcaacacagaagcagccagugccccgccgauggcggcccgggccuagggccuuccuacaacuccagcccaucccgcgaucgcgugccggcccggggucagccuccucccaugggagucccgggagagguuucugaaucccacgaucgccuucgggaggcuccacggcgcccccgagccacgcugcgcaggaugcauccccucugcacggagcacgcgaguucuccuccccggcggaaccagcucugcaaaugcacuucc

SEQ ID NO: 6503 - RNA, 2613 nt, Mus musculus
cauuagaaguagagcuaugaggcuaguugagcuggcccgcugauugguuauauggucuugugcuuccuuuuaacuucucugggcuuccacuucucccucggcaaaacacacaagaccacgccuugcagcugcaccgcgcagaugccuuccgagcuguccuaaaagcugggaucucuccggcagugcagggugaguauuugguuaggaggcugcuuucuuuaucccuuuuaugagaaaaaggacagaccagcaccaguuccaccuuccaagucggaagcuugggcaugugcuagucagaccauuuacccguuaucacccagcaaagaugugauagcucuggagucuucuccaggaaccugcuucagaucccguaucucagacacuguuuccuagugccagccuugcuagucagcagagagagagagagagagagagagagagagagagagagagagagagagaccugaccaggguggcugcugucuugauaucauagcucaucauuuuguguucaacuucacaggacugcagacuagcucccagauacuuuguaacaaaugacaccaagacagugagcuuaaaacaaaacagugagguucagggguccaagccucuggccagguccuccacuugugcucucaugaagcugccauccuagucugaacugcuaaucgucugaaagaaagauccaucuucaacucagccaguuggugucugucaguuccuugugggcugucaggcucgcacuaugugggcuguuggaccuguuucuuugcugacgaucagauggagaccacacucuacuucuggcuaaauagcccccucuaucagcaacucagagcuuauccagcugcuuugccaaagccagcaugggguggagggcgggggguggguaucauggucauuuggucaggcacagucccaccuucagacacaaagguggcaggagucauggagaacaaucugguggccaccaugugacacgauagucacacaagcauguccucaauuuccagauucaggaagaaugucaagaacaggugaaggacccacccaggcucaguucagugggaaaacguucucaacagcuuugaugucccugagcuacaugcagguggcguugguaccuggcuggcugcggcagauccagagcagaaaccacaucggugggagccaggagacugaagagcuucccuuccuacugcaguccuguuaccugggguuggccggucugcauaguguggagucagcaccagcugaggauguacacaucgguugacauuggccagugcugcugcuucugccucuacccaaguggucauuguugggagggaggucguugggcuccagagggcaggucgaauguugaaacuaccugaaguucagaccagcucccaaacugagccuucggaagaaaggccuuuuguuaggggagccucuggagugggaagagagggcagucucccuccccgaauaggaagucugcugguggugauaucuaaugaagacuuuuaugauagaaauguaauuguuaaaaaaaaauuuuuuuuuuacaucggucucagagcuuucaauccaagagcucgaucauucccucauucaugcccuaaauaagcccuaauuaaucucgaggcuggaagaaaggaggcuagauugcagcuuucucuguaaggacacacuucauauuuugggggaguuugaagaggcucucaagcacuucccucagugguauuuuaucagcggcucagagcggcuucauuaggcugcugaaguugcuaauugcauuaccauauuuuuaagccucauaggugcgggccaggcuugacaucuuccaaugugcccaaccguuugccagcuuggcaugucagagaccccucgcacaguuugccucaggugcaaggaaggcgaccagcaccagugucucaggggccugcuggccaccugcugggagggaagccacuaccaggucucauucacuuggcagagagaauguggcuacagaaucaaugucguggugaggcuauaacuccagcauucaagagacuaaagcaagggcugaaagauggcuccauaaguaaagccucugccucuguccccaaagccacaugguaggaaagaauuaaaggggggaaaaaaagcauagcuuuaaaaguuaaugucgucccauggaguagaaaaaaaaaaaaaaccuucaauacccucgccaaggagggaaaaacaaaaugagcccaugugugcacgcaugcauucuuguggguagauauaaacauaugugcacacguuuauuuacauagacaugaauaucuauauauguguguuuggacagauauaaaaauauaggcauauauaugauaacugugcauauguguguagguagaugaaauacauauacauauauaugacuguaucuagguagauguaaauauaugugcauauauaaauacuauauguuuacauagauauaaauacaugcauauauauggauaucuauauauugcauauauauggauaucuauauauugcauaacuaugaauguagauauaugaguauaaaugcauguauauauuuauauagacuugaauauaugcagauucuguauuaguuacuucucu

SEQ ID NO: 6504 - RNA, 1732 nt, Mus musculus
ggggccuccggaggaugcaucugucagauggauuacucaagggcgccccccugucaccacgguccugcagggaacugcgggagcccgagggagugaagaccaccuucuggcagcgguggcaucgcccgaggcggguggcgcgacaacaccugagggaggcagagcaacggcuggcccgcggcuucggucucugggagggagcucucuacgagauuggggguaggaucccaugccgacccauauuucccaccuuccucaucagccccuccauccuuguacaccccucggauuccuccugugcacaccuagcuggguuacauacagaucucuggagggcugugggggcgcgcggagcccuaauuuugcccugggcugguccauauugccacacaucacacagcccugggauucucaacguggcugacucucccuguuuucucucguaggccucuucggaaccgggauccaguccuacuucacuuuccuucgcuuccugcugcugcucaaccugcugaccaugcugcugacugccugcuuugugcugcugccccuggucuggcuccgccccccugagcuaggcccugcccugaaacugagugagugcuggcccugccugggcaagcugcaugggcuagcuuuggacucuccuccauaggaccuucugcccggaugccacccagcacaaacucagacauccucgguauagggucgagacaguggaguugggagauagagugucacauauuugggggacccuguccugaugccauucucuucccacuuagcaggacuccagugcuccagcagcccccugccucagagugacauuccaagguuucacaacccacuuuggaauauuuuaacgggcagaguaagugggguaucuucuggcaauguucugggacaucugggagacuccagccugaaaggaccccugcucccucaagagagauuuuuggcuuuuaagggagacuuuucccuaagccagccaggccagauauagggacauguccccaugacccacagaauccagcuuggagcaagagacaaauggaggaagauguccaggccuguuagauaagcaccucccaccagguguggugacacacgacuuuaaucccaggauuuaggaagcagaggcaggcaggucucuggguuuaaguucagccucaucuagagagaguucuagaacagccaaggcuuccuagagaaacccugucugggggcugggggaguaccucccaauuccuggaggccgcugagccaguagccugaguccuggguccaaaucccugcagccuugggcaagucaccuggcuucuuugaguguguguaaaacagggaugcucuuaggccaggcagcaggaggauuucaaguucaaggcuugccugggauaggaaaggagaucuuguccuuccagggcaagcacuucagggcccugcacucagcuucauucagaugcccucacugucucuccaggccuucaacaacaccuaucucuucuacggugccuaccgagcggggccagagagcagcucugaauacagcauccgccuggccuaccuccuuagcccgauggucugccugcuccucuguuucugugggauacugcagaggugagggacgaccccacauccuccaggccuccauccuuggccauccuucccgggccacagagauccucaguuggcagauagaucacugugcagugagacucauccugguuccgcc

SEQ ID NO: 6505 - RNA, 5582 nt, Mus musculus
auagugccuucaguauuuuauuucacaguccaccucugacaacuccacugugucagucacuaaggaucuauuuucuugaagacagggucucguguagcccaggcuugcaucaaauucucugaguagcugagaguggccuugagcuucuaauccccuagcaugguaggguuacaguugugagcugugagcugcugggguucgaacccacagugcuggggauggagcccagggcuuaugcacacuaggcaauccugcuacaccccagggccaaccccaaccccagggccugccuccucuaugcgcuuccuucucuggauaugcagucacagcuuuccccaccuuaugccugguuauuccugacugcguaaggccaucccaggagugucacuggagcaaaccagagacggaaugaugucaccauccuccagagaggaugagccuucaccaggcuaacagcuucaggcaucucacugcccacuccaaucguagcacggggucccggauccccuggccucagggccgcaacugucucagcacaaacucccacuucuucagugccaguuccguguccugagcagacacaucucggugccacacagcccgcacagacuguucuguccagggaaacagcagcacgcgcacggcacggccagucugagccaccuccucugcacucacagccugcaggcgcuggcauagcuccgagggaggcagcccagcuaccugcaccagcaccauguuggucuccacgguggcaggauccacagagcaaaugggugacgccaggucuuggaguccuggagucagauaugguggugaguauaccccaaccccagggcccaaccaugccacugccagaucgaucccacagggaaggcagaagggcaccccgauuauccuguggggaaacagcuugaauccugauguggcauucagaaacaugaguugaguccuacuuuuuccuucuuccucacacuaaauagauuggucaucuacucugggccucagaugugggaacaucauagggucauuaugaauguuuagaacaugcacaaaagacccaaguuggaggcucuacucuggccugguuccugacucugcugguugcacccaguguggggugccccuuggagcagggccggugaggcaagaagacccaaggucccauccuagagacuuagugccaacuaacucucucucucucuccccucucucucucuuucuagagcugaggacugaacccagggccuugcgcuugccuagcacugagcuaaauccccgacccuguagugccaacucucaacacgcuagacucuuggggugcagaucugcuggggaccugauccugcugcccgggacaucuaggcccaaguaggagggagcaaaagggauagggggggguccuuccaggcaccuuuagcgaaucucugggcauucucguggucccuugguagcaccuccucugccucagcuagucccaccagggcagccgcagccagcacuccagccuggcgcaugccuccacccagggccuugcggaggcgccaugcuucuccaaugaagucuuuggauccgccaaccagagcucccacuggugcaccuaggcccuaagggaagagaagagacccuaucucacaaagccugcccuugagaugagguuagagcuucagccucagcacccgagcgaggcaagcaggucugucaggcuccggaaggacagccuaccuuagagaaacagaaggauacagagucacagugcucuacaaggcgggcaggggguaugcgcagagccacugcugcauucaucaaccgagcuccauccauguggacccuugcuccgugggcgugggccaggaggcacaccugaaagcaaagggcaggugguguucagaggcaaaauuuccaagagaccacugggcuuggaaucuuguuuuuuuuuuuuaaauuuaaauuaaauccagaagcacuggauuccccaggagcgagaguuacaaauugugaguugccugguguaggugcugggaauauaauucagguccucuggaagagcagcaagugaugcuaaccauccagccuucucuccaguugucuuauuuuuauuuuaugugugcagguguaugccauugcagaugguuuugauccagccaaacucucagucucucucucuuucucucucucugguuuuucgagacaggguuucucuguguagcccuggcuguccuggaacucacuguguagaccaggcuggccucgaacucagaaauccgccugccucccaagugcugggauuaaaggcgugcgccacuacugcccggcucagauucucucuuagagcacuguuguuaaccacugagcaaucucuccaguccgccagagagaggauuuuccuaaggaaagggacuguaucaggggaaacaggaagcccagagugcacugggcuggcauugggacacugcugugugggagccuaccugggggagguagccuaccuggcggagguagucgacagggaggacccggccucccgcgcugcugugaguguucuccagguacacgagcucacagacuggaugguagggacucccagagccccgcgugagugcccucucuagcucauucagguccaaggugccauagggcaggucggggagggggugggaaugcaccccagcgaucugcaggugggagaggaugcuggaucagguggguccgguggcacuucuggguaggaagguuccccugcagucagagccaccucuggaacccagggucuuucuucugagcauguuuacacagcauccgaacuggaaaggcugcugguuccugcuuuuucuguucagucguugcccuuuggcgucuuucuggagugcuagugcuccaucuguccacuagagggcaguaaggcaccgcgacaagugagcaaaucugggcccaggcccucccuuccaucucucuuuccccccucugccgguuccaggcugguaccugagaaacaggggccuaccuugacauccuagcuggcugaagaauauccaaaaccccaggguauuauugucugguccuuaccugugccaccccgcccugcucauagacguggagguggcauuccugcccaaggaggaccugggaaccccggcgccggcagugacccaucacugagacagaugggaggagggcaggauuuggaacuggguccagaggaucucucugccccugcucagcuuggccaggcugagcuagggcccccagugagcucagacucccucugucaauugggagucaaaacaccucacugucacguguugaaaagacugguguguuacacaauucuaggcugugaaggcuggacacuaauaaccugcaccagacccccauggccagcaaggaagagugccaggaugcugccuccaggaacaggcaucccaggguaccaggagcagccagaggacagaagcacacugggaaacaacccaggccagggcugcaagguaagcauccaggaagaagagcuagggaguagcagagacucagaccucacuccucccacugccaaaugcagagugcuccaccaguugcacccaaaagaaauccaggugugugcccaccagugccacagacccuuugagcuggggcucagaggggcggguaagacacucaccagagaugagguuggccauaguguuggugggcacaaacagcguccucucuaccccaagcaacucugcagccuuuuccugcaguucugagaagggaggggggcaggggaagggcaagaaucagcaauuccucgggccacuguaccguggcacacaguucguguguacuuguuacaggguuugauagaauagaccugugauuccaguacucugcugaagcaggaggauaacugaguuggagggccgccugagcuauacagcaagaccuuaucuuaagcacuucucuccgaaaagguacauuugcucggaugagaaaugaugguccuguggguggggcuuggagucugugaucuugguaaccacgugccacagccagaggccccucugucaguccuccugagccacaguccccgccccaggccaccgaaacucccuugugguuugaagccccuuucccacccagaccucacaccuguuuuucucccuuucccagaagccccggcaggugaggccuugugguuucccuguggacuuccucugcacaucaccacggaagaagagccucuggggagcgggcagggcacaaagagugcagcuggcgggugaguggauggccuggguaaaggccaugguggcucuccugucugugacacaaugcucagugcuaaagugaucuagauucuguccccagaggacacauacccgugucucccugagcccugugugcggucggggaugaguucugcucgcuccuccucccagccccugguucacccuccucagacuccugucgaggccaggaccucccagccuugauguggugaccuguuuacaccaggugccugcugagagcaguguagcucagcaucuuugaaguuccugguaauaucuuguugucaagagauucuagaucagccccaaucaccccuggguccacaaaggucaagugugaucucugguguaucucuggaucucuagugcacacacagcagcacuagagguccaccuuagcagugacuauugaccccgggugggcuuugguuugcugucuccuuaacgcgcugcacucccuagauaugaaauucugcacccccccccccccccugugaaggagcagcgagcacuuucuuugcuggauugauuuugucuuugugaagucagccaaugaaugaaggagaguaguuagcccuccuuguaguaagaccugucucaaacccugguucuucccuguuccugauguggguccuugaacuccucucugcccaucucggggucuugcuuugccaagucuggacaacacccaucugggcaauugggugacagugggcagaaaucaccaggugguccuguuaaaaugcagauucuggcuccccaaguccauuguggagcucaagagucugcauuaccagggaucucuccgagaaggaacaagaacgcagagugcaccacugagcguccucaaaugucagcgaggcaccccucugcguccgugcuguccugucagaaccacggacagcgucccggggucaccgcaacgaccccugccccgggccuguucgccgggcucaccguggaccguagggucuucgccguaaucaucgucuccuacaaccgcuucggccauagcgcgccucauggccggcccuggccgggucaccgugucgcugcguagguccaccacgugggcugggacccccgcccaauuccuagaccacugagcccagggcacccugagccccgggaccguggcccggaacaggcugcguagcauggcggcccggaacaggcugcauagcauggcuguggcacucgucuuucucggccgcaggagcggaggacagucucuuccgugccagcggggaacccguguaacuggacucuucugaccccgcgcggaccugaacugggcaagcccggggcacuaug

SEQ ID NO: 6506 - RNA, 3972 nt, Mus musculus
acuuuuuuuuuucauuaaaaaauagugcucuuuuauuauaaauuacugaaauguuucuuuucugaguauaaauauaaauauaugugcaaagucugaguugaacugggauuugguugaguuuuucaagcaucuucagacagccucgaaggccugaguggggagaggggcgggcuggagguggauuuuuauaaaagugauugaggcaaauuguaaacauuauucaaaacagagagaaaaaagccaccccaacacacagcugccccacccagccccauaccugacuucagaaaacuuguuucuccccaacacaggaccaguuccagguaauugcauggcugcugcauucccgugaggccccugugagcggcaugggaaggcuucuccaucaccuccugccuccccccaggugagaagggagggcugugcagggccuggaggcucucggaccuacugaccgagagaugacuaggacuggccaaugucuucccaguguuaacucaggagucuccugagugacugggucucuccccugcagccacuuccccuggccuguagccaccugggugaaucccucaacucucugccuauuggcuguguuuggcuccuugugugccaauccccaucccugggacagagggcauuuaaggcgagucuccuagccccacauaggagagacaaagcagaacccuccaucugcuccagggaaaccugggcuccaagauggcucaucuguugaucugccucccuucgguguuggaaaaggcggccagcucaccagccucaucugucucccuucuaaaugcuacugccucuucacaacggggaggguucuggggugcaagggaucugcgagguuucauuagcugccccauggagaggagccuggcaccaguauagcucucuucaggucaccccuugccacucuccccagagccaggagccaccacuccucaccuagguugggcagugggagugguuauuucuuuggccagcauaaaaacccuucacacacccuuuucucuuccauccuucccccaggugccugcucuugaucaaaccaaaucaaagcgcaaacaaguuccagcgggaaaguuugaagauuccccuugcaguucuaaguucaacacuuggagguguccccaccucccuugggaagcagaggggguguggaggaaggggaggggagaguccgcuugucaaagguauugucccaccaggccaggccggcuggcuccacuugaaagaagcuggagcugggggaggggggaaagcagguggcagcucccccuccccucagacgaauuccagguccugccagcucuacucugcgggaguggagggccugaggaagaagccaaucugccccuggcucacugggagcuaccgaccguuggggcuggauuuuugugcuugugccaugugccucggaggagaggcgaccgaccgacccaggccccccucugacccuuuugcuccuuaaaguggagcaucauacugauccaggaacucccgaauggguccaggcagcugggucacuuucucauaggaguccagguggccguugacagucuuccgacaaagaugcuggaggguggccacguuggaggagagaggucggcucaguaccagcggaaucuucucgcccccagaauagauguaguaagcucucuuggggguacucccggggagugccugggcagguggcugcuccggaacuucggacgaggguuccguggguggcaaagaaaaggagggggucccuggaggcggcauguaguggugcaccagcuugaguacacagucgaagcggggaacuggcugcgugcuucgggggucacucugcagcgaaaagcugccccccucacacuggaugcguagguucuugguccccgacugggucuugacgcucaacgugaagaaguggcgcugguccgagcugucgcggauaagaaaggugcccgcgggcucggcgcugagcagcagguucgccucgccgccggucacggcgcuccaguagaauccgcucuccugcagcuugcgcacggcguucaccaccagcugguacucgcuuuuggagcugaaggucuugaggcgcaggcugguguccagggggcggcucaucccggcggcgggaaacuugcugugggugaccauggcgcacggagccagcguggaucugcgcggcgguggcugcagcugcuucgcggccuccgcacagcggccgcuaccgcaucccggggagcugcagagagcaaagcgugaggcgcgugagugcccggaacccuccagcgugcccggcccuccagccuccgccuagcgcccggggcaccccuuugccccgcuuuagaccgugucucaggcccagccaccucgcggaacucgacuguccucggucacugccggccaaccccagacagucucuuccccugcccgcccuaggaggacgcccagagaaaacucgcgcguggaaguugggucuccaggagcgcggccaggauggggagagacacaagagcccuagggacgcucagggcgccucucaguccgguguccucaguggcgagggcgaaaaaaggggggugccaaacccgagauaugugagagaggggacaggagaaacccgagggccccagucugaguaugacgggaaucagggaucuucgguucucauccgcucugcccccuaccucguccccucccuaccgggaaugacccgggaaggggaggagaaaccgggaaaagcucccgagcuggaccgaggcccccacccuuccccacaccgcgccccuccuuccuaccuagucccgaagcgaaaucuccggccuuggggcugcgccuccuaugguccccgaggcgaggcggcggccagcaguggcucgcgcugcgcccagauguuggcagccgugaagucuacaaaggggcuccccgugcgugcgcccccucuggcuucgcugcuccccgggccgaugaggcgcacuccugggcgaaucaggcaaaggaccugggcgagggaccucgacggagagcugggccgggaagggggcguccgggagcccggagagacagcggucguaagagcaggcgaguguagagucagaguuagagccgccucggaggccgcgcgcgcggguauuuacccggccaguacgccccgccccccgauuccuggaacugcccggccggucuucuuguaauguuuagucacuacucugcacugaaaggcugugcgcggagggcgagggaggggccgcggagggcgggcuuggagcuggggccuccaggacccgccgagacucaccgagagggagacaaagcgcggcgcgaggcugcccgaccggcgggcgcggcgccagccuuggccgagcguuccuggcagcggccccucccccgcgcgcuccgcccccaacuucucauucacacuuuccccccccucccuucuaagaaggcugguuucuggcagaggcgggggcgucgcgaugggagcgcgcgggcaguucuaggaggccagccgggagaggcucccuccuggcaccccuucccuuucuuuugauccccgcggggacgcuccccucccucugcacccaggccacuccgagguccucauguacaguuccaagcaucccgugccaaccaaaagggacguaggaccauucagccaccagcccacuggggaccuaggaaguggaggagggggaugcgcgacauuuaccuguagacagguccaaaagaugaagcugugagauccagaaguggaggagacacugacuuagaagcagcuaccuggccucagcucauccgcccauugccugguucuucggugacagacgugggugcugauguccuuuggggaguggggugggaggagcagcuaacuacuaccuuaucacucaucugggccucccaaccugcguggcgaacuguggguccgcccagguacucucggcgcggugggggagcuagaggaaagaaacc

SEQ ID NO: 6507 - RNA, 3972 nt, Mus musculus
gguuucuuuccucuagcucccccaccgcgccgagaguaccugggcggacccacaguucgccacgcagguugggaggcccagaugagugauaagguaguaguuagcugcuccucccaccccacuccccaaaggacaucagcacccacgucugucaccgaagaaccaggcaaugggcggaugagcugaggccagguagcugcuucuaagucagugucuccuccacuucuggaucucacagcuucaucuuuuggaccugucuacagguaaaugucgcgcaucccccuccuccacuuccuagguccccagugggcugguggcugaaugguccuacgucccuuuugguuggcacgggaugcuuggaacuguacaugaggaccucggaguggccugggugcagagggaggggagcguccccgcggggaucaaaagaaagggaaggggugccaggagggagccucucccggcuggccuccuagaacugcccgcgcgcucccaucgcgacgcccccgccucugccagaaaccagccuucuuagaagggaggggggggaaagugugaaugagaaguugggggcggagcgcgcgggggaggggccgcugccaggaacgcucggccaaggcuggcgccgcgcccgccggucgggcagccucgcgccgcgcuuugucucccucucggugagucucggcggguccuggaggccccagcuccaagcccgcccuccgcggccccucccucgcccuccgcgcacagccuuucagugcagaguagugacuaaacauuacaagaagaccggccgggcaguuccaggaaucggggggcggggcguacuggccggguaaauacccgcgcgcgcggccuccgaggcggcucuaacucugacucuacacucgccugcucuuacgaccgcugucucuccgggcucccggacgcccccuucccggcccagcucuccgucgaggucccucgcccagguccuuugccugauucgcccaggagugcgccucaucggcccggggagcagcgaagccagagggggcgcacgcacggggagccccuuuguagacuucacggcugccaacaucugggcgcagcgcgagccacugcuggccgccgccucgccucggggaccauaggaggcgcagccccaaggccggagauuucgcuucgggacuagguaggaaggaggggcgcgguguggggaagggugggggccucgguccagcucgggagcuuuucccgguuucuccuccccuucccgggucauucccgguagggaggggacgagguagggggcagagcggaugagaaccgaagaucccugauucccgucauacucagacuggggcccucggguuucuccuguccccucucucacauaucucggguuuggcaccccccuuuuuucgcccucgccacugaggacaccggacugagaggcgcccugagcgucccuagggcucuugugucucuccccauccuggccgcgcuccuggagacccaacuuccacgcgcgaguuuucucugggcguccuccuagggcgggcaggggaagagacugucugggguuggccggcagugaccgaggacagucgaguuccgcgagguggcugggccugagacacggucuaaagcggggcaaaggggugccccgggcgcuaggcggaggcuggagggccgggcacgcuggaggguuccgggcacucacgcgccucacgcuuugcucucugcagcuccccgggaugcgguagcggccgcugugcggaggccgcgaagcagcugcagccaccgccgcgcagauccacgcuggcuccgugcgccauggucacccacagcaaguuucccgccgccgggaugagccgcccccuggacaccagccugcgccucaagaccuucagcuccaaaagcgaguaccagcugguggugaacgccgugcgcaagcugcaggagagcggauucuacuggagcgccgugaccggcggcgaggcgaaccugcugcucagcgccgagcccgcgggcaccuuucuuauccgcgacagcucggaccagcgccacuucuucacguugagcgucaagacccagucggggaccaagaaccuacgcauccagugugaggggggcagcuuuucgcugcagagugacccccgaagcacgcagccaguuccccgcuucgacuguguacucaagcuggugcaccacuacaugccgccuccagggacccccuccuuuucuuugccacccacggaacccucguccgaaguuccggagcagccaccugcccaggcacuccccgggaguacccccaagagagcuuacuacaucuauucugggggcgagaagauuccgcugguacugagccgaccucucuccuccaacguggccacccuccagcaucuuugucggaagacugucaacggccaccuggacuccuaugagaaagugacccagcugccuggacccauucgggaguuccuggaucaguaugaugcuccacuuuaaggagcaaaagggucagaggggggccugggucggucggucgccucuccuccgaggcacauggcacaagcacaaaaauccagccccaacggucgguagcucccagugagccaggggcagauuggcuucuuccucaggcccuccacucccgcagaguagagcuggcaggaccuggaauucgucugaggggagggggagcugccaccugcuuuccccccucccccagcuccagcuucuuucaaguggagccagccggccuggccuggugggacaauaccuuugacaagcggacucuccccuccccuuccuccacacccccucugcuucccaagggagguggggacaccuccaaguguugaacuuagaacugcaaggggaaucuucaaacuuucccgcuggaacuuguuugcgcuuugauuugguuugaucaagagcaggcaccugggggaaggauggaagagaaaagggugugugaaggguuuuuaugcuggccaaagaaauaaccacucccacugcccaaccuaggugaggagugguggcuccuggcucuggggagaguggcaaggggugaccugaagagagcuauacuggugccaggcuccucuccauggggcagcuaaugaaaccucgcagaucccuugcaccccagaacccuccccguugugaagaggcaguagcauuuagaagggagacagaugaggcuggugagcuggccgccuuuuccaacaccgaagggaggcagaucaacagaugagccaucuuggagcccagguuucccuggagcagauggaggguucugcuuugucucuccuauguggggcuaggagacucgccuuaaaugcccucugucccagggauggggauuggcacacaaggagccaaacacagccaauaggcagagaguugagggauucacccagguggcuacaggccaggggaaguggcugcaggggagagacccagucacucaggagacuccugaguuaacacugggaagacauuggccaguccuagucaucucucggucaguagguccgagagccuccaggcccugcacagcccucccuucucaccuggggggaggcaggaggugauggagaagccuucccaugccgcucacaggggccucacgggaaugcagcagccaugcaauuaccuggaacugguccuguguuggggagaaacaaguuuucugaagucagguauggggcuggguggggcagcuguguguugggguggcuuuuuucucucuguuuugaauaauguuuacaauuugccucaaucacuuuuauaaaaauccaccuccagcccgccccucuccccacucaggccuucgaggcugucugaagaugcuugaaaaacucaaccaaaucccaguucaacucagacuuugcacauauauuuauauuuauacucagaaaagaaacauuucaguaauuuauaauaaaagagcacuauuuuuuaaugaaaaaaaaaagu

SEQ ID NO: 6508 - RNA, 54682 nt, Mus musculus
ggaagaccuuggggccaggccugaggaaaaaguugggccggcggucauggggauggggaugagggggcagccugguggccuuucagggacaaggccugaguuccacccagagucgggggcccaucagccuuaacgagucgcacagcuggccguuuucgugugugagugccaauccagcgcgcagucagguacgcagcgcgcauggcccuacagcgcagcgugccagguggugcgggaagcccgcagccugugccaggcugggcacaacaaaagccgggguucuggggagggcugggcggcgcggcgcgggaggagggcugcugggagcgcccggccugcacuggccgccagccaccgagaggaggagcagaggauccucggagcgcaauaaaacggcggcucggcccgagcccgcagcaaacacagccauagaaggcagcggaggagccgagccgggcugcgcucgcucgccgccccccagccucuuucuucuccgccgggugcacugcccugcgccguccccucgccgcugcgccccuugacaaagaggacagaaaguuugcgcgggggagcgggccaggugaggaggggcgugcccggcgccccaguccgcgccccagcagccggacccaggcccccagcgcgcccgccaugggcgccgcggcccgcagccuccggcuggcgcucggccuccugcugcuagccacgcugcugcgcccggccgacgccugcagcugcuccccggugcacccgcaacaggcguuuugcaaugcagacguagguaagcggcuguacccggguucgcgcggcccaccucucugcccuacagccgguuggggcucucccuuugccauccugcaacugaacgccccaagcucacuuucucccucccccguaacccccuccaccguuccucucuuuucuuuuccccucugagcuggaagaugcuuggcgaccucaaaauuccuccgaaauuccgcagcagcuccggccccaggaaagggagccagggaacgcuuggguguuggcaggccgccucccugggaugccagcgcugggggugggggagugggggacacgcggggggagggugcgauggcuaaaggacugggaaccccgggaagaaacuuccacaggugaggugcuggcugggugaggagggcuucucugcagccauuugggaguuuuugcuuagcagggcagaauggaagcccccuacgcagaucccaugagcucagagggacagaggaaggcugcuagagucuacuuccccgcugcguguucccuagaaggccccaccgacagggccaggcaggauccaggagccugacuauuugcugcuguugacuuuuuauuauuauauuauucagaauguccacacacacgaaugggggugagugggggauacgacgacuuggugaccuaugggggucaaggaauuguguggcugcuuagauugccuggcauauauguuacccuuaggacuccuuaacccaaaggguggguacaaucgagcuagguagggggagcauauauaguuaugugguccuggaaaagcuggcagaaguggaaggcuccacuuggaguugagucccugaaggccucuccugcgcuacucaggcacucagcaggugagacuguggcucccagcccguggcuguccccgugguuugccuuuuacaucucuucugaguauccuguguccccucuuccacacagacagaagccacaguuccucuguuucuccgggugucagaaguguccucuugguacccuuuucguggcuccuugucccacccugcuuagcucuuuggagcguuuuagccguauccuaucuguggagcuaccucacucagcccucuugggcaucggacauagugcaugccuguggagaaguuugcaaacgcagucugaagggggugggggagaugagauccuuuuugcaguuuaucucugugguggucagcaaaauaugggauugaggaagugacccccuccaaugaggaaauccuuacuguuuccccuccaggggcauccuuugggagugcaggcacauuugggagugcaagggcacaagaccacaugucuaccuagcaaguugugaagaauuuagagaaaagcagcaugcgggccuugggagccugguccacagggugcgaaagagcuggcuugggauacccacacugcuagcugcagguuggaggggggugcuuagaaagacucugcugucuuugcccagccaaggccgugccaggcugggaacuauacuggucuggucuggaucagaggucugaggcucuugucaaugccuggaggcccuuuucugcuuguacacugaucucuuuugccuagcuuucccaguauugguguccaaagccuugggccaggucacuaugaagccaagacuucgaacucaucccagcacagaggcccuaucccauagcagagcguccccuguggcugcuaugacagauguucacaagugagugccccaaagcaauggacugaccgucucaugguuccugggguucagaauucagaaauccagaugcuggcagggcuggcuucuuuuuggagucuggcccaguuugacccauuuugacuugaugacaucagcagagauuuccaaauaggguauuguauucguagguccuggcuggucguuaauuuguggaagggguaccgcugaacucagcauagccacgguguucugccucagccucacucacccuucccaggauugaccagcuuggaccaaaaaaagggagcugacaccucaggguagggaaaagcagagaacccgccaugucaccggaggccuccccagguucuguucucguggaugagguacagauuugugacucgcucagcagggcacucugguguggccaggaucagaaaugcccauugcucucucugguguucccagguggacacgaaggcccaggccagacuuuggcugcuguaguuuuuucaaggccccucagguuuuguguacccggaaccaugaccagggagccuggaaagaguacccaucaguguguaauaaagguuggcuuucccuguggcugcagccaggaugcagcuuuauugccuggcgcagcauccgcccaggaguggauuccugagggagaucucucugccaaugcagaucuggagcuguagugggcaaagagaaugugacccuucgcuagacgggaugagagaaggccuggcccacucaggucaggacagaugcaaacaugugucuguguccuggcacugcucgggcaugcugcuggucugauucucucaccuaauggagucuuucaccgccuacugcaagccucagacagcacuacaugggaaagcuggagugaccaaauccguuaagcuacuuggcauaccauggcugcuuugauugcucucuggcaucgggguauucaguagcgagaggaaaaaaacaaacaaacaaacaaaaccccaccccuucuacccaggaagugagaccugaagccacagucaagacccaaagggccagguacuacuaggucccagggugaucagggagaggacauacuggcuuucuauggguccuguuugacuuugcguaugugguaauggagaccagagagguaucaguggccacuccagaaggcaugcagcucacacucaguaaugagucugucuuugucuaguguaaaaagcaaagcaaggcaccaccaggcccugggagcuuggcagggcuuugguggacaguggcucucugaggaaagcuccggcaccagguacaggcucugccugguccucaggcauggaguugucauccugggcuugucuauugcaauggacaaguccagaguagcuggcucugccuuacaggacuguaagggagaaaugagccccuagggaggggagacucacaaccagggcagggcacaggagagguggguuuaaagauggguguuuaggguuaggaggcacacgugaacccuggccaaucgucagcagauugccacuggagguguaagaaaggcagacugugcagcucaugcaaaugauuaaccuaagugacaaaugccaaaaauuuagggguaagcauguagcaacuaggaauggauuugcaguuuacaaagguaaagauuccacuggccauggaggagggcgcugcgugaacccuuuggcuaggguuccgagggauguguucucuuggggaggcucuggaacuccaccuucccaggguugaacagcucccaggguuggauggagcuaaggaggaaugaaguaccaauaaaucagggagguguggacuaucccacaccacaugcugaguccagugccaucccaggaccugcucaggccucuaaucuccugguggaauggucaguuucuugggggagcucccuggggcacuggucuggguagucuucuuucaccccaccuucagcuggaccuucaccuggcuuugagcaugauggccaaugccuaaggcuguggguaggguaagcuacuugcauuggagcacgcuugagagacguguuccagucccaaagaaccuugagggaugagaaaaaacagcaaagaaacaaagggaaggaggaagguucaggcaauggagggggggucaggcaggagcccccaccucaccccuccaccucacccuccacccugagagcugggcucaaacacuuguacuugaugcucccucugccucuuauguaugcacacaugcuacuggcgugcacacacacaagccugggaccaaacgucccaaggcuaggaugguauuucuccagaggguggaaguaaaauguguaaggauaagcaguguagaggacacaagcugagaaaaaaugccacagacauugcuaagugcaccuugaugacguccagagugagcaucauugguggacuggacguuuuggagagagagagagagagagagagagagagagagagagagagcaggaggagcacugcaggugcccaguggccaaggaagagagcucaagugcugauguagauuggggucaagcaucaucccucuggucagucacaaggucacauggugcauuccaucccacaguggaccuagagcaagccccugguaacacucagacuguagauagguggccggaaucauggacaucuggagccuugagaucauugggauuuuuaaagcauucuaggccauccuguagcuguucuacaacauggcaacaguagaggucagagauggugugcugauaagauguuuaauggcuacuuaguugaugagagugcuaggccagggucuugguuuguugcuggaucugcauaagacaaugauacaauguuuaauggcuacuuaguuguugagaaugcuaggccuaggucuugguuuguuugcuagaucugcauaagaacaguggaguagagucuaugaguguccccagguguggcagaggggaauccagcagaugaaauauugaagaugcagggacgagagaaggucaaaggcuaaggaauaagguaaacuucuagaccaaguguggccaagaugcuuagcaugugaggagagucugugguguagagccagcaacuguaguccuaaaccucuuggaacccacucagcugaaugccccuccaucgcaagucuaagguggcuggaauccaugcagccuguggucccagccugaugcgucucugccauuguucccaugugcaggaauggagagggauagccuggggacucacacacaaugaauugcucccuuauggggcugggucccaugagcauguuaaagcuuuggaguccuugaccaggcagaucaagagaguacucugccuugcaaauugagggguagcuuuuauaaaaugggguucagcauguaucuuagggaggaaacccauccucaggcagcugcaacugcucuugugcauagugaucagagcuucgugauacuccuggguguggagggcuuggcaugacuguguggccugagguggcuauguggcuuagcugccugugggcccaauguggcgcuuagacaccugcuucucuugugauuuauucuucuaagcaugcacaauugaauaguugcauuuggauugcugacuguacacaaguucuccgacaggugcucuggggaauuugaaaagaaugagucaggcccagcaccugccuugagggaugugaaggaugggcuauagcuccugggugaucucauaugcggcucugacagggaucuguugguuggagagauuauaguagaacccugggcgaucccguucuguggaguuuaucagguccaauaacccuggaggucaagggaccuggagacagggacagaaaggcuggggugauuaagggggcaagaagccagugugguugaggcuuagcugaguagagccucagagccuggggugcggucagugagaccugaggaggcuugugggagcaauucagaggcaguagcccucuggagacaaucuagugaccauggggcagcgccaacaccugaguuagggcuaacuaaggacaguggggccuuacaaauaaacacccccacacuagaguaggcaggcagguguguccuagccuggccagcugguuagacgggacagggcuuugugaguucuguugggcugugggccugggugaggaagugcccagucagcucuuuagcaaacuguggaaaauguagggggaagggggcuggggagagaacaggaaaugggggaggagccaguaagggcggggcgccugcauuuacagcaaaguguggccagagacugguucugcccagagugauggccagagaccagcacagugaccuugagucccugccuccagucccaucuguaaaguggagaaaguaacucgcucaugccccucuuagacugagggugaaggaggaaggacagaggccagaggcucaggagcagaaccuacugguggcagcagccaggccaucagcuucuuuugugcccgacacugaguuagacuugccucucaggccccauuaacccucagccaacauuauugagggcugaaguguagguaucacauaguagggggagcaaaggagagagagauuugaugucuucugccuccaugggggaccaggugucaggcaggguccugggagguagcagcagcaauuauggcagcugccuugaagcugcaggugcugguguagccacacccucacuuccuccugcucggcaacuucuuuuucuuuggcuccugccuuuuacauaugauaaagucuaaggcccagggcuggcaaaacggcucugugauaaagucccuugccacaccaaccuggcaaccugaguucaagccccaggauccauaugacagcaggaguaaacugacugcaaagauaaccucugaccuccacauguguaccacgugcagucacacacacacuaauaauaauaauaaaaaaauuaaaaacagcaaaaaacaccucaaggcccagacugauugggguggggggggcacucguggcccuguggguaggaagaggucuuuaagcaagaggaauguuucuugauuggggccaguuuguacccacauugacuuggaguggucccugggaaucaggcugagguuccaggagugaagcguggcacccugaaggagggacgcaguacuggguggcaggugugucugcgagacuugccugccugccugccugccugccugucggcagaggagcgaaugugaauucaguuccuaccguggaguccguucugaccgugaaacguaaaccguuguuugcuguaggccagauugacgauccagaaacaggucagagcagguuagucccacaagcccaggugcagccugggaguugagcaugggcgcucuuaauucuuguccaguacacggguugacaugcacacacucaagcguccauuuuaguaaucguauggaguggagacccaggucaagaagcccaagaguucugccaccuagucuggaccagcagguuauucuuuagugauagcauucuaagugggaaagcaggagaggagaagauaaacagagcaaggugguguccagaggucuugcacaagcuauguccuuugccaagcagauuuauuaugaaguacagcaucuuagaaugggacagagucagcggaaagcuaucaugcaaugagacacagcuaaucaaacaguguuggacaaggggaacacaggaugucagagacaagcacagggcagccuuggaacugauaaauccagucucaggguaggaagaauuggguucuuaggaucugaagcgcaacuccuccaagguccuggccacaggcccuuacugacucugccaggcauaauccugguuuuagacuuggaauuauauuccuucuccauacagcagagccucagggaaagccuugaauaagcccagcccucaacagccaccaccaaacaugagggugggaccccaucagacaugugggcagccgguuccuauccuaaauuucagaggcagccacugucgugguaaauuugcugacagucucccggcuuuuguucuuaaaugugugugugugcaugcauguacaugcacuacauucagaagacaacuuucaagagacaugucccuccuccuuccaccaugggucggguucuaggcauugccuugggacuauuguauuuuuucucugacaagggcucugcuugucaguauuauucauuauucaggcaugauucaugcaccguauagaucaccccauagaaugcuugauucaugggagcuggagagauggcucaggaguuaagagcaccuacugcuccuccagaggaucucaguuuuauucgcaguauucacgucaggugacucacaacugucuguaacucuagcuccaggggauccuauguccucuucuggccucugcaggcacugcacucacacgcacauguguacacagucuuacacaucauguuuaaagcaugugacuuaguguuuuuuaguggaucacaagaccccuuccaaaaugaccugucuaguucacagcacccagagcacagaugaccucaucugaggcuuccugggcagacucagguugucucuuuucccagaggaaccgguccuuuccuguguaugccgggcacgcugcaccaggacaugugugccaucucauugucugacuuucccccacagaaggaagcuggcaucccgauauuuucuuggccucuuuccaugguuagcaaaauuacucucauugcuggacagauggcccauuguaaauaaaguuuuauugagauugggcauugucuguggcuauaucaugauacaacagugggggaugaaugaauauggcagacuagacccucaaggcaugacccucaacauuccuucccuuguagaagucuucccugucccuggccuuggggcacagcuguagguuucugguuuguguuugguaugguagcuuucaucugguuaccugcucugugauuucuagaagcaagcaggaugacuuguggaaggauuccugugggaccauucuccacgcugaagcuacagucaguccccuccaaacugcccugggcuccuagaggagagccaggugcuucauggucagagcaugguucuuugugcagauuucccuguggauaucgagcccagaggucuugccggugugucuucggggucagcaugcgguuuggacauuuugucccuuuccaaccugugguugcgggugacucuggcuuuccuggcacccuguuggaguucagacacuuucuggagacacagcagagcuugcuguggcagccucagccuuugccaggcgcucugcuuaugacagagaccugguuaggacacuggccaacuggcucuuagccaagggagggggagagcugucuggagaggagccucgcuuucagagccuccugggcugacugagacccuacucugugcuuuuccagcuguuuccucuucucuagcaacaggccggugccugucugacagacucuguaguauaguagagaagcuggugaugagugaaguucucaucccaggauaagauguccuugagaagcugcacaggugacagucccacugucuccuucuagacaucuaagcuccuggaaaaccugugaccuaugcccaggaacuacagggacaaagguccagggugccagaagagaauaucaacccguccccaucccuggucccagcccauuauauugugaugcuguggauggaaagggggacccuuuucuucagggacaugugagcccagcucaucuucucucuacuccucccuugggagacagaucgagaaggugaggucugugacucgcccaaggucaccaguacagugguagugucaggagucccuggagacucaaacaggagcaggcuuccugguuuuggacggugcuuguuccuuuggacaggaggcugggugucccuguggaggcuuggugacaaagauguugugugugucucaacauacgccuucuggagucucccgugggcaugcagacagaagcaaucaggauuauaaaaauaagccuguauccaggaauuuuuuuuuucugagagaauugguaacagauaacaguaagcauuuggucacacguuuauucagucuuguuuuacuuugggaggagguuagacgcagcugcagacagugucugaggucauaagugcaugcugucaggugucugcagcuuaugcgaucauuuguucacucccgugcugcugggaugagcucaggaccuccuacacuguagcacuccagcacugaacauccccccccugccgucccccccccaccggcuuggguauuuccaaauuaaacuguaaaaaugagggcauaugagggaacucuuguuugcaagugcauccuuuuuuuuucauuuuuucuaaaauagacaugagcuauacauguauuuuuuaaguuuguacuugcuaggauugucuaauaaccagccuaguaccaucuagacuugguuggucucagccagcgaggccugugucaucuagcagaguggauauuuagguuguuuguuuguuuguuuugcuuuguuguuguuggagacaggaucucauguagcucaggcuggccuugauucuccagccuucaucuccuaagugcugggauuacaggcacauacuaugauaccuagugugacaaugcggaugacuuucuauauguguguuugcaugagugcacaugugugugccaacgugcauauguauauuaacgugccagcaauuaaucuauaguaccaugcccuaggaguccuacaccuuguuuuuuugagacagugucucucacuaggcuagucuagauggccauugaguccccuggggaauccccagucucccucuacccaauguggggauuacaagagcuugccacuauuccuagcuucucugucucugucucucucugucucucugucucucucucugucucucucucugucucucucucucucucucucucucucucucucuguguguguguguguguguguguguguguaagacccgggggcucauugguuaggcaggguuggcuguccagugacucccaugagauucacuucuugucugaaccgucucagcccagggauugcaagcaugagccuccaaacccccaacccaccccaguuugaugcugaaggucaaacuuagguccucaugccaacucagcaagcacuuucucagacugagccagcaccucuccagcuugcugguuggauuaauauagagcuuggggucucugggaacagcaagggaggugucaggagagccaagaaggccagggccagggguggcagcaucaccuucauuccagaacagacccagugagaacaaucauggaaaccgagagcacugagccugcuggggcaggcugaaagagccaccuggcaaaagugccagcauauucuagaagccucucuccagggacuuuucucuugcugaagguuugauguaagaccaggaagaagaagaugaaagagacagaaagaucaaccccagggcucuguuugugaguucuccagagaaacagaaucaacagagagaaggcccgggcuuuggagugggaauggggcucccacaguuugaaagagcccacacugguaucugcagaccagaaagcaguggugugauuucaucugugaguggggguggauagucucuagagagcaaaggacaagggaccaggaggagcccagauggcuggagacaacagauauucauucacacccgacaucgucuggauccccaagcuuggacacccguagcccaagcaguaugauucaaaguuaaucccaugcagaaacaccuccacauuuaccagcucgcugggugucccuuaguucauuaaccagcugaguauuccccgguucagucaaguugacacagaaaauaaaccaucacaagagugugagaaaggggaccggaaaaacagaggcggcuuucguggagaaaguuccucguguggggauaacgcauaugcugguccaagucagugggcaguggcuuuuccaggggcucauuccauccggccacagccuuugguuccagguucagcuccucucaucuugcguucuccacagcucggccugcccugcccuuuacuuuuccucgauaggaggaacuuuaagcuugacucuuuacgaagccaccuuccccaaaguaaacccucaguggucuuacuuuuagaggaugcuccagcacagucaaggaugucuagcuuugaggucuaaggagguuuaagaaugaacgaggagccggagcuaggauucuuucuucuccugccucagucagcuucucagagcuguugggaaguagcccauacccucugcccgaguccagccagcugcugucucugcacgaagagggaugggaagcgccuguccuugagaucuuuacguauguuuguccucuuaauguucugacagcuggggugggagagcacagccugaggaggucgugaugcugccagucugaggggagggagcacuccuccaggcuguggcugugaacugaggcuuucuacauugcucaucaacaccucuucaaacagacugcuuucaaaaagcucacagucccugccacuugagacaaaucucugauugcuuuucucaccuggaaacuuguccucuggcuggccugucucuguaucugaccucaccccugaggugaugucacagcaccacagcucugcuguucccauggcaacagccucccuugguuaaccagacagggcagacagggcugcuggcagagguggggagugguaauuccaccuaaccugggucagugaccccugaaaccccacuuggaccaccuuaggacaagauugcggugucugccccuucuccgcugggagggggggucuuuugugccggcuguugggggagaacgugugaccaggccacgugaccugaugcagauuuaaaaguccgucuuaccagcaagaauaggugcugacagcggggggcugggggugggaagacaagaugcucugaggagugggaggugucaugacauuaagaauggcagcugggugccccugagcuggcuagggacuuggaaagguggugaacaccaccccuauauuuaguaaggccccaccugcaucagccacaagugccccucuugauugguggaugccugaacccugaggucagagggcagcuuaccacaaggucugucugcggggaucugagcuuguuccucacccccucaacuggcugcccugcucuccugguagagcaugggggaauggucagauguccgcguguagccccacccccagaaucugggugagaaaggggcugugagcuuggcuaagacauacuuugccacgccuuccccaggagagauucugacaccacuucaaaaaaaacaaaaaacaaaaacgcagcccagcgccuuuaggaaugaccuuucucuggaacuuagcugagggaggaggggccagaaacgggccaugaggccgcguacugugucguagaguauagagaaaugggguuagaaacaucucugauguuuauuucaccugggcuuggcuuggaugccuccagugaugggugucucauugccuacccaaugauuuuaagacagcuccauagaaagugccuccuuucacccggccagccuuugccucccuguaauguguccucauuggccuggcucagucaucuggagacgcauaccguaaguaccacccucuccccacauaacuggccgagcaucugggugguccucacagcgaugggagaaacugcugucacucacuucacagaugaggggcugagauagcauugaucaccaccucucucugggcgcacaguguaccaccugcccuccucccagauccuccagcccugcagagguuucugccuuuugucauuguccugagaucuugcuagcauuccuggccucuucucuccuuucucagaaccaucugggaagaaacucuuugcauguccgacucucccuugcucugcugacauuuagucuggcuguuguuacucaagcaucuauacauuucuuauuaucugguauauuccuagccauuucaacacuuaaaugugcuccccugcgccccgccccgccuugccccgcccccaaaaggguuucuuuguguagcccuggcuguccuagaacucacucuguagaccaggcuggccucgaacucaaaacucucgcugccucugccuccugagugcugggacuaaaggcaugugcuacugggcuuggcugucacacuuucgauuuguugguugggcuuugugacaccagaggcccacaucaggugucuuccuugcuuccguauauaucgagacaggaucucucacugaaccuggagcucaccaacuuggauacccugccuggccagugagcacuagggcucccccagucucugccuccccuauaguggggucacgggcaugagcugcugagcucaaguauuuugcaugggagaucugcacucagguccucuugcucacacaguaagagcuuugcugacugagccacuugcucagccccucauugugccuugaaaaugauuaucccgugaccuugucacagacacuucucaucccuuugacaucacagaccccagucugcccaucagcuuccuggaccuuaauguugucuuuaccuucaacauuggccugagcucccuucaagccaggugcuguucucagugacagaggccauaucauaugcugcugagacacccugacuguggagacagucuguggagacugagggcccagcagccacaucaccgaaaugccucucuuuaugucugagcccgggaugucugggcuguccagcagaggauuagauucuucucagacuguggacagaaaucacccuggggcucugaguggccguguggcucccagccacaaacagugcuugggucucccaagcccccauacucugacugauggaaugggugagauuugcuugucuuccuuuugcauucuguccugucagguuugaccggggauacaagcuguugaaagaaaaucuuugugauccgggacugguggcacaaggccuguaauccuagcacugacgaggccgaaggaggaggaucgcaagucguaggcuagccuacagugagacccaauaucaacagaaaccacacaagagccgcccaagcuggagacuugcagcugauuuucugucugucuugugggucaccagugcccuauggguguuguguuuuaggaugagcgaacuuggagucaaaagcuugggucccugacaugggccaggcccgcugacuccuguacuccuguuugcuuuucugacagauuucauugcuagcuguuuauuuguaugaugccaggccacagcagcuagagggacagguugcuaucagaggaaggggacaguucuagcuagcagggagguugcagccggcuauacaaagcugacuuacuaaguccacauuagauuaaugugucacuuaguuuaagaggaaccuguccuguauaucuuaagaacccuugaggaugcccuauguuguaccaaagaacuaaagaaaacccagagcaguguuguguaacgggcgaacuguguaugcucugugccaggcccucucaggaguuauagcagugucaggcugcaugcaugagacuguaaggcugagcuguauagaaaugcugucucuaguugaugccacuaaucuguaaguaucucuggauguuagugucugaguccugaguauauaggcuguagaagaucuccuauugugggugucccagggaggggaguggaggacccucaugaagaauccacacaggcaccacaguuaaggcgcugggcagcaacgggcucuggacguggagcuggcagcacagaguggaccagacccugcagcugccccacaggcugggcugggaaucucuguagggcagagcccuggaacuugcuagagguucaagggugugcugcuguugccugugggugauauuuggagacuuguuuguaaggacaagggggccacucuagguugucucgguguaccguaguggggggagggugcaggcauagaggugggugcauggaagacaggagggcuuauaagaaauccuaggggcucagcugcuguugccggagggagagagagcuaacugugcagguagacugagaggcacugcagccuggcuuugugguugcggaugcugaguccacccagcuagcuccacuuggucuugucuucacaaguauccccugacuuggcuaagcauccauaaaagaacacgugcuuccaagucccuggagguaguaguacuugauauuguucaccugugucuggggaaagugguagggagcaucugcuguauucauuauuuggugaauguucgagucauaucaguggucaacuacaaugguggguuugucccuguggccacuguguaccuggugguaggaggguguggcacaugguuacaacaaaagcagcaaguagagggccuggugccgcuauuuagcuguguggcuguccuugcggaugugcagaaagcagacccugggcauccacggggcauggguaccaggauggcucuccugcaugagagacagaacuuacacaggucagcugcaggaccccaaaugcuuuugggacucagccuggcuggugugagccuuuuuucuggcuccucacguagcuucugauuauauuacuuugguuccugguuucucuggggcaggcacugacuuuuucuucuacccaaaugcucaaaggcauugggaucaccuuggagguggggggaccucagggucucaugugcaaccuagugcugaccccauuuggcucagguauuugcuacggguggcugugcaugacuuuugggacuugcugaugaggacaucaguugaguaggugccucuccuuagcaaucucaggcucagcaaggacccuccuugaguuccaaguggaacccuauccucuggucacaagaaaguugagggaagggcacagaaaagagcgaaaaggcaauugucacggggacauggauuccugaacuacagaaauggcugcuauucucccaaagauuucuccaugagggugagggucacugacugagauggagacugcuucuggguggcagagacagggcaguucucagugauugucaccugugagaaaggaugggagucacuggcucuaggcucagaaauagacuuuacaccuuaggugggacuggugccaucagagagauagucacagcaacacagacucuccccacccauggugacaccgccauggcuauuccccguguggguaaagcucaggguucggugugagacacacguucacacccagcugcucuggguucugacucacugggucucucucucucucucucucucucucucucucucucucucucucucccucucccucucucucucucucucucucucucucucucucugagcuuccauuucuccuggcuacagacuuagaugugguaauuccaggccacucagucuacggccuacuguuagagaaacugccagacuguugacgaagugccuugccccauuuuaaacgcccaccacaggauguagguuccaguuucccuagcuccuccugauuguggagggcgugagacagucacacugcagcuucagccugccuuucuguggugacuguggcuuuucaugugcuuucucagcuaugcaucugucuucuuggugaagucucuaucuguaucuuuguaucuuuuccuuuaaaacaaaaagacuuauuuuuaauuauguuguggugguaguugggguggggugaggguagggguguggugggaugguggggaugggauugugagaugaggagggggagugagguacaggggaugaguuuggggacacgauggugguaugugcacaugaguguggugcccauggaggccagaggugucauaucccuuggaacuaaguuacagacgauugugagccacccuacaugagugcuggcaacugaauccagguccucuggaaaagcagugggaagcuaucuugacaguucuuuuuuuuuuuuuuuuuuuuaaagauuuauuuuauuauuauguguaaguacacuguagcugucuucagacacaccagaagagggagucagaucuuguuacggaugguugugagccaccaugugguugcugggauuugaacucuggaccuucggaagagcagucgggugcucuuacccacugagcuaucucaccagcccccuaucuugacaguucuauuuguaucuuuuaaacaauauuauguuguuuuuuuugugugcaccugagcgagcggaugccuguguguagaugccuguaugaguggaugccagaacauguguagaggugaaagggcaacuuccagcuguugguucuccuacacaggacucuggggcuugaacucgggaugacaagcuuguguagcaggucuuuuaccugcucagccauccugcuggccuccgguuguaccuuuagccaggcaugcuguuagguugucuucucauggagcuguucaaauaguauggacuggagucucuuccugggucugugggcugaaaaccucgguguuugcagaugugcacagacuuagcuucugaugccagccaccugucaaucucugcuuuagcugcuugguuuuuccuguuaugucuaagaaaucuuugccuaagccagggccacgaauguuuauauguauguauacguauacguauacacacacacacacacacacacacacacauuuguuuucuaaagguuuauaauuuuagaccugaccuuaggucuauauggguuucaccgugaguugauuuuuguguacgauaugagguagagucugggagguucuuccuugaguguaggcauccuccuguaucaagaccauuuguuaaaaaaaaaucuaagaaaagaaaagaugauucuuuucuauacuuugaaagaaaaucucagucccugaguugagggcuccaucuuccucucguuuuuguccuuucggcuaccauugugguuggcaugcuggccggugucacaucagcuguuguuucuaauaacacgcuucugguugccuggucgggagcaaggagcuauuacaaggacauacuugucugugucaguguagugugacugguugugacuggucaaagacccugcggucugccuagucagagaccucuuucuaggaugugaucugguuccauuguccccugacucccugcuucagcuuccccagcugugaaccucaggugguaacagggcaucaccucccagaacagcuagacaaaagugaucuguggugugugugguaugcgugccuauaggcucagcagcaguguguggugugcaugccuauaggcucagcagcuguguguguggugugcaugccuauagguucagcagcagugugugaugugcaugucuauaggcucagcagcuguguguguggugugcaugccuauaggcucagcagcugugugugguaugcaugccuauaggcucagcagcuguguguguggugugcaugccuauagguucagcagcagugugugaugugcaugucuauaggcucagcagcuguguguguggugugcaugccuauaggcucagcagcuguguguauggugugcaugccuauaggcucagcagcugugugugugguauucaugccuauaggcucagcagcaguguguggugugccugucuauaggcucagcagcaguguguggugugccugucuauaggcucagcagcuguguguguggugugcaugccuauaggcucagcagugugugguaugcaugccuauaggcuuagcagcuauguguggugugcaugccuauaggcucagcagcuguguguggugugcaugucuauaggcucagcagcaguguguggugugcaugucuauaggcucagcagcuguguguggugugcauucuuauaagcuuagcacuuggaggguugagacaggaagauuacaaguuccaagccaaccuguguuguauagggagauccccaucuccaaaagggaaaccugcacgacagcugccuaguggacagaggagccugaacuguauguaacauuuaacaucaucaguaauggacaugcagagcugcuuucugauggcugugauugacauuggcuuaagcgggucaaccugcuccuguagggacugaaagaaagagcgguugggggcucuucauaugaccaaugugaucaugugacgcuguccccuugagaagcacagcuucucuuggaaagucuggcaaagcaugggcccuucuggugccacggggacacacagcaguccccugacgaccucacagugccaagccgagagcauugugauguaacgugcaugucuccuucucucugucugguuuguauuagauccacggagcaaucaugugcuuucccacacaccccuguccuccuagaugugcacacagacgcaugggugucugcccccccucugguuuuuacuccauucaaguagcaagcaucuguguacacacgcacgccuucaugcacaccccugcucuugugcauacagguguguaacacagauguaugagcacaaauucauacacacaccucccccgucccacauacacacacccugccagcgauggcuacauuguugcucuucccaccuuucccucgcccaccaccgguuuguuuucagaugcuccuuucugcaaccuccccugacaccugaguccuaaccuugccuuccggugaaggguucucagccucuaccccgcuauuguccuuuguccuggggcuacccugugcauuucaggauguuuagugaugucucuggcuuguucccaucugcagauggguagcaccucuuccauccuauugugaugacaaaaaucaucuccagacauuaccagaugcccucugcagccauacucugugaaacaugcauacccccaugcaaacccacccaugcaaacucccacaugcaugcccacaacauccgagguguucaggacagagagucagagagugggugcuagugggcagagguuggggagagaucuggugaugguguuucgaguguauccuguacacccaugugcacuugucuccagggccuugcacacucuucuuccagcugucuggaguggccugugcccuccaggccuuguagguuugcugugauucucuuguuguuucugcaacuucugccucuggcuacagccaccuuugcuuacaagugugucugcaaaacucacagaaaugcagagagacacggagcgagcagcucagcugagcccuucuuccgaagaugaagccuuaguuuugaggcagaagccguuagagaugccagcccaagaggaggacaguaccacucugcagcaguggaaagcacggcagcugcaacgccuggcugaggaguuaaaggcagaguggcaggaggcccggcugcagcagguccgacaggcugaacgccucuacuuaucccaccuguuggacgaggcagccgagcggagcaugggaaacgaucccagcgugcaugaacagaaccagagaagaacagcaaaacacacaagggcuaaagagagaaaccgagcagcuuucagagaggagcggggccgcagggaggagcaccccaggcagcaccccaagucccggaaaaaggcaccaugcucagagagacgcaguucugccaaagcccggggcccagccuccggugagaaggguaaaaggagacgggugucuucaaguaaggaccacgauggcuaccagggcccucgggugaccagaaggguagguguggcaaagcucaacccauucuuugauggagacacugacugcauggaggacgugcagaaggaauucuuccgggaggggaggcggcccucggcaaaggggacucacaaccucagggaccagagucuacagggcaaaacaacagcccuaacucagcccuugcuccacggccccaccugcaaacaagaggcugcagcccaggagcccccaagcaaguacaacaagaaucuguggcacaaagaaaucgaaucuaccuuugaagaauuguuuaacaugaauaggaagcugaagaaacauuugaauuugcaccuggaacagaggcucaaggcagaccagaauccagaugagcagcagagcuacucagagauucggagugagaccuuuggcaccccgagagaggagaggacggaggagguagaaaccgccgaggagucugggagcccaaccgagguggagaccacugagaugugguccaaagucaaucugaaacagauacugagugacucagaguaccccagauaccagcagauagcaaaguacccguuaaagagugaaagccuagugccugucaaggcagggacaucuagagaacaagaugacuuacucucacuaagcccagagucaggacaggagccgcccaagucaccuuuguuggaggacgaaagccucaagccuuaccugcagaaacaggcagacucuguagcaagcuggauggcuuugaggcaaaagcagaaggcagaguuggagcagagaaggcaaaaggcacuuuuggagcugacagaacaccccaacaugagcuuggagauccacuacaaggcugagcuggaggaagaacgccgggcgcguagacggaugcgcuuggcucuccucaaaucuaauuccacugggaucugugcccugcccccugaccgaaacaaccugucccuggacaacggccuucucgaugaggacaaacagaaccagaugauucgugaccuccagcagcagaucuuagagcaaaacaaguuacaccaggaguuuuuggaaaaagccaggaaacgcuugcaagaguuucaaaaaucauuuuaaaagcagacccacccaugauaaauacaucccugauggcugcuuugccugcaccgugccugugugucucuuaagucucuuuguuucccaucccagcaaaugccuuccugcagaagcaggauccccaugggguccagagagugagucuagccgguguucuacagacagacugguuuuauaggcuguggggacucauggaaaccccaggugaaauagauucuucagaugguuuagccaaacacugggcuuccuggggcauuugggguuagacgggcacaguuucaaaagauacaucauugguugcuuggacucuggcugagacaaugucagagccauuagcuaaaaucucccuccuuuaggagacggggaagaaaaagagacaacagugcuuacaauauaugcacucuuagaaccuuaugggugggggacaggcaagcccagcccagcugggugaccuaucugaggccagugcugauugugggguggugucgacagaggggagaccuggaugucucguuagcuuuuuucuugaaccagcagccaccugggaagauggggcucaacagacuuucucugcagagcccagagagugacugcccuccuuuugccagcuagcaucugaccacugcucagcuugacuuuugcagccccaaagaagcuguggaagggcugggcuguggcuuagaggaguguagaaugcuccauaaacuacguugaggaugcgugaggcccuagguucaacccccaacacuacaauagcaguugggguuagcagugggguggguggggccaaauacaguggggaccugacugacuuaggcaguagcugcuggcuccuccuuaguuucugagcuuucucucacuccuccccucccccucccaccuucuucucauugacuucuagauagcuugauggaucgcauugguucauaacgcauuaguaauaucagucuauacaacagccaucuuuauuugucauauguguuuuguagaccacguaauggaggacuauuaagccaaaugaccuaggggagauucucugacauguaucgauuuuaucucaacccccugcuuccugggacacgcaccuguugaacccuucagcacaugcacuucuacugagcauggugggucauggcugguuuuccuggggauugaagugccacuucccugcuguggucucucagccuugcuccugacccccagccaugaauguagaaugcauggagaugcguucaccuuggcaugauaccuuggcaugauaccuuggcggggcuuuuggagcucuccucccaggaccccagcgugucugugccucuuugugaagaagagcgcuacgcagccagugccuuuggauugggaggccuggcgccgagaagugcuucauucuaaccccagcuuuggcgccagcucuuguuuaaaaaacacuuuuggaagcugcaacgaaagcgugcagcuggggcguaggugggagggcuccguuugccaccccucggcuucccguuugcaccauuucugcugaaagaguuuccucugcucuccugauaguuuucaucuacacggagugccaauugcuguccccgacccuuuccccagcccugucccagcagguaagcugggagcagucuaugagggccguacagcuugugcauagcagaacacacgagcauugaguagccugugugagcaguguugcccagggguuaggcccacagcaugauguuacauacugggcccggugggugugugguucugagcagccugaguccgaagccgccugcuaccgugcuccucaucuggcuggaccguagugauaucccacagggguuuggaaucugcuuuuguuucccgguugucagaccucguuucugccugacuguuggcugaggcucaguguugcaugauacggggcacccugcagcaccaccuccauccagaggagucgaguggguguugcggcgucccucagccuaaagaugcggucacaacuggaccucauguuguguaaccgagccucccaacuuaguuggaagccacagcccaaugagcagacccaucuucccagggcgcagcacauuguuuuuguuuccauuuacaaaaaugguauuuguggcccauguucugaguaagggauugcuucuccucagcuacacugagcuaaaaguagguguagggaugggugcugagacaugaugaaggaugagucaccucugccuggacaguaacaccuacacugucccuuggcagggagcauguggaaaaacccugcccucucccaccugucucuauacgaggcuaaagggggaugggcuagccuuggcucaggccagugguauagguuguaaauccaaccccuaggaucuccucaugcuaaaacaaugacuuccagcgauucccugaggagaugucaugacugccuucccaucuuauccgcaaagggucaugaguuaguguggaccccauuucacccuuuagguuacacugagacaucugaguggcaaugcaaaguccucggguguguaaccuggagccuccacagcacccuccacucuccucacccaucagccucaaggaccacagugacaagaguaaaggcucugucacucaggggacaggcaaggggucaacacgcugacuccccagucuugagaguccgucuccucccucaugcccaacuucagccaucucugucacuggcaucugcauucuugacggguguucuuacgcgcgcucgacuggccaggaagaaugacgcugcaacaggauccuucugcacacguuuauugggagagcuugauuguagaggcgaaagaccccgagcccagaacuggugcugcuuuuauaggccuaggagaggcaugucucacacccggauugguuaugcacuaagccucauuugcauguuccucaucugauuggcuacucucucucucuguaccucacagagccucauuaucauaccucauuugcaugucucacaucugauugguuauacucucaguaccuuacagaaccucauuaucaugcccgggccaggcagugucuuugcaaaaaacuuuacugcauauguacacauugguuguuuguccaaacuuaugcgugguggccagcaguagucagugccacucugcaacggcacauguggcuucccacaggguguucagaggacacuccugcuugacaccacucaaauccugaggcauugguucucauagauagcacugcuggccaggguuagagcaguccauauucacacuccaggccuagccuacugagauggaguauuaagggcgagugugaggcuucuggguuuguacagagcucugucugguugcagaagaguccaggcauggaggcugccuuuauccuucgccuccugaagcacucuugcccugcaccuccucagagcacuguguaugccagagcuucucccggcuuugugucucuguacccacaggggcagggggcagaaccuuuauuccgacuacgugcugcacucaccagaauccuuuucaucaagcuccauccucgcaucucugccccaugcauuuucuccaguguacauguacucagaaaagucuccggggcugaccgugugcuggacaggcacccugucuacccagauuugcaggacagcagcagucacuguccacagguuggggcaugccugggauguccaccaggugagagacgcaggugccugcacugcucacugccacacuggcugagccagucaguggugacuaggaugauccacugggacacacuuggcucagucaccucucccuaccuaacugccugcauggcuagcacauguacauaugcuaagcaccaagccgugcaugcacaugcuaacagcagcacccaggacuccauaucaaugagaggaugcguuuagaaaaggggcaugaguuugggaguggggcagggacccucucuaaccuguauuguucccccuccccaacaaguacauaagagcaagagaucagaguccaaaaccagacagggucuggccucucaccagucuucagaggauccagacuggggaagcuaugggcccuagaccaucuggcuggacacuugagggcuauccugaauguccuuccguacuccguggcuugggguggggcucuacugaugaggggcuggggaaugagaacguacauucugcagugccccuucagacaugguguaugggcucugcucacagcuccaugccuuagugucccauuuauaggcccaggauugucagugcuaagcacuaaagcaaaggcccaaaggucuggucauccuagggucugcuccugggaaaggagcgaacgaagaaagaugaccgacauccgucuguccauccguccauccaucuuuccauccacagccaccaagugaagaccccaaccugccucagugcuaugggaagacagaugguuuacaggggucggcagagugcccuuggggaucucucugggcuuucucugcccugcucuaugcugcccggcuugcccggcuucgggauuuuacagggcugagcuuggcucccgugaggcccuuggcuucuuggcauagaaacugcggagcagcagccuccuccacaaagccacacuguucucagcaaacccucccacgagcgggauggauguuuuucaaaugauucagcggcacgugaaugggaagggccgcacuuaaggccuuggcaugagauucugcuggcccgccacuguaaaggaaggguugcagggcgugggcuugguuccaccaggccuagaaggauagagccaggguccuggggggcaugaugcagcuggagggcugggccaagaaugcuuguagcuugcuucugcucgcucauauagaugugccaucgcccucccggagaagagccagaggaaugggcaggaaauggagaugggaaagcuggucuccauggagacgggcaucuagcggacagccgcccuccugugcaugcgaucaugcuagaaucugagcggugggcagggagccugcugcuaggcaggccuggcacauucccaggcaccaguccaugagugguguggcccagagcugaguguccugcagucccuuggccagagcuuuggaaccccaucccccuccucccucacccucagccacacccaucggcucgccuugaccuggguuguuguagaugaacaggucuugaccucauccugaguaggcucggcccuuccccaaggcuggaguccugcuuggcuucacacuccccaaaagcccaguugcugccuaugaagggacagaucaucggauuugggaguuucugugggaggggcuggcuggucucagcugcugacagaggaaggcaguguggaauccugcucaccagcacaggacuguuuuuaauuacugaaugacagcccccuuuuccuuuuuagggaaaugagagaaaaaggauuuggggaaggucuuuuuuuuuuuucccccaccaaccagaguggcugggcguggagcaaacaaggcaggguagaguucaguggacgaccucagcaaucugcagaggucaccgugaggucacaacagugagaagguugaucaccaugaagccagagacagcagguagagcuggaauccuugguaccugaggacuugugagcaccaaaccugccuuucaucccuugcgacaccuggcugcucaccuauaacucuacauccucaugcugagguguugccucaagaccugggagccagaacagguuuuagggcuccaggacaaagccccucuguugaccacuauuccccaucuucaguggguccuccagccagugaagucgucccauucuaaggaacaagaaagguccauccaaguggucguccccaugcccuccacagcccaacucaggucccacagcaguucaaggacagcauccugaacacuguaaccaucugauggcagcugucacaggacaaagccaggacgguguggcugaucuuacguccccagccgaggguauagaauuggggcauugcccaguucuucuccaggcugacuuucagaguucaagacaaauuaauccaaauucaauggaaaggcagccuggcugaccagcuauguguauugugaugcucucucuaaagggacaagaaacugaucccaaggggccaccucagucagggucuaguuaugggugccguuggcacuuugcuagcugaauggaggauguaaaggacaagaccuuaucaccccaccccuucauccccaagcagaacagacuggagaaagccaccagagccuuuguuuacucugggagaaagauuuuauauauauauauaauccggcuaaauugacuggcaagaacucucucaagaaacaaagaaguagaguggcugacuuuaguuagauaucggcagcugggccuaaaguuaccgcauuuguauccauuuguaucuauuuguaugacgggauuagggaggucuuucuguagcuagaccuaaaguuacugcauuuguauccauuuguaucuauuuguaucgaugggaugagggagguuuuucccugagggaucucccccaccuuaaugccaguagccuuaaaacuaucgcuggccaaauuaaacugacagguuuucuauaggaccuugcuggacccgugucacagcagaauccugaaggaucgaguggccagguagugacccucuggugauccugaguaaaucuuuucaaccucagaagacagguguugauagcuacagguuuaucuggcucauugugggaaacucgccccagagagggagcugaguaggagccgugcauaggacuuaaauauucaguuggcuuaugggauugucccaagagcaggugggcccacaagaggguuacagacuccagacuccaacaaggaagacucuugcaagcagcuuucuuucagguuaugacccuccaauggacucugggcauguugugucuuuagauucucaagggacuuccacaaugauguuacaauggacacuaucaaaaucuaaagucgcugacaagcugggugugguggugcaugucuuuaaucccuguacuugggaggcagaagcagguagaucucugugaccucaaggcuagccuaguuuacauagugaauuccaggcuaguaaaaguuaccuaguguucucucucucucucucucucucucucucucucucucucucucucucucucccuccucccuuucucucuacacacacacacccacacacacacccacacacacacacacacacacacacagucuuguuggauuuaugaacaugucuucagggcucaauagaccauguguuggugacccaggggacagacaggagccccuccggagggagaaccaugacucuuuugccacaguuguuauccguggaguauucugaaucuuccaguugccuuuagccauggccaucaccuagaguuucuagcaccuucccuccuaaagaggacagaagcaggacagcccagccucuguuguuguuccugggcaguuguuacugucaaaugcaaacauggcccaucaucuuuggcucauuaccagugaccucaacacccaccuaggucuuuuccauccccuucugcuggguacacugggauuguuuuugcaggcuccuggagggggaagugacaucaugcgguguccucagccagagggauggggguaggggcucugcgguugugugugcuuugaauuaagucagcgcuugugcauuccaguagccagcaucuggcagcgaauccaucagccaguguagcacuuucaauggcaaacccagauguuggcuuagcagaaggaaaagaggagaaagcaaauuuugagcugcagggggugggggcacaaagcacuuaaacacgagccucaugcugcuguguccagcuucguggguagguagugggacaggacuggauauagcuggucccacucuggugucugccccgagccuagccuguaaauguucagucaacagucacccaugccuugcuucuaguucauuccauauucucugagucucugcacuucccuggccuucaaauggccggggacucaggaaggcugcccaucugugauggguuucccuucucuacagccccagaggucacagugaugaccacugcugugugugugguuuagggguuauuccuauuccuauuagaggauucucuauuuccucuccuuuccuguccaucugucugcccacugccuagaucagagugaucuaagaccagggcggugaaggcuuuuacugggacaaucuccccggucuccuccuccauccaguguucucaccagauaagagcuaagacccaugucugcuguacucaacagugccggcccugucucgcaacaggaccguuaagugggagaggaguguccacccagguuuaacccagaccugugguuccuggcuaccuagaagcagcccaguugucaauggagauucuccaugucugccccuccccacucccuacaaacacuccagaacuguguccccauuaauguucuagccugaaaauccugugucuaccccagacucucagcucauccgucuccucucauaugagauuuucaaaaaagaaaguagauggccuucaucccugaagcaaagugagcacacagucacauacuguccuggcccaucugacugucacgggaccagggccagcguccaggucuuugucuuauaggagcagagaaauuugcccuguuuucaaugugucccuagcacuguaugcccugcccagggccucacuagcccucaccaucacaauaugacacaagcuggugacaucugugucaccugcaccgucaaauggucucugaggaucacgacugucagaguucaucucugcagcagcgccucucacacaaaugcgcgcaccugauuguaucucacucagucuuucggcuuagaucaugucagggacucaacggcggugugggaaguuggggacuuccaugagacagcaguauugaauccuagguucuaugggagagaaaggagagcuuuuggcugucuggaagucauugggcuuauuuucugauugccaagaggguguugccuuuauugaacauuuauuguuuguuuuggguugagacauggucucaaauagcccaggccagccucagaacucuauaguucaagggaaugcuaagauucuaagaacaugccauguccaguuguagguggugggacuugagcuaaggacuuuguggauggcaacuuaagcccuccaccggcuaagcuacagccccagcccuuagugaacacauuggaggaguaagcauggugcaguauaaugggccauuacugagaaacaaggcuagaaguucucuagacaggcagaaggaggugagucacuccuuugagaccccugucccgucuuguuuccaagcugacaacagugcuauacagagagcaaacacugggcaguauuuaccaacaugcucacacauuugcauaagcacagugaugguuguacagauuacacaguggggaccaagggccagccaugcccaugcugccauccugaggcugucagggucagcccagcuccaucuggcagauguucucugagucccaucuguuccauagcauggccucuaccgguuaggaccucucagcaggcagaugcacaggcauuuacaccagauagugugggagaagagcagcagccacugcagggagaagccaggaagggcugcuucucgaggcugagugcaaguucucugggaagggagcuagagguggcauuuuggguagaagagcuuuucuguucugggggggggggaguaacauaucuggguauccgagcaugugggggccagggagcaaaauggauuaggaaagagcaagggccaagugauguugcagaacguauagcucuggcuguccuggaauuagcuauauaaaccaggcuaggcucaaauucagagaucugcuugccucugccuccccagugcugggauuaaaagugugcaucaucuggcucaaaaaguuaagggaagguauuuugcaggaauguuuauggagaaggcgcagaaccgagagagggccuuuuguugugggguggccugccagguggcuugcuuuaggcugggaaacaggaccuuguggccaggccagugguuacucagcugcacagaaggaccaaagcaccaaaguuaaugggccuuggagcuggguggggcccgggcuguggugugagacucauggggagggauccagagugugcuggggucugaagagcagguggcacucccacgugccuggaccucccugccucugugggaaacaguccuggccacaaguuuccaagacucaaacugaccacuggagacucugagccggcacugccugcuccuugucucuguuuaucucaugugcccagugacaaaacacuugcccagagcgacccuacaccacugccauuugaagggcaagccuuuagaagccauuaaauaggcccuggcccagguaauaagcuccaagugaaagagagggaggccugccugucacagcgacugcuggugugcagagggaggucuccagggagggagcagggguuugauuccugauagaagaguccugucgggcaugaucagguuccauaccacucuggaacuuucuuguucugucucuguacaucacuuuuuaaggcuguuguugccugggauacaguuccuacaggaccugcgcuguuguugccugggauacaguugccugggauacaguuccuacaggaccugcuuccuuaccaucgaugucuaaaguuuaugagccacaccagugucacuaacuguaaccugacuaauaugcuuucccacccccauguccugcuucucauaaaauacacguuacagaaggccacacgcgguggcaggcacuuguaaucccaguacugggaaggaaaagacaggguggacccaggggcuugcuggccagaggccuacucacugagcuccaggccagugagagacccugucucaaaacccaagguggggagccagugaggauuauacauaaacucacaugguagagagaaagaauugaagcucacaaguugcccucugacuuugauauauugguugcagcgugcaaacuuugccagccuccaauaaauuaaaaaaaaaaaaaaucagcuccucuccuccaagcaacaaggcgauuggcaucugagaaaugaaagucuccucugaccuucacauacauggcccauaggauguuuuccacggaaacgucuuccuuuugaguugcuagggugggaacuuaggcccucuugcauacuaggcagguggucugcccugagcuguacuccagugcuccccaguggaguccccagaucugagucaaucaggcuuugagguagaugaccccucugcucuaguccucaaagccuguuugaggaugagacgcuggagugucaaagccacuucaccggcuguccaucaacccuaccugcaggagcaggauugcacgccaggccauucguuaaccguuucucuagcgaccgauaagcaggaagaaccagacccacaguggcugcagccugcuguucgcagccacccgggcaggggcucccagcuucuucugccuucacccuugucagcaaaggauucauuuggggauuugcugguuugggcugguuuguuuuguuugagacagggucucacuuuguagcccuugcugaccuggaacucacuauguagaccaggaugaccuugaacucacagauaucuacuugucucugucuccuuaccccccaccccaagugcuggagucaaaggcauaugucaccaugugucaccacucccagcuuuuguuuucauuagcccaggcuggccuugacauccugacccuccuggcucugccucccaagggcugguaaggugagugucacugugcccagucuuauuugguauucuguacuagagauugagcacaggccuuggugcaggcuaggaaguacucuaccgucugagccgugucccagccacagcgaagaacucuugcugacaaccauagcaugacaagccacagaaccuccucuccuugcuuaugacaagacaggagucuccucugaucccucagguuacagcaggugggaaauaggcucaccuccccauagggagcacaucuuacucccgugggcagagccuggauccuggucauggggacuuuccuuacaucccugucucugugcuuugcagugaucagagccaaagcagugagcgagaaggagguggauuccgggaaugacaucuauggcaaccccaucaagaggauucaguaugagaucaagcagauaaagguacauugacuguacagggguuggggaguagggagcaggggcaggggccagggcaaggcuggggacucagccaccacuaggccagagaacugaguugucaaucuacaagaacacaaaagccaggcagaaauguuacguguucaacuaucucaguuaccauccuaugcugugaagcaacaccagggccaaggcagcacugguaaaaccaagaauuuaauggagucuuucuuauaguuucaaagguuuagucuccgaucaccauaguggaaagcagacaagagcauggugcuggggcagcaucugagaacuuuacauccccauccacaggcagagugagagacacacugggccuaccauggucauuugaaaccucaaagcccaccucuagugacacaccucuuccaacaaggccacaucccuuaauccuucccauacaauuccaccagcuggggaccaagcauuuaaauacccgagacuaugggaccauuuuuguucagagcaccacaucugucuaguuucagaaacgugcuauccugauuuuguugggugauacacugguguguagcuuauuguaaaagggugagucuggcaggugggugugcucagggguagcuuuccucccugugcugggccgcuuacugagaaggaaucccauugggugaacaggacuguagucagagacaccauauacacacacauacacacacauacacacaccacacacacagcacauauaccacugucgucaaagagacugcacacggcagccauagugacugugguggugucugcuaguguuuucagagucuuuuccauguuggagacaaauaggaagagauucauauuggagagggagugggagagggagaaggagaggcugagguuguggcucaauugguagagugcuugccuagcauaccugaagucccaaguucaaauccuagcuuggcaaugagaugugcuggugccugcugauggcaacaacugccuugaaguucaaaggaaaacagcuggcuccuccaguguuagggacagcuuugccacaccauagugguugugucaccucaaggggaugacuagccacucgauaccaaagccucuuuacgaggcagagaagcagguagccuuucauaauauccucauugcuuaaugccaaggaagugacucugaccuuuuggaguggcgucauuugagaugcccaaggagaccuugcaagcuucuuccugcaggguccucuaggagagaggcuggagacugggcuguugguguuaagagcacuugcugcucuuucagaguucaaggcccaucacccauguccuacagcucacaaccacccgcacuucugcuggaggggauccagcgcccucuucuggcuucugaggguaucaugcacauggcagcagacaugcagacaaacacaucuuguaaagagaaauaaccuaaaccuuuaaaacucaaaggaaggaugaaggaagggaggaagagacaaaaagaaaagccuuucucugcaguguuaggaaggacaggaguaagaugggaaaaguggggacaccacacacacacacacauaccacacauacaccacauacacauauacacaccauacacaucacacacacacauauacacacacauacacacaccacacauaccacacacauaccacacacaccauacacacacauaccauacacauauaccacacacagacugcacacauauaccacacauaccaaauacagacaccacacacacacaacacaaccacauacacaacacaaccacacacacaacacacacacacauauaugccacacacaccacacacacguacacacucacacacacacacacagcuagcugcugggaaaugucuuccucagcagggcagcuaaagagcuggguaauuaaggcauugagaaaucaagcccucucccgacucugagguucuguucugguuccaagggcuccuuucucuccuucguuguuuccugguagccagugcuucaagaccaaaaucucuggaaauaagcaggguguugcaguacaagccuauaagccuagcauccuggcugaggcaggggaauggagaauucaagaccaggacuggcuacaaaguaaaaagaauccugaaguagggcugggguguaaauuauugggcuuagguuuaauccagaagugggggugggggcugggggguaugaagaucaaaagaaaaugggaaguccacagcagauaaauuaacacaguuccugggaaugaagaugagcccuccguggccaguaagacucucuagaccuuauccagagguccuaaaaugaccucaugcagaaauguccuuggagaaagucucccacagaugacaggacugugcuuacccgcuaagauguccccacagcccucagcagacgacucugaacaccuucgcaaagcagugauggcuugugaauccaugggauacgccugugcaaccuggguccuggguugggggcaugccugggugcaaccauguguuccuauucccaucaugcucugggugggagccacaucucuauuauaccugccuuccuguguuuugcagauguucaaaggaccugacaaagacaucgaguuuaucuacacggcccccucuucagcagugugcggggucucgcuggacguuggaggaaagaaggaguaucuaauugcaggugugugggaguucacccuuccccacugagugcugaauuguggugcagagaauuccaguguccuggucccuaaggaacaaacuucccacacugcccucuagggacgaaagagcagaauugcauugggccagggacugcugauagcccauguacaggagacaugaguggccuuuguuggaggcacccaccuggcccucaccuauacagaagccgucuguauuagcagccucuccagcaggccacauucuugggaaggccagcagcaaucucuucccugggcacuggcugggcguuuaggggcuuucccauuucccuacagagaucgcacagguccuccacugucauauuauaaagguguugccgugaucccccagugcagaagagggcuuggccuugagcauagugauuagccuggggucugcuugcaacaccugccaagagccaaugguuauauuuccuaugagcugauugcgaucauagagcagcuuaaaaccagaagugguagauagagguucuuaagaauaggcuuggagcaccccugcuggcucuacccaaaaaacagguuuauuuuuauguaucuugaguguuuugccugcuucgcuagccaccaggauucuuguagccuguauccaguccaagucaaggagaagaaucuggggcuuggguaucuccucaggagaauccaugugugguuagggcuaagagccaguuucuaacuagaaccuuccuugacaaaggccaggaguuacggauagcugguuaguacauacugggugggguuuaccucaggggccaggcaugccaucuccugugcacauggauaccaggaguauuuuuuuuuuaaccucuuggggccagaccugucggucagagcugcuuaucacuuggauaucccaaauaugggcacugcuuucuguuccgugagauaaaaaccagcccacugaaccauuuagaggcuucaaauaggcaggcagccuacaaauagguaagccaugucuugcuaucaggagccugacacacagugacugcuacaagcaggcucaaacucgugccucauuccucgugccucgauggugugaggaagcugcaggaugccugagcaaagugggggcgggggggacaaugggagagucuugcagggcagcgguuucauggucagugcuggggcugcucuguuuuguagacuugggcaugcauuaaggcacucuccgugccucuucccugccuucucuaagagccaggcucuggguccaaacaggaggccagauaauuccagugaccaugugggcggaugucauaguuucugucaugccauaucccugccauccacauugucugucagagguuuuccacauaugccgugcuuucuccuguccaugcaacacccaugcuugccauugccuccucugucuuagaagaaugucacacagauaucaucacacaagucuucuaggccugcuaagacccaacuccacugcagcuccagguacaaugcagacuaaagguacccgaagccacucaggaaccaugcaccuggcaucuuagacuauauaacacuugcugccccggacacacuccugacuagccacagagcauacugucaauacaugacacuuguaaauaggcugcaugcuguuuuaaaaacuucacuaguauaguuagguaugguggcauacaucuuuaguccuggcacuugggaggaaggagaaggcagaucucugugaacucacaguccuaggcaaugagaucuuguuucaacagcaacaaacaacaacaaaaccauaaaacuccuuccugcaggaucuaggcuaguuagauugccagugggugaaggcacuggccauuaagcccgaguuugauccccaggaccuacacaguagaagaaaagcaacucuugaguuuucuucugauuuacacacacacaugugcaugcacacaugcaugcacauggacccacucacccauauacacacacacaugcacacacacaucacacauggacacacauacacacagaugcacacauacacacacacacaugcacacucacccauacacacaaaaugcaugaaaguaacaaaaacugcagaaacauguaaaauggagugugccucuauaacugccugagcagaggacucgguggcacuaaauguauccacaagaguguguagcuaucacugucuauuccaagacugugucaucuucccaaacuacaucuuggucccacuggccacaagcaucucaguccuugucuugccccagggccuggguucuggucccugccaucuacuuucaguuucugugaacuuacauauuuuaggcagcucucaggucuagcaggguuauauccuuuuguggcaguuuauuuuacugggcaugaagccagguucuguucauguuauagcaaguguaugaccugucucccuuuuuauacguauguguauauacauauauacacacauauauguauauacauacauacauauacacacauauacauacauacauauacacacgcaugcacauacauacauauaugaauacauacacacacuauauacacauauaaacacagucauacauaaacauacacacauguacauacccauauacacauauauauacauauauauuaacacacaaacacacccauauauacauauacacauacacauguauggacauguacauccacaugcauacccauauacacaugcauccauccauccauccauccauguauaugcucauauacauucacauacauacauacauacauacacacuuauauaucauauauauauauauauauauauauauauacauacacauauacaugcauacacacuuauauauacagauucacauacauucacauguauauaccauauaugcaugcaugcauacauacauacauauacacacauauauaugcauacauacuuacauauacacauucacauacauucacauguauauaccauauaugcaugcaugcauacauacauacauauacacacauauacaugcauauacacuuacauauacacauucacauacauucacauguauauaccauauaugcaugcaugcauacauacauacauacacacacacauauauuuuguggugcuggguauggaauccaaggccuuaaauaugcaaugccaggggcucuagugcuguucgguuguguauuuuuugugguauuuuuccauugaauuugacaagugauuuccuaauuuuuuaaggaauuauuuauuuuauguauaugagugcauuauagcuguuuucagacacacuagaagagugcgucagaucucauuacagauggcugugaaccaccaugugguugcugggaauugaacucaggaccucuggaagagaagcacucagugcucuuaacuugagccaucucuccagcccaggauuuccuauguuugauguuucuguuagcuuuccaacucagacguuauaucaugucugaagcugaagcagcugaaggcuuccauggugaaggggaauuaaccacacauuuacuuauuucauguauaugugugcagauaugauggcaucugagcggaagucagaggacaucuugagggagucagcucucuccuacagagcagcucccagggauugaacucagauagacaaguuuggcagcaagcgcccucauacaccaagccauuucguuggcccaguggaagaaaauugaauaugccaagagagagcaaacuaguauagcagaaaggcggcagaugggacaugugccaggugugcacucugaaaacacaccugcuuggguuugaacugguggccaacaccucagaaaccagcauccucugcuugguggccugaauugucagugucccccagaccagagguagggcaguuguugucauaugaaguuagagauagcagaguugcugggugccguuaccagggccuaguccacauucaugaauaauuguguuucauaaauaaaugcaaggugacagacaccugugucugucacucugaaugaaagccaaugagugugaugugguagcuggguaaugagcagguuagccucacaggagaaaaagggagaagggucugcagaggaccucaauagaaagccaccccugggacaggcaguaguggugcaugccuuuaaucccagcucucaggagacagaggcaagugguagaucuuugaguuugaagccagccuggucuacauaguguguuccaggacacugggcuacacagagaaaccuugucucagaaaaauagccacucuggggacagggggauggcacuggggagauggguccacugggaaagugcguaaauucgaucccuggagcccccaugaaagcuggacauagcagcccaugccuagaacucuagacacaggagggucccuggagcucacugucagccagucuaggugaauugguaaacuaaguucagugagggacucugucccagaaaauuagauggugagugauuggggaacauaucuaacauccagcccccccccccacacacacacacaggaccacccuuagaauauuuacagacagccuaugcugguuaggacagccagagauguuuuccuuugugccucuuuugauuucuccccauaaggaccauucuuuggacaacucagucuccuuauucuucucuuacgagguggaacgggccugaggcacacugugcagauaaaggaaaaagaaaaaaaguaaaccucucuaaucuuucuuuagcucuuggggccuggucaggaaccuucugauugggcgugccuuuauuuccccaauaugguuccuguucuuuaggucaggacaggcccuuuaaccaggggcuagccagaaaucacguggcccagcaaacugcccagccagcuggcuguggacgccucuuccucccaggcuggugauucagcaucacauguggauuuguauagguuuuucccuguaauuuucuuuuaaguuucucucucuugaaaggaaaaguaaacacacagccauaaacauacccaagacucuuuccagguuacaauguugcaacagacgauuacuccaugugagcccaggcaagugugguuaugcuaaaggggcuucuucuuuucuuuuugaguuaguguucacuaauuguacaaauaagagccggccucaagauggcucaacaaguaagggugcuugccaaagaaaccugauaacaggaguucaacccccaagcccuuuaaagggagaaggaaagagaagacaauacaaaguucuucacugacguccacauguguccugugauguguaggagugcucacauacacauaagcaucauacaaacaacaaacauuuaaauccgaguccuugugacauuuucaugcacguauguagugcacuuugaucuggggcuggagugauagcucagcgguucagagugauugcugcacaaccaugaggacccgaguucagaucccaauacccauguaaaaagccaggcauggucucacacaugaaggagugugguggcugcagauaagggaauggggagccccugcccuucauuguuggucuccugaauuuucucauugagcauuauuuuaguuuccuuucugucauugugauaaaauacccuaacaaaaaaagcagucuagaggaggaaagguccacucacagcuacagguuauagucucucaguacggggaagucaaggcaggaacuugaagcaacuaguccagagcagagagggaaacaauacaugcaugcucaccuacuugauugcuuguagucagcucugcuucacucuuaugcaguccaagaccccuaccuaggggaugguauccauccuccauccuuugguucuucuuagauaaauucacauagcccgggcuggccucaaacucaccauauggacaagcuuagcuuucaauucaugauccucccacucguaccucuuuguaccccaccacacuagacucaaacaugcauuguuucuuuuuuuuccaaugguguacacccuuaaucccagaauuugggagguagaagcaaguggaucucugugaguucaaggccaaccuggucuacaaaauauuuuccaguacagcuagggcuguuacacagagaaacacugucucaaaaaauggaagugggggggguuguguuuuuuuuauuauuuuauguucaugagaaaaagaaagaaagagggagggagagaaggagggagggagagagagaacaagacugagaauaugcugagugagacgcagcgcccacagaagaggcacgaggguguccuauccccugaagcuggaguuacaggcaugguaaucugccucugccucacgugaguguugggaauugaacucuuguccccuggaagaaaagcaagaacucuuaaccacuggccaucucucuaguccuaacaggaguuguuuuaaaacucagaguaccuaggcaguggugaugcaggccuuuaauuccagcacucaggagacagagagaggcaaaucucuaagaguucaaguccagccagugaguucuaggacagccaggacuauacagaaaagcccugucuggaaaaaccaaacaacaacaaauacucucagaguagucugaccaugguauuauuagagccgacucucaacacccagagcuguacccaggugcaggaggaagacagaagggggagacuuguugcucacauugaccuggugacucuccugacaggaaaggcagaaggagauggcaagaugcacauuacccucugugacuucauugugcccugggacacgcuuagcaucacccagaagaagagccugaaccacagguaccagaugggcugugagugcaaggugagcaaaaucugcaucguugccccucccugcaugaguccucaccccucccuggccuuguccaucacaagaucucuaaguggaaugggggugaggccuuggcuucucagccccucaggauagugaguccugguuuuggacugaacucugcggcaguaaggaagugaggcagucugucuagagacaaagccuguggucccaggucccugaagaaccuugacuuuugacccuuucaagaaauauauucaggauaagggguuguggggugggacaaagcauauaaauuaauccacaugucuggcagcuccuaggaaggaaagcucuaaggaaaggagauuuuugugaggagaauacaguccuggaaauguuuuccuaccauguauaggcauaaaaauugugugaccaagagcacagguauguuccccacauccuagacuuccaugcaugagucucuguaaaugugguauucuggggguauuugucuaucaucucagaaucugcucagagguggcacuaagcagaacuguagaugcacacgugcuuagaugugaccagagugggcgggauuuauucccagauuugggggucgugccaacugcagggaaccaguguguccauggcccagaugcuuuaucccucaccagugcaggaugcaucacagaauagccagcaucccuccuguuaccaggagugagccugggaguugcccacagggucgaguccuaugggccugugccagcugacacuuucuggugcuuccuccccuucuggcugguguuucccaucacuugauuauugaaggagugauuccaagcccagguggcuagccgaauacaugucaagcauggcuccacugugccuggcaccucaaaugcaaacacauguuggccaugauuauacaccacauuuaggaggcugagacagaaggauugcugaguuuguaauaaaccugaacuguagagugaguuccuugacagacugggcuacagagugaaauccugucuucgggaaguaucuccauugagagagugcuuucuagcacacaugaagcccugaguugucuccuagcaccacauaaaccagcugugguggcacauuucuuaaccucaacauuugggagcugagacagguaaucuuugauuaucacuuguuacauagaaacguguaggccagccugggauacaaaagacugugucucaagaacaaacgaguaaaaacgaaguuucuuucuucaucucuguguggcuagagguggacacuugaagcuccauaauuuuugguuaaaaagcuagugugacccauugacccaagcaggugcuuuagaacaaguaagagcaucacuuaguucuaaucugucuccaguguaagccccuugugguggcuauaguuucaggaggaccuaagcugaaaccaucccuuuaaaaagguagaccagauggcacaaagcagaggugcaucuguuacaccagaauuguauaaguagguggauacacagguuuucuguuguaugccggccuguggcuuacaaggaccggguacaccagggaggcaggcugggacugaaagagacuuagacagugagagguuaauggagccaagaaaugauucuguucaaggcccuccaguuuacuacgagagucuacuuauaaaaggggaaggcccauccccugccaguccauucuuggugucuggagccagccaguaggugaugugcagaauaggauguuccuccagaauguaucaggugcuucuuagcagguagcaguaucuuggaaagagcaguggcagguggcagaaaaaaagagccaucuaggucagaaggcuccaccuuagguaauuuccuucacaguggcagcaaggucaaagucuggaucagccuacuucagggcugagggaggcuacaauuccucccugauuauauaauaaaaauagcaggaccgaggcauaaaauuuauuuaugcuccauaguccugccuaggaauuaugguggcuggcggcugugccugccuuaggaucucagaucuucucgaaccauccaauuccgucauaggaggcuacgugcagcuaguuuguguaauauuucacacaaacaugucucugugguguauuaucaacagccacagccuuuugccauguaccccugucuucgauugguaugauuccagaucugguugcccgucauugacuaacuagcccucauagcacaccuuauucccaaaucagaccaaagccacaauauguacuuagaauucuucuugaugaaaauuaauaacugccaccugccuuguuggaggcuagguuuuacaucugcuguagucaggcugaagggcguugcugaccugcuugagaagcaaaggugggacagugaaaagcaacaguauaaaagcuucuuuguggaagcccagguacguuauucaguugcaaauuagcaacaaucaagcucaggcucuggccucccugugugggggagcuggcuuuaagaaauagcagaaaggccagagauucucuggaaguagaggcugugcuccaaauuaacuuugcuagguaauuaagauuuuuagcuaucuucaauaggaaucucuaauauuggacuuauuacuagaccaguccaagauugaguuggaauaacuggucacauugagggaaaaagaagaaucauuauaauucuuucuuaugacuaaucuuuuuaagucagauuccacagucuuugauguucuuuuuuaccauaagguuaaaaagcuugaagcaaggcagcuucucuuguccaaacuggaaaaauggcaagcaaggauggguggaaaacauguacccaauucagcuuccuagucacuacagucagggcacugagugaacucaccuguuuugucacacaaauuagccaucaugcuucugcagcauucuguggagagaaccuaugcuuuucccuuuccuaauaagguagcuguucaggaucaaaccauaugccaauaaguagauccuuuuaagauacuauaaagcauuuauuaaguucuuugacaucuaaauuucaaaauucuaaaauaaaaguaugauuuaaaaaaugugcauggaaaugcacuaaauaauaugcacggggauauaauuucccccuucuuugucuuuuaagaagcuaaaguuuuaaaguuccacaauaccuuguccuugagaauuaauaauuuguugacaaaacaucucaaauacuugacuguuauagucaguuuuaauguaacaugggcagugacuaauagcacuuucaauuguuucucuugaagagcaguuguaacuagaaagcuugaaaaguuauuaauagucacauuugcauuauuuauuucuuuauuuauuaaucagaaauaagagcauucauuuguagcaauuuauuaaguaaaaguccucaagaauuaacaccauuagguggaaauaaguaguaacugaggacacuaauagcaaagaauuuuuuauaauuugauaugcacaauuucuaagaauauuaaaauauuaucuuaaaccauaacuguuuugaauauauaaagaacgauauuauauauccaaucuaucuuauauguaggaccuguagagugccugagauauaaacccagcauggcauugcuuuaagaugucuaggcaaucuagaacaauuuauuaaaugucuaaaaacagccuucuuaaaaggacagcauuuuuucuuaugaguuguauaugcauaagcaauugcaaauuugagaauuaauagcauccgagggacgaacaaucuucagcaauugugaucucugagauauaauauugacuauuaauauacaaauuaaagcuugauuauucaacauuuuaaaacaccaucuacagcacacaauuuaauuaucuguguggaagcaggaggaaauucaaaacaauaagcauaugauucaauucacauguacuuuuuuccccauacaagggcuguuuuuaaacacaguaacuggaaugcaugcaugcaugaauuuauagaaaauacaaaagcaugcauaaaaacaauuuuuaacuuaucuuugggauauugauugucaauuuuauuuaaaaugaugguauguaauagaucaauuauuaauauucuguaauaaccaauuugauuguuguuuggaacaaggaacagacacuuagucagguuuuuaagacacaauuuuuguuauaguuaucccaaacuauaugaauuuaucuuauaauucuuuguuagcaccacaguggcuuaauaggaugcugaaacugcgcuuugaggugaacaccaccucggccucgcccuugaggggcauuagcuaauaaaauacuuuucacuuaggaaacaauauacacugauaaguucaaacucuuagcuucuuguauagaagcagaaaugauaaaaaauuuuucuuauauaauguaaaacuguguuagccauaccuacagcaauauuuuccagugacuaucaguucacuagaagcaaaacucuuuacaauuaucagaauguaaaggaaaaaaacaaacucuuaaaucuauaauaacuuuacaugaaguaggcaagucaaaucgcaauguccagauaaauucuacagccugauugauccuuuuuauaaacuucgaauuuaaacuuuauuagaacaacaucuggguagaucuguaacaguguucuuucagcuaaaagaaauuuccccuggaggcaaguuuccagagcuucccuaggcaccguuugcaagacaaaagaaagucacacaaaccgugcagaagcugcucugagcuucguuccucuugccaugaggacagauuuuacgauuacuaagguucuuuuacaauauuagaccauaacuacaaccuugggaaagcaaaacccaauuucaaaauaauuuauuaccuuagaaucaacauuaaaacuucacuaccacauugugagauuuggcugccaauuuaaccuaugaaugcaugacagugcaagcuucaauguuucauucuuaaagagaccuugcuuuaaaucuuaucuucaaauuuacuuucuaggauaagaaucacauuaaauauuaucucagcuagaagugucuuaggaggcccgguuuuuuuggcccacuuuaugccacguguuugaaaggcuccaaaccugaguuaccaauuuaaagcuaacuuucuaguaaccaauguuacaccuuuuugaucauacccaauaacuuauaagcuaauacucuacgaugaagacacgcagagcauauuacaccucuaagaccaguaaaaagccaaaugaagcggcuauacuuagaccaaucagagaauuuuaauuuuucuagcuauaauuauaaaauaaaaagcacuuugucauuugcuaaacacauuaaucacaaauguagagaauccuccaggcaaaaaaccaucuaucagcuuuuuugcccccaaaccaagaggcugcaggcuccuuuucucaaaaaacaguuuuuccagcaggagcccuccuggcuaaagcauguggccacucucuugcuaaaccagcagauaaaguuuuagucaucuuuauuuucaaacgugaaacacagaacacucagucguucagacaacgaaacaaaacacacaugaauugacauguaaacggaccggugcaccagacauuagacaacacaaagagggcagagaacuucugcuguagagccagagagaauaaagcagggcgucccccgaauucucucugucucugggagaguuucaaaauacauuuccucuauauauuuuacuccaucauuuugagcccuauuccucuagccugaugcaguucucgacugcugacaacugcccguuucauuauuuuaaacccuauuccucucgccugaaacagcuuuuaaaagcugcggacaacggccugauucacaguuucuagucccacacauauuucacugucaaauccuaaguggaaaaagcaccggguuagcacuguuccaaacuuagcccauauccuuccacacuuccagcaacacuuuuuuaaaaaaugaaguuuaaagccagugcuagcauaaauaccuguugcucacuuugccagauacgaucugauuauuuccuucccuuggagcuccauacaagacugcgauucccucaguguuuucccgccauucccauggucccuggcccgggcgccaaucuguuauauacaggccuguggcuuacaaggaccggguacaccagggaggcaggcuggggcugaaagagacuuagacagugagagguuaauggagccaagacaugauucuguucaaggcccuccaguuuacuacgagagucuacuuauaaaaggcccauccccugccaguccauucuuggugucugaggccagccuguaggcaaugugcagaauaggauguuccucuggaauguaucaggugcuucucagaagguagcagugucuuggagagagcaguggcagguggcagaacaaaggagccaucuaggucggaaggcuccacuuuagguaauuuccuucacaguggcagcaaggucaaagucuggaucagccuacuucagggcugagggaggcuauaguuuucccuagaccuaugcucggcaaucguacagggacauaaggcucagcaggacuacugucuuugaucaccuuuuguagguuguauucuggagguaccccaaguauccuuggccccacuucuuccuugguccaaacuaaaccuuccugcauguguccucucagaucacucgcugucccaugaucccuugcuacaucuccuccccggaugagugccucuggauggacugggucacagagaagagcaucaaugggcaccaggccaaguucuucgccugcaucaagagaagugaugguucuugcgcgugguaccgcggggcggcaccccccaagcaagaguuucuugacaucgaggacccguaagaaggcugacagagccccuguggccaauugaaaagccucugaggguuuagacugguccagcuuugacaucccuuccuggaaacagcaugaauaaaacaucaaucauccaaguggguucacgcuagugugauucugcccccuccccuauuuucccuagacaugguagugggucuggagggacaggcgggccagguucccugccauaccccuucccucugccagccugagcacugugugucucagucuuugauccuugcuacaggcaggaguggagcacagacuuguuaccaggucucucuggcacugucacaugcagcagacaggcagcauuaaggguacccuagcucuguuagggcagagccugggaaugugcauuuugcagaaacucuugaagguuguuguaagacuguguagccggccuaccagguccuuuucauccugagagugacaugucccucguuuucugcaguggccaccucucucucuggcccuugcaaaugcuucccaucccuccugcaucugguauggacuuucaggacccuggucucccucgggucuaagaaucacccuccaaccagugguucauuuuucuaggagucccagucagccccaugaauccacagacuucagcgaauggaagcccucccugagccguguuucuggcuucaaccaagucauugcugccuuccucuccccugucucuacacacacccucaguggggucugugaggucucaugcugggggcagggaucuguggugaggggugcuuggcaguccuuguugccacucucaagcuucccaagccauucuucaccccuuuccaagcaagcuucaagcauccaggcugagcagcacggcucgguuuggcucucugucgcaucaggcccugccgcuguuggggggcgcuaccagcacucccucuuuugcacaaacugaugauauaaaaggccaguccuaggcaccuaggaaaagucuagugaacucucccugcuagaucagcggucauuaugacccuguugauuucugugucaguaacuaagcacgcagcaggggagacuuugcggugggcaguucuucguaccaagcccccccccccaaggaugcuguggcuuguuuucagauccaucucauuuuccuaaaggugaauucucaugcauggcugagagacauguguaugcagcucugcuucugucucuuaaugucgcuuaaggcccuuauagggaacugguauaucuacuugcuccuuaaagcaauuuucuuucugaugccaauaggauggggguuaagacaggcagagcuuuaucacuaacaauauagacagccacucuuccuucugccugcgucuuaaaaaauaagcugucccaaggacacaaauguauauuauccauacaugcacgcauaugcucacacacaaacucagacucugaagucugguagccugugaauguuccuuuuguaaaaugcuuccaaaagccucuuugcuccaacccuguccuaaccaucagaaaccccaaagaaacgguuaaggacucccccucagacucucccuacccaagccccuacaccaggaccuggccaguccuuuuaagacagacugggaggacacacaggagucagccugccccuucugagggcauuuucguguugugcagugauguucuuccuuggaugcuggccuggaccagccaacgagacccugcagucuaucccgcccugccuguuugcuuccugugcggugguaucaauauguaacagugccuguuucugcugauuucaugacauguucugguuuguuucugauguucgccgugagcguucuugugccguguugaugccuuucguagcauuagacuuugcacuuuuaaaaaaaaaaaaaacaaaaauguugaagcaucgaggaagcaucgaacccagaguggaaugcaugguaugguagcuggccugggacagagggacccuuucucaucuuccuuugaguucuuugacuaucugcuuuuccagccucucccgucuuuuguaucugguucaaauuauuauaaaggaaagacccucugaguauaccgguucugaaagacggccuuucuguuuuccacucaugcugggguuucuagccacaccaggcagaugagaggaaaccgagcgagcaaacgaaccuuugggacaaagugccagauggcagcugagcaacagccacucaaaugccuucccagcaaaccaauugcaauauauaguuuaagguguuguuuuacuucuguuauauucuaagcccugggccucccucccuuacucccgucaugccagcaacucgcaauauuucagaugacguuuacaugguagcaauuuccaaaucgcugccugaugcguauuaagacauauccgugggcuugcugcauaacucaacgcuuuguugauuuuguuucuguuugaacucuugguuguagggggggagggguggaaccccaugugcgugcuggaauaugaagucugagauguaccccccaacaccccacgcuggcgauacgugagaguuguugaaagucagcaagccgagcgcgccugaugcucuguaucagucucuacuuuuauuuuuaugaguuugcucugucaauggacaauaaaccauauuaucaaagagaag

SEQ ID NO: 6509 - RNA, 9362 nt, Mus musculus
uauggaugaacaaacuucgugagaagcacgugagacuuuaaugauuuuugaugagugacugugacagauggggcuacugcaguaggcacaggaaaucccacaggaccucauggaaccugcuuguaccugcagugagggcccugggacucucaguccuggagugagugcuggcugaaaccuucuaguaaauuuucauuugaauacaaucaguuuaugcuuacaaagcagcuggaggcgaaggaggggacacaggaaugucugcguccccaccacugagauguaccauuuacaccaugucaguggaguuagugagguagaaggggcguaugaccacacggaagcugcuaaaggccccugaggcacagggaaagagggagggagucuuggaacuauugguguccagggcagugggaauaggggccuuggagccuucaaagcuggugacauccaccacacuguagccuccgcagaggaucaguacucuguucucauagccaauugucggauuggaguagcuggauguggugaggcccaguacagggagcucguuagagguacacgagaagccauaguuccagcagcucugcaugguggggagguagguggcugaccaggagaucugcuuguccuugaagaggaagcugggguguugugggguuuggaaggacugguagcuauuguaccgggcuacugagccauagccauauguauagagcugauuguaucgauuguauucauaucuuugugcccuccagguggaggccaucaccaagcuacuccagguggaagagguguaaaggcggggcuuguagguguccuccgugagguucaggccuuuguacuuggccagcacuucgacaggcacuguguggaacuccaaggccugcauggucuuccucuggaacagugccuggugaucuugguacaaggacagguugaacugcagcucgaacagcuccuggggcagcaucauggggaagcggaccuguuccaccaggcgcucuauauccucgugugaggcaaugguuucugugcuccacugguccacugccuucagcagauccagcucacuagacacagccagcucacucuuggggaggagagccuggaucaagguggugggaacagccgaccaggacucagacugugucagaggcucgaaguuccaggccagaaacuguacacacagaucuuccagcauagaguccccgguggcccgugcguacgcauaaagguccaagggaguauggaaaguggggucuugggggaggaggguggcaaaaagccguccacaguaguccugaagcucuguggccccauaggcagaggcuagcuugugcaagcacuuaacagaagacaugcugaccucgauucuucgggaguaaaaguaccugagggagggagggagggaagccaggugucuggagucagcccugccacacagcgggugugccuggccuacugccacccugggcauugaucaucucagucucacaccaacuggcaaaaaccuagggaugucaagcaaauaacuguugacaaagacacccacagccacuuucuuccucgugugugaacacccucaccugagggguuccaccaucuccuggucucccugcugucacugugagccuuggucagcagagaucugggcauggcuccccugcuggguuccugugguaaccucucuccccaaguaucuacccccaguuaggugacaacgguuccucggucaccuuauuucugcuucccuguggcuaugagccacgugagggucagaggccacagugacauccucucucuuugugcacaaauguucagaccggucugagguuccugucacugacuucacggcacucugaaggcugggauggcaacucucuccucugaccugacccacccuacacaaguggcaauagauccuuugugaaaucaccucauagggaaggcacaggauaauaggaugcagccaccgaccucccacugcugcugaaggaggagcaccgggaagaaggauuggcacuagcuucugauccucaucccacucuaaagcggucccuuggauucugcuggcagcucugagagccaagggaggcugaaaugagccacucacagcaagugccucucuguccccaugccuccccaugccucgcucauccaagucuuaagguucagacaucaggguggguacucaguccugcucauccucuacaaguaaaaaacacuuguccagagugggaaaaggcccaaagcuagcagcgagaaguggcuugagggacagcuagagggugcaugcauugacugcagagggaagcugaaggggucugggguaggggaaagggagagagagaaagggagggaaggagagagcacagagcccagaccucaggccacagcuagggacagggcacagagguguaggaagcuggggauggcaucugccucccucucacugugucuuagacaucaccagcaggacacaggaucccugccugcuuugcacacucgacugcaagugaaugguuuuaaucuggguuuaauugccaguacuguucucauaaaugucacguuccauuauauaaagcuccaggucauaagagugaaagagaauacuuuuaauaaauguucugcuuuuaaaucauugcuuucaaaaugcaagccugagaaguucuggguuggggaaucuaaaacuucuuacaacagugugcggugauuuggagaagauauuuagaguuguauagugaaaaaugcaugcauuugcaugcacugaaugugggugagggugcgugugugcagugauuuggagaggauauuuagaguuguauagugaaaaaugcaugcauuugcaugcacugaaugugggugagggugcgugugugcacaucacugugcaugggaugugugugugcacaucacuucagugugcaugggauguaugugugcacaucacuucagugugcaugggaugcaugugugcacaucacuucaguguacaugggauacgugugagaauagagcagugguuugauuaaguaugguccuuacaggcucaaauaucugaaugcuuaguuaccagggaguggaacuguuugagaggauuagaaggauuaggagguguggccuuguuggagggugugucacugggggguaggcuuuggggcuuccaaaguuccagucucucucugccuguggaucaggauguaaagcucucagcuacugcuccagggccugccugcgugcugcaugcucccugccaugaugauaauggacuaaaccucugaagcuuaagcaaacccucaacuaaaugcuuucauuugaagaguugccuuggucacggugucacuucauagcuacagaacaguaacuaagacaaguagacccauaggcacacgcaaauguaagguucagaugggugagcauguguucauacaagugcaagaaguguuuggaugcaugugugugugugugugugugugugcacaugagugugcaugugugcaugcaaagguagugagugaguauccagaugucugaguguucgaugcuuccaugcaagugcagagaacauuuagaugugaauguguguucacaccagugcagcaagcauucagauguguguccaugugauucuguagauggaugugagcauuugugaccauuugucugcaagggcagaugugugccgugugaagaagcaugcacguggcugugugauaugugagugagugcauauguguggguguugcacugcacgugugugugugccugagugugggggacaucccuggcaugguggaugcucuggaaguaaggaggagugugcaccccaggcagacccagagcugaagguuuggcuuaccugaggaagucucugacgacaggcaugcacucagcauccacucucaugaugacgcugcugcccaccacuugccacagggccugggccucgggguuggugcgcaggaucagcgugugggcacagaggcucagguccucauaccccugcccugucaccuggaugaauaggucgcagcccugcuggcugucaaagaucuggcccagugcaucugagagcucuccagagagguccaggaugugaagccccgugguaucugggauggacagaggcgguugcugugugaggcaugggcuuuguggaucauuuucucugugaguuugagucccauuugauacccccacacacccccaccaggagucaggauccucaucugaaccagacauccugguaccuggcucugcccagaggccuuguggaaagaugcagaaugggagaggccugaagggaggcugcagcugccuucugaaccccacaagacagcagcuggcucucuguaccccacacucaggcacuuccucuagaggagacaccaacccuaaggcugugccuacucuucacaaaccuccaguaacugcagaggccacccuccuaugcccaaugaacagccuuucaaguuagggucccauugcaacuuuacauuaaaacuugaggguucccagucccaaggggacaaguccugaagggguauggcaugucucggugcauccccaucuuucccugccucccaaagccuaauccaaaaccacauaccacaccaugcauugcucuguaaagguuuggcuugauuuuuacauuuggaguggguggacuggcuccugugucuucucacaccacagccccagucccuccuagcuuccccuugggucucguuucacacuguuccccagccaguggggccucccagaugccugcacagcuuggucauacucacgaggcuccuccggucugagacccuccaacucagaucaacuuauacccaagccugucugacauugugggauucgacacccucaggccucaguucuccaacucaggacagaagggcaugucccaggaccacccccaccucccaggaggaagucacagauggcagccaggaaggaaagcucccacgggccucaggcacuggagaugaagaguuguggcagagucgggguuuggcagguuagggcuucgggcaccaguguccuugaacauagccagcgagaaucacuacgucaucacgcacagccugugggggggcggugcuaugcaauaugccugagcauaauaaccauaagacaccgguccuuagagagccaccccuccagcacacagugcuguuuguacaugggauacagucccuuacccauaacccacugcccugaucgaggagcuucucugacguguguaacacgggggcucucuuggaggaugugggcucccagccacauccagggugccacuuuugacuauuuacacagggguguugguauaggcaggggcacggcugccacuuccccuaggugcugggagggcagggcagcucaccguuggagcagaccacgccugcguccuucucgugcccacagcggcucaccauccaacccagggaucugcaacuggccagugaggacucggucccuguacauuccaccucauccagcaugaucggucccuuuccugugggcacaaaaggaaagccaggggccacacuggaggaggaaccggaccuucagcggggaccggggcugaucaccagcucaggaugggaugcuuaaagaacauuacucagggaccucagccacaccuggcccgaaggcagcucugcccagugcuuggguggcguucucauagcccagggcccggcagacgacgugggcauccaaaagguuccagagguugucacacacugucccccaccggccucuguagaagaucuccacgcggcccucauuggcugaggccccguuaaccaagcgcaugucuccaucuucuguaccugucgggagaggggaggucagcugggaagagggcuagccugguuugauguucacuccccaugaauucaaugcucugugcucacuaacauucuggaguugcucuugaaccacuucaaaacgcccuccccgugugccgugugugugugugugugugugugugugugugugcccacuaagaaggggugaaagcucugaugaccucacagaggccauccauggucuuucuaucucucagcucugggucuuuugcuccaagagggcacccuggcucucagccuacagagugaacucgaagagguuccuugcuggcucucuggaacacuggccugagggggaagguggguccuggguuccuagacacaggcagaaagcagauucaccucggcuuaugaugggugauguccugacaacucaaugccaacugucucauccuuggagucucuggacuguccccacuuagcaacgggacauugcaauguuccuuguucccuccaaaguguggggccgagggagcugugguguggggucccauuguaagaggagugggguacacagcgcuggucccaacucgcacauacaguucccaccucaccccuacagugguugccuaaagcggacaauccuggacuggagacagucugcacuguggcacaggcagccaggacaguccugcucuccuuucucuggaacucccgucucugcccaugcucacagggccagcugggcgcuugaauuggggucacccauacuagagagggauacucagcugacgguccaggauggacaaggcucucagacccacagugcagugugugaacugccccccccccccagggacucucugccacccuaaccugugcccugagacacccccccacacacacuccaggacagcacgggcugugcucucccuccuuggcccacugaugagaugagaaaaaauuucuuggccucuucuucaauaccugcauuucacuugggugcgggggagcaccaggggccauacgccaccaccauuuagaaugacagaggagccacaugggagagaauccugagacauggcuccuugcagguugccaugcagcuuuucugcaaggcagagggggacaacccacagaacaaggcguuugggaccuuucguggggcaggacucaccuugagucccuggaaccagcaagaacacagagaggagccacaggagagccauugccuggccuagaagcccaacccugcagcagaaagaacaacaaaguuagacuggcaacagcucuccaaaggagacuggcaguuccauggcucccuguccuauuuguagaggaugggaugguguugugggugguacucuuguguaaggcccagauggcuaugugauggcucucaugcaggccucucucacaugcucugcaggacaaccuucaggucagcaagaguccccagaugaggcaaguggcuugagggcuccuggcaacgagaacccaggaagcaaacaagagcucuuuaucuuuagcuggccuuaucuguaaguaguagcuagcugccuuuggggugugcaggggacaagauuugccagucugugaggacauuguagaugagguuggaacucucaaggggaagugacagaggcaguguagaagggucugggacuucaugaugugaccuggggaugugggucagggucaaccaccacggugcugacacacaggacucaauacuuagacucuugccuguauguaggaugugccccacccaggcauugucccucaggcccugcaaggagcggggcaacccacagaacaaaaugcagcagccucaauggacucuggacucguucuaggcccagcaggcagcuugggacugguaguggauggugcuacagagcucugucuccugggcaggaacuggaagccacaaauuguuacuccgaccaggggcccagagacaagcaguagagauauuucagguccaguagaagcaccaggauuggccccuccccagcccucucccaccgaccaacccccaccccagacauucugcaccagagcagcacgagcaagcccucagggggccagggcacuuguagccaucuuggcaggggugaagagauccuaggauaggcuuuggcuauccgacugcggaagcaacagcagaacuggaacuccccgggagucucacgcugaaaggagaaggcuguugccuggugauagccagagaggaagccugucuccaggaaauaacagcucacucugggauuuacagcccaggcaagccaguuagcuauguauaccucuauguaaaccucauguuaauauccccuaauagacucugggccauuaaugggggaggccacuggauuccucuuaguguggccacauuaaauaaaucuccuuuuucggcuuuucacuguuauguuuuuaauuggaccauggaggauggguggcugagucuggcuaucaggggagcuuucugggcauaagcucugaccguugaguccuauaacacacugaugggugggacuuggcccuuaguucugugcaccccacccccaccccccaacugguucccaccagacuucugcaucuagucaagcacagacccagaacaauauacaacucacaaaguucccacaucccuaaugagagccgaagcuagagagccaacugacuccagaugacacagccagugagcacagguuagggucugcccagggguggccuccuucuaccacaaggacccugguggagguggagggagccagagagucccacauccguguggcaaggcauuaccccaguuuuaucccaagaaggccugggcucugggaaaccugagucccaggcaaacugcacugggugcccacucccugcauuuacuauaaacuguggucguagguuuguccaugcugggucaggcgcucuaggccuugggaacauugcaguguauguggauguugcuguccacuggaugacagaggcuguuucugcccuacuccuuugugugggaagaugggacaagccugccuaugcuggcucauucaguaccacugaguagguagguuuaguccugggagagaaucuacagacccaggagggggccggggauaaacucuaacccacucaccccuucagcuguucauucaguggacauccugcccaacuguauuggcuccugugcucuggccugccagaaaucaugcuguguagaguggagacucaccugggagcaagagagggacucaacugucccucaggcagcgaggcaguggcugaaggcaguccuggagccuccuuccuggcugcaacuggaagccuucuguagacuguucagcagagaaaagcuccaccauguggcuuuccucagccucgucccaggaaaugcuuuguaaaccucaccuaguuucgauuuucagaaaacacaugacagaggcugcuucugggguuggcugucagcaaggcuaauagccuucugcuugcugcucuguggggcagagggcaggcacccaagcgcccugugcugagcugaua

SEQ ID NO: 6510 - RNA, 9362 nt, Mus musculus
uaucagcucagcacagggcgcuugggugccugcccucugccccacagagcagcaagcagaaggcuauuagccuugcugacagccaaccccagaagcagccucugucauguguuuucugaaaaucgaaacuaggugagguuuacaaagcauuuccugggacgaggcugaggaaagccacaugguggagcuuuucucugcugaacagucuacagaaggcuuccaguugcagccaggaaggaggcuccaggacugccuucagccacugccucgcugccugagggacaguugagucccucucuugcucccaggugagucuccacucuacacagcaugauuucuggcaggccagagcacaggagccaauacaguugggcaggauguccacugaaugaacagcugaaggggugaguggguuagaguuuauccccggcccccuccugggucuguagauucucucccaggacuaaaccuaccuacucagugguacugaaugagccagcauaggcaggcuugucccaucuucccacacaaaggaguagggcagaaacagccucugucauccaguggacagcaacauccacauacacugcaauguucccaaggccuagagcgccugacccagcauggacaaaccuacgaccacaguuuauaguaaaugcagggagugggcacccagugcaguuugccugggacucagguuucccagagcccaggccuucuugggauaaaacugggguaaugccuugccacacggaugugggacucucuggcucccuccaccuccaccaggguccuugugguagaaggaggccaccccugggcagacccuaaccugugcucacuggcugugucaucuggagucaguuggcucucuagcuucggcucucauuagggaugugggaacuuugugaguuguauauuguucugggucugugcuugacuagaugcagaagucuggugggaaccaguugggggguggggguggggugcacagaacuaagggccaagucccacccaucaguguguuauaggacucaacggucagagcuuaugcccagaaagcuccccugauagccagacucagccacccauccuccaugguccaauuaaaaacauaacagugaaaagccgaaaaaggagauuuauuuaauguggccacacuaagaggaauccaguggccucccccauuaauggcccagagucuauuaggggauauuaacaugagguuuacauagagguauacauagcuaacuggcuugccugggcuguaaaucccagagugagcuguuauuuccuggagacaggcuuccucucuggcuaucaccaggcaacagccuucuccuuucagcgugagacucccggggaguuccaguucugcuguugcuuccgcagucggauagccaaagccuauccuaggaucucuucaccccugccaagauggcuacaagugcccuggcccccugagggcuugcucgugcugcucuggugcagaaugucugggguggggguuggucggugggagagggcuggggaggggccaauccuggugcuucuacuggaccugaaauaucucuacugcuugucucugggccccuggucggaguaacaauuuguggcuuccaguuccugcccaggagacagagcucuguagcaccauccacuaccagucccaagcugccugcugggccuagaacgaguccagaguccauugaggcugcugcauuuuguucuguggguugccccgcuccuugcagggccugagggacaaugccuggguggggcacauccuacauacaggcaagagucuaaguauugaguccugugugucagcaccguggugguugacccugacccacauccccaggucacaucaugaagucccagacccuucuacacugccucugucacuuccccuugagaguuccaaccucaucuacaauguccucacagacuggcaaaucuuguccccugcacaccccaaaggcagcuagcuacuacuuacagauaaggccagcuaaagauaaagagcucuuguuugcuuccuggguucucguugccaggagcccucaagccacuugccucaucuggggacucuugcugaccugaagguuguccugcagagcaugugagagaggccugcaugagagccaucacauagccaucugggccuuacacaagaguaccacccacaacaccaucccauccucuacaaauaggacagggagccauggaacugccagucuccuuuggagagcuguugccagucuaacuuuguuguucuuucugcugcaggguugggcuucuaggccaggcaauggcucuccuguggcuccucucuguguucuugcugguuccagggacucaaggugaguccugccccacgaaaggucccaaacgccuuguucuguggguugucccccucugccuugcagaaaagcugcauggcaaccugcaaggagccaugucucaggauucucucccauguggcuccucugucauucuaaauggugguggcguauggccccuggugcucccccgcacccaagugaaaugcagguauugaagaagaggccaagaaauuuuuucucaucucaucagugggccaaggagggagagcacagcccgugcuguccuggagugugugugggggggugucucagggcacagguuaggguggcagagagucccuggggggggggggcaguucacacacugcacugugggucugagagccuuguccauccuggaccgucagcugaguaucccucucuaguaugggugaccccaauucaagcgcccagcuggcccugugagcaugggcagagacgggaguuccagagaaaggagagcaggacuguccuggcugccugugccacagugcagacugucuccaguccaggauuguccgcuuuaggcaaccacuguaggggugaggugggaacuguaugugcgaguugggaccagcgcuguguaccccacuccucuuacaaugggaccccacaccacagcucccucggccccacacuuuggagggaacaaggaacauugcaaugucccguugcuaaguggggacaguccagagacuccaaggaugagacaguuggcauugaguugucaggacaucacccaucauaagccgaggugaaucugcuuucugccugugucuaggaacccaggacccaccuucccccucaggccaguguuccagagagccagcaaggaaccucuucgaguucacucuguaggcugagagccagggugcccucuuggagcaaaagacccagagcugagagauagaaagaccauggauggccucugugaggucaucagagcuuucaccccuucuuagugggcacacacacacacacacacacacacacacacacggcacacggggagggcguuuugaagugguucaagagcaacuccagaauguuagugagcacagagcauugaauucauggggagugaacaucaaaccaggcuagcccucuucccagcugaccuccccucucccgacagguacagaagauggagacaugcgcuugguuaacggggccucagccaaugagggccgcguggagaucuucuacagaggccggugggggacagugugugacaaccucuggaaccuuuuggaugcccacgucgucugccgggcccugggcuaugagaacgccacccaagcacugggcagagcugccuucgggccagguguggcugaggucccugaguaauguucuuuaagcaucccauccugagcuggugaucagccccgguccccgcugaagguccgguuccuccuccaguguggccccuggcuuuccuuuugugcccacaggaaagggaccgaucaugcuggaugagguggaauguacagggaccgaguccucacuggccaguugcagaucccuggguuggauggugagccgcugugggcacgagaaggacgcaggcguggucugcuccaacggugagcugcccugcccucccagcaccuaggggaaguggcagccgugccccugccuauaccaacaccccuguguaaauagucaaaaguggcacccuggauguggcugggagcccacauccuccaagagagcccccguguuacacacgucagagaagcuccucgaucagggcaguggguuauggguaagggacuguaucccauguacaaacagcacugugugcuggagggguggcucucuaaggaccggugucuuaugguuauuaugcucaggcauauugcauagcaccgcccccccacaggcugugcgugaugacguagugauucucgcuggcuauguucaaggacacuggugcccgaagcccuaaccugccaaaccccgacucugccacaacucuucaucuccagugccugaggcccgugggagcuuuccuuccuggcugccaucugugacuuccuccugggaggugggggugguccugggacaugcccuucuguccugaguuggagaacugaggccugagggugucgaaucccacaaugucagacaggcuuggguauaaguugaucugaguuggagggucucagaccggaggagccucgugaguaugaccaagcugugcaggcaucugggaggccccacuggcuggggaacagugugaaacgagacccaaggggaagcuaggagggacuggggcuguggugugagaagacacaggagccaguccacccacuccaaauguaaaaaucaagccaaaccuuuacagagcaaugcauggugugguaugugguuuuggauuaggcuuugggaggcagggaaagauggggaugcaccgagacaugccauaccccuucaggacuuguccccuugggacugggaacccucaaguuuuaauguaaaguugcaaugggacccuaacuugaaaggcuguucauugggcauaggaggguggccucugcaguuacuggagguuugugaagaguaggcacagccuuaggguuggugucuccucuagaggaagugccugagugugggguacagagagccagcugcugucuugugggguucagaaggcagcugcagccucccuucaggccucucccauucugcaucuuuccacaaggccucugggcagagccagguaccaggaugucugguucagaugaggauccugacuccugguggggguguguggggguaucaaaugggacucaaacucacagagaaaaugauccacaaagcccaugccucacacagcaaccgccucuguccaucccagauaccacggggcuucacauccuggaccucucuggagagcucucagaugcacugggccagaucuuugacagccagcagggcugcgaccuauucauccaggugacagggcagggguaugaggaccugagccucugugcccacacgcugauccugcgcaccaaccccgaggcccaggcccuguggcaaguggugggcagcagcgucaucaugagaguggaugcugagugcaugccugucgucagagacuuccucagguaagccaaaccuucagcucugggucugccuggggugcacacuccuccuuacuuccagagcauccaccaugccagggaugucccccacacucaggcacacacacacgugcagugcaacacccacacauaugcacucacucacauaucacacagccacgugcaugcuucuucacacggcacacaucugcccuugcagacaaauggucacaaaugcucacauccaucuacagaaucacauggacacacaucugaaugcuugcugcacuggugugaacacacauucacaucuaaauguucucugcacuugcauggaagcaucgaacacucagacaucuggauacucacucacuaccuuugcaugcacacaugcacacucaugugcacacacacacacacacacacacaugcauccaaacacuucuugcacuuguaugaacacaugcucacccaucugaaccuuacauuugcgugugccuaugggucuacuugucuuaguuacuguucuguagcuaugaagugacaccgugaccaaggcaacucuucaaaugaaagcauuuaguugaggguuugcuuaagcuucagagguuuaguccauuaucaucauggcagggagcaugcagcacgcaggcaggcccuggagcaguagcugagagcuuuacauccugauccacaggcagagagagacuggaacuuuggaagccccaaagccuaccccccagugacacacccuccaacaaggccacaccuccuaauccuucuaauccucucaaacaguuccacucccugguaacuaagcauucagauauuugagccuguaaggaccauacuuaaucaaaccacugcucuauucucacacguaucccauguacacugaagugaugugcacacaugcaucccaugcacacugaagugaugugcacacauacaucccaugcacacugaagugaugugcacacacacaucccaugcacagugaugugcacacacgcacccucacccacauucagugcaugcaaaugcaugcauuuuucacuauacaacucuaaauauccucuccaaaucacugcacacacgcacccucacccacauucagugcaugcaaaugcaugcauuuuucacuauacaacucuaaauaucuucuccaaaucaccgcacacuguuguaagaaguuuuagauuccccaacccagaacuucucaggcuugcauuuugaaagcaaugauuuaaaagcagaacauuuauuaaaaguauucucuuucacucuuaugaccuggagcuuuauauaauggaacgugacauuuaugagaacaguacuggcaauuaaacccagauuaaaaccauucacuugcagucgagugugcaaagcaggcagggauccuguguccugcuggugaugucuaagacacagugagagggaggcagaugccauccccagcuuccuacaccucugugcccugucccuagcuguggccugaggucugggcucugugcucucuccuucccucccuuucucucucucccuuuccccuaccccagaccccuucagcuucccucugcagucaaugcaugcacccucuagcugucccucaagccacuucucgcugcuagcuuugggccuuuucccacucuggacaaguguuuuuuacuuguagaggaugagcaggacugaguacccacccugaugucugaaccuuaagacuuggaugagcgaggcauggggaggcauggggacagagaggcacuugcugugaguggcucauuucagccucccuuggcucucagagcugccagcagaauccaagggaccgcuuuagagugggaugaggaucagaagcuagugccaauccuucuucccggugcuccuccuucagcagcagugggaggucgguggcugcauccuauuauccugugccuucccuaugaggugauuucacaaaggaucuauugccacuuguguagggugggucaggucagaggagagaguugccaucccagccuucagagugccgugaagucagugacaggaaccucagaccggucugaacauuugugcacaaagagagaggaugucacuguggccucugacccucacguggcucauagccacagggaagcagaaauaaggugaccgaggaaccguugucaccuaacuggggguagauacuuggggagagagguuaccacaggaacccagcaggggagccaugcccagaucucugcugaccaaggcucacagugacagcagggagaccaggagaugguggaaccccucaggugaggguguucacacacgaggaagaaaguggcugugggugucuuugucaacaguuauuugcuugacaucccuagguuuuugccaguuggugugagacugagaugaucaaugcccaggguggcaguaggccaggcacacccgcuguguggcagggcugacuccagacaccuggcuucccucccucccucccucagguacuuuuacucccgaagaaucgaggucagcaugucuucuguuaagugcuugcacaagcuagccucugccuauggggccacagagcuucaggacuacuguggacggcuuuuugccacccuccucccccaagaccccacuuuccauacucccuuggaccuuuaugcguacgcacgggccaccggggacucuaugcuggaagaucuguguguacaguuucuggccuggaacuucgagccucugacacagucugaguccuggucggcuguucccaccaccuugauccaggcucuccuccccaagagugagcuggcugugucuagugagcuggaucugcugaaggcaguggaccaguggagcacagaaaccauugccucacacgaggauauagagcgccugguggaacagguccgcuuccccaugaugcugccccaggagcuguucgagcugcaguucaaccuguccuuguaccaagaucaccaggcacuguuccagaggaagaccaugcaggccuuggaguuccacacagugccugucgaagugcuggccaaguacaaaggccugaaccucacggaggacaccuacaagccccgccuuuacaccucuuccaccuggaguagcuuggugauggccuccaccuggagggcacaaagauaugaauacaaucgauacaaucagcucuauacauauggcuauggcucaguagcccgguacaauagcuaccaguccuuccaaaccccacaacaccccagcuuccucuucaaggacaagcagaucuccuggucagccaccuaccuccccaccaugcagagcugcuggaacuauggcuucucguguaccucuaacgagcucccuguacugggccucaccacauccagcuacuccaauccgacaauuggcuaugagaacagaguacugauccucugcggaggcuacagugugguggaugucaccagcuuugaaggcuccaaggccccuauucccacugcccuggacaccaauaguuccaagacucccucccucuuucccugugccucaggggccuuuagcagcuuccguguggucauacgccccuucuaccucacuaacuccacugacaugguguaaaugguacaucucagugguggggacgcagacauuccuguguccccuccuucgccuccagcugcuuuguaagcauaaacugauuguauucaaaugaaaauuuacuagaagguuucagccagcacucacuccaggacugagagucccagggcccucacugcagguacaagcagguuccaugagguccugugggauuuccugugccuacugcaguagccccaucugucacagucacucaucaaaaaucauuaaagucucacgugcuucucacgaaguuuguucauccaua

SEQ ID NO: 6511 - RNA, 12851 nt, Mus musculus
ccgggaagacguggcuguaggcaaccgagagugcggcgcaggaagacacuuagagcagaggcugccgggagcgcgcggccagagugaggcgcaggcgcagaacagagacugccgggagcgcgcggcggggcggaaguggccgccugcccuguccggcccuacgcagguaggcggcagcccgcaggcuccggagccaggcccucagugggugagugacggugcgcccgcggccgggugcccucccucgcuguguucuggggccuguugccacccgcauccguccggcccggccccaggcaccucaaacucccccccgcagcuaggcugugacgggugccggacagacagacgucuuucccccucuggcuugugugggagaccuccccuuucugaugagggugccgugcugaaguagugcgaaacuucuuccucuucugacuagcaugcuucaaaugccccuagcgacaguaccuucccucccucccugccuggccugggcacgggcucuccaguuuggcacuugaucaccucucuaacagacccaccuacgcaccccauccucaccuguaaccgcccacuuccuugcuccuguccuggcucuucuugcugucaucuaagauuggaccuucccccuaggcagcauagugcacuauccuuuuuuacuacccgacuaccgacacccccugcuucuucugcacacccccuagucccuuucugcacauacaacccuaaucucggcuagacucucccagccucgaagucgggcaucaccugguccauccuuacagagcuuccugccccuagcaccugugacauucauacgccuccaguaaacccaagcaccuuucugcagucacucgggagugccucaguaaccagcuucauuucccaguuccaucucaggucuauauacuggacaaagcuuagaccugggaaccuggucucacggugucaguggggccugacugacuagaucuuacaagcucccaagacuguccugcauguacugcagacccugccuugggaacuccuucucccugccccucuggggcuugucugaggaccauccuucuggacugggcuacaggcccuccuuugagcugcucccuagaccucggccuagcagucuugcuggaacccgugagcacagccuacuuccuucuggauaagacaagggaucucugucacauagagcccagagcgucuuugcuuggcuagagacagaauucugugugcuuucuugcuuucuuuguuccauuugaccuguuauaaaaaaguaaaugcuucuugcaacugaauggaccauguacugugaccauauugucccucaguccccuuuaccacguaauaugcaccaguguguccaggaaugcaugacauccucugccugcugagcagcggggacaggaggagaggucuagagaguggaagaggcaggugucccguugccacccaccugacuguggcaugugugcccaugaagcucccacagauacgugcgacccugucaccugagccuuggaacauccuucgcaguguggcugucuucgccguggccauacagguagguguuccagugcguguuaguaucuguccuuugaggacaguggauggcaguccacacuccuuccccucucugucaagaggcaugaaaauaccuauuagaagccagugaguguugagaauuucuggaaagcuugucuuaaaugccaacacugaaggaauuaaaaccuuguauacugacuuuaaagacuuuauauuggcuuuucuuuucaucaacacaagacagauugucuaggaaaaauuaauaauaacccugauccuagagaaguccacaugcaaugaaauagaaacucaaggcagcucccgugcauugagagugagcaauugugagcaguaaagugcaggugagcgugagcugagagccaucagggugguucugagggucuugccuugucccccagccagcacagggcgggggcgggggagcucugggacagugugggcuguguccaagggugcaacuguguauucuggaauugaguucuggucuggguuggacugggauugucaaaccccuguguuuucaggcaugcuguguuugggguaucacuuugaccuggagggcagcuccuuugcuaagucccucccagggcacuggggaugcagacuaagcagaagcagcagcguugugaugccacagaugcaagccggggaggguucugaagccucucugcccacacugggaaaggacugaugugaacuguaaugagccucaagacgcucgugucuaccucacccccuagccugugagcgugcugcauugcccagggaaguuaaggcuggaaauaucucaccgggaaacagggagggcucccaaggggcaaugugaucucaggacccuuaaagccacagugugaggcagaagagcaagagggagugacuggcucaggcaaagagcuccuggugcucucaguacugcugguucugagcagggaggaaggaaccacaggcagggacugaggcagaggccauggagugggucuuccccaagacccugagaaaggaaccagccuuuggguguugcccagggaggccaagccaaacuccugcagggcugggaaauaauaguaugugauguuucagcugcccugucuacaguaauuaguuacagccccaugacacuaacacacuccuccugagcaguugacuuaaacacgggcugaauaauucaacugucccaguaguacaaagguugacucagugugugugugacccugggguguggugcagaugucggagaucccggagccacacuuggcugugagucggaucugagugugaggaggaguggccucugugguccuuagagcacacauuggcuuucuuccucaucucccuggaccguccacuuggucuaaguggggaauggaauucuuugguacagugcugagcuuggcaaaagcacaaaaccaggagccagauuccacgucacagugccuagccuguggcugugcacgggucugugcccccuaaggcccugccaucagaggcugcugggaagccugggcaucugccuacuucuuccccagcagucggugcuggccaugggcucugcuguaccgugugguaaggaagcaagcuucaaauagaacagaguagacaucugaggccuguccacgcugguguggauggaguagggagcccuuucugcaggagugaggcgugguggcaagagaguagcacugggcacugcccuuccuugauccuggaggggaggagccagccgccuugaaccuguuugagccuccaccugucacacaggccacucgugaaggaagcagagagacaggucaucuuggcuguaguuccacagggugcuguacagacccaagggugcccauggagguaggugcccucugcccaugcucuuccuaacaguuaggccggcagcucuggcagagaaaaacacuuccucuguguugcuuauuccucuggucaucuagaaauguccuuuggugaggacagauggauuagugugucucaugagaaagugagguauggccuugauguuuuaugccugaggguaguuagcuuuucaacacccacuguguaagaggggcggggaagaaaggggaccuggugccauguaacacuggagcaagguuggcucaggaacaaagcggcugcagggugccucugagcuugggcgugggggagagccugucugcgggcucgggaccagcacccuuagccggcuuggaaggacccugacccagcucagaccaggugggccuacuucugucacaaccaugcagacuccugaaugaccucaggguccuucuauggggcuguuguccauuugccccucgcuaccacaaggcuccugucuuguggccuuggcaacaucuacagccacaagacauaguaagucuuagccacaaagcagccagggucugaggacaucagcggaaaggcagcugacuuggugcucuuuuccuagcaaagaaaagaggaaggccagggauaggguauagaaaauggcauauacuguagccugagguggcccacauccucaugcacaggucuagagagucacagacucagaauucuugguuccauugucuugccacagggccaaaguuaggaugucccagagcuguuccuaaaggcucuggggagaacucagucuuuguccucccagcuacgcggcuuuccuuggcuuggggucauaucaacacucagccucugcuuguguggucauucaccuucucuuucacuugcuccucccagccuuuuguagaaaacacaugugagagcucagcacucaggaggcugaagcaggaggauugucuugaguucaagacuagacugucuugagaaugaaaacagacaccguccauugcacugguuagccguccauugcacugguuagccucuucucugaggccuucaauugcuccuucaaagucugcgcuggccuggaagacuccuggacaggggacaguagcagccucccccaggagggaagacuuacugggugaggacacauggccagagggagacugcacagugaagcaauaguugucaugcacuuucaggagguuccagauggcucuguguggucagaggacaugugcauccagguggagggagcacacgugccggggucugggcacauggacucugcacugcagagcuguucucgucugaagucaugguuugugggaggcugggcugaaaaacaaagugaggugcucugcaggcugugacugguaaggagagcuuguaggugagaagggcagacaggcagaccccuccuccgcaucuggcuuuauugucagcaggucugggaaggaugcugagugagacccuuguaagggaagucauugugugacagcucgugacugcuaaguggcagaaccacagcuuggacucuagaggucugaaguccaagugagacagaaacauggcugggggaaugggaccaagcugaacugaugccuagguaaggggaaagaagagugcagaugccccuagguugguccucggggcugggcagcccuuaguguagagaguucugccaagaagcugauuugauaccaauuggccugccuaggggaggugccuaggcuacagagauaccuagaauaaagaacgugggacuugcuagccccugggccagcagagacaucucccugucucuaggacaguguuuggagaggcacagauagcccagguaugcagaccugggcauagggcuguaagaaggaggaggaaagggcgggaaugugauauucuugagguggucggcagggcgcuggagcggggcaggagacugcuccugcauggacucccagaucuucuguucacaaaacaagcugagugcucagugucccugagagggcaguccaggagcacacaugagccagccaggugaacaggaugccugcaaaccaagggaggggcugggacaccagugucagcccauugggguagcccauagagcucuuccugaacaaagauguggggauauaggcuguggcucacaggaaugcagaguuauugaucagggacaaguuugaggguucuagagacuaaggacaauggcgugucaugguguuuaccacucuacacaacagucauguguuuugggccuguggcucauguugggcagcugaguggcuaguuccucagggccuugaucuagagcugugcccuuucagaugacuaaaggaaccucaccaugguguugaucagucagccccucagcuggugcaugcugauugucucuuggcuccuagcucugagcugcgugccagagcuggagcaggaagcccugacuuggugaggcucccaacagaaggagagcagaugggggagucucccaggacuccuugggugugagugaagcagccaugcagagaggggcaggugucugggccaguggaauggugugaggcuugcucuggaagugaagacuaagagggaggaccauugagccguggaugguuacauagcaaguagugcaggcugggguggcggcaaagggcucucggaagaauagcuguagaggaacuggggacugcuggcauguuugggugagcggcgcuccugcagaugagggaccacuacaggaaggaaaggauugaggccacuucuuggcacugugugacaguuugaaguauaacauuuacacccaaacugugacuuuuguuccugguuuccauggggauucugacuugcuggcaauguuugugguagccucagcuauuccugaggaggauugggauagucaccuugagguuggagaacucagacuuauauuuugaaauagugucuaaggugcaaguuggaauuggagcguggcaguauuugacucuuggcagggcucagcaccauguccgggaugaggauacagcacuacaauccuggguccagccucugaugccauagccauagagaggagugugugaggcagagccuccucccaaggaggucccaccagcaugggcuggggacacuuuggggugaccaguucugcagccauugcuaaaaaauggcuaccuugccaacuggucuuagcacaggagccccaaagugcucagagccuucuccuccugccucugcugugagcagcaggcucugcacccacuguucuccuuggaccugacccugggcacuaaaaccugagcgcggccaggaccggugaccuacggcaugggcacagagcaccucuguagcucccagacacccgaaccuuguaguuggaguucaugggcaccccacaaucuaaagcuacuggaaccccaagcccuuuccaggugcugccuggcagcauguacccaucaaguccccugaggugcuguucucggaucuguugaggcagugacaguggcuguggcugguaugcuugcaacccauaagggaaaugccgugcugcauccagauaaaggauggaggggcugagagcagcccuggccacgcuggagcuagacaccuucacuacagccagcacuggcuuggaggcuuuguggcacugggcuuuugagguaugguaggagaggcagggcaugcagugaggguuguggagguagaauucccagcuuccuccagugcucuggaccuguagcugugccauaguguagagcccagcuugggccuggagccaaaaccaugcaccaaguucguaaagugagcaacaugcaagacucaguuccuguaccugcuuguguuaauagaaaagugccacggacugcaucaaaaccagcagcaguguauucgcccgcacuaccuugaguuugcuuuguauugaaacagugcagagccugcccaggaaguaaagacucaguggccccaggcugcagcgugagaggcacugaggugcuggggcugggcagcagugagugcugggagaccugggcaugggguggcuggggaagugaggugagucucccagcgggcagccaccucacuaaugcuucaucugacuaccugcuggggucagguucagccaggacugcacugccaggaggagcugucuugcuugagagaccuuguguaacccaggacuggagaaguaaugucuuccacagcccacucacugcucuccuuuuccugacuuagguccuguccagagugcagucugaugcccauccagcccuuugaccagcgggaauggaaugagccuaugcacucccuccggaucaguguagggggccuuccugugcuggcauccaugaccaaggccacggacccucgcuuccgcccccgcuggcgggugauccucacguccuuugugggugcugcccuccucuggcugcuguacucccaccaucagggcccagugccaggcaggccccccacccacaaugcgcacaauuggaggcucagccagcagcgcaucucucauuacaacgacaccuacccccucucccccccacagaggacuccaggugggauucgguaccgaaucgcagucauugcugacuuggacacgggguccagggcccaggaagaaaacacuugguuuagcuaccuuaagaaaggcuaccugacccugucggacagcggggacagggucagcguggagugggauaaagaccacgggguccuagagucccaccuggcagaaaaggggcggggcauggagcucucagaccugauugucuucaaugggaaacucuacuccguggaugaccgcacaggggucaucuaccagaucgaaggcaccaaagcagugcccugggugauccuuucugauggcgauggaacuguggagaaggguaagugagccccugccgugggccgagcucuucucagcugccacuuuggcgucuggcaaaaguggccuaagggaacaaggguuuccuuuggcacagucugcggguguggcccaucauggucgguggggagucacagcagcaggugugggaggcguccacaggaagagagaugagcccaugccguggggccaccuaugucagggcgggccuuccugcccuuguuaacacaauacagaaacucccucaccugcaugccuagaaguuuguuuccauggcgauaaugaaucccaucaaagugaaagugacacucaagaucuagcucagacagugacccaagugccugucaaagacccugcauacccaggugacccuugauucagcucggcccacagcagagccuuagggggcuuacaugaagcuguuucuagaacucugagcugagcacugggaaccugcugcugaaugggaagcccuuuucagaaugagccaaggcuauguccauugccacccucaccccuucugggacccugguccuugucaugucuucagaggugucuuaggaucacacaguaugauccccagcagguggcucaccuucagggcuggauacccagugauuuacugccgucccaggcucuaaucucaguuuauugggaccacaggucaacugcugcuacucagccuugcucugagcccacccaguacaagggucuguaugcugagcagcaaugacuccugggaacagaaucugauauuagcuucauguguagcagguaggacucaggauggggggacagagcuaucugagccuuuggcagcucuaaucugugccucacagcaagcugaagaccacuacagacuuccugcaguggaaggagggccacagcaaucacccccuguacugucugcccagcccugccugggugauaaaagucuuuuguguuuguccaagguugggcucuggggaguggcagucuccacuuagguacagcgguucuguugcucacccauuuccugcccgcaaccauaaccggcagcauuguaaacuucuguuguguggggcaguucuuccccuugaguaggaagaaugcaaguaaucggaugcuaaggaugcuaaggcugagcuguggcuguuuauccagaaaggucaaaagacuagccgauggggcagcugcucauggaggcagcucaggggacuugagaggucucuggggcuaccaggaaccaaaccaggcccuuagagccacucuagggugucagaagcugccauccuccugcagccagagcuuccuaggggcuaaggagcuugcagggacguuggagauagcauguuuggaaauguuaggaaggagaauguauugaaacuauguaggcuucauugccagccuguaucaggaggcuuguauaaggucaauuaguugaaggcagcuuuggaguagaugcucugacguaaagacaaggguggaaaugaucacugccuuguccugaagacccugucauucuucuuccucacaugaugauagucuaaaacccuggccagugagaggcaggaaauggguagcccugugguuagguguaagcuguggcccuugguggcagacaauggcugcacacagccugcuugaccaccuguagcacacgcagcuccuggggcugcuggcgucacaagaagugggauggggcugccaguccucggaagcugaaggcuggcuggagaaguagcacgggaggucugggaaccgucuaguguggcucuacaguggucacacgugacagggcucuuggaagagaagggguaaggaaaaggaggacauggacuccaggacccagcacagggcuuccugucucagccuccagugaagcucaagggugguaacuucugaacacagcugacagcaacacaggcaggagauuggcagggugugggaaguaggcccagggucucagacuugccuccuguugccccagguuucaaagcugaauggcuugcugugaaggacgaacaccuguaugugggcggccugggcaaggaguggaccaccacgacaggggaggugaugaacgagaacccugagugggugaaggugguaggccacaggggcaguguggaccacgagaacuggguguccagcuacaacgcccugagagcagccgccgggauccgaccaccagguaagacgauucucucuacgugccccaguaucaugcucucacagcuugcucagcuuugcugaagaugcugauucaccguauccagugagccauuugucucugucccuugcuagcccuaacaggugaccccucauccacaaaaagccugccuagcuuggggcccucauaaacacaagauaaguaggccugagcugccauccccugggcucugaggagugugaccuuugaaugaagcugaggugugagacaaagggcagcagggagccagacccagagagcucucccaugcugcaauggugagcuggugcuucccucggccucaaacacugcuggugaaggcugcgggcccugcagggacauagggcagccagugagggaugcucugcagacucaguguagcuuucuggcugggcuguaguggcugcaugguugucccaggucguggagaguaggugcagagcuugagguuagagggaagauggagugaagcccccaaaguguagccucggguggcaaggcccuugagaggaaggcugugccggucagcagggcgugugcugacugcgggucuguacugcuaccucaggcuaccucauucacgaguccgccugcuggagcgacacacugcagcgcugguucuuccugccucgucgggcuagccacgaacgcuacagcgagaaggacgaugaacgcaagggcagcaaccuccugcugagcgcagcccaggacuucagggacaucucugugaggcaaguggggacucugauccccacccacggcuucucauccuucaaauucauccccaacacggaugaccagaucaucguggcucucaagucggaagaggacaauggcagaaucgccaccuaugucauggccuucacgcuggacggccgcuuccugcuuccagagaccaagaucggcacugugaaguacgaaggaauagaguucaucuagaugaguaagcucgcacgcccagaggggcgagggccagcggcuguguuacaccaggacucauaaaaaccgggagcgccuccacucguuugcuuuuuuucuuuuuuuaacuaagagcuguguuccuggcuagagaauuucauuauagggagcugagccccggcccauauggguguacugcucggagacugggagcaagggguccuauacaaggaaccccaggugcuccgcccacccgcgcucacucugcacugccacuuggugguagggauugaucacugcugcagcuaucuucugagccucuggccuucagaauccagccaugccuuucccuggucucuggccuuuccaccacuucucuguccaguaugugucuuugaagcagccccguguuaaacccuagcuuaacccugggagcacacaauagucugagguaggccugccagccaggcacuggggggggggggggggggcccucuuucucccaugugacucuggcauuccauaugcugcagaccccuggaaagugaauguuuacauggcagggugagggccaccccuugggaggcaccugcccacacucuggagccucucuagcacaggauugcuugcgagcuguugauaacuucauuucuccccucaggaggauuuuugugcuguacagccuuuuaaaguccaaauuauuaacuuauuuuuacuagagcaguuucuuuuccugaauaacagagucaccagacuucaucacacagugacaguggaguucccacaugcacuuccaggagcgagggacuuguccccacacccacaguggcgacgugagcuuuuacagaaagagucucagcaucccuggccucugcaacuuccaagggcugccaugcuuucaccccucagcagugguugagggaggggcugcaccugacuggagaccugcccucauuggcuccugguggguguuuagcagccuucucucuagggaggccucacuguuuucugcuguccuguucuguccauguucaaaagagccaaggcagcagagucaggcucagaggucauucugcaggcagcagcaccucaccugccuccggcacccuuagaacaggacaccgguacugcuguaggcacagggcccugaugaccgucacaaaccccuuccacaggaagccacugccacuggggccugacuacccucaguacagcaggcugcugcugacuuguggugcugaggucuucguguacuguugugcugggagcucagccaaaccuccuugaugugugucaacuguguucgguugugugauucugagcugaaagaugaaaugagagagguugagagagaccugggccccucgcugaggagccuuccacauaccuuccuuucccugagcaaugauugugucuuuccauuguuuuauaaacaauaaagugucaggggaauguggu

SEQ ID NO: 6512 - RNA, 1829 nt, Mus musculus
ucccaagagacuuaauugggacauguuuauuuucuuugagguagagacugggagaggagcagcuugauacuaaacacagcaaagggagccuugggcacgacccauggugccugagucagaaggcucggaggcauggagaauucuacaggaugggauuaggaauggagugugucugagaggugucaucccucaccaaccacaacccgaucuagcaggcaaacagccaaagagacucacaagggccaggucgaaaaggcuaaggaguaagagaauuuaugugucacugagcuggacagcugucaggcccuaaaacccuuugucgucaauuucauuucugcuuugaaacuguaagaaagacaggaaauucagcaaggcggagaaugcuuugcagaucucccggucuccuuccaucacugccacaagcaccccaagcggccagaaccugaauguuucccacuuagcucaagcugucccucuggggcucaggcaagggucauggcgaagcaaaacauaacaaaugaagcccaagaugacucagagcccgggucaguggagccugggucagcagagccuagaucagcacagccugggucagaggucaucauccugagaacaugggacagaugucaagaccaagcgccgcuccagggucucccugucaaguuccaaaguaagcuaugucugccccaaauucccuagcuacugcaccuacacaagggugucugggccaagcaacaaaggcuuccuccauauucccaaccggcucucucuccucagaccagggcagcuccugggagaagagcacgagagacgguggagcaucccucccugcagccuaccacaggggcaugcucugccccgacauauuguagugcuauauuuauuugcuuuuguguauauauguguguaugugguguaucuguuugauguuuuuuggucugugugugugagugugugugugugugugugugugugugugugcaugugugugcaugugugugugugcgcgugugugcguguuggucacuccucacccgauuaccuuugagaucuccauccccaagcuuguccagcaggugcucuugcacccugcugaggcgucuccccagucccggcugggcaauucuuuccuucucccuggugacaucauuccugcugcuguucucugguuuggggaaagggcugugagaccugggcugcuguagagagacacuggguccccagugagcacagcaugucauuagcagccccaugucuucucccacuggggcccuaacauucugccaagccggcuauucugggcucgucugcccggcuaucccacaggcaaaggcuggcuuugcaaacuuuugaauuccauucugcaggcaggcuuccauggguggugcuccacugccaagagggggaugggggaaccgcucagagauccacagaaguugcugaaacgggaaaggaaaccuggcauccagacuaguccuggccacgggcccgagcucauggcuccugucgggcgcugccuguuuucugggaggccuaggcagguggagcucaggauuggcagcuuaagggcugguacaggaccucacagcuggaaggaaagaaauguaaguaaggacugucccucugcaaggucagcacacucgggccguggccguucacgcgccucuugauguucauucagccauuuaaccuccccgugccucaguuucucugucucuacuagcucccuccguuuugguaaaacaugucaguucacacagaggcuugaaacgacccugauguaauuaucuuaaccugauaaauaaagugacaucgcccccugguggaag

SEQ ID NO: 6513 - RNA, 988 nt, Mus musculus
ggaagaggacaaugagaccgagcauggagcugggccagcaggucugggaaggaggcauagagaaaccuaaggugaaaggaagucuugcaaugggagggaagaggggagaggggaggagggggaggagggaaagagagagaggaggggaggagggagagaagaggaggagggaaagagggggaggagugaaagagggggaggaggggaggagggggaggaggggaggagggagaggagaggaggagggaaagaggggugaggggagaaaaaggaggaggcagaaagaaagggaggaauagagaggacggagaggagggaaacucgggagaaggcagcagguagaggaaaguggguagaaaaaccauggguuuccccagggugagcccagugcauccugggagcucauuccaaugaaguucccuaauuaaaccaucagguucucgagagagcccagaugacugcaggaguccugcccaggaagcccuguguggggccaaugggccccaacccuucuauccagcagcaacucagcacagugggacagcagcacagcagggcaggcucuggacagacagaugggaaggucuaucucuaaguggcuucccauguggcuggguaaagccaugaucacacuccuccccacacuccucccuacacuccuccucacaccaggaggccucaguaagcggggcuggggggauauucuaaccaccacagacucaggcagccuguguacagcucagcccaaggugucggcagcauccccgugauggauucugguuuaacagcuuuuaaaaacaagcagaggagagccgggcaugauggaugagugcaggaaacacgcucauucggagaugauuuaugggauguugcccgucgugcucaugggacgcagcucgagggugggggccuuggagauggaugucuuccaacgcugagcacuuguagggugucggcagcucaaccacaaacauguaugcuccacccc

SEQ ID NO: 6514 - RNA, 4649 nt, Mus musculus
gucuauuuacaaagcauauauuuaaacacguaaaaagugauacuggauacagacacauucacaacccaagauagguaccaaggguucacucuugagccgaggcagagaucaguuggagauuuauacauagcugagaacucauaaacccaacacccaggcuccacagacucugagccgcguggcccccgaccccugcccacccccacccccacccccaagucagccucucaagagcgagcuaaggagacacacacgacggccauggacagacggcaggacgacgagggcagugagggcagaaucaggaagguuggagggaaggaagauacaaacgaggaaggagagaagagaaagggagucgguagccagauagggagcuccuguuccggaguuacauccacucggucacagaugcacccuucaaaacagguucaucugaaaauagggucgacaucuagacagacacaggcaacagagcuucuuuauacaaagucgaaaauacuaguuuuacaaauaugagcagauaaaaauccccauucuaggggcuucucuuuaggcgcaguuugauucuccaaaaaauaaaaaaauaauaaaaacacguagaauacaccguuuucccuuucucccucucuuuaaaggcaaaaaaaaaaaaaaaauugucuggaggaaagagagaccgagagucuggagaugggaagccgggagugcagaugacgaggcugacgucccucucagucccuccccaucaccaagcuccuucagcccagcccagagccccugaagucugugcuuugucccgcgagcagagcuuagagccccucccuccaaaagcccuggaaguuagagcgucugcuggcccuuuaagggcggggaggguggagaggccgcaggaucccugcuggaagcggcgacuguaggcucggggacagauuugugcuuuugaguccgagcugcgcgcggcgcgguccggagugggccgggaccagggacgcagauggucucggggcacacugguccccggccgcucccgcuccaccucgcgcucccccgcccccugcggcggagucugaacgucgaguucacguggagagcacucccagaaucgaaaaggacuauaaauuacagcuuuugcuuuuaagaaagggggaagaaggaaaacacuaaaguucuacugcgcauucuuggauggaaacccugccgagccccuucggccaugagcuccaccugaccaaguuccaacucgggcugcgacccccgugcccagcccgaccggccuggugcgcagcccgcugcccgccccgcaggguggcuuggcggccgcucgcuccucuaaaagcaggacccacccuccccccgucgagccaggcuuguccgagucuuccugggagguggggccgcccugucuucuggcgaaucuagaggacgcaaaaagaaaaaguccacccgaauauuuuucuuguaaaacaacugucuggcgcucugggcacugacacgcaauccucccaauuuauccuggcauuucgggaauguaaacaaauucgcuggauuucuuuucucuuugcaaaaguaagggaaggaaucgagguaacggggagauuuuuguccacaggacacgcacacacaguccgcguguacggcacucacaccuccauaaagugcacccuccugcuguggucggggagaacugcggcccacucacucgcgaccuuuuucuaccuuuaacaacacacgugagaaaguuauucgaguuguuacuuucccccccuaguaacccuccucaucuuaagaaaaaaaaaaaaagacagaaagaaaauagaaaaaagaaaacuggucugaccccaccccccuuuuucugauugggaagccaaccuuuuguuggccuagcuggccaauggggaggagagcaaaaaucuucugcggugccaggaggguugggaauccggcgguggagggaggaggugggccagcugagucccuccacacacccuccaaaaucccagggcccaggcccccaacuuugcuggugcccugcagggacaggggccccuccugugccagcucagucuaucuccccuaccaaaccacagucucucucucuuucucucucucucucuccucguuuaaauaaaagaacuucaagaguugaaauauauauauuuagauauuuuucucuuaaauaacauauuuacaucuaauagaaaauagaacucuagagauaauuuuccagccagaacugaggacggaggaaugaaagggaagaggggugugaagaaggacaggaccagccagaggccacagucacccagaaauaaaaagcacuaagccauuugagcucacucuccccugcacugguccugggcucccaccccggcaauucaucuuuuuuccuuaaagaauccuugguccguguugcucuccuuaauggugacggucaaaaaguuugaggucacaucuguaacgaccacuuucuccagguuagucagagaggggcuccaggacucuuccucugggucccccaggauccuggccacugggauccuggcgaugagggagggccuucccccuugcgcccccaugucccgauacaggcuucccacugaggcuggggugccugaacuaugucgaacccuggcaccaccaggguccagggcaccuuggccuuuggccuccaggaaagcagcccugugcuuuauuacccuggcuggaaagguguccacagccaacuugcucgaggccucugcugagcuaggacuggucacaccauauugcaccaggucugaguccugccuucgagcaagcuggaucacacuguggccagcugggaacuuuccugucccagaagaggucucauccagcuuccugccuuucagguacucuccaaggccggcacugggcucucccaaaggucucugugaaggguccaggggcuccuuccuggguuucgguccucguuucuuggagcugucccccggugagcugggcuugucgucuacacggcugguaccccugucccucucucggucccggucccgaggugggucugcccugcagguacuggugcugcucccugguggggguagccccguguuccgcaggcccucucgggcccuggaaguagacgccaaauccuggggugagcggccuggguaagggauccggaugccucugguagagucacuucugaauucauagguuuuggccuuugccuuggccugggccugcagaaggaaguuguugugaggagaaaaaagccccgcccccgcccaccccacccccccacgaccucuagccuugacugcccaacuuucccuggaugccugggaaauucuaauugaguggggaggugggcucuuaguaauagucugggggaggggaaugaggguuugucuggaagaagccauuugcaaccaacagacuccuuguguaacagaggucuacuugggauggcuggagggggggugggaaugaaggccuucuggugcagcuaaguccugccucuagaacuccgugauggggccucugacagaaguccagauuacaaauacacacaaggcaagggcacccauugauuuacaagcccugcagauccucccugaacggcacacuccaccucuggagaucgcaacauaccuugagaaggaagguuuuaggcuuggguccucgcuuuuuggggccauagagcuccaucucccguucccuaaagaaagaaaagagagagaaggggguguguccuggcugcaccgaagucagcguguauggguucuagugaguggcuaggcuaagggucuguaccuuuccucaaaggcugcaaggaggcgagcauccagaauauuuucuucgggcucccacgugcuguaccuaaaggaaaccaggaagaauggagcaucagucccuggagcaggagagagaggacagaguggagggcguguaugugugugcaacuuuuccggcugccuuguguuguauuucaaugugaaggggaaaagaggaagaaagaacccuccucgauaucagugugggguagcgauugcauauaaccuacuuacuucugcgaccagcccuuccauuucacgagauauuccaugcgucccugcagaugcaaaagggaaaaugcuuguguaugugugugcguggggagaaaugcaugacgaggacacaagaaauacacacgaaaaugcaugcaccaaaugaaugcuccaaacacuaccgccaaaggaaccaguccacugcagcaccccugcagaaacgcugcacaaagugcaugcaccggcauucaucccccaccccaccccccauccaugcaaucugugcagggcugcaagucuaaggagagcgcuggggcugagccgccgccgccgccgccacggccgcggccgcugcugggaccugggggaagggaggcugggcugcagcaaggggagggagccugggcccuggugagggagaguucgcgucgccgcccgccuuccccuucaccuacuuugcgaaugcgccgcuucaggagggcuucggccgcgaacacccgcucccccaccgccgagagcuccauguugacucgccgcuuccccccucagccgcuuccaggagcagaaaagcagcagccagcccucgacagcccauaauacucucccgcugacgucaguucuccu

SEQ ID NO: 6515 - RNA, 2072 nt, Mus musculus
cugacaccaucuccaccagcagucucccugagccacacgcauuuugggggauaauggucuucaggauuccaaaggauuuauuugaucucuaaagaugcugaucuauggagcuggaaccccgcauuugacaagugaggugaucaaggcgccaguccuaacggcauucucgggagauuaaccuggcagcugaggugcgguggacaagaacaggcagcagagagcguguuauugcaauuucagcaugcaacacaggaaucaaggugguggcagagcuggaaguaaaagauccaggcaucaugcaagagcagagcacacuccugaaugaagaaaugcuuugugggggugguggucacaggcacagguagaggggcuuggagccugggugggggguaguggauggggugggacaccagucagcuggucugacuugcagcccuggcucuccccagaggcagauggggcccagaccguaaguccuugguuggacuaugacagucauuuuuaaacacacaacgcccaacucugggcucacaaggauggugagccuucgauguccuggugagacucugugcuacuguuggcugucuggaaugcaguguagauugagucacuguggaagcccagaggaaacccagcagaaggcuaguggcagccuucagggaaugucugaggaaaguagucacagaggggacggauauaggccagaaaguccccgagggcacagcacaggaggcagauggaaggaaggaaauggagacuuugggggcauccacucagaguauaaagaaggggcucuggggagaucuugaauaggccaguuugggacaguagggagggacagacacaggcacacaugcaugcuuacaugcagggcauuggagccagcacaggggugcacgggacaaagaagaccgcagggugugggcuggagcagagggaagggguggugggagcucaugauggccaccuuggaaaaggagagguagccaguuuggagaggagaagaggggugacaagguggccucccuggcuacaguuuucagaggugagcucauaggucgggugccugagaauagggaagauggcagacucuguaguccuccccugugccacuacaagaccuuuacucugcuaccaggggaggagcaggagcucaaaacuagguuguggcacccaguuuccauggcacccaguuuccaagaguguuguguacaugguuggcuggaagugcccuugggucccuccgcucuccccaucagaguccuagggagagccucucaugcagccaaaguguuaauggaacaaguucgcagcuucucagaaaucucacccuccccagggcugcccacaacucuggaaccccaguuccagggcaucugguacccucaucuggccuccaauggcacuacacauacaugacacacauacauagauguuagcaaaauaacauauagauaaaauauuuuaaaaagaaagaaaggaaggaagguugccauaguacugaagcaggaagauuggaaguucagggccuggggcuggaaccgacuggcucagccauugagagcauuggcugcgccaucugcacaguucugggaguuggguuugccugugguacaggugcagggagguaggaggaagccaacagccuucgggucacugacagaccgugaaugaggcuccgugacggaggaugucaugugaaaugcuucucuguggucguuuuuuuuuuuuuuuguuugguuuuguuuuguuuguugguuugguuugguuuuuguuguuuuuuauuuguuuuguucucaacucaccucauaacaggaaaacacuuaaaagagguucuucguauagcuggauuucuuuucuuuaauuaaaauaauuauuauuaggcuggagagauggcucagugguuaagaguacugacuuucccuuccagagguucugaauucaauucccagcgaccacauaguggcucagaaccaucuguaauggaauuggaugcccucuuccagugugucugaagacagcgacaguguacucauaugcauaagauaaauaaagaauuccuuaaaaauaau

SEQ ID NO: 6516 - RNA, 4035 nt, Mus musculus
agaaaagcuuaugagggcagguguucuggccuggccuucucacaguguccauaugaguguucuguguccugcaauguaugggaaggacacgccuaccccgagccaagugucagaugcacccuccacugggauccuccccugaggaucuaaggugugugcagaaacagcaacccacuggggccugaauagguugauggguguggugugcgcagccacgauguccucugaauacuuggucccggagaagggggagaauauaacuccccagccaagacaaaggcaucuggccuggcuuggaagcugccuccgccgccaugcuggaccuagggaacuucugggaugcucucuuccuuuuaauaaggaaaacgcccacacuccauccuccaaagcugaggauugugguuggauaaaaguguguuccagagcuuuccuagccagugucccaaaagcuggugcaagcaaggagccuggauuccuccacggagggcugaauccucauagugggugcaggcggcagggucgguggagaugccucugccuuuuggcuuuucucacuaagaguggugcugcaggacagugccacguuuaaaggugcugaccagaauaagagggggcggagccucagaaugagaagggugggcccucagaaugagagagggcgaggccucaaaaugagaugggcgggaucaccgauugaaagggcggggccucggaaugagaggggcgggccuucaaaaugagagggggcaaggccucagaaugaggagaggcucagcauaagagaggcggggcuucagaacgaggggcggggccucuaggccuccuuucucagcuucccuugcuccgugagcucauccccuaucugaaggcccuccugagaaugugaguccuucuaggaagagacuuuggaaguggaugugcuaaucuugggggguacuguccuuugugagcaacagugcaguccugggaguggccuuucaucugaauugcuuucuauacuggcuucugacucuuccuggaagcuagagccacaaacagguauauccacacugccuaucaccccaguaacagaaaugcagggcagagccucagugaccuagaacucugugcaccuggcuggcacagacugcaguccagguugggugguucuggucuuguguaguuugccucaucacuucugggguugucgccaucucugaaauccccguggguagguauaugggugagacagcacuggccucugggucuuaggucaccccaugacgguagaggcagaaaugggugguguuuuuuuaguaaguggauacccccacuugcuaaccaugucaaagcaaguugaacggcugaagccagcauccagcccugggaaggugaacccuugucuuggggucuucucuugguagucaugugacagaagccugguaauucagagggggucccauaagccuaccuccccaggaucacacuucuguccugcaccccaguaucuacacuccaauguuuugauuggggacagcuggagcagauccaaagacuuacuggccauggagagucucagcauuuauucuaagucucuagcucccacaguccuccccccuccagugcuccccaagaccugacccaaccuguucagugacagccuugugccagguauguccccucuaguccuauggacuacuggaccuugguguuaccucaggccagcuggggccucugcagccagacauggugugugggcucucggagcccugcucugcucugaggacgagagaggccccgcgcagagcagcaaccuuaaucuggaugcaauuagaggaaaccagccaaaugcccuguggcagcuguuaccccaggauuauucccagucagcaaaaggcauuagagugauaauucagucauuagacuucuagcugucucacagccaggacguacaaaucacggguaaucagcaaguacaccguccccuggccacgaggcuuauuuaacccauuuuuuuaaaaaaaugaugcuuaaugcuauuggccgggcgcaucugugugcgcaugccccaccgauaaugucugugcugacgacauugcuuaaugucaccaaggccuugucaucuagggcucugggagagaaggacgccuuugaugugcgugugugcugucacugcugagacaugaugccuaccuuggaaagggcgcccucacuucugacucacccuccaaggagaagggagagggcaagggagggggcagcagcagaauguguccuccucucucuggguuagaggaugucuucacugggcacaggaaagacauugccugccuagaaaguugcaccuggagugccagccaagaggccuagcuguuucugcagaggagggccgaaguccccagagaggcucuguuaguaaccuugagcugggcgaucuguugcagagcuaugugguugcugaucaaaccgacccggguuagggaggggcacaugcuacauucagaaggggaugacugggggccuggcuuugagugcaggacaccagcccaagagaggcucuggagcuggugccuucgauggccagggcaggauggcaguaaauaagugggaagaggaaugcuugcugucagggucagcuccugaaaggcuccuuugaccucuggccuguauuuguguuuuccuuacugcuuugcugggguuuugcugugcuggggaggggggaguagggggugcaguacguggaacuugcuaggccauaagcgaugcagucgucuuugacaacauuaauuuagauggcgaucaaccccaggguuccuggaauccaccugugaccucccuccgcucugucaguucccuucuacugcagucaggccaggagugucaggcauacccggggcuggccagacagagggaaggaaccuggcagagaucccuggaggccacccugccuagaacggagacgaugaugacagguucccccagaaaacuuaugcagggcuaugcuauggccuggguuauaggggagccaggacugccacccagcugggccaccagagacgacauagggaaacuggcuagccugaggcuggaccuggcagaucccuggagucucugaagagacaaguggccucuggguguuaguguuguguuucuacagaagcugugauguguuuugucaugggcuagccuggucuagccggauugugacaccccaaaucuaagaagccaguuucucccagagcuucugcagcagggagcaagggguucccccagcccacuuccuugccuauaaaaggagaacaaggcccucccacagacuccuucaaaagacuucucugaggcugccaugaggguggcuaacuauggcccagggacuucacccgccacucagggacgagcccacuggccuuagccuuccgcagcauugaccgagagggguuguccacucccagucgaaugcccucccaggucugaagucagcaaaccaaugccucuccugcacuucuaccuugcugaguguccuccgcagagggcaaaucucucuguaacguucacucugugccacccacgccuacccugaagaaaaaugagccacaaagccgccucagcggucucggucugcgccuagcuaugcacauagguguuugcagagcucuuccauggacggcccucggagggggagacccuuucugaggacucugcacuuucugagcagcugcgugcagaugccugcugccaccaggccuuuaaauacauuguguucaauuccaggugggaagauagcauuucagguuugcagaaaucaagucacaugacugucuuccuuccacacuuugaggauaaggaggacagcuuuuuuguguguuucguuuuguuuuuaaaguaaggaaauacccccauugcugaugucuauagcaagugauucguuucucuguugcauuuuguuuuuuuaagcaguccccuuccggucaaggucaggacuggucaccaugaccccugugaauaaugauucucauggauuccucacaaaacaaauaaaauaguaucaccacacac

SEQ ID NO: 6517 - RNA, 3025 nt, Mus musculus
ucgcgucugacccgaguuuaauaagucauuguccagcccaggcuuuauuguuggagccuugagggaaaagucgauggaccgguuucugucgguuuaggcaggugaccugagcucaaggcagucuaccccugagcagucugauagugccaggggaauaaccggguaugggcuccaucuauucgcacaguacccuuggccucgucucuuaacggucccuacuucaaggcagugggcagaggucaugcaugagcaauuguguacugucugaguauguguuguagacuggugcaagccaguaucagacccaggacagccugagcugggacccaacacagggccuacggggugggaagccguggcugccuccucuccugguggguacagaucucucucucucuuaaagauuuauuuauuuuuauuuauauaaguacacuguagcugucuucagacacaccagaagagggcaucggaucccauuacagaugguugugagccaccguaugguugcugggauuugaacucaggaccucuggaagagcagucagugcucuugaccacugagccaucucuccagccccacagaccacccgcuuacuuugauuuuuuuucuaggaaguuuccagaagagacuuuugccccuuugcucuuguuuguuuccccagggagcugaugacaccgccuuauacccagacaggagaccaagguuuuggccagaggaaguuccaagucacucaguuccccuagccucacaggagcacacagcucacaggagggggucccguccuuucaggggacaucagguccuggcucuaggccucaguccucugugcuguuuccagggugauugcucugcauggauuccugggagcuagugacuguugacgauuccaaccuccuaggagcugccagucagcaugucgugagguucuuguccuagagucuggcagaugugcauauccuguauugacacggggaccaugccuguuuccagcaggauucagguugcauguggagucaaguucacaaaguagcugaccuggagaggagaggagaggaggggaggggaggggaggcggggugggggggaggggggggagggggagagugagagcagagccuggguuacccgagugugaucgcaggcuucuuacaggcugggaggucagugucagauccguggacuguggcaaaggcuccauuggucaucacuggccaaggaugcaaggcuucugggagguccucuggagucuccagaaagaccaaauccugcccguuugauauuguaguccagggguccuguuugcaccucugaaucucggagauucaggacuguacaccagguggguaagcucugaacauggcuggccccugcuacagcagccacaggaggcagaugcucagaaacagaggugggaugucauguucuuacugguuuucugauggccaucgcccccuccauaucuuggagggaucuagggcacaagucacccaaucccuggccauaaauucuggguaauacgugucuuaacuucacuccuuguaaacaucagcuaaaugagaugccagccgcacugccacaaggguuacggaaaacuccaguugcugcucuggccagcagacucaaagcccccaagauaaaauuucaguggcuccugugggcaguagguacuugggguagagccuggcuuaucaggggcuguguaagaagccaccuguuuuccuccuagcccugcugugggucuccugucucccaucucucuucucuugggacuucuguccuaccccauuuuaaaaacaauguuugcuuuaauuuuauguguaugcguguucugccuacacauacauuugugcaccacucucauuuagacccugcagaggccaggagauuguguuagagcccuggaauuguaguuuacagauggcugugagccaccauguagguuuuaggaacagaacuugagucuucugcaagagcucuucaccgcuguaccauuucuccagccugguuguuuuuaauguauuuauuuuuccauuuucauaaguguaugugguauguauauguguguaggcacaugugugaaugugcguguacauugugcauguggagaccugacguugguauuugcaauuguacuugcuugcuuuuccaucuuuuuccuugaggcaagaagggacucucaaucaaacccagagcucacucaccgauauggccaaucucacuggauagcuugcuuugggaauuccuugucuauaccuucccuggcugggauuacaggaggagcacuauacccaccuaucuauaccuucccuggcugggauuacggguggagcacuacacccaccuaucuauaccuucccuggcugggauuacaggaggagcacuauacccaccuagcauuuaugcagguuuuagggauccaaguucugguucucauacuuguaaaucgagcauuaaccacagagccaucucccuaucucccccaauauuuguguguguguguguacauguacaggguguuugucuuguugagaccagagacagacauccagucuuuuccuugguugcucuccacuuuuaaggcagggucucucauuugaacccagagcacacauauuagacgacucuagcuagacagccugcuacggagaucaggaucccaucucagccuccagugugaccggaugaccggcaggccaccgcggucaccugcuuuaacaugagugcuaggaucugaguucucuccuucacgcuccuuagagagcccuuuaccuaccaagccaaccuuccuuucaucaguuugcauuuuuccuuagcuggugccccgcccccaccccgguaccuuuuaucucugaggcggccuucagcgucuuuaucccccaccgacacccccugggagcugucagagcagggagcccacguuucucugugggguucuuagggagguuuuugugagcugucucugaggcgaggaagccaugcuguucuuuucuuuccgauugcacaguaguuuugcaaauggcucug

SEQ ID NO: 6518 - RNA, 1312 nt, Mus musculus
agcuguucugggacgacggggagagccucgcgguucuggagcguggggccuacacacuggucaccuucucagccaagaacgugagucccaaggccuguccaggcugguggguggaaacaugggggaugggauugucuugaccugggggagggaaggacugggccagaguacccaguggccagcaugucucuugugucugcacagaggaggcugccugugacgcuugcuuuauagucucuauccuggugggcucacggucaugguccagugacacuccuuuuucuuuucucuugacauuaccagaauaccauugugaacaaguuagugcgugugaccaaggagggagcugagcuacaacugagggaggugaccgucuugggaguggccacagcuccuacccagguccuuuccaacggcaucccugucuccaauuucaccuacagcccugacaacaagguaugagggcaggcuggggauuggggaucaggcaggagcgaagagggugcuaaggacucccuuggugcagccaacucagacacgcuccugggagggagacagggcauuuggaccucacagaguagaaugggccgaguggauccucaccccucaccauaucuacccugagauacagcuccaaugguggaggcuauacccugagauacagcuccaaugguggaggcuaugagcugguaaacagagccuugcucccgauggaauccaaugcugauuccaaggcacuggacucucuaccuuggggagggauggccaggugugugcucaucaccugccugucuccagaccaucuggagccuggcugggggagggaaccacuugccauugaagcuucuuucugaccuccagagccuggccaucccugucucacugcugaugggagagcuguuucaaaucagcugguccuaggagaguccgucguuuacagaggccuccagggaggcagagggagcuugagcuggcucuggcugguggcuccuguaaggaccugcguccugcucuccugacacaucuuugagcuuuucccaccguguuacugcaugcgccccugaagcucuguguucuuaggagagugaggcucgccucaccugccccaccccagcugucugucccucaccuggcacuagagaauguggagcucggcguggggacaucgugucugcaccaacaucaggcugugcagccacugcagccgcaacccugcagagacagagcuggugccuucaccagguucccaagacucgagaaacuuacugugaaguguacuuacuuuuaauaaaaaggauauuguuuggaagca

SEQ ID NO: 6519 - RNA, 13721 nt, Mus musculus
ccugagaccugaacugggagggggagggcagugggcuuuccgcgaagggaugagcuagaggaggcgagucccauuggcugaaccugaggucuguccccacagugguccacacugcauaaccuuagugugagagagacauggggaauguccaagguagcuuuaacacuucaucuggaguggcgauguccaaagccugggacaguggcaccuguccuauagggguuaggcagcaaggggccuuugcacaguccuguccccacccagacauugcaugacguaagugucaguaccuccuuucccuggcuacagagggaucaagcuugggacaggagaaaaaaacagccauuuuaagccugucagagaaacaagcugucuuuuuguucaguuuacaccuucgagaaugacaggaguucaucuguuaggaucauccauguugguaugaccguccuugacuguucguuuucccauuuuuuucauuccauuacuuccuagagggaagcucauugaagcuccaggggcuccuuaaaaacaaggucuacagggucuuccaaguuacauagcaguaacagauaggaaacuacaacuggcugagcugauuuucagucuuuagaauccaggggcacagguuucguguaugcugggguggacgccuguaacacagccuccugccagucuauuuucccucaguaaccccaacaaaugcacggcuucauuaaacaagccuagggacguggacgucuaccgcuggugcuuuguggggugagcugcuugcuugacucuuauccggaacagccacuguacagggacagccacgggggacuuguugggagaucccagcagggcaguugcccgucuccucuccucccaccucgggagucgccuuccuccacacuuacaugcagguucaggaaauggucagucaggggacccagaugcaugccuggccagccagaucagcgcaucaacccgguacccacgggaaacagcccacacuccaggcagcgcucacaagugucugaacucagcagcuguggagacagcguguggaggcaugcacugugauucucacugcacagcagcaggcagcucucaccgggcucacacgccacccaccugccuccuucggcaaacauccaauccuuuuuuuguuuguuuugguuuucgguuuuuggagacaggguuucucuguauagcccuggcuguagaccaggcuggccucgaacucagaaaucugccugccucugccucccaagugcugggauuaaaggcgugcaccaccacgccggcuuauauccaaucuuuugagcuguguagucuuacccuuauacaacgcuaauuuccuaucacuggcucaacucauuaccacagcuuuaguggcuucaaauaacacagaugaagucugccacacuucuauggguccaaagcaaaccuggcugaagucagggugcagucuguucugcucacaggccguuggcacaaucagcuacaguuuaagcucuguccccggugaggacaacccuucaaggcuccaagguuccugcaggucuugcucugucuccucagcccccaucauuaccuggugcccuguccccugagcacgugcagucaaggcuccugacccucacaggaugugaguggguaaacuccagagugaccucucauccccaagccuuggcugagucccaucacaggguccaguucaccagguaacucgggacucgccuccccuaggagucccccaguuugcuacuuuguguccucugaagacauuuaacuggacaguccgaguccuucuccaucaucuuaaagagaccuuugccaaacccacagucacuauugucuucugacuucuacuauggauuuuguuguugcgcucuuacuucaaaugucucaagcuggacucucacgugagugaggaguuaggaaagaacuggugcggucuccaugaccagaccaggaaagcuggugacaccacaaagaucugcacucaaacucacaggaaaauguccacguuuaauguaaaagguuaagcaucggauuauguacaugugcauuagaaaagauggcggaggcugagggucuucccgaggggcuccgagaagacaguccauaucaaccccauuaaauagaagcuuccguuuccaaacagggccucggugcaccagcaccagcuucagaugaggucagccacugagggaggagaaagauaccaaguuaaugucaccucccuaauggaguaagggagccccacacacugcccuccccgccgcgcacccagccgccaacuugccauucaugggcaucucgucuaucuggguggaguaguacugcucaaugucccugagaauccggaugucaucauucuucacaaaauugauggccacaccuuuucguccauaccgacccgaucucccaauucuuuggauuaaaauauauguguuagucagcagucagacagacgcaggucgagaggcgugagcaaaggaaggaggcacauaccugugaauguacaguucucuguuguugggcaggucguaguuaaugaugagggacaccugagggacauccaggccccgggcccagacgucuguggagaugagcacccggcugcaggaaaaaacaaaacaaaacaaaccagauccaugagagagagagagagagcagcuucugacagucgugagccgcacgcuagcaaucacauaacccccacugcaaaaccugcugccaugauggaaaacaugacugacaagaagacaacuggguguccuuauagcaaauuuguuuaaagucagccuuuccaggaaaacaugaagucggcuuagcaaaaauccaguuaugaacaggagccuacuacugauucaccuuaacccauacccaucccauaggagagcagaugcucugaccaaggaguaucaacugcccacagagaccacagucaugccaccuaccugaagcaugccugguccuaacagacacgcuaggugugcaaggauaaggggcuugaaagcacaguguaaaaacacggacacucccacuccugaaauggugccacacugacagcaagcuagaaagcgccugcuugcuccaccuguugacaugguuacuagaaaaaaaauggacuccuguuuccacugcaaguuaagggaaaggagaauccuagaaggcucagaguguguguguguguguguguguguggacacuucacugccuuugugccgcaucacaacugacccaggaggaagagaaaaggucagagcauggugugugaggcaagcaggccagagacuccacuuaaucuauagacagcaaaaggacauacaaagaaauguguaucuagacuuagccaaaggccaacugaggcugaaaaccaaagcaaaagaaaagcaggcagagagaagccuauaggcaggagaugcuuaaacaggcaacuggacugugcacuggggggccuaagagcugucugggagacccccucaccccauugagguagaaggaaacuauuaggccaucucagcagcagcuccuucaccucuccuggccgacucucacucucagacccaaacuaacuugaacaugucucagaugaaggucagaaauagaaagaaaagucaaacacguauaaaucuaaauaaagucuauccuauaaagcaaaaugucacugcagauuaaaacauacaguaaucuccagcacugaaaaacaauuacgggcuggugagauggcucaguggguaagagcacccgacugcucuuccgaagguccagaguucaaaucccagcaaccacaugguggcucacaaccauccguaacgagaucugauucccucuucuggagugucugaagacagcuacaauguacuuacauauaauaaauaaauaaaucuaaaaaaaaaaaaaagaaaaaaaagaaaaacaauuacauuugugugugugugggaggggugguuuaacaugcaugaaacuaaucuuaggcuuggaacuaaacaaaucuagauccuugaacugucuguaaagacagggaaaguagguaauggucacagauguuaggaauagagaugguaucaucucuaugguacuaaaaaacaaucaaaaauuaagccgggcaugguagcacacaccuuuaauuccagccuucaggagacagaggcaggcaguuauuugugagucugaugacagcccgguuuacaaagugauaguuuagucaaggggucuguuauacggagaaacccugucuggaaaaccacacaaggguuggagagauggcucagcaguuaagagcacugacugcucuuccagaguuccugaguucaauucccaguguacuggcugguuuugugucaacuugacacaagcuggaguuaucagaaagaaagaagcuuuagaugagaaaaugucuccaugagauacagcuguaaggcauuuucuuaauuagugaucaaggugggggagggccccuugugggcugguagucuuggguuccauaagaaagcaagcuaagccaggggaagcaagccaguaaguagcaucccuccauggccucugcaucagcuccugcuuccugaccugcuugaguuccaguccugacuuccuuuggugaacagcaguauggaaguguaagcugaauaaauccuuuccuccccaacuuguuucuuggucaugauguuugugugggaauagaaacccuaagacaaauugguaccaggagugggguauucacgugacaaccugaccaaguuugggggaggauugcagaaagacuuuggaacuuugggcuagaagauucauucgcuguuaacagcacugugggauguuguguaggagcuucaaagacaauguugagaacaguacaaaagauggagggcuagcuuauuucagagggaagauuaaagacucuuaucagggcugcugcuauuuugacugugaauauucuuuggguuugguuagcugggguugaagaaucaauugugauuaacaagacaccaaaaccacuaaaucgaaaauuuuacauuacugggacuacugaugcugguuagcuagagcuaagaaauuaguggugauuaaaaagagaccagcgucacugcgguaaaaucuucugggaaguguuuucugagagcacagaggcuguguuccagagauagccaaggucguaccuugugcuauggcuggacuugauaauauguaagagucacucagguaguacugguuuuaaagacaugaauggguccugaagagcagcugaggcucggcacugugagagcccauggaaggccauuggugaaggugcaaccucaguugcaguugaugacccaggacugaaggagucaugcaaaggaguugaggcuuggcaccaugacgagucuauuggugaagucuaguuacaguguuuuggagaugccaguacccugaaugaccaccaagaacagcagcagcaguggggcacaggcagcuggagccuagacaagaugugugcuacaaagggcagggcuggaggagugacccaagcccuuggaggaauccaaaagauccugaguagaucucagacacuggacaguuaagaguuugauuuuuuuuuuuuuuuuuuuuuuuuuuuuuuuuuuuuggguuuuuuagacaggguuucucuguguagcccuggcuguccuggaacucacuuaguagaucaggcugaccuugaacucagaaauccgccugccucugccucccgagugcugggauuaaaggugugcgccaccacgcccgacuuauaguuugauuuggcuuuugauugugacugugcccugauauuuuucccucuuuaaaguauuuuaguggagcccacaguuaagagucuuuuaauuguaaaaauacggucaaggagccugcugccaaguccgauauccugaguuuaauccuuggggcagacacggugaagagagagagcugacuuccacguugguuccugaccuccacacacgcucuacagggcacauucaacccuacacccacaggacagauaaacaguaauacaaaggacagagaggacggaccccucaccuacacagucacagagaacuaacuaugagagggaagggagggcaaguggaaggcuaucacaggcuuucagguccagucuagcugggcaucuccuguugaagaacacacacacacacacacacacacacaccccaugcaaaagugaccccggggaaaucacagcaggccugaaucaaagaggaaaacuuaagaggccuauucuuugaacacuguaugacuacggauccaacaugugguuaccagaagaccaucagaaaccagagugacugcaaucuauccaauggcuagcaguaguucaccaccaacccaacagccaacacgggacaguguccucucagaacuguaucagcccuggaaccuggggcccugggggcagcaccauccguccccccacaggagccaaagcugcaaaggccuaccuggcaccugaccggaacuccuucaugauagacucucguucuuucuggggcaugucuccaugcauggacgacacagugaaauuggcuucucucauuuucucugucagccagucaaccuauagaucagaacaagagauacgcucaacuacccaaccagauccauguacaacggcagcuccuaacagcagacguguacagagaugcagaggaaacgcacucacccaccuacugggauaggcaugcccaagaauucuuuaaagaacacucucacagcugggcgugguagcacacgccuuuaaucccagcacuugggaggcagaggcaggcgaaggccagccuggucuacaaagugaguuccaggacagccaggguuauacagagaaacccugucucaacaaaccaccaaaaaaaaaaaaaaaaaagaccacucucacagacucugcccacaggccaucacuucagccuacugggccugggcccagcuuaaaccaaagacaucaaauauacuacagcaaaccagugucagcaucucccauccguccuagacacaggucuucugcgaccucccuucuuagcugccccagcagcucugccacugucaaaucucagcauuucugucuaacacaccaucuagagcugaauuaacacaggaacccugagcccaagccacccccugcccaccuuugacaggacaccuagccugcaauuccccaagauggcuacagagcaagguggcacaccuuccgcuugguguugcagaagaugacggccugggugauggucagcgugucauagagaucacauagaguaucaaauuuccauuccucucuuuccacagccacaaagaacuguuugaugccuuccagagucaacucaucacugcaaagagagcucacaucacucuucaaaccagaacccgagagacauggccacccaagagccccagcccuugucuacccagccggucuuagagcuuucccaguucccacucuguggauaucuaucaucccacagaguacaggacaccauguuaguuuccaccgaggggaugaaggaacggaaggcauccucaccgcuucaccaagaugcggauggggucggucaugaacuuguuggucaucuccaggaucucaugaggcaguguggcgcugaugaggacgaccuguguggcugguggcaaguaccuguacacaucauagaucugcuccuugaaaccuguaacagccgggagcuuagagucggccugcaggcugacacucagagccacacugccaggucuucagagcaaggucacaggcagugugcaugugaaugcccgagcccugacccagguagugugcagugccaaagcagacaauaacaacacacuaucauggccucaaggaccuuaaccaugaaaacauuacaaucaaaguuucauguucaaaacccgcaagauacacuguuucuguacaaagaacuaucacaggaacaccuggcaguguuagaaaauccugguccccucaccuuuguucaacauuucaucagccucauccaaaaccagcaucuugauagcccguguccguaaacuucuccggcggaucauaucuggggauuagauuuugaaagaaucacacguggcucuaaggaaaaagcuggcccuucccucuggucccaagagcccugagucggucccaucacaugguguauacaacuugacugcuacaccucacacauagcacccacagcccaguucucaacaagagcacucaccaaagacgcgucccggcgugccugccaccacgugcuguccguaguccagcuuccggauguccucgccgacguuggugcccccaaugcaggcauggcacugcacguucauguaaucccccagcgcgagcagacccugaggccaaacagguuucaugucaagugucaccucuacucuaaugggagauaccaccugccacucacucagucacucaaauucaagcucuuuucucugccaaaaugaaauucauuuugagaguuucuugagacugauggggugcauaccaauugugggaaaagucacaguucauaauaauaucguaugaacaucccaauacauauuccuccaagauaagaaaaaaaaucguuugauuaaaaugaauuucguuuuccuugaaggaaacugucuucccccgccagugugaggaaggaacgcagggccuuguggaucacagcagagcuaaccacugagcuucaucuccgaccacuucuaagaucaugaacacacccaagagcagaacgaccagaguuauacgacacagaaggaacuguagggugcugggcaugcacagagcuccagguuccaucuucugguguugugaaaaccaaaacggaagaaggaaacaggucggagacagcagggguccauggucucccuccaccuuuacauggacucugggaggcagauucuaagugugagccauaagccccuucacccacucuacuguccccaggagaacagaaacagccuacccucccacauaagccacacaucggacacuugcaaacacaguggccaucucuguuguugcgcuacagggacugaauggggucucccacauuuggggacagcgcucuggcgaugagcggcaccuagggugacacgugaucccuagcugucucaccuucugaaucugcaccgcuaacucccugguuggagccaggaucaaagcuuggguuucucgaaccuggugaacaaucagagaaaggucugagaauauacagaagagugagcaguucccugugacauuuccacaggucacucacacucaccuauccuucccucccgucucuucccaaacagucccaucucuacuuucaugccugcuuugaaaaauaaaaaaacucuauauucugcauaagaggaaaccuggugucuguccaaguccagcuuccugccccgaccgagccuggcagucuccagccucacucacauggcugcuaacaagcacuaggaccugcugugaacaccagcuugggugagcuugcggcucucuccuaaccagccuacggagacauuaaguuggcaggcaagagcgugacacagucagggcuuuccugugcaggccagaauuuccuggccccacuauguacccuaggcuggccuggaaccugcugugaagcucagagcccccucugcugggguaagguagacagccacaacccacgcacacgcggccaaucaccuggccacaccccacgcacacgcggccaaucaccuggauauccaagcacugcagcacugagacacugaagguggccgucuugccugugccagacugagaccuguugaaaaaguacaggcguggguaccagagaaagaccaucuggcacugcccccguugucgugccccagcccgcagcggugcaccaaaggccuggauggagacacagggcagcuucuuucuaggcgaccuuaguccucaccuguuggaggauggguuugugcacuguguaaagguucuuuguguuagucaaaugguggacucuguccaggcagacacuguaacuguuauuucuaugaagcagcaucugucuaguguuuuguuaacucuccaucaucuccucacuggcuuagggaagagcugaucuuuuagcuggacagaaaagaacccagucagggguucccagagaccagagggaagggagggaggggaggcgggagggaugaaccgagaggacuauaaauaaggagaagguguagagaaaccaugugaagaaaccaugaggagagacauggaccaaaucgagccaaggcaaaaccaagugucgaguaacaggacauuugucugggugucagcagccuagccaggugaguacaucucaggaccugccccgcuuaggcuugcagcuuguuaauaaaaacaccagguaucugugucuucauuaagagcuaagaugggcuagcccaggcuuagcaacaccagaaguuaucugagaauaggggcacaggcacucucccaggcauuacucuuaccuaaacaccuuagcugcaaagaugugaggccaaaguacaaagucacauuuuuauuuuuaauuuuuauuuuuacuuaugcaucugugugacugaacaccacuugugagacugcuuucaaagcccgaaaaaacuggacccccgaggcugcgguuauaggcacugugagucacuaagacacaguguguguggguacuaagaacugaaccugggaacagagcgagcgaucuucacagcccccacagacacaaacugcuaaaggcagaauaaaugggaugugcaacaucaacaacaacucccagaggaggcagaaggggccgcucccuuuaauacacuggcuccuacaagucuaaguaugacuuaaaaggauaacugguuguuuaaaauuuuggaguacaguucaguaguagagaaggcccugggcucaguacuuagcaugcaccuuuaauccagguagcagccagaauucugaguuggaggccagccuggucuacagagugacagccaggguuacagagaaacccugucucaaaggaaaagaaaagaaagcuaaugaaaaaguaucuugggcuggugagauggcucagcaguuaagagcacugacugcugcuccggagaucuugaguucaaaucccagcaaccacaugguggcucacaaccauccauaaugagaucugacgcccucuucuggugugucugaagacagagacaguguacuuggagauaauaauaaauauuuuuuuuuaaaaaaggaaaaguaucuuauacgaauucauaaaucuacacuuaggacuuaggauauacaucaguagagaguacuugcgcaguguguagugaccuugauaugacccagaacaccagcaacgcccccaaacacacaagcaaaacaaacuggcauaaacaaacaaacaaacaaauaagcaggcucagcuucccacagcucuccccauggacccaacucccucucagcacccauaacuuacugugcaaugacaucucucccuuuaauuaucugcuugauagcacgcugcugaaucgcugaagguuuuucaaaaccuagaaauacaaagaggaagaaacuuaagucccaggacugugacugcaugaacuacccaggggacacacacugcuucuuacgccaacccuaggcaacccaggcaggaccaagcacaucuuuacagcccagccuacgagauuaccugugaagucuacuacaccaacacuuggaaaguagaggcaggaacaccaggaguucaaggccagccuaagccacaugaaaccuccucuacaagcaaaaccacaaacccggaagcacugcaguugccccuuccugccagcaagcacucgaacuuguguugcucgaggcuccagaguacugagccugcacaggggugaggugagaugccccgugcuugccugcaggcagccccauccuagguaccuaccaccccaccugcugggcauuaccaccagcaaugagaacagaaugaagacuacacaaggcugugcacccuguuagucccagcagagaggcugagcaggcggaucucuaugaauucaaggccagcuggucuacagaguguuccaggacagacaagacuauguagagaccugucucaaaacaaacaacaacaaaaacacaaguacuuuccaaauaagcagacauaauuuauacagaaaagauguuguugguuugcuuuggugugugugggggugguggggggguggugagggguuguucaagauaggguuucucuaaguaacagagcccuggcuaucuugaacucacuuuguagacugaccucugucucccaagugcugggauuaaagcugugagacuggcuuguuguaguuuauuuuuacacucuuuuaagauguagcuagugacacuugccagcucaacacaggacuuguaaugcuauucuuggcugccaacuugccuacaucugggauuaccgaaaacccaagcuggguaucauuaaaaaugggagggaccaaucuuccuggucuagugaguuccagggcagcuagggcuagguagagacccuaccucaaaacaacaacaacaacaacaauccuggcuugguguggcacaccuuuaaccccaccaucugggaggcagaggcagggaaucucugaguuugaggccagccuggucuacaaagaauuccaggacggccagggcuccaaagagaaagucucaaaaaaaaaaaggaaaaaagaaaaggacagaaacaaaaagacaaagcucauuuggccucccuuaaaugcuccuaaacacacaccagcagcaugaccgaccauucacucaaaaaaaaaaaaaaaaaaaaaaaauccagcuccaacucaacgacaacaucagcaucucucuucuacaguccggccaucacccccgccuccucuucuaacuccaaauccagacaccaagauaaacuuucaaacuguaagcccgauccugucaauuuugcuuagagcccugcaguggcuuccagcgguauuuaggaaugaaucucaaaaucuuuacccaggcguuuaaaacaugacaggggguucuuuuucuguuccuggcacaggucuggccauggcuucgagaagccagggucacccuggugauuaugaacgccucugggagcucucucucggcucuuuuaacuguccccuaccaaucuaccuacucuacccagcugcucauucucuuguuuucccaauucccaccgccugaagcacuuuggcuucguguuuuucgccucccuagaaagcuuuaaacucccuaaggcgagaacccaccagacuuagagccgcgacuuccccaucaaagcucggggcaccucgggggacacacauggcgauccgcucgcuacacgagccacugaagagccuggcugacugcagccccgggggagcaggccggagcucuggggcggagccgcucgucgccgccgggccuaaccccguccuaccggggcccggcccccaaccucccccgccucgaggcccgcgccccaccguaggcguagaugccgcgcagcagguccucucgcaggcccauggugucgaacgugggggucacguccaccuccucgcucgucucgaacuccacuuuggucauguccuccucuuugagcagccgcuuccgcgccgagccagacgucgccaucguggcguuagccgccaugauccggauuccgcagaaagacaacugcaagccgcggcgggaaccggauguaaggcgcgcgccgccggcccggucgggaggaagugacgcgccg

SEQ ID NO: 6520 - RNA, 13721 nt, Mus musculus
cggcgcgucacuuccucccgaccgggccggcggcgcgcgccuuacauccgguucccgccgcggcuugcaguugucuuucugcggaauccggaucauggcggcuaacgccacgauggcgacgucuggcucggcgcggaagcggcugcucaaagaggaggacaugaccaaaguggaguucgagacgagcgaggagguggacgugacccccacguucgacaccaugggccugcgagaggaccugcugcgcggcaucuacgccuacgguggggcgcgggccucgaggcgggggagguugggggccgggccccgguaggacgggguuaggcccggcggcgacgagcggcuccgccccagagcuccggccugcucccccggggcugcagucagccaggcucuucaguggcucguguagcgagcggaucgccaugugugucccccgaggugccccgagcuuugauggggaagucgcggcucuaagucugguggguucucgccuuagggaguuuaaagcuuucuagggaggcgaaaaacacgaagccaaagugcuucaggcggugggaauugggaaaacaagagaaugagcagcuggguagaguagguagauugguaggggacaguuaaaagagccgagagagagcucccagaggcguucauaaucaccagggugacccuggcuucucgaagccauggccagaccugugccaggaacagaaaaagaacccccugucauguuuuaaacgccuggguaaagauuuugagauucauuccuaaauaccgcuggaagccacugcagggcucuaagcaaaauugacaggaucgggcuuacaguuugaaaguuuaucuuggugucuggauuuggaguuagaagaggaggcgggggugauggccggacuguagaagagagaugcugauguugucguugaguuggagcuggauuuuuuuuuuuuuuuuuuuuuuuugagugaauggucggucaugcugcugguguguguuuaggagcauuuaagggaggccaaaugagcuuugucuuuuuguuucuguccuuuucuuuuuuccuuuuuuuuuuugagacuuucucuuuggagcccuggccguccuggaauucuuuguagaccaggcuggccucaaacucagagauucccugccucugccucccagauggugggguuaaaggugugccacaccaagccaggauuguuguuguuguuguuguuuugagguagggucucuaccuagcccuagcugcccuggaacucacuagaccaggaagauuggucccucccauuuuuaaugauacccagcuuggguuuucgguaaucccagauguaggcaaguuggcagccaagaauagcauuacaaguccuguguugagcuggcaagugucacuagcuacaucuuaaaagaguguaaaaauaaacuacaacaagccagucucacagcuuuaaucccagcacuugggagacagaggucagucuacaaagugaguucaagauagccagggcucuguuacuuagagaaacccuaucuugaacaaccccucaccacccccccaccacccccacacacaccaaagcaaaccaacaacaucuuuucuguauaaauuaugucugcuuauuuggaaaguacuuguguuuuuguuguuguuuguuuugagacaggucucuacauagucuugucuguccuggaacacucuguagaccagcuggccuugaauucauagagauccgccugcucagccucucugcugggacuaacagggugcacagccuuguguagucuucauucuguucucauugcuggugguaaugcccagcagguggggugguagguaccuaggauggggcugccugcaggcaagcacggggcaucucaccucaccccugugcaggcucaguacucuggagccucgagcaacacaaguucgagugcuugcuggcaggaaggggcaacugcagugcuuccggguuugugguuuugcuuguagaggagguuucauguggcuuaggcuggccuugaacuccugguguuccugccucuacuuuccaaguguugguguaguagacuucacagguaaucucguaggcugggcuguaaagaugugcuugguccugccuggguugccuaggguuggcguaagaagcaguguguguccccuggguaguucaugcagucacaguccugggacuuaaguuucuuccucuuuguauuucuagguuuugaaaaaccuucagcgauucagcagcgugcuaucaagcagauaauuaaagggagagaugucauugcacaguaaguuaugggugcugagagggaguuggguccauggggagagcugugggaagcugagccugcuuauuuguuuguuuguuuguuuaugccaguuuguuuugcuuguguguuugggggcguugcugguguucugggucauaucaaggucacuacacacugcgcaaguacucucuacugauguauauccuaaguccuaaguguagauuuaugaauucguauaagauacuuuuccuuuuuuaaaaaaaaauauuuauuauuaucuccaaguacacugucucugucuucagacacaccagaagagggcgucagaucucauuauggaugguugugagccaccaugugguugcugggauuugaacucaagaucuccggagcagcagucagugcucuuaacugcugagccaucucaccagcccaagauacuuuuucauuagcuuucuuuucuuuuccuuugagacaggguuucucuguaacccuggcugucacucuguagaccaggcuggccuccaacucagaauucuggcugcuaccuggauuaaaggugcaugcuaaguacugagcccagggccuucucuacuacugaacuguacuccaaaauuuuaaacaaccaguuauccuuuuaagucauacuuagacuuguaggagccaguguauuaaagggagcggccccuucugccuccucugggaguuguuguugauguugcacaucccauuuauucugccuuuagcaguuugugucugugggggcugugaagaucgcucgcucuguucccagguucaguucuuaguacccacacacacugugucuuagugacucacagugccuauaaccgcagccucggggguccaguuuuuucgggcuuugaaagcagucucacaagugguguucagucacacagaugcauaaguaaaaauaaaaauuaaaaauaaaaaugugacuuuguacuuuggccucacaucuuugcagcuaagguguuuagguaagaguaaugccugggagagugccugugccccuauucucagauaacuucugguguugcuaagccugggcuagcccaucuuagcucuuaaugaagacacagauaccugguguuuuuauuaacaagcugcaagccuaagcggggcagguccugagauguacucaccuggcuaggcugcugacacccagacaaauguccuguuacucgacacuugguuuugccuuggcucgauuugguccaugucucuccucaugguuucuucacaugguuucucuacaccuucuccuuauuuauaguccucucgguucaucccucccgccuccccucccucccuucccucuggucucugggaaccccugacuggguucuuuucuguccagcuaaaagaucagcucuucccuaagccagugaggagaugauggagaguuaacaaaacacuagacagaugcugcuucauagaaauaacaguuacagugucugccuggacagaguccaccauuugacuaacacaaagaaccuuuacacagugcacaaacccauccuccaacaggugaggacuaaggucgccuagaaagaagcugcccugugucuccauccaggccuuuggugcaccgcugcgggcuggggcacgacaacgggggcagugccagauggucuuucucugguacccacgccuguacuuuuucaacaggucucagucuggcacaggcaagacggccaccuucagugucucagugcugcagugcuuggauauccaggugauuggccgcgugugcgugggguguggccaggugauuggccgcgugugcguggguuguggcugucuaccuuaccccagcagagggggcucugagcuucacagcagguuccaggccagccuaggguacauaguggggccaggaaauucuggccugcacaggaaagcccugacugugucacgcucuugccugccaacuuaaugucuccguaggcugguuaggagagagccgcaagcucacccaagcugguguucacagcagguccuagugcuuguuagcagccaugugagugaggcuggagacugccaggcucggucggggcaggaagcuggacuuggacagacaccagguuuccucuuaugcagaauauagaguuuuuuuauuuuucaaagcaggcaugaaaguagagaugggacuguuugggaagagacgggagggaaggauaggugagugugagugaccuguggaaaugucacagggaacugcucacucuucuguauauucucagaccuuucucugauuguucaccagguucgagaaacccaagcuuugauccuggcuccaaccagggaguuagcggugcagauucagaaggugagacagcuagggaucacgugucacccuaggugccgcucaucgccagagcgcuguccccaaaugugggagaccccauucagucccuguagcgcaacaacagagauggccacuguguuugcaaguguccgauguguggcuuaugugggaggguaggcuguuucuguucuccuggggacaguagagugggugaaggggcuuauggcucacacuuagaaucugccucccagaguccauguaaagguggagggagaccauggaccccugcugucuccgaccuguuuccuucuuccguuuugguuuucacaacaccagaagauggaaccuggagcucugugcaugcccagcacccuacaguuccuucugugucguauaacucuggucguucugcucuuggguguguucaugaucuuagaaguggucggagaugaagcucagugguuagcucugcugugauccacaaggcccugcguuccuuccucacacuggcgggggaagacaguuuccuucaaggaaaacgaaauucauuuuaaucaaacgauuuuuuuucuuaucuuggaggaauauguauugggauguucauacgauauuauuaugaacugugacuuuucccacaauugguaugcaccccaucagucucaagaaacucucaaaaugaauuucauuuuggcagagaaaagagcuugaauuugagugacugagugaguggcaggugguaucucccauuagaguagaggugacacuugacaugaaaccuguuuggccucagggucugcucgcgcugggggauuacaugaacgugcagugccaugccugcauugggggcaccaacgucggcgaggacauccggaagcuggacuacggacagcacgugguggcaggcacgccgggacgcgucuuuggugagugcucuuguugagaacugggcugugggugcuaugugugagguguagcagucaaguuguauacaccaugugaugggaccgacucagggcucuugggaccagagggaagggccagcuuuuuccuuagagccacgugugauucuuucaaaaucuaauccccagauaugauccgccggagaaguuuacggacacgggcuaucaagaugcugguuuuggaugaggcugaugaaauguugaacaaaggugaggggaccaggauuuucuaacacugccagguguuccugugauaguucuuuguacagaaacaguguaucuugcggguuuugaacaugaaacuuugauuguaauguuuucaugguuaagguccuugaggccaugauaguguguuguuauugucugcuuuggcacugcacacuaccugggucagggcucgggcauucacaugcacacugccugugaccuugcucugaagaccuggcaguguggcucugagugucagccugcaggccgacucuaagcucccggcuguuacagguuucaaggagcagaucuaugauguguacagguacuugccaccagccacacaggucguccucaucagcgccacacugccucaugagauccuggagaugaccaacaaguucaugaccgaccccauccgcaucuuggugaagcggugaggaugccuuccguuccuucauccccucgguggaaacuaacaugguguccuguacucugugggaugauagauauccacagagugggaacugggaaagcucuaagaccggcuggguagacaagggcuggggcucuuggguggccaugucucucggguucugguuugaagagugaugugagcucucuuugcagugaugaguugacucuggaaggcaucaaacaguucuuuguggcuguggaaagagaggaauggaaauuugauacucuaugugaucucuaugacacgcugaccaucacccaggccgucaucuucugcaacaccaagcggaaggugugccaccuugcucuguagccaucuuggggaauugcaggcuagguguccugucaaaggugggcaggggguggcuugggcucaggguuccuguguuaauucagcucuagaugguguguuagacagaaaugcugagauuugacaguggcagagcugcuggggcagcuaagaagggaggucgcagaagaccugugucuaggacggaugggagaugcugacacugguuugcuguaguauauuugaugucuuugguuuaagcugggcccaggcccaguaggcugaagugauggccugugggcagagucugugagaguggucuuuuuuuuuuuuuuuuuuggugguuuguugagacaggguuucucuguauaacccuggcuguccuggaacucacuuuguagaccaggcuggccuucgccugccucugccucccaagugcugggauuaaaggcgugugcuaccacgcccagcugugagaguguucuuuaaagaauucuugggcaugccuaucccaguaggugggugagugcguuuccucugcaucucuguacacgucugcuguuaggagcugccguuguacauggaucugguuggguaguugagcguaucucuuguucugaucuauagguugacuggcugacagagaaaaugagagaagccaauuucacugugucguccaugcauggagacaugccccagaaagaacgagagucuaucaugaaggaguuccggucaggugccagguaggccuuugcagcuuuggcuccuguggggggacggauggugcugcccccagggccccagguuccagggcugauacaguucugagaggacacugucccguguuggcuguuggguugguggugaacuacugcuagccauuggauagauugcagucacucugguuucugauggucuucugguaaccacauguuggauccguagucauacaguguucaaagaauaggccucuuaaguuuuccucuuugauucaggccugcugugauuuccccggggucacuuuugcaugggguguguguguguguguguguguguguguucuucaacaggagaugcccagcuagacuggaccugaaagccugugauagccuuccacuugcccucccuucccucucauaguuaguucucugugacuguguaggugagggguccguccucucuguccuuuguauuacuguuuaucuguccuguggguguaggguugaaugugcccuguagagcguguguggaggucaggaaccaacguggaagucagcucucucucuucaccgugucugccccaaggauuaaacucaggauaucggacuuggcagcaggcuccuugaccguauuuuuacaauuaaaagacucuuaacugugggcuccacuaaaauacuuuaaagagggaaaaauaucagggcacagucacaaucaaaagccaaaucaaacuauaagucgggcgugguggcgcacaccuuuaaucccagcacucgggaggcagaggcaggcggauuucugaguucaaggucagccugaucuacuaagugaguuccaggacagccagggcuacacagagaaacccugucuaaaaaacccaaaaaaaaaaaaaaaaaaaaaaaaaaaaaaaaaaaaucaaacucuuaacuguccagugucugagaucuacucaggaucuuuuggauuccuccaagggcuugggucacuccuccagcccugcccuuuguagcacacaucuugucuaggcuccagcugccugugccccacugcugcugcuguucuugguggucauucaggguacuggcaucuccaaaacacuguaacuagacuucaccaauagacucgucauggugccaagccucaacuccuuugcaugacuccuucaguccugggucaucaacugcaacugagguugcaccuucaccaauggccuuccaugggcucucacagugccgagccucagcugcucuucaggacccauucaugucuuuaaaaccaguacuaccugagugacucuuacauauuaucaaguccagccauagcacaagguacgaccuuggcuaucucuggaacacagccucugugcucucagaaaacacuucccagaagauuuuaccgcagugacgcuggucucuuuuuaaucaccacuaauuucuuagcucuagcuaaccagcaucaguagucccaguaauguaaaauuuucgauuuagugguuuuggugucuuguuaaucacaauugauucuucaaccccagcuaaccaaacccaaagaauauucacagucaaaauagcagcagcccugauaagagucuuuaaucuucccucugaaauaagcuagcccuccaucuuuuguacuguucucaacauugucuuugaagcuccuacacaacaucccacagugcuguuaacagcgaaugaaucuucuagcccaaaguuccaaagucuuucugcaauccucccccaaacuuggucagguugucacgugaauaccccacuccugguaccaauuugucuuaggguuucuauucccacacaaacaucaugaccaagaaacaaguuggggaggaaaggauuuauucagcuuacacuuccauacugcuguucaccaaaggaagucaggacuggaacucaagcaggucaggaagcaggagcugaugcagaggccauggagggaugcuacuuacuggcuugcuuccccuggcuuagcuugcuuucuuauggaacccaagacuaccagcccacaaggggcccucccccaccuugaucacuaauuaagaaaaugccuuacagcuguaucucauggagacauuuucucaucuaaagcuucuuucuuucugauaacuccagcuugugucaaguugacacaaaaccagccaguacacugggaauugaacucaggaacucuggaagagcagucagugcucuuaacugcugagccaucucuccaacccuugugugguuuuccagacaggguuucuccguauaacagaccccuugacuaaacuaucacuuuguaaaccgggcugucaucagacucacaaauaacugccugccucugucuccugaaggcuggaauuaaaggugugugcuaccaugcccggcuuaauuuuugauuguuuuuuaguaccauagagaugauaccaucucuauuccuaacaucugugaccauuaccuacuuucccugucuuuacagacaguucaaggaucuagauuuguuuaguuccaagccuaagauuaguuucaugcauguuaaaccaccccucccacacacacacaaauguaauuguuuuucuuuuuuuucuuuuuuuuuuuuuuagauuuauuuauuuauuauauguaaguacauuguagcugucuucagacacuccagaagagggaaucagaucucguuacggaugguugugagccaccaugugguugcugggauuugaacucuggaccuucggaagagcagucgggugcucuuacccacugagccaucucaccagcccguaauuguuuuucagugcuggagauuacuguauguuuuaaucugcagugacauuuugcuuuauaggauagacuuuauuuagauuuauacguguuugacuuuucuuucuauuucugaccuucaucugagacauguucaaguuaguuugggucugagagugagagucggccaggagaggugaaggagcugcugcugagauggccuaauaguuuccuucuaccucaauggggugagggggucucccagacagcucuuaggccccccagugcacaguccaguugccuguuuaagcaucuccugccuauaggcuucucucugccugcuuuucuuuugcuuugguuuucagccucaguuggccuuuggcuaagucuagauacacauuucuuuguauguccuuuugcugucuauagauuaaguggagucucuggccugcuugccucacacaccaugcucugaccuuuucucuuccuccugggucaguugugaugcggcacaaaggcagugaaguguccacacacacacacacacacacacacucugagccuucuaggauucuccuuucccuuaacuugcaguggaaacaggaguccauuuuuuuucuaguaaccaugucaacagguggagcaagcaggcgcuuucuagcuugcugucaguguggcaccauuucaggagugggaguguccguguuuuuacacugugcuuucaagccccuuauccuugcacaccuagcgugucuguuaggaccaggcaugcuucagguagguggcaugacuguggucucugugggcaguugauacuccuuggucagagcaucugcucuccuaugggauggguauggguuaaggugaaucaguaguaggcuccuguucauaacuggauuuuugcuaagccgacuucauguuuuccuggaaaggcugacuuuaaacaaauuugcuauaaggacacccaguugucuucuugucagucauguuuuccaucauggcagcagguuuugcaguggggguuaugugauugcuagcgugcggcucacgacugucagaagcugcucucucucucucucucauggaucugguuuguuuuguuuuguuuuuuccugcagccgggugcucaucuccacagacgucugggcccggggccuggaugucccucaggugucccucaucauuaacuacgaccugcccaacaacagagaacuguacauucacagguaugugccuccuuccuuugcucacgccucucgaccugcgucugucugacugcugacuaacacauauauuuuaauccaaagaauugggagaucgggucgguauggacgaaaagguguggccaucaauuuugugaagaaugaugacauccggauucucagggacauugagcaguacuacuccacccagauagacgagaugcccaugaauggcaaguuggcggcugggugcgcggcggggagggcaguguguggggcucccuuacuccauuagggaggugacauuaacuugguaucuuucuccucccucaguggcugaccucaucugaagcuggugcuggugcaccgaggcccuguuuggaaacggaagcuucuauuuaaugggguugauauggacugucuucucggagccccucgggaagacccucagccuccgccaucuuuucuaaugcacauguacauaauccgaugcuuaaccuuuuacauuaaacguggacauuuuccugugaguuugagugcagaucuuuguggugucaccagcuuuccuggucuggucauggagaccgcaccaguucuuuccuaacuccucacucacgugagaguccagcuugagacauuugaaguaagagcgcaacaacaaaauccauaguagaagucagaagacaauagugacuguggguuuggcaaaggucucuuuaagaugauggagaaggacucggacuguccaguuaaaugucuucagaggacacaaaguagcaaacugggggacuccuaggggaggcgagucccgaguuaccuggugaacuggacccugugaugggacucagccaaggcuuggggaugagaggucacucuggaguuuacccacucacauccugugagggucaggagccuugacugcacgugcucaggggacagggcaccagguaaugaugggggcugaggagacagagcaagaccugcaggaaccuuggagccuugaaggguuguccucaccggggacagagcuuaaacuguagcugauugugccaacggccugugagcagaacagacugcacccugacuucagccagguuugcuuuggacccauagaaguguggcagacuucaucuguguuauuugaagccacuaaagcugugguaaugaguugagccagugauaggaaauuagcguuguauaaggguaagacuacacagcucaaaagauuggauauaagccggcgugguggugcacgccuuuaaucccagcacuugggaggcagaggcaggcagauuucugaguucgaggccagccuggucuacagccagggcuauacagagaaacccugucuccaaaaaccgaaaaccaaaacaaacaaaaaaaggauuggauguuugccgaaggaggcagguggguggcgugugagcccggugagagcugccugcugcugugcagugagaaucacagugcaugccuccacacgcugucuccacagcugcugaguucagacacuugugagcgcugccuggagugugggcuguuucccguggguaccggguugaugcgcugaucuggcuggccaggcaugcaucuggguccccugacugaccauuuccugaaccugcauguaaguguggaggaaggcgacucccgaggugggaggagaggagacgggcaacugcccugcugggaucucccaacaagucccccguggcugucccuguacaguggcuguuccggauaagagucaagcaagcagcucaccccacaaagcaccagcgguagacguccacgucccuaggcuuguuuaaugaagccgugcauuuguugggguuacugagggaaaauagacuggcaggaggcuguguuacaggcguccaccccagcauacacgaaaccugugccccuggauucuaaagacugaaaaucagcucagccaguuguaguuuccuaucuguuacugcuauguaacuuggaagacccuguagaccuuguuuuuaaggagccccuggagcuucaaugagcuucccucuaggaaguaauggaaugaaaaaaaugggaaaacgaacagucaaggacggucauaccaacauggaugauccuaacagaugaacuccugucauucucgaagguguaaacugaacaaaaagacagcuuguuucucugacaggcuuaaaauggcuguuuuuuucuccugucccaagcuugaucccucuguagccagggaaaggagguacugacacuuacgucaugcaaugucuggguggggacaggacugugcaaaggccccuugcugccuaaccccuauaggacaggugccacugucccaggcuuuggacaucgccacuccagaugaaguguuaaagcuaccuuggacauuccccaugucucucucacacuaagguuaugcaguguggaccacuguggggacagaccucagguucagccaaugggacucgccuccucuagcucaucccuucgcggaaagcccacugcccucccccucccaguucaggucucagg

SEQ ID NO: 6521 - RNA, 12116 nt, Mus musculus
cacgugaccguggggagcggacgagccggaaccgcuuacccugaccggcgccgccaugcacugcccgggacuggccugcugcacaauucuguugguccugggacucugcggcgcgcacucgcgcaacgugcuacugauaguuggugagugccgccgucccuggcacggccaccugcugcugcucccagaagcggccacugggcucuuccccgccacuggcccaugcugaccccggcgcgccaauuccuugccgagccuccuguugcaggucucuuccuggugacucuaaaugcgucuggcccucccgcuucugccauccccaagcuggccagcauucccacaucuguagucaaagcugccaaggagacccgguggaccccggcuacucaugcagaccucugauaagguuccagaaaugagaauagccugaguccccgaguuuuugcaggaugcccuggucaguucucuuagcuccuggcccaaaaguacaguacuccaaugcccacgcaaaccaccaaguuccuccugcauucaugagacuuccuguuugggugaucagugccuggcuugugacagcccaggccuucugaggucuggcucugggccaggcccacucuucugauaaacuuugugguaucugggcaagccaguugguuaauuguaacauaaacagugcugucuuugcagcacuacccccaaucucuccaaggauagucucgaagaucggccuaggguguauauccaccggauaggauuggcgcuggaauccucuggagccaguucguguggcucuggaacuucgguccugucucagcuuggacagccaucacaacaaaaccuggcagucucagggcuagagagguggcucagugguuaggagaaguggcugcucuuccagaggacacagguucaauacucagaacccacauggcggcucacagggaucuguaacuguuguauauguacaugcagggaaaauacggacaaagcagaaaauagagucacacucacgcaugcacacaugcacgccacacuacaggccagguuuuuaacaaaccaauguaagucuaacaauuucauuauauggagagacuggguucagagagccggcuccucccucuguuucuggggaggccuuccuggauuguugaugacaccugucucauuuccaaaccugacagagaaaugccacaguccuguucgauuggaccccacccucacuuaacuguugaagacuggauucagauaaugacagcaggaauuuuaggacugaaugaucagggucagaggcaagagcugagaccucugugugcaagcagcauggcuuccuggcaugcaacagaaggcacacguaacacaaccacuccugccuguccucccaucuguccuccuggcuguccucuugccuguucucccaucuguccucccuccuguccuccauccuguccuucugccugucuuccucccuguccuucugucugucuaccucccuguccucccaucuauucuccuggcuguccucuugcuuguccuacugccuguccucccaccuauccucccgucuguccucccgccuguucuucugucuguccuuccgccuguucuccugucuguccuccugcccaucuuccucccuguccuucugccugucuuccucccuguccucccaccuguccuccugccuguccucuugucuguccucuguccuguccuccugccuaucuuccucccugucccucuguccucccgccuguccuccugccugucuuccucccugaacuccuggcuuuccucuugucuguucucccauguguccucuguccagcccuccuaccugucuuccucccuguccucccaccucuccucccgccuguccuccugccugucuuccuccuugucguucugucugucuuccucccuguccugccaucuguccuccugccuguccucccgccaguccucccacuggcucagcugucauugguucuuguccgagugguccagcgggguggaggaugguggcuggacuggaggcuggguauccaucuuuguucagggacugcauugccucugaggcaggugggugacauguugcuccuggguucccacuggguaguucuggggaacuccuacagggcugugggugcugcauggcaucucucacacuucuggugccuccugaggggucaagggucagaagcagacaaucugcauggcugucucugaaagaugcagaggugugguguacacacacacacacacacacacacacacauaccccucagcuguauccuaggcgugucucuccugccuggcugucacuugugagguagagucuucagagccccaguagucugcagggauuacaugcagccaucaccuacuaacacaccugcauggacuccagucuguuggggugugagcuccucacgcuagccuaccuguuaacauucccaccugaguuuccuguguucccugcaaaccauggugucuucucccccugcuaacauaucacucagggaucuugccuaccuguguucccugccugcucacaaacuccuauaucguugugccuggcaucacacccccucaggcuuuccuucuucugggagugucuaguccaacuccugagcaucacagggaccagccuuugcagcaguacccuagguaucccccagcccccacugucccuccugaccccagccaacacgcccucugcucugucuuccucagcggaugacggaggcuuugagagugguguauacaacaacacugccaucgccaccccucaccuggaugcccugucccgccacagccuuaucuuccguaacgccuucacgucugucagcagcuguuccccgagccgugccagccuccucaccggccugccccaggugagaguggcuagugggaugaggggacugggcgggucgggggguggauagguggugacucuaggguccucucuccugggaggugcuaccugguuucccuugcauccuuaggggcagguacuccccagaggucucaggugcagccagggcucugccuccacaccccucaguucagcuggcucagugacuaaguguccucaucugagacgugggcacagugaggugucacuugaaggucauuguggguguuggucaagcacggcuuugcggggagaaagugcucagcauagacagaaccugcacaccucccgcccagcccugagcucagaaccuccgugaggucaggcacuuccuuuuucuguuguugugguaaaguacauaaaacauaaaauuugccaucuuaacaguuuuccagugcaggcaguggugugagauacgcucacaugacugcaagccauuccuccauccgccucuagaacuugcucuaaacccugucuucauuaacccugcccuaccccaauuccugccagaccccugcucuauuguuucugaaucugacaacucuagagcucucuugaagauggagucaccgcuguuuagcuuuugugacaggcugugacacugagauuagcaucucuguggcccacguaggaauuuacuaaaucuuuuucacaaucucugauauaaaugccuuuaaucccagcacuugggaggcagagccagguggaucucuugaguuuacagccagccuggacuacagaguuccaggauagccagggcuacauacagagacccuguaucaauguuuuauguuuuaaagguuuuuuuuuuuaaagauuuauuuauuauuauacauaaguacacuauagcugucuucugauacaccagaagagggcaucagaucucauuacgggugguugugagccaccaugugguugcugggauuugaacucaggcccuucagaagagcagucaguguucuuacccacugaggcaucucaccaguccuguuuuaaaguuuaaaguuacauuuuaauuuuuuuguuuguuuguuuguuuguuuuuguuuuuuucgagacaggguuucucuguguagcucuggcuggccuggaacuuacucuguagaccaggcuggccuugaacucagaaaucggccugccuuugccucccgagugcugggacuaaaggcgugugccaccaccauccgacuuuacauuuuaaaauguauguugugugagcuggugagguggaacacaccauacacgucacagugagucucuggaggucagagacagcuugugggaaccgguccucuccucauaccacgugggucucagggaugggacucaggucgcccuugggcugagcgcuuuucaugugcgcugucuugcacagccccaacccuuuuacagagacagggccuaggaccaggcuugccuccagcucacugugcagcuggggcacauccucccugguuccuuuccuccuccggcugguguccccugucacaggagggagaccggguggaguuccccugggccagcauccacaggggucccgggaugagcuguggggugucggagcguggccucacagaugagcaucuucgucuacagcaucagaauggcauguaugggcugcaccaggaugugcaucacuucaacucuuuugacaagguacagagccuuccgcugcugcucaaccaggccggagugcgcacaggugaggugugggcaggguggcacggacgugcggucccucucugacuccucccagccaaagcuggaggucugagucacucucaaccuaugugagcuguugcucagccaggccagcgugcacacaggagaggugugggccugaggacaggaugcaggugcaaggccacuuugugauccuuccuagccucuuagagaguccagggcucugaguguguggggauccagggcucugagucacucucagcucaugaaguccuccgugagcacuuguccuaagagucaggccaaagccuccaaacuacccaugcacaggauaagggggcagaguggacucuggacggacagacagacagaccucuuguccacccucaggcaucauugggaagaagcacguggguccggagacgguguaucccuuugacuuugcauucacagaggagaacagcucugugaugcagguggggcggaacaucacuagaauuaagcaacugguccagaaauuucugcagacucaggaugacagguaaggagggcucugcccuuuagcccucugggguagccagaccucucaauaguagguuuaggcugucauccuaggguccacaguugacuguggcaggggcagaggaaaacauucuccauauccagaagaagagggggaaggggaaacugaggcagugagugagacaaaggugggcaugcaccaugccaaagugugucuaucuaagaauuggggcucucguggucgagacaguggccuggucuugacugauccccuccccuacacucaggcccuucuuccuguacguggcuuuccaugacccgcaccgcugugggcacucucagccccaguauggaaccuucugugagaaguuuggcaacggagagaguggaaugggguacauuccagacuggacaccccagaucuacgacccucaggaugugaugguaggagggacccuugcaauguucccaaggcaugcaacccgaccucuauaccccgggcccugcccuccugacaacuuguagccccugccuccaggauguaguauaguguguaugaggagacuugaccuagggggcuucagguucauggggguggggggcugcagagagagcccuggacccuggagaugaagugcugagugugcagagaguaaagcuguuuugacuaguccauucaugggcgugcacacgcacugcgcugccuccuauccagucagaagucaccuaugcaaccccaucccccuauuccccgcccccauccuggcucugagaugcucugcucugauuucauccucaggugcccuacuuugucccggacacaccagcagcccgagcagaccuagcugcucaguacaccaccaucgggcggauggaccaaggcgagucccagugacugaggcugucccucucaucauaggccagggaccuuuagcuggacuucacauuaguggaguccuggaaucagcauaguguuagccaggguuaauguugaaggggugaggcuuagugucuggggccggagccucaguaucccuucauguugcugcuuagcuaugucuagacccuuuugucuguagcucuguuuuuuggguuuuggucuuuuuuuuaauuuuuaaauuuauuauuauaauuauaauaauaauaauaauuauuauuauuauuaauuuuauuuaucuggauauacuguagcuaucucuagacacacuagaagauggcaucggaucccauuacagaugguugugagcugccaugugguuguuuggaauugaacucaggaccucugaaagggcagucagugcuccuaacugcugagcugucucuccagcccccccuuuuuuuuuaaugacaggguuucucuguguaguccuagguguccuggaacucacucuguagaacaggcuggucucaaacucacagagaucugccugccucugucucccaaauguuguuucuucuccuucuccuucauauuuaauuuauuuguguggauguuuugccuacauguauguaagugcaucacauacacacagugcccacagaggccagaaaggacaacagauccccuggaaugacaucauagaugggugugagccaccaugugggcgcugggaaucaaaccugcaucuucuggaagggcagccagugcucuucaaccacgagccaucucuccagcuccagcuuucauuuucauuaauuaaguuuuuucuuuguuuuucauguguguauguguguguguuugcauguuuucacacauguauggguguacaaauguguguguauucuuucacauguguaugggugugcaaaugugugugcauacuuucacacguguaugggugugcaaaugugugugugcaugugggggccagagguugauauuggaagucauuuugucucuuuuuuagcuccuuuacugagacugagucugucagucaaacccagagcuugcugauguugcugucuugggagccagcuuccucugggaaccccauuuuugccuuccauggcuggaauuccaggcgagcucucucacccuggcaauuaugugggugccugggauccagacucugugauccugacucuugcauggcaagcaguuuagcugcugcucagucugccugguugccaucuuauuuugacuuuuugagacagggucuuguuauagaccagguuagccuggaacucacuugauagcccaggcuauccccgaaugccagaagaucucuaacaguggugcccuaucuuaggcucuuacccaagcugucucuuugcuucauagacacuagauucuaaaacagaagccagcuuggggcaguaccagcugccucauauggcaggaguucuaagggaugagaggucccuggaagccaugugaccuguaccauguguacaggagguuugugguuugggcuagaggcugggcuugcaggaaagacugaaggggugugugagggccaggauguaauagagcccagggguaaguggacacaugugccucugagccuucuuccuccucuccauccucagggguaggucuggugcuccaggagcugcgaggugcuggugugcugaacgacacccucaucaucuucacaucugacaaugguaucccuuuccccagcggcaggaccaaccuguacuggcccgguacagccgagccuuugcuggugucaucuccagagcacccacagcgcuggggccaggucagcgacgccuacgugagccuucuaggucagucugucugucugucugucugucugucugucugucugccugccugccugccugccugccugccuggcugucucaugggaagggagaagugaaguccaaugggacagccauggguuagguucaggagugcucccgaaccuagguagugcuccuucaccuagguagggacaagauggcccccucuauuacaugguaagaaccagagucaccuggaggucuguucuugucacgucacgacccccagagugucugguggggucccaggcaggaccgauggacuguggguugcccacuugagaaccauuuccccuuuucucaggaucuggagccucucaugacucagcucugagagccugguuaucuggccccauaccacagaugagcaagcauacaugcaggugugagaaacagacaaaggggcugaggaacagaggggcugagaaacagagggacugaguuugugcccagcccaccugcuuggaaagagucccuguguucuucucaguggcuacaagauaggcucccuccagcucaggacucgcuucuccauugugacccuaacccaugagugagggaaccuugugaccaacccagacugaguggaugagcccucccuacccaggguuccucuaguccauaggacuuuagaagguucuuggauaucagcaagccagggccucugguuauacuguuaucagccucacuggccagaggugauccgauccuacgagugcccaugggauuucccgagagacucagauccagcccuuacaaugggcuccaugucuuccaggaaccccugcuaagagccuguccguguccccacuaagagccuguuccuuuccagaccucaccccuaccauccuggacugguucuccaucccguaccccagcuaugccaucuuuggcucaaagacgauccagcucacaggccgaucccuccugccggcgcuggaggcagagccccuuugggccacugucuucagcagccagagccaccacgaggucaccauguccuacccgaugcgcucgguguaccaccagaacuuccgccucauucacaaccugagcuucaagaugccauuucccaucgaccaagauuucuaugucucgccgaccuuccaggaccuccugaaccgaaccaccacaggccggcccacgggcugguacaaggaccuccaccguuacuacuaccgggaacgcugggaacucuacgacaucagccgggacccucgagagacacggaaccuggccgcugacccagacuuggcucaagugcuggagaugcugaaagcucagcuugucaaguggcaaugggagacacaugaccccugggugugcgccccagauggaguccuggaggaaaagcucacaccccagugccgaccgcuucacaaugaacucugaccauccccggggcaccugccagcccaccuggacauggagggagggagcaauggaggcaguaccaacagcugcaccuucuacauacccauccuaggaggccccucuaccauaugggaugccacucccgccuccuguagaggacacucaagcacgcacucccuaguugcugccauaccaaggacaccguuguccucaugucugccuguccuggcucaggagacucuagggggaacucgggcauggcagaaccccaaguuuugauaggugaguuuggagaucugcagauggaggagcagggucuggggcucgaagcccucugguuucgggaaccuguggauguuuucaagcccuucacccuaagaggagcucagguuucugggugccacaugggcagugggcagaccgcacugacuacuucaaccaaccuuguccuggagagagcauucaguaggccuugagcuugcuuccgccuccaugcucccccccugagguacaugcuuagccaggguucaugcuguucucagaggagugaguuugauccuguggucuaucugggcucugcucuccuuucugagggugacugaggaggacagggugggacagugugcgcucucucucccucucucucuccccccucucucuccuuucauucucucugagugacaccaagcaaaccaccuggcuccaucuuuucccuuccuucacuugccaagggacagaagcacugcuuagaaaucuagaaagagaggggcugucccuuuugccccucugucaacuccaucuuggaagggagugagaguuaugggcccuaguguuggaaaauccuuuuuacaauaguauaaucauucacagaacuucauaguagcacacugcaucuuaggcaccgagacacaaacaccgugucaaaaugacucaguuuauggcuagaugggggcuucacccaaguguggcgcaaugcagccugggaaggacugggggaaaugucaguuuugagagagaguucuuugcucaugaagggucaguuggcucugggauaugcaccaaagcaaccugggguuugggguuaggcacagaggcagugagucaaagagccacucaagucugugcacuacagcaccuucauuugcagaugucuguggcagcacuuggcuguuagcagcugagucagcugugcccacggugcuccagagucaggcccccgcccugggcaggaaggacugcuccagcgagcuugcaagguuccuuugacaucagaaacauaaaaggaagggccagaacccacaaagcuauuccuguugucacaggagguuggggcacuggcucugagcaggucucagggaguacccccacacggcagaauauuuuccgguccuccaucagcccaggccaugcugugugaagguggcuucgucauuuacaccuugauuucugggggcaccugaggucagaccccgaccagagaaggaagugggguuguuugcugacagcauugacagacacacagagguccccacagucccaagccaggucugggcuucagcaggggcucucuguccacaccaccuucuucugcucaucugcaauggccaggcgcacacagcugagcaggcuguccagaucacuccagcugucgggggccaggcugcuguacagacacggcacucuguccagcucucccuccuccugccgggccaccuccaggaacugcuccuccgagcugccaagccgaugcaggcccuuccuacaaagcagagauagauguucagcucgaagacagcaagguagccaggaaagcacacaguuggcuuuaguacagcacacuguugucauccaggccagggucugcagaagacucagcaugcacccuugggcgcgagcaugggaguccuauccagggaagucaugaaggaaggacggacuuggcugcaagcagcauucacugauggagugagccaaagaaauuguacuucccagaagauauaggcagugggauguuugucccagccagacaccaagugauggggugagaccaggcuucaugagccccaggcacugcgcagcuuugguguaacuagggcaggggacagguccacuccgggggagagcaagcuggaccucuggccugagguugcaaggacacaacuggggcuggaacuuagagcuccagugugcgcuagaggcacaugacaagcuuuuucuggagcacaggcaccuguuuggacccugcuacccucucccugcccagcccucccuccccuggcagcuaccugaguuucuuugcugucuucucauugacagagacauggaugauaaugggaaacauguccauccuauguaggacucggacgcuguccagccgcacauccagcagggcgugggugcucuuugggagggcauagagaagcaaguuaagccccgggccucgggucugggagggacugagaggaagcugugcagcagagcacagggcuguguggaagacacccgaacagaggcaguguggcaugugccaggacgccugcuguauaucuucaagggugaaacccauuugauuugucccuggggaaaucuggauuugcaagcuuuuggcauugagauagauuuugcauggaguacaaaccuuaagaaucaaacagugccagcuguugcccuccguugugcgugugugcccgugugcaugcacaugugugugugugugugugugugcguguguguguguguguuuuccuuccuacuccuccuuauggaagugugaaacuugaugguuuacugagagcuguaaaaucugagucuuaaugucuucauuuauuucuuuuauuaacaucaaucaaauaucccuaguuaagaaaacuga

SEQ ID NO: 6522 - RNA, 2610 nt, Mus musculus
ucaacaaaacacagggaacaaaagacuucgucuuuguuuauuuugucacaaaacugucgagaaugggaagcgguacaucauacgugggguuccauggagguaggaacacaacacugaagaauguguuguuuuuuuuaaaguaguauuugagguauuucuuaugugaauucgugucugaaauuagaauuugaauuccaacaauaauguugaguggcaauuugauuucuuacccagucacaguuagcuguguauggugguugcacauacucauaaucccagauuucuggaggcuaaggcaggagggcuacagguucaaagccagccuggauuacacaaaacaacuucuaucaaaagcaaaaaagcaaacgagcaaacaagcaagcuuugggcauaccacaguggcuucagcagucccuugucuaccuuaggcgagcacugcaucugacuccccccuuccauggcacagggauucugagaucuucccaccccaccagcaccaacacaccagccuuaucuucauuccccuuugguuuugugcacagacuuuuugugggagaaauguuaucuuuaugucacuagccagcucucuccugcuacaagacagguguguuccacgagucagaaauacccgugccucaugcaccuuuacuaauuauagugugguggcuacaggaagaugugaguggggagccuagagucauccguggacccuuuuuaagagauaauuuugucuuaaacaguacuuagguugauuuugcuggcauaucuuaaugcuuucucacauguccaaaugcccagacuucgggguacucaucacucuuuuagcaguggugcaauuaaaaauccagguuagggggcuggagaguuggauucagagauuaagagcucuggcuagaggaccugccuaaacccauguguuggauuagauaucaucuauaucugcaguucuaggggaucugaugucuucaucugaccuacaaggacacaggaacacacguggugaacauauauguagucaaauacucauguacauaaaaacuaauuaaucuuuaaaaaacaaauucugggccaggcgugguggcgcaucucuuuaaucccagcacucgggaggcagaggcagguggauuucugaguucaaggccagcuuggucuacagagugaguuccaggacagccagggcuacacagagaacccugucucgaaaagcaauaaaaauaaacaaauaaaugucggguuagccuguagagcugagcacguaaccugagcaccugaguguaauuaguucuccaggcucccuccacgagggaagagagaaccagcggucacagaucaccuucugaauccacacacgugcacaugggugcacacauacagauacauacacucacaugaguacaauucaauuaacauaaaaagccagguugagauuaugucuuguuuauaaaugacuagaugacaacagcuaaguuauagaagauuccagugacuguucuucacagggcuauggcggucugugcauauugaugaccuccgcagaucaacaauuauggcuucagaugucaccaaacugcagaaugucaccaucagccaguuguucaagccagaggacaaaccugagcgugagugacaagacagucaccuggggccaugguguaggugacaggagggaaaugaaugccagcugcggugcuggaugcguagccacucugcugucccagccccugacccucagcagagugcagcagugcuggagccaccugagaugccacagcaugccaggcuacaguaugauuccucugccagcuuuuagagcccaggcuagaggaugccugagccuggagcuggagcugcucuacaagacacauguucaguagagccaucucuacagauagggacaagaagccuggcaagucccacucuggguauaaacccagacaguuugauccugcaugcugacuugaacaugucugccuugccuuuugucuagcagaggaggagauggagauagagacaagccagucaaaggaauuggcagaggaacaaauggaaguggaagauucagaggagaugaaaaaggccucugacccaagaagcugugacgugaguccggcuuuugccauuagcuaagggagacacuugagcugcauuuuugaccucuugccugggaguuaaguggacuccuguauuuaugauggggggaagagacagugggguuaaucugagcccuuuucuccuuccacauuggauguguaagggaaucaacuccucuuaaguuacccuguauccuugcuucacuugcugaagccagcuaucaggagcuauggcuggugggguuuacuguaacuuugccaacuuuaaccaccacccagggccacaugauugcucacacuaaaccgccaucuugugugggugcccuagccuuuguccagacuggaaucagcacaguagaauucuuguuuucuuccucaguguucacaguuccuagauaccaccagacuggugcagagcugugugcagggugcuguggggaugcucagagaccagaaugagagcugugcgcgcaacaugagaagagucaccauucuucuugaccucuuaaaugaagauaac

SEQ ID NO: 6523 - RNA, 6115 nt, Mus musculus
ccgggcugacucaacgguagccuaaggacuguccacagugaggaaacuaggggacgaaggugacagcgccgaauggcaggugaacgcuggugcacacuucucagcaagcacuuguagguccaaaacacuggguguguguauguucugcgccagcggggaggggggcgucggcugggcgguuuugaaagucaggaagccugauuuaggcucacuccugugaggugcucugaauuaaucacagucccaucugauuagcugaaaggccgagggagggcguucgcaucgccuaguaaguccagcggugcgcugcgcuagggacgaagcugcuucgcguucugaggcgcguggcuccgcgcggccgccguaggucgggcggaguacgguggccgcagagcggcggcugcgacggguucggccggccggcgcggggccgccaugggcaaccuguucggccgcaagaagcagagccgagucaccgaacaggacagggccauccuggugaggggccuacggcgggcagggggccgggccccgugggggaaacugaggcgggaagcggagcgggccgcgcuuccggugccauggcgcgcccagcugcagacuccuggaccagccccggcucggcccggaaagaccgggauugugucucggggcugagcgccgauccgugagagaaggugccaggaaggaagccuguggccuuggccuuggaaucccaagccauaaguuauugaaaguuccuagaaaaagcccccagauaaagaucccgugggcguggcuuucacuaaaagucucagcgugauucuuacugggaaagggugcucgucccccaucucugcagccucugugugagcuggaagcccccgagacacucgugucucaggacaccgcccuccaucucuaaguaaaacugucacagagguggguccugcggacaggacacaccuugucugcuccucuguggaauucggaggcucaggacaccacugucaagcacacaucugaacagucccagagcgccaggcaccaggaaggaaagugccuagcuccaggugcugcugcugccacugccugaccugcucagauugcuuggucuccagaggcacagucuggccauccugcagcuccauuuggugccccugucuccccaggcaagaugccugaugcuuuguaaacagcuggcagaaauaaccacccgagaagagcauggguagccuaacucaaggucuccaaaccuaaaggguggaaauagugagcacucucugucaugcaguugaugcccaccguggggcagacccuguagaggacacugggugaaggugggagacccagaaccacacccaggcccaugcucaaacacacacacacacacaaaacacgcuagcagagcuccccagcuagccuguucuccuagguaaccuacagucuauggugaaugguuucucacuaacuaaaccuuaaaggugcccauggccuucacuugaaauagucugccucaggguuucauucugugugugacaugugcccagggccuguaccuguucaucauggcuccgccugaagggucggcauuuggacacagaacagaaaugggcugaacaggaggacugagcgcacuuggcuaguggcuggggagggggaggcagaagaugucaacuucagacccuuuguuacauuugagccucccagggccugguggccacagcagugacccacagaguucaggcugaucacagccucauccuccugugacugaagaggaugaaagucuccuccucggcacagugggccuuggcuuggggcaggccaguugcaacugcauuguaaggcuggggauguuucuggauguugcuccauaucuuuggguggcagaggccacugcugggcaggguuaccuggcccuuccugaccaugcuggugagcgccuggcagaaggacccgcugaccagccugcacucuugcucucuccccagcaacugaagcagcagagggacaaacugaggcaguaccagaagagggucacgcagcagcuggagagggagcgggcccuggccaggcagcugcugcgggauggcaggaaagaguaaggggcacuuccuuccccgggcuagcaugguguguguguguguggggggggugcuucccuggggcugagccagggccaacucugacaccguggcuuuccccugcagacgagccaagcugcugcucaagaagaagagguaccgggagcaacugcucgauaggacagaaaaccagaucagcagccuggaagccaugguaggcaguggccaggagccuuugcugggaacccgagugcuugggggaugggccuccccagggugggagguggggaacaggucaggcuggugacucccagagcugggguaagagcuuccugguuugucccugcuggcuggagccacugaaaggcagucagcacccuuggaauguccuccaggacauucucaguagaucucagccgccacagcagagaccaggaaggguaggaccaaugacagaagcccgucacucggcugguccagagccaaacagggcuucugaccccuggcugcugcuuucagguucagagcaucgaguucacgcagaucgagaugaaggugauggaggggcuacagguggggaacgaaugucugaauaagaugcaccagguaggucuucguggggccuggugggcgggugggugcagcugcagggcccaggaaaugggagcgaguuugcgccagaucagggccgagucuagcuggaucuggaucgggggauguuccaguaccuggcugugaccagugggaugggaggaagguguggcacagcgugaccuuugagcaggguucacuggugccgagugccagggagugccugccugcccacagagcucaggaagcagcacuggguggugagugggccggccuuuagcugccuucuggguaucugaguagggucuggggugcauuguaucaggccggcaucuguauuguacugacuauagacagaggaagucuagacaccacgcaggaaggauuuccaguuuugaccugguuuacucucaauugucgggguuguucagggccugggaaggucugggcaguggaagacuggucuggcucaacgccaagggcaggcccacuucccuggcuuugcugaaggagagacaggaugaggguguggccuugcugugggcuguccucucccuugcugagcagcucugaaccuucaucaggugauguccauagaggagguggagaggauccuggacgagacccaggaggcaguggaguaccagcggguauguguugcugggcacaggcucacccauuugugaucaccaaguuggcauuuguguggcgauccacugcuucccgggggaacccagaggcccaguuggaaauacccuucacaguccauucauguucccgggggcacccagagcccccccagacacgccccucgauaccucuccuuccacagcaaauugaugagcugcuggccggaaacuucacccaggaggaugaggacgccauccuggaagagcugaaugcaaucacucagguacaguccccagggcugucuuguccccugggggaugggacccuaugggccucugcuugguggugugucccacuguugugucugagcccagaguccugguuucccgauucccuuccuacggugauuccuuuguacggaagccaagcagcuuccacacuccgugcggcgcugagggaucugugcaggagugguuuggagucugacccggcaguuugcugcuggccggcacucgugacccauguguggacugagaggaaaugcugagccuggccugcccagucagcaugcgcuuuccucccccgugacucaguggagucuguucaccucugcacuccaggcccucgggguccugcugcugcggcagcugugucugccccguauccaggcugcgagcucuguagcuaccauacgggcauggccucugcuucccaagguuccccuguguccccagagccaccuccuguccucagcccaggaagacugucugggaaguugcccacuggggccugugacugcccaccuguuagagccaggagcccuaugaggugcugggaggacaggccgccugcgggcgcucacagggccgcucuccaccgcagcccucuaggauugcucccucagugcuccucagcagaagccuccucgcccaggacucagcauagccugaaagccugcuuuccccgugggccucugcaggcccugccuugugagcugacauuccugagaauagcuccaggucuccggggacucugaggacucuugguguagcucagccccuggaguggccugucaccucuaguggucaucuguaaggacgcuguagcucgggggagugcagggccagucaucugagcaggagucuggcggcugcuuugucccucugagagcagcuagugagcagauccagcccuugagagccagggcagccugugacagcacacacccagcucaugccucaccugugcuucuugcaggaacaaauggaguuaccagagguuccgucagagccgcucccugaccgaaacccagguaucgguaucauugcguucugugugugaccguguuggucuaaggaacauacccaaggcucaauacgcugcucaucauaccaugcccacuggcaucucccacagcgcagugggaaagugcuugagccugugccugggucagcagagaguaaguguccagccucugguuggacuuggcuuucucaagggccagaccagcacacagagucacgcugacacaucagccaugggagaaggcuuguccgucauuaaggcccugaagggcuuagauccccuggaacucacagccuuggagagcgcugccccuacaccaucacagucauggcucagaagccuccacacacccuagucaguggauuaaguggacacucaaacucaggguagcuccacaguucccucuguuccuugguggcuucugggagcuccaggcugugccccuggccuguagguccaucucacuuccugccucuauauaacucacauucccugcugugcaugcccuaccccagccccuggccucguccucugaaagcucugugcucaccaugacccauuguuuuuuuccgcagaagccccugccaaggccagauccaggcaggcagagcugguggcggcuucauaaccuggucucuccaggcacucauagggauucucugaggacuggcccacagagccuuuggcugcgagucaacccugagggcucccgggaggccuggagggcuggacuggccagugcaggugcugauggcuggagcagcagcuuacauggaagcugacaucagggcgccuugaaguuuagucuggaugcaccuuugucucuuucuccuucuggacuaaguggauccccggccagccaggcccagcuuuaggcagcuguggaccccaugcuggccgcagcccacuacuccuggugcuguucucaugcugccccagcccaugugagcugcgcucagaccucggggucccugugcuccccucucgugucucugcugcucacaugagcuggugggggcuucagcugagcaguucucgccuugccuggcauccugacaccccucaguuacccugcaggcuaguggcagaaacccuaguguucuccaaaucuguuggagcaucuuugcaccucagaucaccuugagccucuucuguugggggaggugggccaggggccaucccacagaauggacaaaucuaggagcccggcuuggggucuguucgcagaagaaaaacauguugaaggugguaacaagacccuguuuuaaugggcauguaccccauggaguccuggacacacuaagccaccaacgcccaggaggcacggaacucugaacugaccuccagagcccuaugcuuguuucaucacggacaaucucugguccucgggucuuugaggaacaaagggucuuauguacccuuagggccuaccaggaaaggagggcauuucuuccuuacccaaaacaggucaaccucaguauuaaaguugaccccugcauggucuuuggccucuuggacuugag

SEQ ID NO: 6524 - RNA, 2162 nt, Mus musculus
auuuugguuuuuucuuuuuaaagauuuauuuauuuaauguauaugaguacacaguugcugucuucagacacaccagaagagggcauuggaucccauuaugaugugguugcugggaacugaacucaggacuucuggaagagcagucagugcucuuaaccacugagccaucucuccaacccuauucuggcuuuguauucaauuacuccuuuuuuuuuuuuuuuguucgagacaggguuucuccacguagccauggcuguccuggaacucacuuauguagaccaggcuguccucaaacucaagagagcugcuugucucugccuccugaacgcugggauuaauggcucaugccaccaauugcucuuucuagcuuuuccuuucucucucucucucucucucucucucucucucucucucucucucucucucucucaucucuagaagcugcucugccugaugcuggaagaauuugucccuugucugagaucuugcaugggccucaaauuguuuucuaggagagccucuuuaggcagcuugaaguuccuccuugcaugcacagcucuggccuccuggaaucauuguggggucuuucuuggaccucaggucccuaggccuucauucaccacagacaccaccauaaagaacacugccaggugccaguaauccacuuagguguuggagcguucucuuuucucuagucucuuuaauguccauuacuccaggaagaauucucauuaguccuuccaguacagaagccaccaucucuugaaauccuagauuucccuagucucuccuuuuuaccuuuccucugguuuucuuucauauuagggcaguagaccauuuucacccacuuagcguaucaaacagacacaucuccaugcucccuccuccaggcuguugugacuuugcugagucucugaaccucccggugucccgaugauuuuuaucuguaaaacguuaagugcuaauuuugucccaauaaguuggcauucagucuagacagguccuccaauugugacccaaaauccuuccugugcgcaaggaccugaaaauuaacccucaagagcccacuccucaccugaaagguaguccuucucuuucucuccuguuguuccacuagagguuguacccagcaaaugacucuucuaccagcggccacagucacuagucuaagccuggaaccccuaacccagauuguagccccgcccugauucagaccccgccccacgucccgccgucccuccccccacauacuucuuauuggccagaguuacgccuagcuccgccucugggcccacccaaaccacgccuccucgggcauacacaccuacuucuaguuggcuggcgucccgccucaucccgcccuuugauaccgucacuuccugguagaguaggcuccgaaggcggaaguuugggugccggaggcagcgaagcggagcugagguguugcuagcguugccugcggcgcuuccggguucccgcuucacucuggggaggcggaggcgggaaccuggaaccauggcuaugaggcugcugcggagccuggcagggucuggaggcugaccucgcgacgccuguccgcggcccccccugcuucagguuuaggguuaucuagggucgcucuguccuggucccuagacccucaaaaugacggccgccuccaccuccaagugggggcugaucacgaacguggugaacagcaucgugggcgucagcgugcucaccaugccuuucugcuucaagcaggugagucgagggcgcgggggcaucagguugaagugcucguuuggugggaagggggugugagcaccgcgggucgggaagagacccaagcaacguccccgaagcgagucgcgguccggaucugcgcgcucagcgguugcucacacuguacggaaaggcacagagaaggauacguuagcggauugauagugguuuuguugguccuguuuuugacucugaccgacugcauggcacggaagcaugccgguccucggcuucggcuacucaccuuuacucaaggcgauuuaaagcauucguuuggucugaucuguaucaugugucaccgcaguuggaaaagccggcauacaaaaaaguuugguguuauuucuguguugaaugccacaugaaaagauggucauuucuacguggcuuuguugugucug

SEQ ID NO: 6525 - RNA, 2528 nt, Mus musculus
cggccccgcccgcgccgcccccgcgcgcucgcgaccccgggaggcccgguucuugcucgcgggggucucggcgaguggcgugcgugcgaucggcccugcccugccccgggacugccgcguagcagggagggcccgggcugcgccccgaaacugccaagcccggggcgggccgcgccccgaucuggggugagucccguggcccccgccccuaugugaauccugugccccgcacaccccccaggaccuuucucuacaggguccgugugugccuggcuggggacgggcuggagggauucccggggguccggggagcggccaucacaucccagucacgugggagagggucaccaguucuuccacuucagccaugucccuuuauuggaggaggggucgucacgggguugggugucccugggcaucaaagaaggugguggugguggugugagugggcauuguguuaugcuggcuuugcgggacacauuguagggaaacugaggcaggggaagucucccgacuuucaggaugguccagccccgccccccgcgugggucagcuggcgagacuccucuccacugauuaugaaguccgggucaaacugguuuugggcacagaaugcuuaggccuuaguccccuccggacaggcguggggggcgggccggccucgcugcccuucucccggcuguuuggaaacuugucacccuuagcagggucguggcgcugccguccuagauggugccugaagagaaagcuggcacgggaguuaaccggguuuuauuuguaagcuucuggaaugguucauuguggaaugaagcggaggguagcagugaggugagggacuccaaggucacagggcacagagcuugauucgagcagguacggggugccacucccacccuaugcacaggcgcucucaggcagcccugcaaggucagcuccccaucugagacaugaacacaagacccagggggaccaagcagccugcccugcuuaccugcuggccauaaacccgugccaacacucagucaccuuuugugcaacaucaggccuagaaagaagggcgcuggcccugugguuguacagaggugccugucaaaugggagcaccacccaugagggggaugcagggcuggaccuccaggaccccaccaugagccuacaggagcuaacagcuaacuaacacuuguaggugggggugagagucguggggaaaguggaagguuucggugagcacucacaccucugacacgcccauggcuacccaagaaguacugccgggggccuggcccucaaauccgagccuucucuuaagacgccuuugucugcuugugugcagaaggcgcugcgagcacggaacggccauguaaggccggguucccccggcgggggcgccuugucccgccgcgggaccaaggugcaacucaggugugcgggugggggcaggggcggcgggcggcgcgcggccauauuuggcgauuucgacccgcgcuccgcccgccgccgggaggccaguggccgcccugagucacgggggcggacguaacggacggggcgccgggccgcgcuccucgccuuauuuagucaagcaggcuacccauuggcccgcaggacaaaggcgguuccggccggugcgcgcggagacccucgccugugcgcuugggauccgagacgcagcccucccuggggacgcgggggagggguagccccagccccgccggagcggagccgcagcccggccuccuaacgcggugcacgagaaggaggcgcugugauuugucaguuuugcaacugggcagugugagggaggccucgcccaaggucagguccgggcuguucuugccugcuguggaaguuggcggccccaccccacuuggagcaggaauugagaaugccuggcuuccgugagccugcaggccagggcugcaggcucacgauugcagggcugccagaagugggcgugucuccguuguaaagaaagacucagucuagagaaaugauaaaaaacauuuuuccuuugcuggcuuuggucggcuuuuauugugacguuguugcaucuuauuucauauuccgguggauuaaugcagcaguugaagaguuggggagauuuacugcaggcuggcuccauccgacacccucccagguggucacugcaaccugucacuuccuucucccugcggccacuuuggauuccccggagaguccggucaccucugugcuugguaccuggauccuccagcaaggcuccgcccaccaaggcacuucauacucacuuucuccuuguuaggcaacgggaacgagaaacauggucuccacuguuccugcccucaggggugucaaccuaaccuuagaacagaagagagugaaaaggccgggagcaucaggccagguuuggaauguaugccaagguuacccucaguaagggagcugacguuacaguguaaugagugaacuccucugaugucuuugaaacuuuuaaguaaaccuaaaagcccagaauaaaaagggaacuguaaaagucugaggagcucaacg

SEQ ID NO: 6526 - RNA, 1681 nt, Mus musculus
gggcuguccagacuugaaggggcugacugccaggcaagagccaccacugcucugaugaaccacccaugcuaccaacugccacugucugcagcguggcaggaaagucucaggcacugagguuugcuucugaggagaaaugaugguggccuccugcccaauaaaccacccaagaggggcugcacugaaggaggaaggagcagagguaaaucucucacucccaucugugcaguuuuaucuuuaaaaaacaauaaauaaaaguuuccugggugggaauuauugauaacugcugauuucaggcaaguaaaggucagggaccuacuauacugcaugucagacaaaggcugccacacccuagccacacaugcucccaaaggagggacacagccccacagcaagggaacagagacagccaggaacauucauccgaacacugggggagaaggugggaaggcagaaaacaaagaucauagaggaaggagagauagcugggugacagcagcacccucucuguacaccccaauuucaggugauuggcuggacguguucagucccuccaacacgugaggcguguggggagcucuugggcaggucugcucugccuucccaggugggaggcucuguucaaccccagcacagcagccgagguucuuucucuucaagaucugcacggagacgcuucaggguaucuggaauaccagggcagcuggccccacuguuucagggcugugggcuucaggccuuauagggaacauguggcgcuccagacuucagagggcugggcuggcccagucccaugcagcagaggcccagagcccuagguccgggggaggcugcacaucucgcaguggccugugccagguugguucaugaaggugcagugcugacaggcccacauggcagagguagcagcgcgugcagagcccccgacugcaccaaacucguggaggccugggagcugcacaccaacggugccuguaggguaaagugagaacacgucaugccugcacagaaaaagacaucuccuuagagccagauggcagggcaggguggcucaaagccccuacugcguaagcccaaacugucagcacaucaaguguucuggcuccagucagcaaacaccuuccuacuugcacuugaagucugcucccuguugcuagguauuucugcgggaaccucacaccccguagugagcaucugcauagauucacucucacacaaacucugggagcuuucuuuguaucuuccuuuacccugguaaagauucaacauugagacggcuacgucccaguucaaauaccacacccacucccaaguagaguucaaguccaaccugccccaugcucuccacagugcuugauacugucagguucguuugguuuugguuuuuuucauuuuagcacucugaugagcaugcaguggugucucaugcuuucccugccauguccuugaagaaugauaguauauuccuacaucuucuuuugcaaacuguuaguaaauccagcuaaagcagccacccaugucugucccuuugcccaagcacuccaaggaggcaccugggccagagggccaguauuuaaaugacagagcucaugcccuauauuuugacuaugacccuugguggaagggaaucgagaacacuuacugcauaacugcucaaugguggcccacuguucagacuuuu

SEQ ID NO: 6527 - RNA, 1681 nt, Mus musculus
aaaagucugaacagugggccaccauugagcaguuaugcaguaaguguucucgauucccuuccaccaagggucauagucaaaauauagggcaugagcucugucauuuaaauacuggcccucuggcccaggugccuccuuggagugcuugggcaaagggacagacauggguggcugcuuuagcuggauuuacuaacaguuugcaaaagaagauguaggaauauacuaucauucuucaaggacauggcagggaaagcaugagacaccacugcaugcucaucagagugcuaaaaugaaaaaaaccaaaaccaaacgaaccugacaguaucaagcacuguggagagcauggggcagguuggacuugaacucuacuugggagugggugugguauuugaacugggacguagccgucucaauguugaaucuuuaccaggguaaaggaagauacaaagaaagcucccagaguuugugugagagugaaucuaugcagaugcucacuacggggugugagguucccgcagaaauaccuagcaacagggagcagacuucaagugcaaguaggaagguguuugcugacuggagccagaacacuugaugugcugacaguuugggcuuacgcaguaggggcuuugagccacccugcccugccaucuggcucuaaggagaugucuuuuucugugcaggcaugacguguucucacuuuacccuacaggcaccguuggugugcagcucccaggccuccacgaguuuggugcagucgggggcucugcacgcgcugcuaccucugccaugugggccugucagcacugcaccuucaugaaccaaccuggcacaggccacugcgagaugugcagccucccccggaccuagggcucugggccucugcugcaugggacugggccagcccagcccucugaagucuggagcgccacauguucccuauaaggccugaagcccacagcccugaaacaguggggccagcugcccugguauuccagauacccugaagcgucuccgugcagaucuugaagagaaagaaccucggcugcugugcugggguugaacagagccucccaccugggaaggcagagcagaccugcccaagagcuccccacacgccucacguguuggagggacugaacacguccagccaaucaccugaaauugggguguacagagagggugcugcugucacccagcuaucucuccuuccucuaugaucuuuguuuucugccuucccaccuucucccccaguguucggaugaauguuccuggcugucucuguucccuugcuguggggcugugucccuccuuugggagcauguguggcuaggguguggcagccuuugucugacaugcaguauaguaggucccugaccuuuacuugccugaaaucagcaguuaucaauaauucccacccaggaaacuuuuauuuauuguuuuuuaaagauaaaacugcacagaugggagugagagauuuaccucugcuccuuccuccuucagugcagccccucuugggugguuuauugggcaggaggccaccaucauuucuccucagaagcaaaccucagugccugagacuuuccugccacgcugcagacaguggcaguugguagcaugggugguucaucagagcagugguggcucuugccuggcagucagccccuucaagucuggacagccc

SEQ ID NO: 6528 - RNA, 7969 nt, Mus musculus
uguaagugggcggaaauagcuucgugcaggacgcgccugggguagucauggcgaggccugggaacauagcacugguuacugcgcggucggccggucuuagaggcucgggacagccgcaggggcggcggcagcagcaggcucaaggacagcagcgcucggccucacugcccggacagcgcagguaggugccaaccccgggagaggacccauuugggaacuuuccugcgucccucagcccaggccauguguugaaugaacggaggugagugucuccaguuucucgugagccacguucgggggaugaggucagagcugccagccucccugggcucuagagcgccuuuugccucagcgugcagagaaaaaugcacuugaaggcagccugggucgagggugaggggaggaccguguguucuuggccccggaaccguuucuuuacgggguuaauuccuacuauguguccggcuguguuguacaugggaagggucacacuccgccuggguuuccuuuccagcaaagaaaagaagaaagugaauugcaagccuaagaaccaggaugagcaagaaaucccuuuucggcuccgagaaauuaugaggagccgacaggagaugaaaaagacgcuaaguaacaagaagagaaaaaaggaggguauguacagccauugcugugugccaccauaucugcacccauccagucgcccaaauucugaaaggcguuugaggcacagggacuacaccaagacccgguacugggagugcaggguaugggaaagacagcacagggcugauuuuacagcagugcuuuuauaauuuauauaaaaguacuuggacuuuugaaguucucucucuuuuuuuuaagguuuauuuuaugcauaugaauacaccauugcucucuccagacauaucagaagagaccaucaacucccauuacagaugcuugugagcccaugugguucccaugugguugcugggaauugaacuuaggaccucuggaagagcagucggugcucuuaaccucugagucaucucuccagcccccuuuuuugguuuuucgagacaggguuuguuuugcuuuuuucaagacaggguuucucuguauagcccuggcuauccuggaacucacucuguagaccaggcuggccuugaacucagaaauccgccugccucugccucccgagugcugggauuaaaggcaugggccaccucugcccagcugagguuuuauuuucauuuauguauaugcaagugugacugguguagaggggugcaugugcaauugcuauuggaggccaugagggggcguuggaucccauggaauuauccuaaacguggaguuaaaggccuuccugcccagugugguugcuggggagccaaacucagguccuuaaggaauacauuuuuuaaaguuuauuuccauuuuuuacaugccuugugguuugccugcaugcaugucugugugagugucagaccuugaacugccaugugguugcugggauuugaacucugguccuuuggaagaacacucagugcucucaacuguggagucaucucuccagcccuuggaguacauggucucuccagccacauugguguguuuuggguuuuucugauagguuauuucuagguagcccuguuggccucaaaaucaauuuaccuccaccuccugguuguugagauuauggguaugugcugcuaugaucgacacugcuuugguuucuuuguuugccuguguggcacuggacaucuuugacaggagccgguaggucuugacaucacauuuggggcuccucugaacugaauauuuuagcuuucucucugucugucauuaagccuugucguccccucuuuuggcuguaggagggaaauggucccaggcugcuuaccugucaccaacccuucuucccgagcuuccucuacaccuacucuggguguccuuucuccucagcccagguggcuuucaagaagacguuggaaaaggaagcgaagggggaggagccagacaucgcuguccccaaguucaagcaaaggaagggggagucugauguggccuacguccagcgcauggagcaggaggcccagcacgugcuguuucuuagcaagaaccaggccccucggcagccagaggugcaggcagcucccaagaaggagaagucugagcgcaagaaagcgugaguugagcggaggccccccgagguuccaggcugugggucuggugacuguguccucuggugauagcgcuucaggagucagccuguccgucccaccugaugacuauggagaaucaugagcugaagccaugaucagcauagcuucuuuuugagacaggguuucucuguauagcccuggcugucuuggaacucacuuuguagaccaggcuggccucgaacucagagauccaccugccucugccuccugagugcuggaauuaaaggugugcgccaccacgcccggccuagaauagcuuuuuuuuuuggggggggggggguuagggguuuuuuuuuuuuuuuuuuuuuuggguuuucgagacaggguuucucuguauagcccuggcuguccuggaacucacuuuguagaccaggcuggccucgaacucagagauccaccugccucugccuccugagugcugggauuaaaggcgugugccaccacggcuggcuccagaauagcuucuuaacaccggaagcuggaacccaaucggugggaagcuggagcccagucaguacuccacacaccauacuuccauuguguuuacuuggcuccucuggagacagcacuggagggucuaagaacaggacaggaaggggcacugcugcaggagaguggagaaagauaggcuugguugugugcuacaggagagcuugcugggugucauggcaucguauccucuagggaauaacccuguggcaugacccguguggggcugacacgcagccugccacucgcacugcagugggguugucaccacuguuccucuugaucugaaagggauuugaguuuauguuguuugugcagggucugugccuucuuggccugguguucuugacuguaaagaggaggugaugucauuuucaugaugcucaggugugcucuuguauuauccacgggggugguguccccaccgugagcuuggcuucccaucagucaccuccuccugcucaggccaccccuggcuugggcccagauagagagguaguuuuguccaaaagaaaaaaaugugugugugcaugcauuauacauguauauacauguauauauauguauauguguguguguauacaaagaggugugaugugccacucacggugccucacaccugacccucacuugggcugggguguguuaucccaguuaaacagcccacgguuaccuuccagcagcaugcccgugcucgauacacaccacuuagcugcauccuugcugacccucccaaaauaucuaggcuuuuuguucccugggucugaggaaugcugacuggggacccuuggagagcccguuggaugcagaguguggguuugcaucccagccccgcaguuuggaacccuccaggacaggcugaccucugcugucccuaaaauggaccaagagcucaggaaucuggaaaacuugugcuucuccccagguuccagaagcgacgacuggaaaaggcccagaggaaaagggaagcaagagccguggacagauuggagcaggagcuacugaaagguagcucuucccguagcaggcgcggaagcugugguccccacagggcugggccugggcuucccacuauaccucugggugggcccuauggacucccaggcucaccaccacuaguaggccaguggaugagugaguucugaagccuucaagaaagggaggguggaugggcgagucagaaacaacaugggcuucuguucacugucucuccagauacugugaaguuuggagaaguuguguugcagcccccagagcugacaguucagcccaggaggagcacaagcagagaugcuguauguggugaccagggaaugcagagaggguguggucugcagggucuucccuugcuggggagcaaaaguguccuggcccaggaccuucuaaggggcccuuagcugcuggagcagccagaacccuuuacccccuuccuuuccagcugagccugugcuacagccuucucucucuuccucagccuggcaagaaaucacuaaugcugaagaagaugcuguuggguccugguggcggguccccggcuccagccaccucacuggcccgccagcggauccugggggaagagcgggaacgggcugugcaggcuuacagagcccugaagaagcugcauagacaggaaaugacaccugcacagccaccaggcagcucuuuccagaggcagggccacgcuugucugugaugcagagacccaggggccugauccccuggaaacuggucugggagcugcuagaccuggguaagggagaggcagcggaugcucuccuugcauaggguccugagaguaagcuuucagguuuggaagagugcuuuuccuuccucugaagguuguccuuauaagagugaccaccaugguaucccaucucauacagggcaaacccccgcaucccagcacuugccugagacacagcuggaagggcugguauuuuccuugagccuaaguucauucugaaacaagucucggcugagacaagccaggaccacuguagaauggacucaaucccuuaauccagccaauuacugaagcugcugguguaggucagccuacaccaauguuuuaagaagcucccaugggcuuacugcaaccuuuggaaggcagggacagacagcaaagcagguuagugggcugguggaagggcaagugggggcggcaaucagcacuuuuuuuuuauuugccugcaggguucuguacaaaugaccagaacucccagcccacucuugguuuggauagagaggggguuucaguacugacugagugccuugagguauacacaugaaaaccagguuucaaugguugacagaguagaguauuuauaccaagaggguagaggcgaaagaauuggguguucaaagccagucuugacuugaagcaaauguauggccugccugaacagguugagagagucucaaaaaccuuacuuagacaucaaaagagcgaagcuuggacccugcuggggaagcccacaguccucuagcagaccuaggagccuccguccagcaaagcugguccuggagccuaguggagugcuccaaaugugcauuuuccagagugaaguuuauuaaaguuuugcucuuugaagucugggccguugcucuccaacaugcuuauccacggcccuagucaaugcgugucaaugugacaagaugagugagugugcagacacacacccaacaguagcaagggccagaauagagcagggugcaucggccacuugacuuuccacugcacaucaggacuagggccagggcccaggagccaccauuaucagaguauguaggcuucugaguucuuuagaagcaauguggccacacauccaaagcucaacugugcgcuacaucaaaugacucuggguaauuaucccucagagcccaugccuauaugugccugugccuauaugugcuugacuccucccacuuucuguaauguuuauuaaagaugcccacacccaugcauucagggauuguuuucugagugcugcuuuuucacaaaauaucccagcuaaauggauguuuuccugcugugcuuaagccaucucagauugaccuuggccagaacgauguguggagccaccugucuggcuuccccauuccucacuucugguauggaagauguggcugcucuuguucccugcccacuccaaggucaggucuggucucugcugccaucuuggaguccugacccucagaacacuaaauauuggcagguaagcuggagccuguccaccauuauaucauuacugaauaauuggugauucauauagacacauagguacauauaugucuucauguguguaaaggucuucaugguguaaggggcaggagacauaagggcuuccccagcccucuccacuuuguccugguugaaaaucaggcacccugauguacugcucugcugcagguuuuuccucagcagaugagccuagaagauuaucaugcugaugcaccugacaagcuaucccaguagaauguuaccaccuccugugugccuucucuuguccacuugugggaccucauauaccccuguacaugagaaauaaaaguuuauugaauaaauccaucaaugagaacauucuuguuucuggugaggucacaaccacacucccccucccccagaguuuuggcuuuuuguuuuuuggguuuuuuuuuuuuuuuuuuuugagacaguuucucacugugccagccagaucuugagauucuccugccugacuucuaagugcugggauuagagaaaugcucuaccacacccgucccgcucacccccaucucuaugaaaagcucagcucuugagcuuaagaugauccuuuugccuuugucucucgaguagcucaagcuacaggcacgugccaccacauccugccuacuuuuucccauuugagacacaacucuauuuuuucuuuaaaauuaauuuuccguauaugagugcuguaucugcauguacaccugcaagccagaagagcacaucagaucucaguauggccaccauaugguugcugggaguacaauucaguaccucuagaagcagacagcucucaagugcugcgccaucucuccaggccaagacaauucuuuuuuuuuuuuuuaaauuauauuuuauguauaugaguacacuguagcuguauagaugauugugagccaucaugugguugcugggaauugaacucaaccucugcucacuacuguagcugucuuuagacacuccagaagagugagucagcucucauuacagagggcugugggccaccaugcgguugcugggauuugaauucaggaucuucugaagagaagccagugcucuuacccacugagccaucucaccccuccccaacuucccaaauuuuuuuuugguuuucgagacaggguuucucuguguagcucuggcuguccuggaacucacuuuguagacgaggcuggccucgaacucugaaauccaccugccucugccucccgaguacugggauuaaaggcaugugccaccaugcccggcccacuucccaauucuucauuaacuuuauauuuuuuucugggcaacauggucaggauauaggaacucagaaaggcagagucuguacuauaaaaaugaccugggcuccgugcaguccaaagcccucaguggguccaacuucuuggugggagacgugaagacaccugcaguuuguucugucuugggaccauuguucagaagugagaugacagugguguuuguaaguguaugcuuguuuacuggucacagcacagcccccaucacuugcagauacacuggguggccugcuccuaucaaacaccucaggcucucaugcauuugccuccuaggcacuggguggggucagccauacuucuccaucuugcugucaacugcugugccuguguugauucuggagccagagcaauacuguugccaagccagugccauuccuggcacuuauuucuacugcggugauguuuugcuuggcacaagcaaugaugucuggaagccucaucaaugacuucauuuccuccauggucauguaacaggguaggucacuguaguugaagaagcacuucgucaaaguggugcucgccacaaaguuguucuacccacagcugcaccuccccgcugcagacccuauggucuuggcuguacucaaguagagcaaccccuugggauaccuugcccuucauccugcccagcccuuagacccauacauuuuauugaagaguaugaggacggaggcuuuuucaaguucuucugcagaaaggagacccaggagcugcaugcaggaugcaga

SEQ ID NO: 6529 - RNA, 7969 nt, Mus musculus
ucugcauccugcaugcagcuccugggucuccuuucugcagaagaacuugaaaaagccuccguccucauacucuucaauaaaauguaugggucuaagggcugggcaggaugaagggcaagguaucccaagggguugcucuacuugaguacagccaagaccauagggucugcagcggggaggugcagcuguggguagaacaacuuuguggcgagcaccacuuugacgaagugcuucuucaacuacagugaccuacccuguuacaugaccauggaggaaaugaagucauugaugaggcuuccagacaucauugcuugugccaagcaaaacaucaccgcaguagaaauaagugccaggaauggcacuggcuuggcaacaguauugcucuggcuccagaaucaacacaggcacagcaguugacagcaagauggagaaguauggcugaccccacccagugccuaggaggcaaaugcaugagagccugagguguuugauaggagcaggccacccaguguaucugcaagugaugggggcugugcugugaccaguaaacaagcauacacuuacaaacaccacugucaucucacuucugaacaauggucccaagacagaacaaacugcaggugucuucacgucucccaccaagaaguuggacccacugagggcuuuggacugcacggagcccaggucauuuuuauaguacagacucugccuuucugaguuccuauauccugaccauguugcccagaaaaaaauauaaaguuaaugaagaauugggaagugggccgggcaugguggcacaugccuuuaaucccaguacucgggaggcagaggcagguggauuucagaguucgaggccagccucgucuacaaagugaguuccaggacagccagagcuacacagagaaacccugucucgaaaaccaaaaaaaaauuugggaaguuggggaggggugagauggcucaguggguaagagcacuggcuucucuucagaagauccugaauucaaaucccagcaaccgcaugguggcccacagcccucuguaaugagagcugacucacucuucuggagugucuaaagacagcuacaguagugagcagagguugaguucaauucccagcaaccacaugauggcucacaaucaucuauacagcuacaguguacucauauacauaaaauauaauuuaaaaaaaaaaaaaagaauugucuuggccuggagagauggcgcagcacuugagagcugucugcuucuagagguacugaauuguacucccagcaaccauaugguggccauacugagaucugaugugcucuucuggcuugcagguguacaugcagauacagcacucauauacggaaaauuaauuuuaaagaaaaaauagaguugugucucaaaugggaaaaaguaggcaggaugugguggcacgugccuguagcuugagcuacucgagagacaaaggcaaaaggaucaucuuaagcucaagagcugagcuuuucauagagaugggggugagcgggacgggugugguagagcauuucucuaaucccagcacuuagaagucaggcaggagaaucucaagaucuggcuggcacagugagaaacugucucaaaaaaaaaaaaaaaaaaaacccaaaaaacaaaaagccaaaacucugggggagggggagugugguugugaccucaccagaaacaagaauguucucauugauggauuuauucaauaaacuuuuauuucucauguacagggguauaugaggucccacaaguggacaagagaaggcacacaggaggugguaacauucuacugggauagcuugucaggugcaucagcaugauaaucuucuaggcucaucugcugaggaaaaaccugcagcagagcaguacaucagggugccugauuuucaaccaggacaaaguggagagggcuggggaagcccuuaugucuccugccccuuacaccaugaagaccuuuacacacaugaagacauauauguaccuaugugucuauaugaaucaccaauuauucaguaaugauauaaugguggacaggcuccagcuuaccugccaauauuuaguguucugagggucaggacuccaagauggcagcagagaccagaccugaccuuggagugggcagggaacaagagcagccacaucuuccauaccagaagugaggaauggggaagccagacagguggcuccacacaucguucuggccaaggucaaucugagauggcuuaagcacagcaggaaaacauccauuuagcugggauauuuugugaaaaagcagcacucagaaaacaaucccugaaugcaugggugugggcaucuuuaauaaacauuacagaaagugggaggagucaagcacauauaggcacaggcacauauaggcaugggcucugagggauaauuacccagagucauuugauguagcgcacaguugagcuuuggauguguggccacauugcuucuaaagaacucagaagccuacauacucugauaaugguggcuccugggcccuggcccuaguccugaugugcaguggaaagucaaguggccgaugcacccugcucuauucuggcccuugcuacuguugggugugugucugcacacucacucaucuugucacauugacacgcauugacuagggccguggauaagcauguuggagagcaacggcccagacuucaaagagcaaaacuuuaauaaacuucacucuggaaaaugcacauuuggagcacuccacuaggcuccaggaccagcuuugcuggacggaggcuccuaggucugcuagaggacugugggcuuccccagcaggguccaagcuucgcucuuuugaugucuaaguaagguuuuugagacucucucaaccuguucaggcaggccauacauuugcuucaagucaagacuggcuuugaacacccaauucuuucgccucuacccucuugguauaaauacucuacucugucaaccauugaaaccugguuuucauguguauaccucaaggcacucagucaguacugaaacccccucucuauccaaaccaagagugggcugggaguucuggucauuuguacagaacccugcaggcaaauaaaaaaaaagugcugauugccgcccccacuugcccuuccaccagcccacuaaccugcuuugcugucugucccugccuuccaaagguugcaguaagcccaugggagcuucuuaaaacauugguguaggcugaccuacaccagcagcuucaguaauuggcuggauuaagggauugaguccauucuacagugguccuggcuugucucagccgagacuuguuucagaaugaacuuaggcucaaggaaaauaccagcccuuccagcugugucucaggcaagugcugggaugcggggguuugcccuguaugagaugggauaccaugguggucacucuuauaaggacaaccuucagaggaaggaaaagcacucuuccaaaccugaaagcuuacucucaggacccuaugcaaggagagcauccgcugccucucccuuacccaggucuagcagcucccagaccaguuuccaggggaucaggccccugggucucugcaucacagacaagcguggcccugccucuggaaagagcugccugguggcugugcaggugucauuuccugucuaugcagcuucuucagggcucuguaagccugcacagcccguucccgcucuucccccaggauccgcuggcgggccagugagguggcuggagccggggacccgccaccaggacccaacagcaucuucuucagcauuagugauuucuugccaggcugaggaagagagagaaggcuguagcacaggcucagcuggaaaggaaggggguaaaggguucuggcugcuccagcagcuaagggccccuuagaagguccugggccaggacacuuuugcuccccagcaagggaagacccugcagaccacacccucucugcauucccuggucaccacauacagcaucucugcuugugcuccuccugggcugaacugucagcucugggggcugcaacacaacuucuccaaacuucacaguaucuggagagacagugaacagaagcccauguuguuucugacucgcccauccacccucccuuucuugaaggcuucagaacucacucauccacuggccuacuagugguggugagccugggaguccauagggcccacccagagguauagugggaagcccaggcccagcccuguggggaccacagcuuccgcgccugcuacgggaagagcuaccuuucaguagcuccugcuccaaucuguccacggcucuugcuucccuuuuccucugggccuuuuccagucgucgcuucuggaaccuggggagaagcacaaguuuuccagauuccugagcucuugguccauuuuagggacagcagaggucagccuguccuggaggguuccaaacugcggggcugggaugcaaacccacacucugcauccaacgggcucuccaaggguccccagucagcauuccucagacccagggaacaaaaagccuagauauuuugggagggucagcaaggaugcagcuaagugguguguaucgagcacgggcaugcugcuggaagguaaccgugggcuguuuaacugggauaacacaccccagcccaagugagggucaggugugaggcaccgugaguggcacaucacaccucuuuguauacacacacacauauacauauauauacauguauauacauguauaaugcaugcacacacacauuuuuuucuuuuggacaaaacuaccucucuaucugggcccaagccagggguggccugagcaggaggaggugacugaugggaagccaagcucacgguggggacaccacccccguggauaauacaagagcacaccugagcaucaugaaaaugacaucaccuccucuuuacagucaagaacaccaggccaagaaggcacagacccugcacaaacaacauaaacucaaaucccuuucagaucaagaggaacaguggugacaaccccacugcagugcgaguggcaggcugcgugucagccccacacgggucaugccacaggguuauucccuagaggauacgaugccaugacacccagcaagcucuccuguagcacacaaccaagccuaucuuucuccacucuccugcagcagugccccuuccuguccuguucuuagacccuccagugcugucuccagaggagccaaguaaacacaauggaaguaugguguguggaguacugacugggcuccagcuucccaccgauuggguuccagcuuccgguguuaagaagcuauucuggagccagccgugguggcacacgccuuuaaucccagcacucaggaggcagaggcagguggaucucugaguucgaggccagccuggucuacaaagugaguuccaggacagccagggcuauacagagaaacccugucucgaaaacccaaaaaaaaaaaaaaaaaaaaaaccccuaacccccccccccccaaaaaaaaaagcuauucuaggccgggcgugguggcgcacaccuuuaauuccagcacucaggaggcagaggcagguggaucucugaguucgaggccagccuggucuacaaagugaguuccaagacagccagggcuauacagagaaacccugucucaaaaagaagcuaugcugaucauggcuucagcucaugauucuccauagucaucaggugggacggacaggcugacuccugaagcgcuaucaccagaggacacagucaccagacccacagccuggaaccucggggggccuccgcucaacucacgcuuucuugcgcucagacuucuccuucuugggagcugccugcaccucuggcugccgaggggccugguucuugcuaagaaacagcacgugcugggccuccugcuccaugcgcuggacguaggccacaucagacucccccuuccuuugcuugaacuuggggacagcgaugucuggcuccucccccuucgcuuccuuuuccaacgucuucuugaaagccaccugggcugaggagaaaggacacccagaguagguguagaggaagcucgggaagaaggguuggugacagguaagcagccugggaccauuucccuccuacagccaaaagaggggacgacaaggcuuaaugacagacagagagaaagcuaaaauauucaguucagaggagccccaaaugugaugucaagaccuaccggcuccugucaaagauguccagugccacacaggcaaacaaagaaaccaaagcagugucgaucauagcagcacauacccauaaucucaacaaccaggagguggagguaaauugauuuugaggccaacagggcuaccuagaaauaaccuaucagaaaaacccaaaacacaccaauguggcuggagagaccauguacuccaagggcuggagagaugacuccacaguugagagcacugaguguucuuccaaaggaccagaguucaaaucccagcaaccacauggcaguucaaggucugacacucacacagacaugcaugcaggcaaaccacaaggcauguaaaaaauggaaauaaacuuuaaaaaauguauuccuuaaggaccugaguuuggcuccccagcaaccacacugggcaggaaggccuuuaacuccacguuuaggauaauuccaugggauccaacgcccccucauggccuccaauagcaauugcacaugcaccccucuacaccagucacacuugcauauacauaaaugaaaauaaaaccucagcugggcagagguggcccaugccuuuaaucccagcacucgggaggcagaggcaggcggauuucugaguucaaggccagccuggucuacagagugaguuccaggauagccagggcuauacagagaaacccugucuugaaaaaagcaaaacaaacccugucucgaaaaaccaaaaaagggggcuggagagaugacucagagguuaagagcaccgacugcucuuccagagguccuaaguucaauucccagcaaccacaugggaaccacaugggcucacaagcaucuguaaugggaguugauggucucuucugauaugucuggagagagcaaugguguauucauaugcauaaaauaaaccuuaaaaaaaagagagagaacuucaaaaguccaaguacuuuuauauaaauuauaaaagcacugcuguaaaaucagcccugugcugucuuucccauacccugcacucccaguaccgggucuugguguagucccugugccucaaacgccuuucagaauuugggcgacuggaugggugcagauaugguggcacacagcaauggcuguacauacccuccuuuuuucucuucuuguuacuuagcgucuuuuucaucuccugucggcuccucauaauuucucggagccgaaaagggauuucuugcucauccugguucuuaggcuugcaauucacuuucuucuuuucuuugcuggaaaggaaacccaggcggagugugacccuucccauguacaacacagccggacacauaguaggaauuaaccccguaaagaaacgguuccggggccaagaacacacgguccuccccucacccucgacccaggcugccuucaagugcauuuuucucugcacgcugaggcaaaaggcgcucuagagcccagggaggcuggcagcucugaccucaucccccgaacguggcucacgagaaacuggagacacucaccuccguucauucaacacauggccugggcugagggacgcaggaaaguucccaaauggguccucucccgggguuggcaccuaccugcgcuguccgggcagugaggccgagcgcugcuguccuugagccugcugcugccgccgccccugcggcugucccgagccucuaagaccggccgaccgcgcaguaaccagugcuauguucccaggccucgccaugacuaccccaggcgcguccugcacgaagcuauuuccgcccacuuaca

SEQ ID NO: 6530 - RNA, 13338 nt, Mus musculus
agggguccgggacuccgcccacugccacguucgacggagaaucgggcuggguacgcgcaucucuccaccaaucaggagccacgaggccgggcagcggaaagccgcagccauuccagacguguggaaggcgugggaaaagucgccagucagaaguccagaaagagaaaguuggcuuucgccagcgaaucagacgcugggggacauuggguuugugcgcgcgcgcgcgcgccguggccaaucccaggcaagaaccgaaaggccuccgggucuuugucgacuugguggcccagccuugaguggguguccaguccccgcacggcgagggcgggucucucagcuccuuggccaaucggagggcgcggcggggcgcaugcgcacggcggcugacgcgcgcagcgagggggaggcgugggcgcguccccggcccaggauuuauaaaggcgaggucuggaccgacgcgcgcucucgucgccuuggcugucccggcggcgccaacccaacugccccgcccgcugcagacguccgacaugcugagccgugcuuugcugugccuagcccuggccugggcggcuagggugggcgccgacgcccuggaggaggaggacaacguccugguguugaagaagagcaacuucgaggaggcgcuggcggcgcacaaguaccugcugguggaguucugugagugcgccgugggccugggcggggggggaagggccccuuguccacggacuccuccgggccgcccucugcggcacccagcacuguccugcgcggccggccccucuugaguacgguggcccguagcccucagcuugccccacggaacacggacuggccgguccagagcugcaccucgcggguagcaccuacuguaagcuucucugcuuccaguugucccaagagcauccuuccuacccaaaguagaagucguuguagucagagcucauugagggggacugcgggauugagaaucaagaagguaucuuugugcacgacguccacauggccagaaccuucuguuagcugggaaaaacagagugggcugugugagcaguuagcaguuccgauagaguagaucaaacgcucuuuacuaugcccacccuaccuguaacuugccguauaccgggaagcaagccagaucuaagccuuuacuucugcuuacaagugugugagcuccaacacagcugccagguugccuugacagauugucacauucccauaguagaaagaacagcuuuggauaggcaucuggacacguacuugcuacauauagugcuggcccagcaaccuuuuaacuuuuccuagauucugagugguaaaccccagguauacacugacccugauugcugggggcaguacgaaguuacaagucaaggaugauuuuacagugcugguggucacagggcaaaguagggauugggguugguuugucacucguggccucuguccucauauugcccaagagcaccagcuaucagugcagucucuugacugcauuaagagggguuaucuugguaugcugauaagguuuuuaugaaaggaaguacaaagggaagaaauagaccuggauagaggacuaccuuccaauguccugguuucuuuuacagaugccccgugguguggccacugcaaagcucuggcucccgaguaugccaaagcugccgcaaaacugaaggcagaaggcucugagauucgacuagcaaagguggaugccacagaagagucugaccuggcucagcaguaugguguccguggcuaccccacaaucaaguucuucaagaauggagacacagccuccccaaaggaauauacaggugugacccuagaacugcccuuuaauaacuguguaggcuuugggagcaaacccacaggugggggaaaaaaggcagggagaggcccuguucucaaguggguucuauaucaacucuugcaugugggagcuggggaaaguuccuccuuuggaguacuucacaggaagugucacaucugugaugaccugaguagccugcuggcugaguuaucuggugauugaccaaugaggaggaggaggcaagugcuuugcucaacacacggggcuuugaacuauuggugcuuccaggaaugcagugcuuccagauaguguaggcgugacacuugggugacgcuuuguagcugucacucacagggugucaguaccaggccagguauucaugauucucacugcauuuguaccuuugggaaccuuucauaguuacagcauucuaguuguuggugacuaaaugcaaauccagguggaucacccagccaccgcuaaaggaauuuuuguggagccuggaccuugauauaggcaauucaguuaguuacuacaagcaaaagacuugggcuucagcuggaggcgguggcacagaccuuuaauccucccguuuggggguagaggcugguggaucucuuuaguuugaggcuagccugguauauagagauacauacauacauauacucaugcagacauacacacucacauaugucauauaaaguaucuauauaucuccccuugagagcaguagugugccacucuagucaccuuccuaggcuaucugugguccuuuuuaauaugacuucacuauuggaguagaaaguuccuguccaccaggcagugguggcacacacccuuagucccauuacuugggaggcagaagcaggcagaacucucgaggccagccugcucuacugcucuacagaucaacuuucaaaacagccaaagcuacacagaaaacccugucaauuaaauuaaaaacaaaaacaagucgggcguuguggcgcacgccuuuaaucccagcauuggggaggcagaggcaggcguauuucugaguucgaggccagccuggucuacaaagugagcuccaggacagccagagcuaugcagagaaacccugucucgaaaaacaaaaacaaaaaccaccaaggcucuuugcccagaccuugcuguacuggcucgcuugugagcagcagcugggaaacagaggugugagcaucguccaagugugaggccauccuggugugggucucagccaccugggucugcagaguaagaccucaucugaaaagcacgcaguuugaucggcagagcacuugccuaacaugaagacgcaauuacagucacuaccacuuuauaaacuggguacggugguguuguguuuaaucuggguuuguguaugugugcaugcgcacaccugaagcauaguguauacuuguuuaucuugugcauucuuccagaagaguauguuggaucuccuagaacuuacaggcaguugugggucaccuaagguaggugcuggcaaccagacccagguccuuuuagaagaguagcaaguguucuuaagcuauugagccaucucuccggcccccuguccccaguggaaaauuuauuuauuuauuuauuuugguuuuucgagaaggguuucucuguguagcccuggcuguccugaaacucacucuguagaacaggcuggccuugaacucagaaaucugccugccucugccucccaagugcugggauuuuuuuuuaaagauuuauucauuauuuauuauauguaaguacacuguagcugucuucagacacaccagaagagggcaucagaucucauuacggaugguugugagucaccaugugguugcugggauuugaacucuggaccuuuggaagagcagucgggugcucuuacccacugagccaucucaccagcccccaagugcugggauuaaaggcgugugccaccacugcccggcaccagucaaaaauuuaaaggaaaaaaaagcagguuuuuuucuuagucaguaguaguggcacacuuuuuuuuuuuuuuaauaaagauuuauuuauuauuauauguaaguacacuguagcugucuucagauauaccagaagagggcaucagaucucguuacggaugguuaugagccaccaugugguugcugggauuugaacucuggaccuucagaagagcagucgggugcucuuacccacugagccaucucaccagccccguggcacacuuuuuuaaccccagaaacucaggaggcaggcggaucugaguuugagaccacauaccaagcuucaggacaguccggguuacacaaaaaagaaaaaaaaaauuuuuuuuaaagauuuuuuuauuuauuauauguaaguacacuguagcugucuucagaucucauuaaggaugguugugagccaccacgugguugcugggaauugaacucagaaccucuggaagagcagucagugcucuuaaccgcuaagccaucuccagcccccaaaacaaauguuuuuaaugaccacaguuacuuugauguucagcgaggcucuggguucucugagugagcugugucuuguuuggaaucuggcagcucagcuucuuguuggcacuaagcuguagaguacugguaaaucuaauguuagacgugccuugauuaguccaaaaggcacaguccaggaggagggcgucuucugucagccucucccuuaaggagggagcaggcucucuuucucaccgugucugcuuugacuagcacucaagcacacaauauuuuuccaguucauauccaucugggaaguggguagggcaaguuccagacaggaacaccuggcccaccggaggugucagagucaagucaauccuguuuuggggcagcagagcuagcacugagguuggcuaaccccacaucucuagggguguagccucuugugugaguacuguaggaauaccugaacaagaguguucaaggaaauaugggaaugcgaacagauugaggagaaaugcuuagucagcaggacauauuuucagaugugugcagucuuuccuccggugaguaccacgguguccucuucuggaauccagaggcuguagccaguucucuauaggagaauauuuugcucuaguaauaggcugaccuauccugagccucacgggcacagcucagaagagggaugcagcggcaggaugggugauacccuguuucacaggaacuugcauuuguuugggguauagcuggcagggaagcugaugacauugucaacuggcugaagaaacgcacgggcccagcagcuacaacccugucugacacugcagcugcagaguccuugguggacucaagcgaagugacggucaucgguuucuucaagguagagcuuuaagaauuccauuuucucugucuacuguccgcacagagggaggggcccugcuguuuuucaggagcacugcucaggguuggccaccucuguuuuucccuuccuauucuaggacguagagucagacucugccaagcaguucuugcuggcagcagaggcuauugaugacauaccuuuuggaaucacguccaacagugguguguucuccaaguaccagcuggacaaagauggggugguccucuuuaagaaggugagugccccuugggcagcugugcccagggcaggucagauauuggucugcagggggugguguugccugcucauauugggaaggaccaagugggcugaugggguggauggugaucaaggaucucugcuacaucauuuuggaguugugcuauggcaaccacuucacacuguggccuuuggaacagcuuucuugaccaccgacauacugggucuccugaacaauacaaggugguuguuauggcaagauaagagucuuacacuguagcucuggcuggccuugaauucacuguauagcccaggguggccuucaguucaugguaggucuccugccuccaucucucaagugcugaaauuacugaucugagccacauaccugaccuuaaacuuuuuuuuuuuaauuuuaugugcauuugugggggugccagauccccuggaacuggaguuaaaacagacaguugugagcuccucuguagauaugggggauugaacugggaucagcugagcuaucacucuuuaccacugagccaucucuccacuuuuaaguuccuagucuagugguauuauuuccacagugccaagagacuaggcuuuuuccucagcccagacaagagcucuagaaucuuuggaugugugaccccugugcugacucccacccuuauuccccgcaggucuccuaccuaaacaccuguaaauuccaguccuauugucacucuucuguagacaguguguguccuugcuauguauuccugucucagggacuaagcagacucuaguguugcugagggggccgagggcugcuuugucuuuugucccgagagccagggugauaccuauccgugguuuugcaguccagcuguaccaacguggggauucagucugggcagugguagugcaugacuuuaaucccaucucccaggcagaggcaagcagaucucugaguuggaggccagccucauguauagcacuagauccagcacuagucagggaggaguacacagagaaacccugucucaaaaaaaacuaacaaaaagccaaaaagauaggagacucucaugucagccagguagguuguguaguggacuggugaggacagaugaagcauagcugagagggucugauuggucuggagccauguuagccuagcaucugacauuguucuacguguauguguauaugugugugucugucuguugacauuguucuaugugugugugugugucuauaugucugugucugucugaaaagguuucaccaguuugagguugaaugaauuugaaggagaagaauaguuuggacaucugcaggggcaggggagcaacaacccccccucagcucacgucagugcuucugucugcugucuucacccagcagaggaccuaaugagagcagaaucgcuacauuauuagaugucucgguacauuuguccagaaacuuuacaguaucuugucugaugcgagguaugagaaaacucugggugaagucuugacacagcaaaagcucuuuucggguuuuagaaauuuucauucaagccaggcaugugaucacacaacacaccuuuaguuccagaagcagguguaagagcuauaaagaaaccuugucucaaaaaaaaaaaagaaagaaggaagaaaaaacuugauugcucuugccuuuaggugcagaucugcuguuuagacuguguauuugggaagggugggucguuguuugguucuugggugguuuuucaucuuuuuaaagauaaauuauucuaauaauauauacauuugaguauuuugcccaugugucuggugaacuguauguaugccugaugccugcagaggccacaagagggacauuagacacccugggucuggacaguuaugaucugcgauauagguccugugguccucuguaaaagcauccaguccuuuucaucacugaggcacacacacacacccuuuuuuuauuuuuuauuuuuuucuaggcaggauguuguguagccugggcuaguuuuuaacucuauagcugagacugccacccuugaauuucugaucuuccucuccugaguauacaaagacacucagugguuugggguuuguuuguuuugcguuauagacuuacucucuggccaagucugguuuccuucuguucccuucuuugggauauuagcucuacccacugaaugagcuggguuuuccucucuaccucagggaacucucugaggcagacuaguagggccagauagguucccccgugaggcaagccagccagcuguggggugaagucaguugcuacuugcuuuguguuuugccugaaggaugacaugcaaccuggauugaggacagagcugaagaaccaaggaagccagccagggccacuugcauauugucugucaugaccugguggggcuacuaguucuagagaaguuauggcaucugggugagaucuucaaaccaggccucuuugcagcagcccccacugagcaagagcuguuuucucauaguagacugaaggaauacugugugauguugucaagaggauagcaggccaaaccagauggucaguuucgcacgcugcccuccagugggaggcgggagggaggcacaggaacauuguucuauagaaggaggaaccucguggguggugaugcugacucagcaucacaccuggagauaguauuugagggcacccuccuuacuuguaucuuccagauagcacgcaguacauuccauucgguauccauuguggcuggcgagggaaagaugguguagaagccaguacccuauaggcucagucggaauuuaagagcacagcgggcucagccuggcuauucacauuccuggcugugaccugcuaugaguguuuaaaaugaguauugcugugcuccucccacccaccuaccccccuuuuaaaaugguuuuuacuugugcguguauuugugugucuguuguauggauuagauccccuggaacuggagugguaggcaacugugaacugcgugcuguggugcugagagcaucaccgugcuccuggaagagcagugcauacucucugcuuccuuuuuccuccugaccuggagagguauaggagaagauggccaaugagaaagaugagcagucagugcccacauccuugcauccaaguaucuuggcucagaaguauuuggaauaagcuggguuugauaguacuugucuguaauccuagcauucaacaugcugaggcaggaggaucacaaguucgaggucagauuggaauacagguuaagacccuguuucaacaaacaaaccaaaaacugggcaugcagugguaggucucugagaccagccaggguuccaugcauggugagauuggaaaacaacaguuauaccuguaucuaacaggagcaggcuuuuaccccuugucauugccuaaaccauacaguguaacaacuaguuguauuugcaguguuaugaauugucagcagccagcuuuauuuguuuuuuugugguuuuuuuuguuugguugguuuuuuuuuuuuuuuuuuuuugguucuuugagacaggguuucucuguguaacucuggcuguccuggaacucauuuuguagaccaggcugcucucaaacucagguccucuagaagagcagccagugcucuuaaccauggagccaucuccagccucuuuguuuuucuuuaucuagcagauagccugagaggucuggaucccucucuucauuguugcccugacuccagccuuaucccuagugaaccacuauuuuuugaaacaaguaccuacccucucagcauuuagcucuggagauuccugcuccauucuguaagagcaugaagccucuguagugaugucugcugccuuggccuggcagagacgacauuaguucaugccugugcaguucagucagagcagcagaaggaccaugagccaccagacauggggugugaaccugccacuggcuugugggcaggguguauccagcuuaggcuguugggggacaugcaaagcucacagcccccuuucuguccguaguuugaugaaggccgcaacaacuuugagggugagaucaccaaggagaagcuucuagacuucaucaagcacaaucagcugccuuuggucaucgaguucacugaacaggugggggggcccugagguagaguggggggggcugggacacuggguguauagcagaagacagaugcaguauugcuuccuguuccacagacagcuccgaagauuuuuggaggugagaucaagacacacauucugcuguuccugcccaagaguguaucugacuaugacggcaagcugagcagcuucaagagagcagccgagggcuucaagggcaaggugagcuaccucaggacaccggguucuuuuacaggggcuagcagucugcugguccucuguagugcuacccacuagggccagcccuguuggcuagcaaauacuuguuacucuaauuaagcagccccagacuuaagagcuguuucaagggugugagcauauggccagaauuugucuaaaugugucuuuucucccccaagauccuauuuaucuucaucgauagcgaccacacugauaaccagcgcauacuugaguucuuuggccugaagaaggaggagugucccgcugugcggcuuauuacccuagaggaagagaugaccaaguacaaaccagagucagaugagcugacggcugagaaaaucacagaguuuugccaccgcuucuuagagggcaagaucaagguguguaguuggaccugaauugugguaacaccguuaagcuugcaaaggagguuccacccgagggaucccgggccuugggcuuccuauaguaccucuuucaaacgcugaagaugacagcgcacguuccuuagcaugguuccucugaugguuugaggacgccguucuugucauauaccaaggucaaggcgagggaaccauagacagacucccuccugguguacuagccuagccaugcaccaagguagcuucaaagccacuaggacacuugaucugcauuuuaguuggucagccuugaagacuuagccuucucuuaacagauuccuggcaacaucagcucugguuucuggagggcagugugucucagcucuuccggaguuggaguguggggcaauguuguaccugacuguacuuucccucucuccacuuuagccccaccugaugagccaagaagugccugaagacugggacaaacagccgguaaaaguacugguuggggcgaacuuugaagaggucgcuuuugaugagaaaaagaacguguuuguugaauucuguaagugaggaucucuggguucccagcuuggcuccauaagggggcuggcaaccucaaacgucggugguggcucuguccaggacgggcucgcagcacugcucucuuucagaugccccuugguguggucacugcaagcagcuagcccccauuugggauaaacugggagagacauacaaggaucaugagaauaucaucauugcuaagauggacucaacagccaaugagguggaagcugucaaaguacauagcuuucccacacugaaguucuucccagcaagugcagacagaacgguguguuuuccacccuaugggcuggugggcaaacaguucuucagacacuccugcuauacggcaggugcugaucuaugcuaggcccaguucaacccucuucacuucccuuccugcaggucauugauuacaacggcgagcggacacuggacgguuuuaagaaauucuuggagagugguggccaggauggagcaggggacgaugaggugaguguggccaccucuggguccaugugggagguccuagcucaggcuuugacuuggacuuugguggccauguaacaggcacagcugugacccuagacuuugccuuugguuugaaagaagugcucgaugguuaccacuuagacagcagggauguuaaaggugccuuucaaagccguccuauagccuucucuaacccugcuguccuagaauucacucugcagauuaggauugccucaaacugagagauccacccuccucugccuccugaaugcuggaaucaaaguuguacgccagcacugcacagcugauuccuguuauuguguacuuaaacuucuagccaauugucuguuguuugcucuguggauaccacacacuaguuacuagacuagagaguagacauaggcugccucccacucaguagaucuauaccuaggaagcucggcuugcuuaugacuguuaaccuugauguugcugauauggaggaagcagaaggcagaucaggauuugauaggguggagcuugagguccaccuagaaauccuguugaagugagagguauacuggccccaagggaccuauuggggaguagaguaagugcugccuucuguccauaugcaguacucugcacuccacacacagccuggcaaaguaaccaacggcugcugugcugcagcuugugcugggccuguugucccugccugggcuggggcucugcagguuccuagcaccauuccugguuggcugggguuccugacuggaagacaugccgugucuugccuuauacacaaccaggccacugcuggugaugguggccagguccuuggugaucagcgagugcugguuucacugaggacagccagaguguagcuuuguuccuuuaacugccccuuccuucauccaggaccucgaccuagaagaagcuuuagagccagacauggaggaagacgacgaucagaaagcugugaaggaugaacuguagugcagaagccagaucugggcgccugaacccaaaaccucggugggccacgcucccagcagcccacaucuccggagccugagccucaccccaggagggagcgccaucagaacccagggaaucuuucugaagccacacucaucugacacacguacacuuagaccugucucuucuuuugcuuuucaauuuuggaaagggaucucuguccaggucagccccucuugaagggcuaccuuuuguuuuaauuggugguguacuuuuuuguauguggaauuugucccaugugcuugcuaaaauguuuggggaucuccucacacugguaaugucuuuccuguuagagagguuuaugcuaccacuucgcauuucaucugugaggcauuucaucuuuuagacaugucuucauguccagcuacuuguuucaccauggcagaccucccugagccuucuuccugcccuggguaggaaguguggcucugggucuguggucacucuccaccuuguccuaguguugccaugguagcauggcuuuguaguuugcauuuaaccuggggaucuaugcauccugucaagaggguggguccccauccccguguguggaaaagagacaguguggcuugcugccaggcucaggccaggucuggacagcucucacucuccucaagccaggacuaccgaccagccggcuaugggcacauuacucuguggcugcuggauucuuuuccagcauggccuguggccugugugaggcagaacugggacccuugauucccagauugggagucagccaaggacacuggggcugaaugaaaugcccauucuucaggcauuucuaccauaauauuggaauugaacacauuggcuaaauaaaguugaaauuuuacuacccauugucacugcugcuuuauuuugagcuaagggagcugagcugaaauucugccaccaaaagggauagcgggcaucugucaugcaugcugucauacaauaaccuuacauucacaauaacuuuaaauucaggauugagccucaagaagguguauccuugccaggugguggugacaccuuuaaucccaccacuuggggggcagaggccagccugaucuacagagugaguuccaggauagccagggcuacacagugucucgggaaaaaaaaaaagguacccuccagagaucaggaaugcaacucccca

SEQ ID NO: 6531 - RNA, 1379 nt, Mus musculus
agacaaggucucaaguagcccauguuguccuucagcuccugguauauuuuacuauaccuguaauuccagucauuuaggaggcagaggcaguacaauugcucaaaguucgagaggccaggcuagucuacauagugaguuucaaaaaaauauauagggcuaaagaagggggacaggggagacacaaaaacaagacagaaagagcuaauccaccugccucucucaaauacugggauuacaagggaacacugccauaccagcgaacauucuucucuuuuuucacuuuuugagacaggguuucuguguaacccuggcuguccuagaacuugcuuuguagaccaggguggccacacacagauccaacugccucuaccuccugaauacugggauuaaaggugugccaccaguggcccgcucuuuugucucuaguuccaaauaaugguuucuagaacagcucaaggcagcuaaaaaaaucacugggagauagcagcaucauauaugaagcuauuucuauuguacccaagucaggaauguguacaggcacuaaagauaggcagagaaaaaaccaagcaccuagccaagcugcugcuagauuagguacucuuccagggcaaauucauucauagcucuccuaggccugcaaagucaucccguauauacucgaagguuucccagugagcuccgaccaggaucugacucccucucugccuacacugaauggguuggggcacaaaggacuuggucuucaagggaagaaacucacacuagauaagaggaguuucuaguaggaaagguaauacaugcauguccuuauugacaacguugcuaaagaagcuacugccaggcagugauggcacacaucuuugaugccagcacucugaggaggcagagguaaauggaucucugaguccaaggccagguuggugucuaucgaguuccagggcuauacaggaaaacacugucuugaaaaacuaaaaacaauuaaaaaaaaaaaaacuaucaaaauacaaaaccauaugccauauuucuuguuuuuuauccauuucugagagcaguguaguacuagucaaucuauauacuuaauauuuggguguuugccuuuucuaaugacccuugacaaucaggauaguuuucguagugggaagugaaaaaagaagaugcuucuaggagugagcucccgggcugggcguggagagcaggucgguugacagccggggagcaguaaagaaagagaaagauggaccgaacacggacagggacugcucacagcuguaacuacagcacccagugggccggugcagaucuuuuaaguauuuccucggguuccaggccagccuguguacaaugaguuccaagucacuaagggauagagacacaaagua

SEQ ID NO: 6532 - RNA, 4388 nt, Mus musculus
uaguaaaaauggcggacauggcccaauuuauggucagcugucagcaacaagacaaaaagguaucuuuuggcccccugcaauaaagguucaucacacuauucaccacugguggaccccaaggcaagauuggcagggcuccagcaaaguagccgauuacuacucgcuacacaacugguacacccacuuuccugaacagcuucaucagagggugguuuuccaaagcuagcauaaggcugaaaagggaaguuuuuagacugacuccuguaaaggcaggaugggguuuugagguuacuagguaccuuugguugugcugaagacagacaaguaauccugccucccuguggucacuacagagagcuacacaagagcccuguuaaggcuuaguggcuuuucaggguucugcuacaagcuucaugguucagugguccugcccuuucucccuagguucgugggugcucuagagagcacaguacuggagaugugcagaggcucgguuuccuguuccaacuagccucacuaacaggcauagggaacucucucaccaggucgaccuacacaugcaaguuguucagagccagaucaguuugaucuuccagcagggcuccauacugagggcaagucccagccaggggaaauuuagauaugcugacucaggcaaucccucuaugcccagggccagcacugugacccaugggccugggguuuguucuauauucacaucuccacaggaagccaggagcaaagacaaaacagggcuguuagcagcagacaaccuuguagccaggacaucugaucugagggacauccacccuccacuggauucuuaccauucccuacaaaaccccaacacaagcugcacagaccacacaaucccagacuccuucagggguguuuauuucccagucagaagagaagcagggacaggcuccucugccuguugaggcugggccuggcagacaccacacagggacuggggauagggaggggaggcacaggagacagcucccaacugugugaacuuggucccacauuuguccuggcuggguccagggagggucggcccagggaugguggcaccaagaaccagggcagaggcaucaggccagcuggcccaaauggaggcaauaaauacugacaggccaggcacgagguucaggccacguggcccaggugagacaaguaaggcucggcuggcuuugucccucaggggcucucuguggggacaggggcuccgaguacugccuacaagggacagagaaggcagaggaaugaggcacccuacccugccuccuagauggggcuggaggcaucgaguuuuggcaauugacccuccccuagcuacuggagccacccccaacccuggccacggggaggggaagagcuggccaggcucgcaggaagcaacagcagcgcaccccaggccucccuugggugggucacugggauggggauggcagacgaggcgaggacagggagagcacaugcucaugcagacagggaguuaagaguuagcgacggcccccagcacacguuccacauguuaaggcaucaugguuagacagugacugacagugauggaugaccuggccagggaguggugggacuagaggacagauagcccagcccuuccccaugcugcgacagagacaaggugggcuggacaacccugacaguguucuguuccauucuagaagccagggccugaggaagggaagacagagggaaccuggagggacacagcagauuggaggccugggcuggaaccccucccccacugcacaggcagaagcagcaaugugacacuggagaccacaggggccugcgggcaggagguggaggaggggcagacaggagagcugacugccugaguggacuagggaggaaugacgggugagggagguccugucagcacuuugguuugggguagguaggggguuaggguggggcaugucgguccuucugucuguccgucgcccugcccgucucccagcuggagcucaguccuuccacuccuuuuugauggugagauuccacucccaggacagguggucagucuugucgucaucugugaagcgcgacuugauguuguaacugccccgagcaagcaugccuuugggagccuccuccaugggugucaggaacucauacuccucggcccucggcccauagcucccgaccauguagucagucuugucaacugagggacaggagaggcaggauuacuggugcugcacgccccucccaggcccaauggcuccccacucuauggcccgcccacucacuuuugaccccuuuccuguauguguguuggauguacuucaugccggacacgaucucucuguucaccuguggggacacagagccagggucagcugccuucccaggcuugccccucugccccuuguuuccaggccucucaaagcccccaccuuacccggaaagagauuuuuauccgguacuccacaccuuccuucaagacaaacgacuguuucuugaagcucuccagaucaccuguauugaggaggagucuccgcugacugcuugcuugaagggcucuccacccugcuacauucacucuccccagccccuucccugacacaaagcagagcuucggcaagccccuagcugcacuuccccucuucuccaccagagggcaucagugcagaaaauuauuuuuagggguagaggcaagaugccagcuggccccacccagggauucuaauacccacucaccugucagguccaguuccagagggccuggggcagugcugcauaccaaggucagucgagucacaaugacauuggggacguuggggucugcagagugagaguuaagagucagagucccaucccuuaagauuuuucuuuuuaaacucacuccuuggaagaguggucuggaaagagacugggcacagguuuagaugacauccuuccuccaagccaccuaccugcagagacagcuacucggcccagcagggccuccuuguacuuucggaggcuuucaucguccuuguccaguuccuggaucuccuggaugcucuucugggcuggaggcuuguaguucacagagugcucaucuuccucauucucugcagcuaucugcgcaagcugcucagcaguggguuccuguucugccaugcuuaccucuagcuugggacaccugugggcggggcaugagcaggacugugacagccuggaggcauuccacccuaggcagacccugacaccugcaggacaccugacuggaacuuugagaggaugcugccacugcccuacgcagaggcccauuugagaggacuagaaccccaagcaacgaaaugggaccacagccuguuccucagagaagcaaaacaccuuuccuccccacuaagaauaagccuccagaccgaacugaacuggcagacgcaacacuaaaucccugggguccuguugcugucccuagcugcccaggcucucaucuuacuggguugggucauggagguaaguucuccgacagggagaugcucuguauguuagccacgugcaggacaagggucuguuuguucgucccuuccaauggaauacuguccuaagcucaacuaugugaugaccgcuuaaaucccaagagcccaaaggggauccuaaauacgcaggucuguccucucuagugagggucugcguaugcaacuugggagcuagugcaccgcuugcaaauaaaucucaggagccuguuucugggcccugacccuaaaccuuuaguggcggugaggaaccaaccaggacggaagcgccuagaugccuuucaguuccgcagauucccaaacgucucucggaaacccacugugaugccuacaggcaaugcgcagcggucccgggaagagcccggccguugucccucugagagguguccgccaaggaaacacauaaagcggcgguccgaaacccggaggcuacagacaaccccacccgacgccaagcguggccgccggcgacagcaucagggcgcggcccgcacuuccguagagcccgcaauccgagcggggcggggccgcgcggcgggagccccgggccaggccccgcgccggaccccgcccgcgaggccgaggaaggggguccccugguagcaggcgcgcaggcccggggggccgcggccccuccggcaggaccugcgcugccgcccuggcccgccccgcccgcccgcccgggugaccgcgccccgcccgcgagcgccgcagucgcccgcgacgccgcacaaagccaacccacuccccucccgcacugcaccgcgcugcgccacgcgcccacucaccggaggcucgaccgccgcucucgcgcucccucccgcaccaaaugacgaacgucguccgccgcccgccgcucggacggucacuuccggggucacaagacuu

SEQ ID NO: 6533 - RNA, 4260 nt, Mus musculus
agccacccccaacccuggccacggggaggggaagagcuggccaggcucgcaggaagcaacagcagcgcaccccaggccucccuugggugggucacugggauggggauggcagacgaggcgaggacagggagagcacaugcucaugcagacagggaguuaagaguuagcgacggcccccagcacacguuccacauguuaaggcaucaugguuagacagugacugacagugauggaugaccuggccagggaguggugggacuagaggacagauagcccagcccuuccccaugcugcgacagagacaaggugggcuggacaacccugacaguguucuguuccauucuagaagccagggccugaggaagggaagacagagggaaccuggagggacacagcagauuggaggccugggcuggaaccccucccccacugcacaggcagaagcagcaaugugacacuggagaccacaggggccugcgggcaggagguggaggaggggcagacaggagagcugacugccugaguggacuagggaggaaugacgggugagggagguccugucagcacuuugguuugggguagguaggggguuaggguggggcaugucgguccuucugucuguccgucgcccugcccgucucccagcuggagcucaguccuuccacuccuuuuugauggugagauuccacucccaggacagguggucagucuugucgucaucugugaagcgcgacuugauguuguaacugccccgagcaagcaugccuuugggagccuccuccaugggugucaggaacucauacuccucggcccucggcccauagcucccgaccauguagucagucuugucaacugagggacaggagaggcaggauuacuggugcugcacgccccucccaggcccaauggcuccccacucuauggcccgcccacucacuuuugaccccuuuccuguauguguguuggauguacuucaugccggacacgaucucucuguucaccuguggggacacagagccagggucagcugccuucccaggcuugccccucugccccuuguuuccaggccucucaaagcccccaccuuacccggaaagagauuuuuauccgguacuccacaccuuccuucaagacaaacgacuguuucuugaagcucuccagaucaccuguauugaggaggagucuccgcugacugcuugcuugaagggcucuccacccugcuacauucacucuccccagccccuucccugacacaaagcagagcuucggcaagccccuagcugcacuuccccucuucuccaccagagggcaucagugcagaaaauuauuuuuagggguagaggcaagaugccagcuggccccacccagggauucuaauacccacucaccugucagguccaguuccagagggccuggggcagugcugcauaccaaggucagucgagucacaaugacauuggggacguuggggucugcagagugagaguuaagagucagagucccaucccuuaagauuuuucuuuuuaaacucacuccuuggaagaguggucuggaaagagacugggcacagguuuagaugacauccuuccuccaagccaccuaccugcagagacagcuacucggcccagcagggccuccuuguacuuucggaggcuuucaucguccuuguccaguuccuggaucuccuggaugcucuucugggcuggaggcuuguaguucacagagugcucaucuuccucauucucugcagcuaucugcgcaagcugcucagcaguggguuccuguucugccaugcuuaccucuagcuugggacaccugugggcggggcaugagcaggacugugacagccuggaggcauuccacccuaggcagacccugacaccugcaggacaccugacuggaacuuugagaggaugcugccacugcccuacgcagaggcccauuugagaggacuagaaccccaagcaacgaaaugggaccacagccuguuccucagagaagcaaaacaccuuuccuccccacuaagaauaagccuccagaccgaacugaacuggcagacgcaacacuaaaucccugggguccuguugcugucccuagcugcccaggcucucaucuuacuggguugggucauggagguaaguucuccgacagggagaugcucuguauguuagccacgugcaggacaagggucuguuuguucgucccuuccaauggaauacuguccuaagcucaacuaugugaugaccgcuuaaaucccaagagcccaaaggggauccuaaauacgcaggucuguccucucuagugagggucugcguaugcaacuugggagcuagugcaccgcuugcaaauaaaucucaggagccuguuucugggcccugacccuaaaccuuuaguggcggugaggaaccaaccaggacggaagcgccuagaugccuuucaguuccgcagauucccaaacgucucucggaaacccacugugaugccuacaggcaaugcgcagcggucccgggaagagcccggccguugucccucugagagguguccgccaaggaaacacauaaagcggcgguccgaaacccggaggcuacagacaaccccacccgacgccaagcguggccgccggcgacagcaucagggcgcggcccgcacuuccguagagcccgcaauccgagcggggcggggccgcgcggcgggagccccgggccaggccccgcgccggaccccgcccgcgaggccgaggaaggggguccccugguagcaggcgcgcaggcccggggggccgcggccccuccggcaggaccugcgcugccgcccuggcccgccccgcccgcccgcccgggugaccgcgccccgcccgcgagcgccgcagucgcccgcgacgccgcacaaagccaacccacuccccucccgcacugcaccgcgcugcgccacgcgcccacucaccggaggcucgaccgccgcucucgcgcucccucccgcaccaaaugacgaacgucguccgccgcccgccgcucggacggucacuuccggggucacaagacuuccgcucucgcgggcggggucgccuugcgcaugcgccgccagggggcgcgggucggcgccgucgccauuuugcugcgggccucgugggcgcgucccgcgugggccggcgcccucgcgccuucugccgaaugccgggugcgaggguuugugggacacgagagccggcucuuccagagcagcgucgcgcggccauucuguggcucccaggguucccugauugccgugccuggcccuugucccauuguccucagagucaacagaaccacaguccucaccgaccgcagugcccuguagcugugcugccuggcgcauugcucuggggacugcgugccccccgagcccccguauguuagaaguuguaugguuuugcugugaggagcgguuuuccuuggaacgggcugccugccuaucuugaaccucaucccugagacgcgcccgccucugccuccaggaugcugagauugaaggcgugcaccaucaccgccaggcguguuucacgacgcugaggauggagccuccuuaguggagggccuggcuggggggguucccggucgugugcuugugccagccacuccaguuccuccugaggagucucaguuccugcuacuccgugagggcacuccauguuggcuucuucugaguguagccucagacugaggggaggcaggaauuuaaggggcacuacggggacuucuauagcuuaaucccacaaaagccaucgcuucuggccugcucuguuggccacaccugccccugugguauccaggaaacagcuguuggcuccggagagucaucaaacuuaaaagaugaggaauccaauggccuccacucuccaucuucaguuguggcccaguuauuuuacacaagcacgcauacccucuggcuauacaucaaucugaagcaaaccaaguguucuuucaagcucauuuauuuuuaucucuaaggaagauggauuugcaauaucauuacccuacauccagguagcugcucuucuaugcagaacuauucuaaaacaaaaagccacgugacuauccccacucuuacuguaugaugaauuuggcuggccuuccaccuacacacaggugugcccaacgaagugugucaagcuggcuuuucaggaggcucaugguccuccaacuggaugagccugguuuauugagcucugugccacccacaauucccugguuugacgcucaaaguacaaaucuuccaaagcug

SEQ ID NO: 6534 - RNA, 1729 nt, Mus musculus
ugucucagggguuuuauugccaugaagagacuccauucggcagcucuucuaaaggaaaacaucucauugggucuggcuuacgcuuucagagguuuaauccauuauugucauggagaguagcaagacugaaucagggccgacuugcugcuggaggaugggcuuaguuagaguucugcauucugaaggcugcaagaaacuguaagucacacacgggcauagcuugaguauauaagaccucaaagccuguccccacagagacaaucgucuuccaacaagaccacaccuccuaauagugccauucccuaugggccaagcauuuagacacggcauuuagaauucaugcaggccauuucuauucaaaccaccacaaggcauaaggaguaauucucuguauucugagacucuggcuacagccagugaaagauaaaagcucccccccccccacuccccaaagaaauacaauguaaagaauuacuuuuugaggcugggugugguggcacauguuuuuaaucccagcacuagagaggcagaggcagucggaucucugagaguuuggggccagccuggucuaaaccuugucucaagaaaccaaauuugacacaaaggacacacacaggcccccuccagccugcuuacccccuuuuccuugucaccuauguuacagaacgagucaccuuuucacgauucccagagaagacagggucaaauagaacguucagaaccucgaaaugaaaacuugaucccuccuacuuuccuucuuuuuuacuuuuucaacagcagcgagaagucucacagaaaaaguagcagcagaaugcacccaaaguaguuucaaaugcggcagagaaggguugggcaaagugcacaacuccuacagugcacgcacacuacccgaagagaugguccacggccgcaggugaagccccuagcacccuccggagauuagaaucauuagugagcguccuccaagccuucgugucaucguggauaguuuggggaucugagcugggguuggggcugugccccucaacagccguguccuuuucagacugcugacccauuuagaaugaggacgucgcagcagaacgggguaaggaacuaaaucacugugucacaccuucaaaacagcaaauagguucccgcguggugacgcucaucugugaguuccgcuuucagggggccgaggcaggagcaucucagggaauugaaauccagucugcucgcuguacagugaaacuaugcauccaagugaagaaaaucaaacaaaccucccauagaccucggucugaguugguguggagaucgggagggagcuagaggcauccgaguuggggccacuccguagaaccugucucugcaggagcacggucaacccggcgagcgccgggacgacucccgcgagacauugccagggcgcggcgggcguugccaagggcaacggcgcggggcugcgcaggcgugaugggggcgcgcucgccuugcugccgccucgccuuucccuuuaagcuuaggccagccgcgucgccgcuucaugaauggaacccacgugaccaaacaucaugugacgucugaggagcggcggcggcggcggauucugagcccgguccggcccggccuucccagcgcgcuuggcccggcccgcgcaggcggccaguccuccuaagcccccggcccggacccuucgcgcccgccccagccccgcgcagccccggagcgcgcgcgcgcggccccg

SEQ ID NO: 6535 - RNA, 842 nt, Mus musculus
uaccgcccuaggagcaaccgcaggggcgggcccugaugcggcgaccccgggcggcccgcggguccacccauccgcccguuccccacccgggccggcggccgcaccugcagcagcacggugcucggcgucaccuucaccguguggcgccgcccguuuggggccagcaccgacaccgcggagcccccgccgcccgccggggccgccaucuuccgcucacgugaccgcagccggcucgccucaaacaacuuuauccgcaacagcccggacgcacagccacgcggucucgggggcggggccaacucgcuuccgggcccgcccccggcgcucuggcucugcuuugcuauuaggcagccugauggcgucccgacggcgcggaccaaaggcaccucccuggaaggagcacaguucugucagggacauuguuucuucauccggaggcacguguuccugggaaccuccaagcucugggggcugccugcaagaaagcuaugcugccuggggccagccuggggcccacagcuaccugucugucaccaaguacuggguaugcgcacaccagaguuagccuuuguaccuacuccguuaaguacugauccugccucccuucucaaguguuccugugaucaucaucgucacauggcgacaaccuuuuagaaaaauauuuuauugagacugaugugguaaugcaagccuuuaaucccaguauguuggaggcaaaaacagaucccugaguucaagaccagccuggucuacagagcaacagucuuccaggacaaccacggcuacccagagaaacccugucuugaaaaaauaacaacaacaauaauaauaaaguuauauuu

SEQ ID NO: 6536 - RNA, 3573 nt, Mus musculus
cuaggaaugacaaggaagccuuuacucaacauugcaaccgcuccccucggccuccccguaaaagcugauggaugagccugcaucucacuccaaggagcccaaagggaaggcucuagcgaugggaagcucagagggaagcauccugaacaccacguuagaggaaggaagucucccagcagugucucugggagggcucagauggagguaaugggagaacagcagccccuacacaaaaacagucccaaggcuggucccaaggcuggucccaagucuccucuggucacacagucuguacauucuuacuuagugguggcucuaugagccgguggccaggccugaagcccaccccuuaacgacuagcccaccuggccccaucuucugcaggugaggacaagccgcagcaguuggaggcugggaagcaccaucggggguagcuggggugguagacuuuauccagggaaggaccuguggcugggcugggaaccacagucuggggguagcuggggugguagacuuuauccagggaaggaccuguggcugggcuggaaaccacugucucugggguagcuggggugguagacuuuguccagggaaggaccuguggcugggcugggaaccacagucuggggguagcuggggugguagacuuuauccagggaaggaccuguggcugggcuggaaaccacugucucugggguagcuggggugguagacuuuguccagggaaggaccuguggcugggcugggaaccacugucucugggguaguuggggugguagacuuuguccagggaaggaccuguggcugggcugggaaccacugucucugggguagcuggggugguagacuuuguccagggaaggaccuguggcugggcuaaaggcaucaggcacucagcaucuuugccuuucucucuuccuggacggucucggcacgcacagcccgguugucucauuuuccagagguaccugguguccaacugggaccgaggucgugggaggccuucaagcagcuucugcugaccgccaugaucuaaggcccgagggagccggguagagcagccaccaggagucggcaguuacuggaaagcucccucaacccuguucuucauaggacaccagugggugucuggguagagaaggcagugcacagacugaaaccuaucaggaggaggagucagaucaggucugccugggaggggacugacaccagagcccuccagggugcccacucaccguguaggguccugcuguauguugaaacugccagcuacauucaccacauuauguggguucucaggacccccauagcucaagguaaccugggaggagaaucagggagggagaggguuggcucuuccuccugggcccuccaccugcuagaggaaauuccacucaccccucaggcuuagggaggcaggacaguggcccuucauaagaaaccccacgaggcuugccauggacagacaggguccugaagguucuccauccagcaggcaaagucucugcccagggcccacccccaagcaacaaggaaauucugaggauagcacucuccugagcccugaacaacuggagaccccuugggagcuaggcugcauccuuguaggaguggaguaccagguuggagcaucuucuaccugcugcaaaauagcaccagacggcagccucugcagguuuuccaggugcgaguggaacagggggcuauggagcagacgggcgcccagaaguccuuccacgauguaucccacagugcagucaucaggcagccgaacccgcucugcugugcucaugaaacugccaaggcuggagaggaggcuagucagcaccucuacagcccuucccacccccaaaccaggcagcuggcuucccagccucccacuuaccuggcccacgggcucauuuugagggcaaggccccugcucaggcagaacccagccccaccaguagcaaaccagaauuucacuguguuugacuggaaaaaggaaaagcugucagggcugaccaggauagggcuccucacccucagcccuccaacugaaucuuguuacccucauccuaggccaccaucuaggaguuuucagaaggcacaagggguuuccugacaugucaccuguggccucuaaggccuucucuaucacugcgccugauuggcccguuccauggaagccaggguaguuggcccaugccugccuuaggguuuucucacucuucagugcuccuugggucagccccagggaggagcauguuagcccagcacucacggugccaccgccuuggacccucucuguggcuucgauggggugguccaggcuaggucgccccagguagauguccugguuggaagagaagguggaaagcaggugcagcaggcuuuugggguucacguaguugucaucauccacguggcagaaccaucugaagguggagggagaggucuaugcacugaggcccccccccccccaguuugggugggagccuccacaucguucaguccugguucucugacaggugagguuacuuacuuucguccagauucuaggaacuuaucauauuccaccgacauuuugcagcacagugcuuggcgggugcgcacagcagagcaauugguguugaucaugcggccgccugcacgggacauacgggaauauacgugaguggugaguguugacuucuagcuugccuccucagguuuaggccuguccagccacugagcacagcccucauucugaagcagaugacaguugcuuagaacagcacaggugggacaggacaagacuuggcaggcugagccuuccucggggaaucugggugacauuagccaugcguggcacccugucgggaacugggggcaggguggggaucuggguuaggguuaggguggauggguguccuggcucugcccuccacuagcugugugacaguaggcaagugcccgacgcaggaaugaauggcccugguagcuacaacucaggccaggggagcaucucaccugccagcaucuggagcucagggucgucuccaucggugaaaaugaacgucugugggagaaaacgccgugagugggucggggagucggugcagagcccggggaccaggggcgccagccuggaauccaggacccugcgcggcgggggacgggacgcgcaccugccguggggcucgugagauccagguacgcagcagcagccgcaggcgcgggccgugguucuuccgaguggucuugacugcaaugaagacgucgucggguugcaggcggucucccucgagggucaggcuccgggucgggacccgaucgggguccggugcgggcgcgcgaggcagcggcagcgguagcggcagcggcaguagcagcaacacagccaggaccgcggccagcgcgaggcaggcccggcacaacacccgccgcgcacggcucaugcgaucgccccggcccgggcgcugggcgcccgccugcgaccgcggcggccccuuuaagagugacagcaccccgccccaagcccugacccggaacugacggacgcgccgccccggaagcgaacgucgccgcggcgccggggguggaagaugccgc

SEQ ID NO: 6537 - RNA, 5295 nt, Mus musculus
ucaggucauggauugcuuuuuaagaccaaauuagagaagucuuuggccuggaaagggacccagccuggacugcaggaagcccagcaggugaggccugugacaccaagugguuucucugaagucguggguagugcccuagccugaaagccagcaagagccauccccaccccagggcagccaaugaagccuggacacucuuaaggaaaugccuuuacucagggaaucuccucuuugacacagaagaaccuguugaugucugcagguggggucuggcaauguugcaccaagggcagcuugguuggacuugccccguucccacacuuguguuuccagcacugaacaauaaaccauuucagagaagcauuugcagagaucucuagugaugccuauggcuguugcuccuaggcugugaguggucagaguauccagggaauacaagcagaaaggaaaggagccuuggggcaaugaucaacuuguacuuuaauggacuacucaguuaagacacugcugcagucggaacuacauggacaggaagggucugagguacccuuaccugggaauugcacauggucuguuucacuggggcagaaacuuagagucaggcccaaguggccauaugggcaggcugccuaccacugcagaggguaccucagcguggaaggccaacgaacuggcaccccaguggccagacugcucuaaugaaccacacacagucuggggucucucucgucuugaggaaagcaggcaggaggcccaggugcugcuuccacaggcagaguaggugugcagacuauggucugacggucacaggaaugccuuucacauguugguacucaugcgugacuggcuguuggcuggagucagcuccccuuggcucccuucucuaggaggagacugcaguggacagggaggguucaguggaggcugugugagugccgcccauucccucgcaccccaggcucuucaccuugacauggaucugguugcggagcacagcugcucucagaaucauagcuuuggcacgucguuggaauuccuugcccaucagcagggacuucucaaagguggugcuacgcugauccacaucucgagcauacaguaucuggacaagaugagaaggcucagaacagcccaaggggccuccacaccacacacucggcagucccaaccccguggacccaccuugcugugugagucgaugcgggcauuaauaaggcccuccagaaugagcugugucagcucaucuuccagagcugcaacuguuguguugaaggcugcagccaucuugugcauaucagcugacacauaggggcugaaguacuacaggacagaagccacaagcuguccacugcuccucagaaggucugcauuccacacagcccuaaccauccaagcccccuugccccaacaccgacgcuuacuuggauaagagcccgguuacgaaucuggguguacaguguccugacgugaggggccagguacauguccaggagcagguuauccugcagaggagagcuggucagagacccccgaggugugcacaccuagcucaguuccagugugccuuacccuugcgccuuaccuucaucucguccagcaucuucaagcaugaggcauacuuggauucauagaauuugaagaugaugucucugaccuguggcuccagcuccaggaacagcuugaaggaacugaggauaccacaaugcucaacuaagaagggacggaagggccuggcuggacaagagaaggugggagcccacuacccaacuuaccugcuggagaugacauuucguugcagcuccugccggucaaagguggcuaaggcacacaggccaccauagacagccacauugcugggggacagcagcugggaggcagaaggggaaguggguccagaaaccugggguccugggccauugacgggcacacagaccaaggaggaagcccaaaguuggggccuacucuaccuuucccacuacccauaaagacgaugcuuagacccucauugacgagagguuaaagcccaaucaauccacgagcgcgcguucacuuccccuuacggacuuggacaaccugaacagugccugccccuccucaccucugggaagucacagugaucaaaggaagccagaaggaagcacuuggcugcuugcuuauacuuccgugcggccagcucagccaagccuacaggcagggaggaaacuggugaagcuaggggucuggagaaggcgugggagccccaggacaccauggccaucagugggucgccucugggcuccuaccccaguaugccccaguuuagggacagaaaucuaacugaaaacauuccaaguuaggccuacagggaauucucaaaauguacacacacacacucacacacucaggcucagggaaaccagcucaccuacuuccccagaccccacuagcucucucuaugaacuugagcaagugccacacagggagaaggagcgggagcaguggcuggaagccuuaccugcagcacacuugagcuuggugaggauggcuugcgucuggcugucccgcucuccccgcugcuguaggagaagacagcagaugugagcccccacccugcgcuccuuauucaagaagcucuguucccuguccccaccuuacccugagcccaaacucaaagggagcuggaggcaaggaaggaguaaaggggcuagcugggguaucugugagguggaccuuaccucagcaaucucuggaguagacucggccuugcugacauagcuuaacacaugagaccaauuuugcaaguagacacugaccuggcagguaaguagguaaggccagauaagauuggguugucccuucugggcccuccaugccuacccagcugucacccaggccaccuugaugacguugaggcacauguugaugacaugcuuagcacuggugcaguagucucgggcucgugaguaacauuugagggcauugcugagguccccacaguccagguagugaucacccaggucaucguggccgcgccuguaggccuggcagugagugaaugcuggucgaggggccauuagggcccgguugcccaccuccccugcccagagaagcccagcaccugaugcucucuuugauagaauugcccuuauaguucuucaaguccguguccagcuucuccaguuucaacagagccuucuuccgaguggccuccacccaggcuguguccaggggcgggggcuccacuccacucucagggauggcaucaggugcauucugcagcucccugaagggugagcuagccaucagacaggcugauucucaggagaucuuugccucucccugccccacugcaagggcccagucuguaccagggucacagagaauugcugaucuaagagaccacagcuagacagggaaggucaaaagagaguaggagguuuugacccagugcagccaggccuuuuuuuguuuuugguaaagaagaacagcgauaccagauucucaaggauuaggaagcucaacugucugcacagaggcaaggaagccaacggagagaaaauggccggcuaccagcucuccaccccaaggaggaagcauguucuaucucucaccuacuggaggcacaucacgggugaaaggcuggcagggaaaagccauggccagcccagaucugcucacccuccccugcucccuaaggcuuaaccugguagccucggagagcuuccgguguaucucuucauacauguccacauugaagguccucugcacgaaggauagagccauuuucaaggccucuacccucaguggagggcaacggucagcaauaaacuguagucgcucaauucgcaucaggccacuguagcuggcugcauacugcuccagauccuuguggggaggagauaagcgggucagcuggguaagcaaggaccugacaaccugagccaggauacuaaaccuucccgagggagacuuggggccacagucuugacugcugucccagaggcugggaagagacaacagggguggauuaaggaucaucagguucaagcucugccccgggaaauggaaacucaacaagugauggaugcugggguaagaaaaggguaagugucagcggcaaauacagcuuugcuucacacugacccaauggggcugugcccuauggagaagcaggugcagggucuuagcacuaccugagaacccaacacaggugggcaaaugaaaacccaguuuccuggcuuagagggaugugucuaaaguaguugcuaaaaagcaucagcuguccuaggauauacaccauagcgggagucugaguuggaccccucaacauguccaagucaccaggagucccccgccacgugggauucauaccagggugggauucuccaccacauaguugacaucaggugcguucugcggaucuuccugcggaucgacaucaaucugcauggguuccacggcccccugcaauacacgaagagcagcuugacacagggcaccagggacagcagaggauguuccugucccccacggucgcuucugcccucgauuuuccaaggcagaacugcacugggcccccacaggugcuggcagccaagcgcccucagcucucccacccagguccugcgcacaacucuugagacugacugcgggaaccaucaagcguuccgggccgccaucccgacccaucucccuccaggccacagagauccaaacagauugucacccuauuuucaucaauccaaagagccagagcagacuggccacgccgcggaaggggucggcgcaucccggacuccagggcccagggccucaagcgccgucgggagagccgcucccgggcgggcgcgcagccguaccucggaaagcaacgugcaggccgacaggcuggcgcucaggcuguagucgcccgccgugccgggccgcaagucggaccugcugugcgcagggcugcggcucaggucggaggccgacgacgaggccgagcugggcgccgggcugccccgcauguuggccugacgcgccucucugcgaggccggcaccgcacggaaagcguuggcgcgcgaggcgggggcggggcgggggccggggcccagggcggcccgcgaggcaggcgacgcucgcgcgcccaggccagagccgccggccccgccccgccccgcccugccugccgccggccccgcccaccaggcccgcuccggaccgaacggccacgcggcgagcgcagccaccaagcccuaccugcaaguuaaacaccugaaccggcagcggcaucuuccacccccggcgccgcggcgacguucgcuuccggggcg

SEQ ID NO: 6538 - RNA, 9017 nt, Mus musculus
cggcuccggcacuuccggcggcguugcgcugagucugagccacggcgcuuggcggcucccgccgccuucgugcggguccugcuggcggcgccgcgggucaggcagaggcuacggggccuugugugccccuuucuuuggagcgugcccgcagucacagaccuucaucgagcccuggccaacuccgacggugcgggaaguaguccuaguucaagccccguggacguccgguggcggucucgggccccagccagcccagggguuagguaggggcagcucagggggcucugggcccgaccaggaaaggagccguggaggcugacgugcucgcuacucucccaacccaagauccgaggcggcgucaggccucgugcagccggguggucucagcugugcaggucccacagaccuguucauccuccacacccgcugcaccaggcuggcguuuaaggggagaagguccagagagggugagugguaugucagggucacugccagaaagguggagggagggcaccucaacccugugccuacggauaccucucuuguuuucaccguguucuugggagagccgacagcaaaagcugacgagagcggucagcuccuggaguugaacuucguacccuccugggguaugaugguauaccauggcugaaaugagcgcuuguuccucuucugcccuuaguguggagaggaugcccaaacugcaggguuuugaguuuuggagccgcaccuuggggggugcccgacaugugguggcacccaugguggaccagagugagcuagcuuggagacuucugagccgccgccauggagcccagcuaugcuacaccccuaugcuacaugcccaggucuucguuagagaugcuaacuaccgcaaagagaacuuguauugugaugugugccccgaggacaggccucucauugugcaggugagcugagggacuggguagcaccuaagcuccagacccuguauauaaggacagcauucccaagcugucccugucauauacauauaacccaggagaagggucggggucccugaaguccugcaugacacaugcugcugagugggcauccccagaacugggaacuagccagagucccggugaaggggcagcuuggaggacgugaggaguguagcaccagugucaccuugauccuucuccgucucaguacccuccugucgagaaccaacaguucuuuacaagucugugccaguggcuucuguuacaugucauuauagcucauauuccuagugguugucauauugucaaugucgguggaaagaccauagcucacugagucaccaugggauuccucacagggcuggguggccuaggcagggagaguccuaggccugggcugaccgaggguggcauucgugucuucuucaguucugugccaaugacccagagguguuuguccaggcggcucuccuagcacaagauuacugugaugccauugaccugaacuugggcugcccacagaugauagccaagagaggugaggucauugcuccaguccuguguugacaccuguccaggccaauacuaggcccacuaggccuccaaauaagggguccaggccuguuccaguggagccuggguauuggugcacauggggagaguuaaucccugccucugacugugguggcaccuguagccagcaagcagcccuuuuucugaacuuaacauccugaagaguccucagguguuugacuggggaccagacucugcuggccacauagguauccuucugauaacugugaccagcuggugugggucccuggcucuaaucccacaauucaggcucacugggcccccaagcacccauuaugaucuuaggcuguguggcccacuuuggaguuuugacagcaggcagagcuccaaagucagggcuaagaaagcugguugguuucccuuucccucugcucuccccagagccucugcugaccuuggggaggccauguagaagcuggugcucauacacauggcguagcuguggaguccacuguguucugaggagcuggccuaguagggaguugauagcagcgugggugcaaugggggccacucucauccucugcaggucacuauggugcuuuucugcaggaggagugggaccuucuucaaagaaugagugaguuggcuauauaccacugugucagugagugagucgccccagagacagucugacagggcucauaagcacagcuacuugacuggggcucaagaggacaccgaugaucccacugggggcucuuggccauagcacuuuacuuccuggaaggaggugacuauagaguccccugguguauaccaacuauccccuuaggaucagacaugaaguccuaggacacuguccuuaguucuguuagcucccagugccccauggggacauauugggguuuugccaccuuggagugacacugguucccucagaggcugucuuuuuucucaguucuguuggcucaugagcgacucucuguuccugucacgugcaaaauucgugucuucccagaaauugacaagacagugagguacgcccagaugcuggagaaggcuggcugucaggugaggccauggcucccagggugguuguuggggucuagcaggcagccuggccucacguuugaguauggucuagaucuccaugacgaucuuccaacaccaggagguggcucuugcuucugcagcucuugagugggggcugcagccaagaaauuuucuuugggcaggcaguaggcuccuccuggccccacuucuuuaagaccugguacccuggccucagaccucuaaaacugcauuccagcuccaggguguugucuguguggagaguaauaguggguucacuaccacaucucaggcucucuagacaucagccagggcugccuuuaggugagcucagaauccagccucucuggaagccugggcauaagccaugggggucucagaccugguccucuuccaccaugcauguugagccuggccaaauguacucugagacaugugguuucuggaaacagcaggagccacccucacucagcacccugcauccugaguuuucagauuuuuccuguacucaggguucugccucuugacuuauguuuucugauugcagccuggggcucuuccaaaggggcagggcucucaagacccugggaccagggacagaaccaugccagauggccuugguuccucccagcauggaaagcugagaaaccugagcaggucccuuguaauuggugugagaccuuugcauagagcaggguugaaccaaguguuggucuguccuagcugcugacugugcaugggcgcaccaaggagcagaaggggcccauggcaggaacagccuccugggaacacaucaaggccguucggugagcagauacugugggucgggugacuuuguggaagcggcauaagccuaguuccacgccuuggggugguuguucagcauuacccaaugccuauaacuaucugggagggaaggcaauaaugccauagaagccgaggugucucaacaagauagaacuugguggcugguuucugccacuccuggcuuagcacugcccuggcauggauuagggucaggcuucucuuucccccacaggaaggcugugggaaucccuguguuugccaaugggaacauccaaugccugcaggauguggagcggugcauccaggacaccggcgugcagggagucaugagugcaggugagccuuguuccuugccucagccuuggucugucccuguaggucugcuuaagaugguguucacuguuaugucuuuccaaggagcccaaaccaagcucucagaccauuuuucagacuugcugacccuauagcuagccagugaccugaguggccaggagugggucccaagcuuugccuugccuucuucccagaggggaaccugcacaacccugcccucuuugagggccggaguccugcugugugggagcuggccgaggaguaccuggacauugugcggcaacacccuuguccacuaucguauguccgggcccaucucuucaaacuguggcaccacacgugaguugcucuuugggcagggguugagagugggucucucuaggcaaugucagaauccugccuggaguguucuguggucuucccaaaacaacguggccaccaagucugcugaagggcugguggcuuggcagugaggaagggcaggagccucggugggaagagauaauuagccgugugccuaggacuuggcccagguggugacugggagugacaggcaucugccuuaggcuacagguacaucagcaacuucgagaagagcuggccaaagugaagacccuggagggcguggcugcugugagccaggcgcuaaagcuucggugucaggcaggugcagggcuggugcaugggaacccagcaaguucuguagugggccagcaguuuaggucuuugacaggccuugggcuuuuacaggaggacaugucuaggcagcaagaaggagugaggccagcugacaacuuaccugcuuuccauuggaucugccagccguacauccggccagggugagccgagccagccaacaaugggaguauaugcacaggugcccuuugccacugcucuaguugcuaaggcaaguuccucuucugggggaaggaaggaagaggagagaguuugugugccuaggguacucauccgaggucgguaguccuguguggcuuuguccuugggguuaacagguagacccuggggcuggaaucucuaaagugggcaggcugucaucugugaauucagccugacugggcuuugucaaagacccugggccccugaaccucacaugucauuccaggaagguuuaguuccuguuagccauucuauugugugaacuguaccuauguccuauguucuuggacaagcccuguuugcuugggcagccaagcauaguugcuuggugugagugggagacccaugcaggccuggcaucucucugcucuggagcccuccugagagcugcccguuuagcaguggugagcaggucugugaugcugcucacuguccuuucccuucagaccuagggaagggagcaaggagaauagugguggucgaagcaagcgggcucuggaggaagaagaaggcagcauggagggcuuguccaagaauaagcugaagaaacaacugaggaacccucacaaaaccuuugacccuucccugaaacgugagugcuacuccuguugaagccagguuuguugggcagcugccuggaaaccucuucguucucuucaucuuuacuagggauaggaguccaggcccgucaaguguaaugucucuggagacaugccucgggacaauucucccagccauccugugcccagaccagacuuuaugacacuaagaaccugggaaaggccuuugaaucucaucuauaguguauggcuauaaaccucuuaguguaucagacaaggccauuguacaagccccucagccaggugcuguucaagugaccacaggaguuugccuguaugacaaagacuuugagucacuagggcugucuuuggccugcugagaccuggaugcaccucacccuugcauggggcucagucuucaagcaguaacuggcagcuucugggaaacaugcuaggaugcuauuauuuggauccugacccagauugaugggguuggaggugcuagucucucucauagacacucaggacuuuucaguaugguuucugggugugcagcuugaggucucaauccaggauauuguccucuguguccuagccauuuuggcaaucugggcucacacauucagcuacuucuucgaggaucagaagccugguggcagcucccugggaguuuaaucugagcuuugcaaggcugagacagcaggaagguccauaucacaguccugcacagacuacuuaugaaggaaaugcuguagcauuuucucccgcaauucuguaccccagggagugggcauuaggacauggguucugauuuuugccccucuuuuguuuccugaaauaggccucagucuguaguccaggcugccucggaucucacuguguagucugcucugacuucagacucagcagcaaucuggacuacuaggaccagaggcuuaagccaccguacuuggaagccccauuuuucagcgagagagaguaacagaccuagggcucuggaugcuaaggguagagugggcagcccaccugcuuuccagugaggccacucggucugcugccagccaucucuugucauaacuagcuauauccuguccuuacuccauuucuuggccugaguggccacagcaagcuuuguagagguguagagauugagagcgcuuccacugguugcucuuccagaggucuugaguucaauucccagcaaccaugacuaaugagauguggugcccucuucugguauucagacacacaugcaaacagaacacuguauauauaaucaaucuuuguagaggugggggcagcugcucgcccugcccuccucauucaucucauucaaccugcccuauuuuuucccagccaaauaugccaagugugaccaguguggaaauccaaaggugagcuggcccuuguguuguccugugggcagggcaguccugguggguguucccugugcugcuggagucugguacuacuuaccucagcucauuagcuuugcuauauacagggcaauagguguguguuuaaucugugccguggcugcugcaagaagcgagcuuucagagagacagcagauugcccaggugagcagaugcccacuguaaccagcccauucacccaccaccaucaguggaagccuuggcuuccugaccccuauucuccucucgcccucccugucaggucauggauugcuuuuuaagaccaaauuagagaagucuuuggccuggaaagggacccagccuggacugcaggaagcccagcaggugaggccugugacaccaagugguuucucugaagucguggguagugcccuagccugaaagccagcaagagccauccccaccccagggcagccaaugaagccuggacacucuuaaggaaaugccuuuacucagggaaucuccucuuugacacagaagaaccuguugaugucugcagguggggucuggcaauguugcaccaagggcagcuugguuggacuugccccguucccacacuuguguuuccagcacugaacaauaaaccauuucagagaagcauuugcagagaucucuagugaugccuauggcuguugcuccuaggcugugaguggucagaguauccagggaauacaagcagaaaggaaaggagccuuggggcaaugaucaacuuguacuuuaauggacuacucaguuaagacacugcugcagucggaacuacauggacaggaagggucugagguacccuuaccugggaauugcacauggucuguuucacuggggcagaaacuuagagucaggcccaaguggccauaugggcaggcugccuaccacugcagaggguaccucagcguggaaggccaacgaacuggcaccccaguggccagacugcucuaaugaaccacacacagucuggggucucucucgucuugaggaaagcaggcaggaggcccaggugcugcuuccacaggcagaguaggugugcagacuauggucugacggucacaggaaugccuuucacauguugguacucaugcgugacuggcuguuggcuggagucagcuccccuuggcucccuucucuaggaggagacugcaguggacagggaggguucaguggaggcugugugagugccgcccauucccucgcaccccaggcucuucaccuugacauggaucugguugcggagcacagcugcucucagaaucauagcuuuggcacgucguuggaauuccuugcccaucagcagggacuucucaaagguggugcuacgcugauccacaucucgagcauacaguaucuggacaagaugagaaggcucagaacagcccaaggggccuccacaccacacacucggcagucccaaccccguggacccaccuugcugugugagucgaugcgggcauuaauaaggcccuccagaaugagcugugucagcucaucuuccagagcugcaacuguuguguugaaggcugcagccaucuugugcauaucagcugacacauaggggcugaaguacuacaggacagaagccacaagcuguccacugcuccucagaaggucugcauuccacacagcccuaaccauccaagcccccuugccccaacaccgacgcuuacuuggauaagagcccgguuacgaaucuggguguacaguguccugacgugaggggccagguacauguccaggagcagguuauccugcagaggagagcuggucagagacccccgaggugugcacaccuagcucaguuccagugugccuuacccuugcgccuuaccuucaucucguccagcaucuucaagcaugaggcauacuuggauucauagaauuugaagaugaugucucugaccuguggcuccagcuccaggaacagcuugaaggaacugaggauaccacaaugcucaacuaagaagggacggaagggccuggcuggacaagagaaggugggagcccacuacccaacuuaccugcuggagaugacauuucguugcagcuccugccggucaaagguggcuaaggcacacaggccaccauagacagccacauugcugggggacagcagcugggaggcagaaggggaaguggguccagaaaccugggguccugggccauugacgggcacacagaccaaggaggaagcccaaaguuggggccuacucuaccuuucccacuacccauaaagacgaugcuuagacccucauugacgagagguuaaagcccaaucaauccacgagcgcgcguucacuuccccuuacggacuuggacaaccugaacagugccugccccuccucaccucugggaagucacagugaucaaaggaagccagaaggaagcacuuggcugcuugcuuauacuuccgugcggccagcu

SEQ ID NO: 6539 - RNA, 18704 nt, Mus musculus
cguggaaucgcagcgacacggaccuguccccccgcguggcccugguguccuccucagugcagaguuuccagugugaccaagcacgcccgacccacacugcgcgcgcacagugcacaccuggcaccggccgcgagggggugggggugggaggacagagaugagggcgucgggaugagccccgcguggcccgcgcgaggccgggggcggggacggaagcaggcgggggcugcgcguuccuugugcuccagcgcgcgcccgugcagggucccggcugggggcggcgcgcgcgggcaucaccccaccggcggcggcgcgccgggucccggggcgcagccccgacgcucauuggccugggcggcgcagccaagcugucagcccauguggcguggccgcgcggggauggccgcgguuuaaauagcgccggcgcggccuagagggagccagagagacggcagcggcgucccguccaguucgccugccgcgcuccucgcuugucgucugccuccagagcccagacagguacgccgcugcguucgggguuccggggcggcaggccggugucgggaugccacggcuccaguggaaggauaggcgggcgcccauccucggcaccccugcgcucacaaaagcgccgccgcgccccuccgacagccagccaccgggcugagcuccgcgaucaggccgagaggggcgcgggaggggugugcggagagccagcgcggcgggccgcugucacgugggcgccgcgccaaccgggugcaggagucugggcgccucguggauggggccggggccuucacucgcacugggcggcuuuggcagggcgcaggaggccgcggugguacccgggcuucagcuuggagaaggcagaugcgggucugggugcgcacgaggccccaggggccucagcggaagucaucagaccauccaggccucaccggcuggguggcacggaagccuucucguuggacuacgguugcaaggccugaacugcccugggcaagugccuuagggacaggaggaucuagcagauccuucugcugccucggccagguuacaaaguguucgaccagauggcgagaggcuucaccuuuccccuaaccgcaccaagcugagaguaguauuccaggucggaccuugcugaaaggguccauuggcaggggaucgguuugccucagcccugcuaggccugggcacucacuaguugucgggccuguucccucuggguccuaaccaagccuggcguccuggcuggcacugaacggcagucagucuccacccucuucgugaaagggaagcgcgcuggcuuccccguggcuuaaggugagagugccccagacccuguuucuugaagccccacuucuguuugcaaguuccugauuugacuagccugggauggagcauccaguaggcaacuggagauccuauggucccagguagcucuggcaaaacaugguagggucaggccaggucaagugucuacccuggaagggcugacaaucucagaaguagcuaucagugcaaggagaccuaagcacucagcucauccguuguuuacagcugaguucugcuaguuuccacugggggcuuucugagcccuugcucucagaaagucuugaggugugcuaccuguggauuuagguggcuguagcugggaaugacugugagagacccaccaugcuaucuucccccacagagaagagccauggaggagguggugauagccgguaugucggggaaguugcccgagucagagaaccuacaggaguucugggccaaccucauuggugguguggacauggucacagaugaugacaggagauggaaggcuggugaguguccccucgggaucaugcagcaggauggucugagaguuuaugaccaaggcacuucuggagacagggaacucccuguagagcuagcugugagguugagaaccggucagaaugaaaagggacaggugacuugguugaucccucguggaggacaccaaagguggaucauagaagggggcuggcccuuuggauaucucaucugcagccugugcccugagcuggcagauggugucuaagaugacucucacacccaaugggcucuaacagagccacagagcagcucuaccugauggacaggugugagucagcauugggcuggccuggccagccugggagcaggcagagggucucccagucgccagccucaccuccuacaggguuggcucugggucacccacauguggcuguuuugggacuccucacuagcagugagucugggucacucucugggagccuggcuucagaggcugugauguuccucagggcucuauggauuacccaagcggucuggaaagcugaaggaucucuccaaguucgacgccuccuuuuuugggguccaccccaagcaggcacacacaauggacccccagcuucggcugcuguuggaagucagcuaugaagcaauuguggauggagguggguuguuggggaauuccuacccuuuuuagaacauacuguaaugagggcuggggacauaguucagugguagcgcaacuugucuagugugugcaagaaccuggacuucauuccugguacuguuaaaaggaaaaggagaugcaacaauaauaucuuuuuggcucuugagacaucaagggcucagagacaggccuggcaugggucucucuagcuauguccccaauccugauacagggccgguggcucaggaggcgggggcccugagcagggcacaguuucacaaccgcacacuagaagugucccaggcgcgcccuguuacccuaguuuccucacuccccaaugucugguuguucuugggcugagggcggggcuuacagcagguagcucugcaggggcucagccucgagcuuuggcaacaacccugucccacuggcugucucuuauucuggauccuacugcuugggacauggaugugcccccagggauagaaggcccuauagugggcagcgaguguggguugguauggugggggugcgcuucagguugggagauguuaauuagcccuauacuugauagacagcuugaugcacaacugcccugggguaugguauaagaccagcgagcccuuggugaaaaugaaggcccucaccucggaccugucuggcugcccaggcucuaucaaaggcugggcacagcucccaggggguuacccacgguccucugcuuucccggcuuggacacuuggccuuuguguuccuguaucuccuuaucacagccugucccagggcaggcugcccuuggcacuagagaacucauuggccagcagccucuugagacccaccaguaacaccagaggccaagggaguugccuucagacaaugcuguucucugucuuuccuauggccuccuauggguugcugccugacccagaccuuagagguucacuguggccccugauggcaucucucucacccaagccuguguggcucuugcugcccccggcagguaucaacccagccucacuccgaggaacgaacacuggcgucugggugggugugagugguucagaggcauccgaggcccuuagcagagaucccgagacgcuucugggcuacagcauggugggcugccagcgugcaaugauggccaaccggcucucuuucuucuucgacuucaaaggugggugggcagcccagccuugggcacgggcccagcugcaugagugcauucaccuagacaacccuuuaggacuuccuuauuccugggggaacgcugagugggguacucaaggccccagcggggugcggggggugcggugugggacagcaucugcccuuguccacaggaccaagcauugcccuggacacagccugcuccuccagcuugcuggcacuacagaaugccuaccaggccauccguaguggggaaugccccgcggcccuugugggugggaucaaccugcuccugaagccgaacaccucugugcaguucaugaagcugggcaugcucagcccggacggcaccugcagauccuuugaugauucagguaaggguggccuggggagcgaucauuaggcucugcuuugcagggcuccagccuguacccugaguguggugucuuggcuucugaugggcgcacacauguauagacucacaacacacacaccccaucaccccagagcaccuagcugagguguugaccuacccuagggaguggauauugucgcucugaggcuguuguagcaguucugcugacuaagaagucccuggcucggcgggucuaugccacgauucugaaugccggcaccaauacagauggcagcaaggagcaaggugggcauggagggaaaagaaagagcauggaucauaagaaauggggaagaggggcaugcaaggcuucauaccauaccguaccacuacccaucuaccguagguguaacauuccccucuggagaaguccaagaacaacucaucugcucucuguaucagccagcuggucuggccccggagucgcuugaguauauugaagcccauggcacgggcaccaaggugaaagcccuuucugacccauaccugugacuccucuacccuuguuagagguccuuccggcugcagccuuaaccuacucuguccccugcaggugggugacccccaggaacugaauggcauuacucggucccugugcgccuuccgccaggccccucuguuaauuggcuccaccaaauccaacaugggacacccugagccugccucugggcuugcagcccugaccaaggugagcagacugggcucugggucaagagucccuguuauguggauagcuguguaguguaaccauuacuuggccuaccuuggggcuccugccugccuaccagcuggcccuuugacuguaccgugggagcauggggcuacccuuauggcacguucccugugguagaugugccgacuuauauagcuucuggccaaagggaaaauuugguugcaaaaaggaaagguacaguucugaagaaguaucuaggccuccuucugaggugagggaggauugagccaacaucugcuauggcgugcccuuuccugcugggugaccuugcacaccugccuguccacuuguugggaccuucagcuugcuucuacauugggggaugugugguugucucgaugacccaucuguuugggcuucugggccuggcuuggggggguuguguguucaggccuacggcuccucaacuuggagacaugcacccuagaugacacaaaaaaacaaggucagaggacaagggucuuggugcucaguaccacacacaggucacgggcccaggggagguagauagccacacuuggugggaacagcugcccaguaacuguguucuauugcaggugcuguuaucccuggagcauggggucugggccccuaaccugcacuuccacaaccccaacccugagaucccagcacuucuugaugggcggcugcagguggucgauaggccccugccuguucgugguggcaacgugggcaucaacucauuuggcuucggaggcuccaauguucaugucauccuccagcccaacacacggcaggccccugcgcccacugcacacgcugcccuuccccauuugcugcacgccaguggacgcaccuuagaggcagugcaggaccugcuggaacagggccgccagcacagccaggaccuggccuuugugagcaugcucaaugacauugcggcaaccccuacagcagccaugcccuucagggguuacacugugcuagguguugagggccguguccaagaagugcagcaaguguccaccaacaagcgcccacucugguucaucugcucaggugagccugccccuguguucccaggcugaccuuuaaaggaggaggggggugucccuuuuuuugagggugaggcugauggguggccaugcuguggcccugauaagcuuucugucacagggaugggcacgcaguggcgcgggauggggcugagccucaugcgccuggacagcuuccgugagucuauccugcgcuccgaugaggcugugaagccguugggagugaaagugucagaucugcuguugagcacagaugagcgcaccuuugaugacaucgugcaugccuuugugagccucacugccauccagguaugccacccguguggugcaggcauccuggggcacuugugccaagguccugccuuccgcaccaguaucacauaguccuggaccagucugguguguaggcagagccuuauacugguacgagccuggggaaggguaggacuuucucagaggucucugagagaggccugguacccuuggccugcugggcuuuacgguuagggauugucaggcuagugaucuaggggcugugugacauggccuggguccccgcuucacagauugcccucaucgaccuacugacuucugugggacugaaaccugacggcaucauugggcacuccuugggagagguugccuguggcuaugcagauggcugucucucccagagagaggcugugcuugcagcuuacuggcgaggccagugcaucaaagaugcccaccucccgccuggauccauggcagcuguugguagguauccuccaaagggcucccaaccucauuaggcaccagaaucuuccuggaagggguuucuguccuggguccuccaaaauaaccugcugcuuugguguaggacaugggguugcaaagggagaggucacucuguucagguuaucuacaguuucgaccccacaggccugagcagagucugaaacaccacacaugagaugagggccagggaacugaggagagcuucucacuagcccuggguguucacugcccagcuccucagcugcucacccugacgcuucccuugagaucagacacagcaagggggaaaaugcccuggaaggcggacauuugucauuucaccaacaacauuggccccagguagugcucauguccaggaggaugggcugggcucugaggccagccacucuguuugcagguuuguccugggaggaauguaaacagcgcugccccgcuggcguggugccugccugccacaacucugaggacaccgugaccaucucuggaccucaggugggccugcaguccuagcaggacuucuguucccugcauuuugcccuggcccuaccuaggaggccaggccuccucagucugugucuaggcccagcuggugagcuccccuugucucaggcccucugggugaaaccuaagcugggcggacugugugugugucugaccagggagggccaguccaggugcccugaccacucuccuugaugccugcaggcugcagugaaugaauuuguggagcagcuaaagcaagaagguguguuugccaaggagguacgaacaggaggccuggcuuuccacuccuacuucauggaaggaauugcccccacauugcugcaggcucucaagaaggugaguaccuggcuguaugaguagaccugagggcgggugacaugacuucacgugcuaacccagcuccugugcaggugauccgggaaccacggccgcgcucggcucgauggcucagcaccucuaucccugaggcccaguggcagagcagccuggcccgcacaucuucugccgaguacaaugucaacaaccuggugagcccugugcucuuccaggaagcacuguggcacaucccugagcaugccguggugcuggagauugcgccccacgcacuguugcaggugagcaccuggucugccugggauaggggcccagcagccugccagucacuggagaaggcgaguguggcacggaaggggucagagcccagccccucuuugcucuguguaggcuguccugaagcgaggcgugaaguccagcugcaccaucauucccuugaugaagagggaucauaaagauaacuuggaguucuuucucaccaaccuuggcaaggugcaccucacaggguagguccgguccacucuucuuucuacuacucgcuuaggggaccacaucacccaccaacccagaagagggguugcugucagccuagcucaguucuggccaucgguccuggggccagguaugucacucagcucuuuuaucaccagcaucaaugucaacccuaacgccuuguucccaccuguggaguucccggcuccccgagggacuccucucaucuccccucacaucaagugggaccacagucagacuugggaugucccgguugcugaggacuucccaaacggcuccagcuccuccucugcuacagucuacagcaucggugagccaggccucguggcgggcagguuccuucccaggcaugugggccagugcugagccauuuguccuuacagacgccaguccugagucgcccgaccacuaccugguagaccacugcauugacggccgggucaucuucccuggcacuggcuaccugugccugguguggaagacacuggcucgcagccugggcuugucccuagaagagaccccugugguauuugagaaugugucguuucaucaggccacuauacuacccaagacagguaagaggccccuucggugggggcugcggagauugauugucaugccugcucugcugacccuccuucuuccucugcaggaaccguggcgcuggaggugaggcugcuagaggccucccaugccuuugaggugucugacacuggcaaucugauugugagcggugaguagggccuggcugggucugugggcgagggaucccagcuccuggccugccccaugcuaaggcccuccuguugcuuugucuccuacaggaaaaguguaccugugggaagacccgaacuccaaguuauucgaccacccagaagucccaacacccccugagucugcaucggucucccgccugacccagggagaaguauacaaggagcugcggcugcguggcuaugauuauggcccucaguuccagggcaucugugaggccacccuugaaggugggcaagagcaaccucugagucagugagcaugacugccagaagccauguccugcuggggauggggaagacagggaggaaggacguagaggcgcuggagcaguugaggccuggggugcugaccagccccucugcugcaggugaacaaggcaagcugcucuggaaagauaacugggugaccuucauggacacaaugcugcagguauccauucuggguucuagccagcagagucuacagcuaccuacccgugugaccgccaucuauaucgacccugccacccaccgucagaagguguacaggcugaaggaggacacucaagguagcucuggcccuagcucuaugcccuugcauccugggcugggcauugccuacacuaaccagcgugucuccauaguggcugaugugacaacgagccgcugucugggcauaacggucucuggugguauccacaucucaagacuacagacgacagcaaccucacggcggcagcaagaacagcugguccccaccuuggaaaaguucguuuucacaccgcacauggaggcugagugccugucugagagcacugcccugcagaaggagcugcaacugugcaagggugagggucccaagccuucuccccuccuccuucacucucugccucugaaacucgccagacaaggccuggacaguggggagcuugggguugaugagagcagccuaccuuccaugggccuccagcacaaaacuacugcauccuuccuuuuuccuucccguggcuguuucugcuguggacaagcuaggaagugggcccuggaaguuggcgggaggccuuagagagagaacauaggccuuucuccaucccaggucuggcacgggcucugcagaccaaggccacccagcaagggcugaaggcggcaaugcuugggcaagaggacccuccacagcacgggcugccucgacuccuggcagcugcuugccaguugcagcucaacgggaaccugcagcuggagcugggagaagcgcuggcucaagagaggcuccugcugccagaagacccucugaucaguggccuccucaacucccaggcccucaaggccugcguagacacagcccuggagaacuugucuacucucaagaugaagguggcagaggugagugcuggaaagaagguggacaggccaugugcaugcaucuggggcagucucgggcccgaacccgaaacaggcagucgugauguagcagcuuacugugccuuugugcuuugguuuguuccacccuaaaagacuggaaauauuuucacugcuaccagcccaggggaugagauaucagaaguaaggcuuaugggaaagaauccugggaugcuuugggcucucagcuggggugucauaggcagagucuacaggagaguagaguagagcacugguagagccuccuggcuggcaucaacaugagacugagcagcacgaggggugcucacggcuggcauugccacgagacugagcagcauagggggugggggaugcucacccaguccccaggguuucugcuuccuagagacaauagaucuaagaugcccucccaccccaggugcuggcuggagaaggccacuuguauucccgaaucccggcacugcucaacacccagcccaugcuacaacuggaauacacagccaccgaccggcacccccaggcccugaaggauguucagaccaaacugcagcagcaugauguggcgcagggccaguggaacccuuccgacccugcgcccagcagccugggugcccuugaccuucuggugugcaacugugcauuagccacccugggggauccagccuuggcccuggacaacaugguagcugcccucaaggaaggugguuuccugcuagugcacacagugcucaaaggacaugcccuuggggagacccuggccugccuacccucugaggugcagccugcgcccagccuccuaagccagguacugcgccuagguacacagggcagguaauggcuggguaugguucggccagcucaguacuuaaugagacuucauacacguaggaggagugggagagccuguucucgaggaaggcacuacaccuggugggccuuaaaagguccuucuacgguacugcgcuguuccugugccggcgagccaucccacaggagaaaccuaucuuccugucuguggaggauaccagcuuccaguggguggacucucugaaggucagacucuggggcuggguaccuugccuugccuggcauaugaacagcccugaggcugacccuccuuuauccugcagagcacucuggccacguccuccucccagccuguguggcuaacggccauggacugccccaccucgggugugguggguuuggugaauugucuccgaaaagagccggguggacaccggauucgguaggaaagacucugagaggugccuacccuuccuccuccccucccucccuccagucuugguauccuuacucacuuugccccacagguguauccugcuguccaaccucagcaacacaucucacgcccccaaguuggacccuggcucuccagagcuacagcaggugcuaaagcaugaccucgugaugaacguguaccgggacggggccuggggugccuuccgucacuuccaguuagagcagggugagcccacugaugcccuauaccugacaggccaaggaggaggugggggacaaagagcuggccagguaggcacugugacacacauauccuugcuuucuuuucccucagacaagcccaaggagcagacagcgcaugccuuuguaaacguccucacccgaggggaccucgccuccauccgcugggucuccuccccccugaagcacacgcagcccucgagcucaggagcacagcucugcacugucuacuacgccucacugaacuuccgagacaucaugcuggccacgggcaagcuguccccugaugccauuccaggugccaaccaggauggggucuugugacugggucgcuguggaaguagggaaugugccugugccauagcagcccagcgagaaggaaguuguccugcacagcuccuggggcagagaggguccccagcaccagggcuguacuugcacccugugccccugacaaccuguccuagaguggggucuaacgcgagccucccuccugucugcucagguaaaugggccagccgagacugcaugcucggcauggaguucucaggccgggauagguguggccggcgugugauggggcugguuccugcagaaggccuggccaccucaguccugcuaucaucugacuuccucugggauguacccuccagcuggugaguggguggcugcaguugggagaugaugugaucuugguugguggccaggcugagucgaucuugugcuguguacccucaggacccuggaggaggcggccucugugcccgucgucuauaccacugcuuacuacucguuagugguucgcgggcgcauccagcguggggagaccgugcucauccacucagguucagguggugugggccaagcggccauuuccauugcccucagucugggcugccgcgucuucaccacuguggguaaggccccuuaccucucccaaacccuuggagcuucuugagccccgugccccaaacucacuggggucucuccccugacaggcucugcagagaagcgagcauaccuccaggccagguucccucagcuugaugacaccagcuuugccaacucgagggacacaucauuugagcagcacguguuacugcacacagguggcaaagguacguacgugucccccgggccgcugccugagacuggaccacacagucaaucuggcccucaggacugagguaugggugagcccacccugaccgagugaccuguuugccacuauaggggucgaccugguccucaacucacuggcagaagagaagcugcaggccagugugcggugcuuggcucagcauggucgcuucuuagagauuggcaaauuugaucuuucuaacaaccacccucuggguaugacugguaguccagggagcagggcugggggcugguguuggggccagaggcguccaucagugaacaugacucuccucuucaggcauggcuaucuucuugaagaacgucacuuuccaugggauccugcuggacgcccuuuuugaggaggccaaugacagcuggcgggagguggcggcacuccugaaggcuggcauucgugauggagucgugaagccccucaagugcacaguguuucccaaggcccagguggaagaugccuuccgcuacauggcucaggggaaacacauuggcaaaguccuuguccaggugaggugaggcgagguccucgggcgcccagcccgccuuggccuuucuuaguuuguuacuguguguggcgggcgugugugggagggaggacagcgugguguaggaguugguucucuacacacgcacgggucagcaggcuugguaccagcaccuucagccacugcuacuuaucugcagguacgggaggaggagccugaggcugugcugccaggggcucagcccacccugauuucugccaucuccaagaccuucugcccagcccauaagaguuacaucaucacugguggccuagguggcuuuggccuggagcuggcccgguggcucgugcuucgcggagcccagaggcuugugcugacuucccgaucuggaauccgcaccgguaagcaaguaggggcggcugguaauuaauguaggcuucccuuugaugggagguguucuaggaugggcugcaggccacgcuuauccucuggugcagcuccauagcccugugucccauaggcuaccaagccaagcacauucgggaguggagacgccagggcauccaagugcucgugucaacaagcaacgugagcucacuggagggggcccgugcucucaucgccgaagccacaaagcuggggcccguugggggugucuucaaccuggccaugguaagaaaggcaggcaggacucugcguaccucuagagccugagacccaggguagcugcuaagugggguuagaaccucagagccgcagcaagcacuaaaaccucugcuuccagguuuugagggaugccaugcuggagaaccagaccccagagcucuuccaggaugucaacaagcccaaauacaauggcacccugaaccuugacagguaggcugucagucccucuguugaguuuuacgcaugcucgcaauguguauugguuccugcugugccaccuguggccuucgcacugcccuggggagguuaugggcuuagggacaugagagcugucugagcugucagacugacacacgcacccacagggcaacccgggaagccugcccugagcuggacuacuuuguggccuucuccucuguaagcugcgggcgugguaaugcuggccaaacuaacuacggcuucgccaacucuaccauggagcguauaugugaacagcgcaggcacgauggccucccaggugggcuucucuguccagcccgccccugcuuguggucucacuccccaaagcaccucaccugcugccucccuugcucacaggccuugccgugcaguggggugccauuggugacgugggcauuguccuggaagcgaugggcaccaaugacacagucaucggagguacgcugccucagcgcaucuccuccugcauggagguacuggaccucuuccugaaucagccccacgcaguccugagcagcuuugugcuggcagagaagaaagcuguggcccauggggacggggacacccagagggaucuggugaaagcuguagcacacauccuagguaagccagcuuugggguccugcccagcccaguugacuaaguaucagcugucccaucuguagaagcagaggacagaguucuguggucugaaugcuuggcugggugauugucaguaaugcuggagagccacagcauguaccugguccccauguccccuucuacauaauggccacuuaucuccuucggcaggcauccgagaccucgcagguauuaaccuggacagcacgcuggcagaccucggccuggacucgcucauggguguggaaguucgucagauccuggaacgagaacacgaucuggugcugcccaugcgugaggugcggcagcucacgcugcggaaacuucaggaaauguccuccaagacugacucggcuacuggugcguaccaggcagcaggcugagaaaguccugcuaugucccaucaggggcagccaguaguggaggcaacagcucugcccuuuuacaaagagcacuggggccugugcuuagucugugugcauguccucacgagcccacaagccaaggcuacccugucuccuccgucuuuacagacacgacagcccccaaguccaggagugacacgucucugaagcagaaccaacugaaccugagcacacugcuggugaacccugaggguccuacccuaacccagcucaacucggugcagagcucugagcggccucuguuccuugugcaccccauugaggguuccaccaccguguuccacagucuggcugccaagcucagugugcccaccuacggccugcagugcacccaagguacugugcacauugcggagcaguacucacugccucgggccuugguaccccgcuaacugcuaagcuauucugcuuguuguucuagcugccccccuggauagcauuccgaaccuggcugccuacuacauagauugcaucaagcaagugcagccugagggacccuaccgcauagcuggguacucauuuggagccuguguagccuucgagaugugcucccagcugcaggcccagcagggcccagccccgacccacaacaaccucuuccuguuugacggcucacacaccuacguguuggccuacacccaggugagagcugggccaacugguccuaaguguugcuaccugugucuuggcuuugaauucacuucugggaggguccugguuccuucagcacuugccacagcaaucucuccuucccugacagagcuaccgggcaaagaugaccccaggcugugaagccgaggccgaggcugaggccuuaugcuucuucauaaagcaguuucuugauguggaacacagcaaggugugccuggagacacccuagagagggcagggaaggcaaggcugggcggaguggggucugugugccuuuaaaguggaccagggagaucugagugccucuucagaaacccaucugcucaugaaggcagggcagacuguguggccccgccccacaugcucagaacugucaccccuaggugcuggaggcccugcugccacugaagagccuggaagaucggguggcugccuccguggaccuuaucacuaagagucaccacagccuggaccgccgagagcugagcuuugcugccguguccuucuaccacaagcuccgggcagcugaucaguauaagcccaaggccaaguaccauggcaacgugacacugcugcgugccaagacaggcggcaccuauggcgaggacuugggugcugacuacaaccucucccaggugaguggcacaggugaggcagguguacucgcacaggugggcugcuuggugguggucacagaaugacaccugaguauuuucaggugugugacgggaaggugucugugcacaucauugagggugaccaccgcacacugcuggagggcaguggccuggaauccaucaucaacaucauccauagcucccuggcugagccacgagugaguguacgggagggcuagaccugccgaccaccaugaagccacgcuccacaccugccaccagagaugcuccgauccccaccacacccugagugcaggaacuggggaggguccugcuggugggaccccuccccccaguggcccagcaccacccgcuccccugguggcugcuacaaacagaccaucacgcguguguuucccagccgcguagugggguucccagagccacugacuuggagacacccuggucugugaagagucaguggaggcaggagccaaacugagccuuuucuaccguguggcauuugccacgcuggucguuucuccauuaaauucucauauuuauugcauugcugggaaagacccccaggggugacucauuccagaacccccuaaaaugggagaagccauguggggaagauuucugggaaaguuucuagacucaauacacaggcugcuggcuggagccccuuuuugucuuguccugucccugcucacugcagggcaggauauggagagggcugguucccagggaacaaggaccccagcagacacuguagcccguggcccuugguccccagcauccccggcugccccaugaugcagggccauccugacucugcggaccgcaccgggcacugacugucuguuuuccaagacgaaaaugaugcuuggguuuugacuuuucugcagcugucagugugaagaagugucuggacugugucauuuuuacaccaaccugguaaaaaugcugcucuugaugcucuccugaucccacaauuaaacugcacgugagcgagcacugccuucgguucagucucuuuccaguccaggcccggcuucaggcucugauacuuauggguauuccccacaaguggccuccacagcucuuccagugagacuccuuggagggugugccauucugucaguauaaggggaguaugcuaaaauguguuucagcauggagggcuggcuggaggccuugccacuguaguacaagcagaauuuguccaccuuuaaguugcccugagggcaucagcuuagucacagccccgccccagcgguagagaauagcaucauccucuacuuguagucaacugaguguuggugcaagcccucuagagaaaaacguaagcaguaugugaccacugugagaagcaugucccuggaaacaggugacaugacgagagcagagggccugagucacacagaacugaccauguguguaagcagaggaguggagguugcuuggaagaggaggaucaagagaaaaguaggcucaguuuaguggacccacaguagcagccaauguaauuacauuggcuuggagcuaaggcaugguggguccugcaggguggcuuguuggacuaggcaaaguccccuggcuugaggguccaggagagacugucacaaggccgcagcauucgaucacauccagagaggagcauccagaggacaacugcauugguaggguacaaagguguucagaggaucccagucugagugauuagccuaagacugaagcaucugguuggcucuagucacacuuagaaaaauucuuacagcacucgucaugaguuguccauuccuggaaaggaccugcccaaucucuauagugucucuaccuaguuagaguuuacugacucaagggagcagauuuauaaacuugcagaaaggcccgacucccuuacgaggcugugugguccuuagaauucauggaugagaggcaauaaaaccuugagguuccuuccuguucuuugugauugccuaacaagacauaaacugggugugaugagauugcucaguggauagagcgcugugcagccugaguuugaucacuggaacccaugcagcaguagaaaagacuaaguuguccucugaccuccacacaucuguugaguggaacaagacugaaauaaaugaaaacuuaaaagagcaguugcuguccacagggaucuuaagaucuggcuugucaguaugacaaugauuccucacauuaaacaaaagcucaaagaguuuaaaggucaaag

SEQ ID NO: 6540 - RNA, 1160 nt, Mus musculus
cagguguccgcaggggagcagcgcaugcgcgcuguagggggcgccaggccucaugugcaccuugggggccagagugacucagcgccuucgcuuccugcugcuuuggggccucaugggagauauguaaaugagcuggagcaucauggccguugacccuuuauaaggccuuguugguccucgcucgguguucagugcucagugaggagagccuggcuuuggagucccuuagcuggcaccugggcgcucagucagggagguaaggauggaaagggacugggccgagggcugggccgggugagcacggugggcagagaggagauacuccugacguaggcuucccggccucuuugguugguagccgggugcaagugugaggucggggccuugagcccugaggacaacucugaugucaccccagccuguccagagugagcagggagccccgggggccagagcuccaacacccucuccucaaggggggcccugcagcagcccgggggcugggguggggggaggcaaaccucauuuccucugccuuucaagcucuccagacauuggagcaagugugaagcugaagaaguuucuggaagcucaagccugucuacuucuccagagagguauucauuuaauucucacccaguucucguaccacugccccguauccugcagccccaaagccccuagaccuccuacugugcccuguuuucucccguuucucucauucucaccuuuuccaccuauuucuagccucuaugguccuacugagaccaucgagcaagucuuccucuguguguccgcuuagcugcagacagacuucuugaccaugugucccccagucagcguucgccauggggccaagggcauguccugccucuauggggcguggcuguaccaucuuguccauggggaacagaugaagaucugcuuugcuugcuucaaggcagcuuuccucgucguuaagaacaugcuggagaugggagacugggaagaaggagugugggaugcugagcccauggaacucucagaggcaucgucugagcccgaggaauggcccgggcuuagugggggagagggccaaggucaucugccacauggcaucucugucucugcaggcucuggggcucagggaccccagccugugcccacugagcuggggccuc

SEQ ID NO: 6541 - RNA, 2184 nt, Mus musculus
uccucccugguguucagugcuuagcgaggagagccuggcucuggaguccauuagcuggcaccugggcgcucagucagggagguaaggauggaaagggacugggccgggggcugagccgggcugggugcggugggccugggucgggugggagcacggugggcagagaggagauccuccuggcguaggcuucccggccucuuugguugguagccgggcgcaagugugaggucggggccuugagcccugaggacaccucugaugucaccccagccuguccagagugaacagggaaccccgggggccagagccccaacacccucuccucaggggagcccugcagcgggcccagcagggugagccaaaccucauuuucucugucuuucuagcuccccauauauuggagcaagugugaagcugaagaaguuucuggaagcucaagccugucuacuucuucagagagguauucauugaauucucacccaguucugguaccacugccccguguccuggagccccaaagccccuagaccuacugugcccuguuuucucccguuucucucauucucgccuuucccacuuauuucuagccucugugguucuguugaccugaccuccucaguccaucgagcaagucugaaucuguguguccgcuuagcugcagacagacuucuugaccaugugucccccagucagcguucgccauggggccaggggcauguccugccucuaugaggcauggcuguaccaucuuguccauggggaacagacgaagaucugcuuugcuugcuucaaggcagcuuuccuauugaauaaacucuaccuggagaugggagacuggcaagaggaggaagaggaagaggaagaggaagaugcugaucuccuggaauacuugucagagucagagucagagucugagcaggagccagggccugagcaggaugcauggcggggauuggggucccuuuaugugccacagagugucucugaagggucugggguccugcugccaaccccuguguggacacagggcauacuauucuccauuuuugugcccacugagcucuuuccucaggaagcuguaccccuggaucuggguccugaggaugcugaguggacccaggcccuucccuggagacuugaugggcuuuuucccugcucgcaccagcucaucccuccucugacuuggugggauauuuuugaugugaugccaucuccugggcaaccuguguuguuggaguugagaugccacuggcccuuggaccagacaguagcacaauccugguugcaagaccagaaguuuguccuccuguuggauagcguccaaucuaggugccaccugcugucaaugcguguccgcugggucguaaggacucagguccagcacuggcagguguugcuggacccuggugagauguggguggcccauuuucggaaagaaguugggcagcacggccuguaccaucagagccugaaucccuggaggcugagcauccugacagcuucagaauuagggauggaguuauugccugccaccugcuaccuguggaauaaaggcuucuggguagguuccuucuugcccuggcacauuaacaugccagagaccuggagcugggagccaggagagaggcuguuuaucacagaugcuacuauuugugguacugacuaccaccuugcucagucuuuccuugauucccaccccaccccccacccccuccugacccuuacucccugaugcacauuccugagacacuaaagcucagacauuccccagggcccuggggacugugaagagcaagagguugccuguucugagcagcucaggggaacaguugguccaggacuugagggggcaucuugaacauccugugagcuuaugaaccucagagggaagucuggcauguucgugucaguguucaguguuugguaggugaggccuagcuguauguuuagcuguauggaguguugugugguggguguuaugggggcuccggucacagaucuacguauguauggacucugaggcacuaguugaccuuacugucauaggggucauaugcuuacugucuuagggucaagauaccugauuuuaggguucacuguuuuuguuguuuuacuuuguucguuacucgugcuccuuuugagggcuuuuguugaauaaaguugguguuuuaaauuuuauuguuu

SEQ ID NO: 6542 - RNA, 5437 nt, Mus musculus
ccaggacccccaucccaccccaacuuccacccccaacacugaggcaggacacacuucagagaacaggguuuauuguuccaugugcauaugggagcaagaagcuaccguggaauggauggggagagagaggguagagaugccugcaggccccuuaccaaccaaugggggaggguccucaggcuggaagggcuuacaucaaaggucagguuacagccugguacuagcugcucuggguaauuaggccuuacaugacucagcacaccagggucuucagaagagggucugggccacagcuucugaagccccucagagacugguuugaagcaggaauguauuggcaucauaggaaaggcucugauagagcugaugagaacaacagagaagaggggacuuuccacaagaagacagacaagugaguuagguuugaguaggggauucugggaauggguuccugaguggccugccuuuggguccuuuccuacccgcagggucacacaaagcacucucacacaaaggccccauuagggggaacuggagacagcacgagggucucuguggccuguuggcuguuggaggacagugagcggcccgaguccugcuggagguggacacggcuggacaggaagcugccagcacucccugggccacggcaacugcuacccagugaccgcuggcggccacgcagguacucacgguaguucuuggugagcagaguguagaggaagggauugaugcagcuguugccguaagugaggcaggcagucagguaguugaugaugcgugcagucucgggugucaguggcauggccuggugguacugggccagcagcugccauagccagaagggcagaaagcaugcccagaagagaaggacgauaccaaggaugagguagagaacccugggguugggcagccgccgugucugcuugaaggaagcuugcugggauagccaauaggcccuggccagacggauauagagcagcccaaugaccaggccaggccccacaaugcuggucccaaagagcagcgucagguagguacggugggcacgagggccccaggcuggcaggcagaggcucuuagagccccuacggaccagccggauggcaagcaucauggguaaggucagcagcagugccagcaaccaggugcccagcgccaacagcuuacgguaacccuuggagcgcuggacgguguccaggggccucaguacugcugcauagcguucacugcucauuauggucagggugaagaugcuggcaugcauugucaggaaguccaggcuaaagagaacucggcagcccacguccccgaagugccaguccuuagugacguagguggcuacgaugaagggaaugcucagcagauacagcaggucagccagggccagguugaccacauagacguacauggaggccgaggcacgcagaaaucggcacaugaccaccagaguguacacauugcccaccacgcccaccacacccaugguugagagcacugccccgaugacaccgguggccacaaggucuugcagggagcugggaucuguugggccaguccaggaacuguugugggacacauuaaagccaccaggaagcucagacgcagugcuucuggacacggccagcauggggaagcuuguagacuccaggcucagcgccaucucuguccucacccugggcuucugguggaaggaccacugcucggugaggagaacccguggggaacuuguccugugggagaagauuagugucagagauucaaagcugcaaccuacuuccaugcccuaacagccucugugaaggacagagucacugucccucugcagagagacaaaggcucaccaaguccugucuccuguuggaacccuccaaagaaucccuuuugugucaacuacccaggaggacccuagagccauuaggacccgcuguccccaggacacuccuccagcagaacugcaagucacacccaaaagcuucuucuaaaaaguugaccacagugagguguaggucagaguaggcaaaguuaaggacgcuaaguucuggcuucacaaccucagauagagccccauuucccauuuuauguuacgcacaugcuuaaaaaaaugauuucuuccaaucacaaaagcaacagcuagacugggcuuaaagguucagauagaaaaauagguaaaagaaaggccuuuggauuuccuuuuuuuuuuuuaaggaaaugggccugcaccccugccucacauuccguacucagugguggagggcagucgaucaaaagcagguagaagaaaacaguaugugccaugccaggaagaugguuauuguuguguggugugcaugugugagugauuguguacaugugugcaugccacagugaucauguggaggucagagggcaagcuuuggauauugguucuuuccuucuuucccaugcaggucuccaggcucuaacucaugccaucuguccuggaggcagguguucucacccacugagccaccuuaccaguccucuuacccucaaaugacuaaaaaaaccaaaaaccaaaaaccaaacccacaaagucucacuauguagcccuagcuggcugggaacucucuauguagaccaaaagauucugcuuaagugugcaccaugccuggcuuuuuuuuuuuuuuuuuuuuuugagaaaguauagguucucucucucucucucucucucucucucucucucucucucucucucucucucugugugugugugauuuauuuaauauguaugagugucuugaccucacaaauguauauacaccacauacaugccugguacccucuggguccagaagagaauaucagauaucucguaguuggaguuacagaugguugaaagcuaccaugugguugcgggaaaccacacccaggucuucugcaauagcagcaggugcucuuaaucacugagcgaucucucuagcuccagguaaagauuacuaaaaaaaacaaaacaaaacaaacaaacaaaaaaaaaacaacaacaaaaaccuucuuagcguuggagagaucacuugcugcucuugcaggggaacuggguucaauuccuagcauccacauagcagcuaaaagccaacuguaauuccagcuccagggaauugauacucuccucugaacaccuugggcaccaggcacacauauggaauacauacauucauauaaaaacacucauacacauaaauaaaaauaaggguuuuuuuuuuuuaaauaggguuucucuguguaauaguccuggcuguccuggauuugcuuuauagaccagucuggccuugaacucacagagaucugccugccucugccucccaaaugaugggauuaaaggcauggaccaucacacccagcuaguuuuuaaaacaaaaacaaaaccacaaaaucccaaacuucaaaaacaagaacuucacuaaauaaauaaaagugagaugagaaauuaugagaaaagauacaucagguuaauggacuagggagugauauacacauaagaacuguaaaucaauaaagaaaagagugauuagcuauuugcaggagagaaaggcaaacuaaacagguaugucuaaaagaaaacaccccagaggccagaaacuagugaaaccauguuacacagcuuuuugccaucagagaaauucgaaucaaaaccauaaagaaacuguaacaaguacacacaugcacacgcacgcauacacgcgcacgcacacacacacgcgcacgcacacaccacugcuuuggucuccuguaacggcgaccuuaucaguuugugaacucaucucagagggagccacacuugaacuucugccugcuucuguccuucaaacccagccugcagcagucucuuccuccauucucccuacuacuguaucccugcuucugcugcugcuaucuguggucguucuggucgcuucaaacucauuaaacguaaagcugccauuccuugggggugugagugggaucacugguggaaccacacacgucuguuuuguuucauugcaaugccaagcuuuuccaaagcugcuguagcauuucacauacucaacagcaguaacugacaauucuaguuccuucccauccucucucccauaacucaacaguagaugcauugauauuauaggcacacagugugaguguguguggggugugugcacugugguguguguguguucaugugugugugguguguguguguguagguggugugugcacugugugguguauauguguguguucauguguauacguguauggugugaguguauucucuccauguggaacacuggaaagcucuuggagcagguuauguccauucccugcccuaggcagggucacacaggugaacauguaaaacaaaacaauaacaacucccucacccccuaccacccaaucccccaaacucuaagcuucagccaggcugugguggcagacaucuuuaauggcagcaaucaggaggcagaggcaagcagaucucuggguuugaggccggccuagucuacaucucaaguuccaggacagucagggcugcuacacagagaaacccugucucuaccaaaccaaccaaccaaccaaccaaccaaccaaccaaacaaacaaacaaaaaaccccucuaagguucguauacuuacgacuccugcugacuggauuagguuagccucacaagaaaaaggaagcccuaaaggguagacuuucuaagaaggaguaaagaagaccucuuuguacaggccucuccaacauccaggccuaggaaugaaugauaccucuagaagucaucuuucccuuuagucaaagcugaagaaucccggcaggucuaaggugaggaagcauccucaggucccugcacuugcagcuccuagcuucaucugcuccgaagcccucgccccgcugcugucucaccucacaggucagcuccagagacacugagguccuccagccucacuaggaaggcgaaaggacgcagaagacaccaguucagagaagaugaaaguuuccagugccaggcgcugcugcgaagccggccaaaccgcgcucacaggccaggcggcgugcgcucccggcacucccgaagcccucagggccgcacccuccgagaucaagaggugcgagcuggguucgggguccccggacgcuccgcacgcccugggccaugcgucccagguuuugcagcccgugaacgugcgcucaccuaugucacgaagucauuggcugccuuccagcccggggcuuaagagacgcgccgcguccugucacucagauacucgagacccaauggccaucaccgugcacagguuggcuaaugucgcguauggaaagcuguguugcaggaacguccccgagcgcucccccaaccagggcagcgcggagcaagguucugagccuauuugggcucugggcacacgguguggucgcggaucgccggccucccuagagucccacg

SEQ ID NO: 6543 - RNA, 19777 nt, Mus musculus
caucacuagcuucuuggagcugcaccgccuggagagccccucagaacggucacagagcagcgacagugaaccugauggcccugguggccagaguugacaguguggacuggcugcagguaaaugccauccacuucugaugcaucuccaaccgacuugacaauuguaaggguacaggcagaucuugggcaccugccuguggcuccuugggcaguucuacuaugggccaccugccuuuugcuuguuuaugcuucuacacuuugcagaaccuugggcuagaccucugccacaacccagaaagguugcaucuaucaggaugcaggguguggaugcuacaucuagggggggcaaggucucagaaaugagugccuucuccagaguuacacugcagcucuggguugggcagcacagccuggucuggauaagcucacccaagggcaaucugaagcagaaaaugccaagcucucuucagcauaggccuagugccugccuuggagacaccuugccacuccaggcuacuguaagcaagacuccauuccuagugagugagacaccuauaugcacgugggcagacacacuccuaugcacagugaugucuguucccucugaccaucccucaagauggacacucucaguggucaggggcuucccugaaggcaacucuggaugcuggacaccugaccacagaacucucagaggaauccgagugcugcugacuacccaguuccuucuuagaccaugugucugagagcccagcaguguuggagcccagcugucaggaauggaaggcucucccaacccagccuggaaagaaggugcuagcagaggaaagaucaccucuccuggcauccugcagccuuuaagaccugggggaucccuuacagaaacagucuuagccuuucgagccuugaaaagaccugaagaaaacaggcauguggagacacagcccaauaaaucccaguguugagaacugcagcgggaagaacguucaaggccagccugggccauggccucuucuaagaaaaguugguaccaaccacuaaugguccuuuucugcucuucuagucuccuucuggguggacucaaguugcucaaaaguacauuguuuacuaaguucccagccuggccucuaggccuggaagcuguggcucucuggccuaacacagcuccucgaagccucauacgcauaccucaucaggcagaacuggggaauugaaguuacauagacaaaggccuugaggccacuguaccuaagccgagcaugguaguuaggcaagaacuaugaacaggucuucugaagugacugccacuaguucugacuuggggaauauggucccuuaaacaugccaaagugagcuuuuuaaguggauaaguuagagauuucucuccccagaugaaacgugaaguauagcuuguuggguuuuggcuuguugccuauaggcucuuaagguacuuuagacaagagaggaaggugucuuaggugcugucauagacucacuccugggugacagcauucaauucucuauggugguaaaaagcugauuagaguuucugcuggugggacuuccacuucuacuggucuuuuuauuucagaaguaauaaagcucuacaugcaacuugcaaaugugccuuucuguuuucugcuuugcccaaaguuacuguucauacaguuggagagccugucugcacagguguccggagcucagcaggaagagcacaggcuccacauggcugggccagugaaacagaaaucuuggugguguccaggcugauauacagggccccagccucucagggguucugcccugugucccagccugggcuggugggugguggcugucgggcagccgccucacccagguccugcagcagauccugcagucgcugcagacucgggagcacauucuccuccagccacuccucuaugguguccggguagaagaccggcugcagggccaccuccaacugcugcacgagguuguuccaccuacuuagaaggcugggggagacagcagccaugauuugacuugagugugccugcugagacucaagguuacauagcuacacccauauccucagucccuggagcugguauuauuccaugccuccguguaacauugggacaaaaaaauaaauggucacauuucaacaaucaaaagcacacuacugccuggcaguuuuucucacaaccaugaacgggacacacuauuggcagcauguuacacucaguacaauuguacucuuauuaccugcuuagagucuugaacuaagagaggacagugcaggcagccugggacuccagccacagggcauguuaccagauuguaccaggaaaugacagggccagcauggaccccagguggccugauuccaaagaugaggucagcuugggcaugugguugauacugucuuaggccaggaaccacuuagauucuugcuaauauuaggggacguguuacuaagcaguagccuaucagugcauccaagaucuauagcugcaggaccuggagagccugucuugccuuaacacugauagccauggucauugcuacuguguguguccguaaaggggacaagguguuccaggggcugaacaccugggaagauaugaugguggcuaccugagugccuccggcuguaugugcuggaucauaacugggugaacaagcuuccgucuacgaugguaggggcugaaccagccagugacauaccuggagcaaauccagacagugucaguggagccagugugguuuggagauaacugggggcauggggggugggguggcuggcuuaagaaucuggugguaauuuuuagaagucuuucuagaaaagccuuugugaagaauagugccaggagacgugggagccacuuaccuguuccuuuccagaaguguguccacagagcugcgcagguggagacuaauuugugugacgagggcauggaugucacugccagggaaggagccagcucccucacugccagagagucacacugagaacaguggucucggggggggggggggaagggaugucagggaccgugggauuaccuuacaguauccgcuaucuccaggcuugaaaccccaaggaagcguuccgcucucagccuaacauccucagcaaagccuccugaaaccguccacaggcagaagugcucagagagaaccccugaccuuugagugcuaugggcaaaaggcacagcaucuuggggagccccagccaggccagguggcugcuuuccagugaacaugugaaagguuguagcagcacaaucugcaggagccccuggccucaccacacaguccauguacaaguguccaggcucagaggcggaguagucuagagcaccugaaacaggaugugagacaggacacacacaccucccagucagcacaaaaggcugucucaggaagccacugacagaggguuccuggcucugcacugaggggucuggguuccagcauaaucacucuucaaaaagagcuaaagccaaccacuaacaucagugccucuucagugcugagggcuggcugugcuuauuguucccuuguuuuucuacacacucuagacacuuuacacuuuacacuuuucuuccagggggaagaaagcuaaauaaaguaagaccacuuccacaucucuccugcaggccacagcugcuaacugcuuuggggacccuucuuuacauguggacguccuuugagugaggcugcaugggcuaucacucugagcagugcccaugccugcuuucugcaaccaguuguuuccucaggucaucuggguguaggagcucugggauaaaggcuccugcagcagugggggcacccaguccuggagagucuucggaacacuuaagcagcaaagagaaucugcaucugcaccuaaagcaugaauuaguuucuuucuuuuuuucuuucuuuucucucucucucucucucucucuuuuuuuuuuuuuuuucuuuuuugguuuuuugaggcaggguuucucuguguagcccuggcuguccuggaacucacucuguaggccaggcuggccuuuaacucagaaauccuccuaccugccucugccucccgaguacugggauuaaaggugugcgccacaacugccagcuaagcgugaacuucuuauauacguucucugaaucuguggggcauguccuuucuaacuucccaaacuaccugaggcucaggcuggggaucuggguacaggcaauccuggaccagcugguauuuaagcaagugggcagacuagaaacaugagggccggcgagagcugucggcugggacauaccauguacaagugacuguaggcaggcagccagggaugggauccccaccggaagcagcucacacagcacagagaaguggucguaccuauguccaggagaagacuauucagcucuacagcccauaaccgcuucagccugaugaggacgccugauuugggguacccucucuuauguuuugagggguuccuagacuaggaaccacugugggcaaacugguguaucaggauuuccaaaguggguuucaagucauggggauuuugcauuagguuggcaauaaugcccuggggaggagccuguacaggggaaaugagcucugagcaucugggcucuccacaguggaugcuugguauggagcuccuguagagccuuuuccuguacaguccgccucgaaaggcuucuucuguggccuguaucccaucuauccaucucaugcuuuuccacaaggcuccagguuagagugggcaucagaucuccaggucugggcagagagccucuaccuggccuggccuguuucuucagucauaaggggcuagagagaugcuccucaccugagguacauggaggcugacagaugggccagcaucacuggucauuaguuuucuuuuaccucugugagucacuagucacgauccaaugcauagaaaggguuucacucucugugagagucuugguuuaacucacaccucaauauacucuaccagaauggcaaaugcuugguaagucuucaaugagccaccuagaaucaucucugaggccaaccacugaaagcacgagcaacuccuauaaccacacuagccagccucaguuggcugagcacccugcucugcagucacauuuuagagccugugaaggccccagggggacaucuuuccagcuuuuccuaguguacuuggcuagaaccacagacuggguucauccuauuuuucaaagcauaugacauccuaaaagaacugggacuaaucuucacguccugcuacacaugagacauauguguagcacacaguaucacacauggaacaugcagacuccagaggcugcgugcuuguggcucgaccacucaauugucuccucagcagaguuaaugaggcaaacacagaggcauggagaacaugauuugggaagaugagcugccauguuggaugacaggaacucuuccucacuuccuaccccagccccugagagcuuaccucugccagcccgucaggaugauuccuuguagagcauccuuugguccacugccugccaccugcagccacagcucaugguuucugauguggugcucaacagggggcagagccugacuagcuccuguggcccccuugaaggcacuggcagcccacagccucuggaagccacacuccugguacuuuccuaugaggaaaacuaggcaagaaagcaagcagaugagcaucucucacagagaguuccugcauacacagccuaaccagagcagcugagagccacgccucaucuagcagagaggagacaccaaccauucccacaaugcccgugguuuaucauucaucacgaauaaacacuucaggaagagcuggaaaggaccugggaugaucuggagccagcaggggauuccaugccaggacagggggcuuugcauaaccuuucuguuccaugcuggaaaagcuaggcuaauguggugcccauauuuccaggcuaaauaguucagguuacaggguuaugggagacugggaaacagucaugcagguacguguaccaugaggaauguauugugagcaacccguacugaccuuugccauggacauccaggucagcuccauagucccagaggacaggcuccaccaguugaggcaccccagaugcugccaacagagcaaggcugugagugugguaaagcccacucaggucacacuccugcuucucagacguauuuguuuugauauaggagucucaguuugucacccaggcuggaccugaacuccaauccuccuaucucagccucuuuuuuuuuuuuuuuuuuuuuuuuuuggguuuuuugguuuuucgagacaggguuucucuguauagcccuggcuguccuggagcucacuuuguagaccaggcuggccucgaacucagaaauccgccugccucugccucccgagugcugggauuaaaggcgugcgccaccacgcccggccuaucucagccucuuaaguacugagauuauaccaugugccaucaugcucuucccuggcacauuccuuuaauguuaaaguuaaacaugaaccaucucaucaggucuaguggguuuuaaguacagcuugcagcuguguuucuguguuuugggccagaaacaucagagcuacaaaugauguuuguagcugccugcuuuugugaggagggauuccuaaacucuucuccaagcugccugccuugcugccuuggggcacuggaguacaucucuaacucauuaauguaaaacauauacuggccucacagaacauagguacagcuggcccuggauaucugcacuggaccucaggguuuaguggagcuaggcaaugcaucuaagugccaaucucccaggcuguggaagguacucucagcuuucaucuccaggcuuugggccaguguggcaucuucaaggcuggccacagaguacacauaggacuaaagcuaucagaagcgcuggacaugccaauggccccucugggccugucaguagccacgccaauuucuguucacacuccugcaaggcuguacagugauuuaaaggggacagaacccagcacuuucacuagagcauacauuaagaccucacuuccaaggccucugaaacuugaggucuuaggcagccacauauaacccccauccacacaggcccugccaaccuuuuagcuguuccugagggaugucccguagcaugucaucccacaccaaggguguuacgccagggugcugggucagcacauggcuggcuacugccugcauguggcucaggcacaauuucgcauggcuguucuguuccugcuguagccacuguuuugagguuucccccucacccaaguaguagaccuaggaggaagaaacaggaugggauuguaucuggugccauccuuaggacuacaggguucacacuuguccugaaucuugggguggcugcaaguacagaggagaguagaaaggaacuuagcuuccuuguuuuccaugggaauacugccuuucuuagacuggauucacuuagggcuucuuuggguucaaagcagcuuugcugagaugacuaagaggcagacgaccuuguuaacugacugaggagugggugcugggaauugaacccagguccucuggaagagcagucaaugcucauaacugcugagccaucacuccagcagccaccccccccccccacuccccugcuuugagacaggauuucauguagccucggcaggauuguaauucccuaugcuauaaagucugcugggauacagguauguauaaucacaucuuacuuucggauuuccuuaguuugagauaccagggcccaagaugaccuagaacucacuauguaguagccuagcuggucucagguuugugacgcuucucuccacaauccuccaagugcuacgauuacaggggucagccaccauaucgaacucugauuuacuuuuaaaacuggaaaccucaagguggaaugucuacaaacccaggcagaagcagccuuugucucguagccuagcccagcccugcccacauaucuggaaucaagccagagaagcagagaaguagaggcuagccauugggugggcuugguaagagggaaugaugccacagaugccccagaggaacacuucucccaauagugcuucaagauccaaguauaacagcacuuuuuuccugucaacaccucaaauugcacaucuuuggcuacaacugucugaaagggcgugcauuugcucauggcuagggcuggcucuguucuguaggaucaucagguauacaggauaccuuacuugggcucugcaggacugcccucugccacucaaugcuccucuccagagauggcgucucccuaaauaggcccagcuccucggcaaucucugccuuuguucuuuaguauguggacuauuuccuuuauaaaagaauccauggugacacaggccuauaauucuaguguuuggcaggaugagacagaaggaccaagaguucaaaccagccuggggguuguaauggcaauguagcucaaauuuuauuuuauuuuuuugggugguuuucugagcaaaaaauuuuaaauuaaguuaaaucaaaccaaaucaaaagaaaacaaacagggcuggagagauugcuccguggcuaagagcacuagaaguucuuccagaggaugcagguuugauucucagcacuuacuagguagcucacaaccaccuguaacugcagucccacaugaucaugacccccucuucugaccccugaggguguugucaucccacaacaaauguacacaggcacacaugcaggcaaaauacccauacacauaaacuaaguaaguaaauaaauaaauauaaaaagaaaagaaagaagccaugaugugguacgcaauugugaagaaaagcagccucagaccuugucacucaccucgucacagccaauguggagccaccggacaucccuguguagcuccagaauuugaucgaucauagcuuguaccaaggccagggacucagccucgugaggguucaggguguuggggaagagagccacuucacggagaugugcaaaugcugcaugcuuuagcacaaacuaagaacagagacggaagcagguucuuaaggaucccagucccuugcguguccuuggcgagcacuccaaguuuagcugcuucacucagugugcccaagggccagcuagguggccugcacagacuacugcugacuuccagaugucugcagcugagccaagccuaagagcuucugccucugccuuagcugggcucugagcccucuagcugguuccucggcagcccucuucccucaccuugucacucaccucgucacagccaauguggagccaccggacaucccuguguagcuccagaauuugaucgaucauagcuuguaccaaggccagggacucagccucgugaggguucaggguguuggggaagagagccacuucacggagaugugcaaaugcugcaugcuuuagcacaaacuaagaacagagacggaagcagguucuuaaggaucccagucccuugcguguccuuggcgagcacuccaaguuuagcugcuugguacucuaacucgggguuuugcacaugucaagugaguuguuucccagagccugaucuccagcuucgucuuuuuacuuauaugggugcucagcuugucaggguuagggggucugugcaccacaugaaucuagugcccaccgaggccagaaugggggcauuugauccuguagaacuagcucuucugagcugccuuguaggugcugggaaucaauuuugggcuuucuggaagaacagccagugcucuuaauaucuauagccacuccaguccuuugguuuuuuuccuuuacauuuuauuuuggaggagugaaugaagcugcauccuacaagccauuaaaucaauaccauguuugccucuugguugucugucuuacauaugagaaauaauuuuggauacugguaaacaaaaaauggaagguuuccuuccuucccaaugaagcugcuuugaccagugcucucuggcugcuuacagauugaugcugcagagaacaggaguucaggcagcacugagcugcugccuacccgucaggcccuguugccccgcacuggagcccaggcccagucucugaaccucacauucauaccaguaacugucaccccucccacucaccuccauguguccgaaugucugcaccaaggggauaacuuccagcucacugagucuggccaggcgcaggaucucuguaaccucggacgggcugggguaauaagaguacacagaggcuugugucagccuggugcaugcgcaggcgcgauggagagcuggaaugcccagagccaagccuccuucuagcauggugaucaugcuccugccugagccauccaugugcugguauuauaggcaguuaccaccaugccuaacuaaagaaccagcaaggaccguaucuacacuccccugaccugccuguguaugcuagguaagcacucuaccacugagcuauauccccagcuucauugauucagcagcuaaaacgacacugcauaguuguuuuaaucucgauuucucuuuuuuaaaaaagauuuauuuauuuuuaugaguacacuguagcugucuucagacacaccagaagaaggcaucaaaucucauuacggaugguugugagccaccaugcgguugcugggaauugaacucaggaccucugcaagagcagucagugcucuuaaccgcugagucaucucuccagcccccuuaaucuugauuucuaugagaggcuuaguaucuucccacuugcuuaugcauuccaagguuaaaaucaaacuaugaggagcuggggagaucauucagugguugaaauaccuguugcauaagcaagagagcuagaguucagauucccagaucccagguaaaugcugggcgggccugguagccuagcucuauuuccagugcucagaaggcacagacgggggauaccagaggaagcuggcuugcuaggguagccaaaaugcuguguucuggauucaaccaaagaugcugcuucaguuaaaguagagagugauaaagacuuggaugucaacugcaggcuucuacauguacucauaacaugcacacccacacauacacaugcacauccacacacaugugaauucacacacacaccccccccacaaggacccccacgccaaaaauaaaaaaugcaacccagucccagcugccccaugacuacuuacucuuccuuguagggucagaauagauauuuauuuucucuuuuaaauguuuccugauuaccuuuaauguacauguuuuauuuuaaaauauguucugccgggcggugguggcgcacaccuuuaauccuagcacuugagaggcagaggcaggcggauuucugaguucaaggccagccuggucuacagaaugaguuccaggacagccagggcuauacagagaaacccugucucaaaaaagccaaaaaaauaaaaaaauuuuaaaaauaaaaauaaaaauauguucuacauaugugugugugugccauguguauguguguguaccaucuguaugugugccauguguauguauguguaccacguguauguguguguaccacguauauguauguguaccauguguauguauguguaccauguguauguauguguaccauguguaugcaggaaccugcggaggucagccgagggcacuggcuguccuggaccuggaauugcaggugguugggagccacuaugugaguacugggaaccaaacccaggucuguuuuugagacaggauuucaaucugcagcccaagauggccuuugacuuucaauaaucauccuguuguuaaaagccucccaaaugcugggaucauaggugugauccacuacacguggcuacaugucuuaauuuuauaaccaaauuuuauacacacacacacacaaauguguauauauauauauauauauauauauguacaugcacuuaggaagacaaaaaggacuguaaaauguuaguuuccaauuaucccauccacaguaaugcccaugccuuucuccccucccccacccccuacuuggcacccucagcuagcuuugauaccuguaugcaugcuuggcccucagcagccucagguggcccucauagggaaacaugucuucguacucaaugaggaggccauuugcaccaagugcauggaacaagggaaaaaccuggauagagacagaggguguuggaaaaggggcaaucugaacaccucaagaaucggaggaagugugcgccuucuccuuucuaggcuuuggagagggacugaggcugauauucauauuucucuccugcaaacuuuaaaucuagaaugugaacuugaugcuugcacaggaguggcaugugccaucgaauagcaauaaacaacgcugguggcucagcugaggagggaggacuugggccagcugggagaguuauguuggagccaggccagaggggucuaacacacaagaacccaugugcuauagcaucagggacaccagaaacagcucugaagagaugaguucagcuccuaggaagaaaaggcagguggggguaugugugcagagguagcagguggugugcgugugugugcaggcaugccgggguagggcucaaagucuuggagugccuuccucccauucucaccacuuucuuuccuuuauguuaaguguaggaauuucccugucuucaaggacuuuuaggaccuguucaugccuauuauacagaauaauugggauugauuuaucuauuggucugagaucaaagccagggauuaaaaaacaaaagcagaagguaggcaccaaugaaggggccucuaucuacagcuaauacaacuaucaaccuccaaauaaggcuccaaacguucucugugauguacaaccugcuuucuuuccuaaagugcagcaaagugaagccugcugaaucaaggaaaucagguggugaccgaaaaucagcugcggacgauucacaaaauggauauuaagcgaguccaaaugagaggcagccugaccauggagagacguaaucucagucaacuacucagagaucaacgcaauggugguggcaucuacuccccgggguccugccucuggcuucccugagcucccuauggccuccugacaccugcgugcccuccugggcagcucuugcuguggcugggcugucugagaggcugggaccucacagccguugaguccucugccucccauaguuuggaugcuagcauagguuuccacuguuaagcuguuuaaaucacaucacaagcuaacuuuuacuuuucuuuuuuuuuuuucuggaauacuuuaaagcaaaucccagaccuuccacuugcaaaugcuucgauuuauauuucaaacuguuugaacuuaaaagaccuaauccaaccaaaccaauuaguaacuccuuaacacuccccauucucaaauuuuccuauuucaaaaagcuguggcuuggguccgauuuauacaucuuaaguagauuuguuuguuuguuugcauguauguguuaauguauuuucaugugugaagaggccagaggucuacuucacaagugcugaaauuacagguaaaagccaucuccccggccccuccagcagauaaaaaauaaaauuuuucaacauuuauuguguguguguguguguggggggggugccuauaugaacaucagagaauugugaagugguucucuucuuccuuuauguaggauccagggaacaaacucacaucaucaggcuggcgguaccuuucuccacuaaccaccuuugcccggcuguugagcagauuuuuaaagcaguaucuugugcugauucugaggcagggucucacucuguagaccuggcuggccuggaacucagagaccugccugccucugcuucccagcuguguacuguucuuuugagacaggguuugacacugcacuccaguggaacccacuugccuucuccuguaccagccucuuaaauccuguaauuccaggacuugauguaaccccaggauuugagaggccgauucagauucuucccaagguuguacagcccugaguuacagcaggcagaauuucauuagaauuacugauagcuuuccuuuuuucuucccuacuuccuccucccugacccuuuuuggcaggaggugugugcauaugucaaaauagggcucucuccaccuacuucugucuccugagugcuggaauuaaagcaauaugccaugaacaccuggcauuuguacugcauuuuaaggaccugcaccaaagauuuaguacuccuuuugggucacugacccuagacuuggccccacuacuuggccuugacauacuuauugauacuacuguuauacugccaacucgaccacuauauaucagaaaugauucugcuucuuuaagaugacuuaaaucagaugcuuugguguguguguuugcguguaggguauggaggaagaggacacuugugggauuaaagucucuucuuccacuaugcugggucugggaauuaaacuucugucuuuaggcuugaguucugcaggcaccaauuuugcauccuuuugucuaauccucccaguucagugucuucugccugauuuuaaaccucuuucccagcuuucaucauuuaucucaucugauuaucucaguuuauucuguuucauggucccgugacaugcuuguuucugugcuauuaagacacuaucggguuggcgagauggcucagugguuaagagcaccgacugcucuuccgaagguccugaguucaaaucccagcaaccacaugguggcucacaaccauccauaaugaaaugugaugcccuuuuauggaguaucugaggacagcuacaguguacuuacauauaauaaauaaauuuuaaaaaauuuuuaaaaaagacacuaucuuuuuuugcaguguccuucuaugcucacucagaguuuaaccacaaccuacuuauuauucacugagguacuacagauugaacuuacggcuuccaaauguuaggcaggcacucacuacucuacuaaaccuuauaccuagcaguccugcucauuguaaagaacaggcacacauggcugggauggagacaggccucugaccaggcucgucuucugcuguugucauggacauuagguacuccaucccaggaugguccuugcugaggccaccguuggucucugccuccuuccuccugguuaucugaacauucucuuuacuuuccuccaauauuuuguccuuaugauaggucucugguuucuuugagucuuaugguccuccagaacccccauacuuuuguuuuuaaccucauuuuauacacucauuaucaaauucaagccaguugaaaacuccucccaauucuggauguggguaaaaucuauuugggaguauuuucuacuuccuuuggucacagcauugcuacaguuucccuucucuuugcuuuaucaccuucugcuaaggcugcucaccccacacgggcuuuaggguauugagauaugacuauacuuauuccgguuuuagaaucuauggugauaccugacaccuaaaucuuacuuuuuuuucauuaauuaauuaauuguguguauaaauguguguccuaaacacacguggaggucagaggacaaucuacaggagcugcuucuugcccaccauaagacaagucccuagaacuugaacucaggucauuaggccugguggcaaacacuuuuacuacugagcuaucuuuccagcauccuacuaucaccucucauuuugagacaaggucucaugaauuguaguucaggaugguuuugaacuugcugugggauugaugcuggccuugaucuucugaacggccugccucuacaucccaaguacugggauuacagaugaguauacuguguucauguugaagaauguauugggauucuaggucuauuguuagaaaugacuacaaaugacauggcuucaaauaacgggauuucauucauugucccggaggccaggaguuccagcugaggaguuggcagggcaugcuuucucacaaggucucacaggagaguccuuccugccucuucuagcuucugguucauuaauuugugauuguaucgcucugcuccuguugucucaggguguccuuguuuauguguuuucucaacuuuaggucuaaagucuccucuuuuccuggaguuuggaucccuaacagucauauaaaagccagggaugguggugugugccuauaacccuggcacuggcagggucaagacaggcagauucuugaaaaaaaaaaaaaaagaaagaaagaaaagaaagaaaagaaaaaaagacagguagauucugaguuuuacuggccauuuacacgguccugucugauucugaggggaacugggaggaugaaaaccccaugcucugucaccaccaggacccagaaggccucgaggcugucucuccagugcucgcuuccacagagugaaagcucauucgaggugaagggaguccuuaccucagagagauaugaaaccuuuggcggcgcuccuuuaagguccaaaugaacuaaucucaucuuaaauggcgugggugaugacauguugguauuuuuuuguaaacuccuauaacagagucucugucugggacuucuuccugguggagagaacuuaaguuauaaagaggagcagacacagcccucuccuuuauuuccacauuugaauacaauauuuauaaacugcccugagauaggcauuuauuaaccauuuaaugaucuguauuuccuugugagauuaugaugauuuauagcaagcauggcaguggcauacaccuguaacaccuuucccaccugucuuagucaggguuucuauuccugcacaaacaucaugaccaagaagcaaguuggggaggaaaggguuuauucggcuuacacuuccauacugcuguucaucaccaaaggaagucaggacuggaacucaagcaggucaggaagcaggagcugaugcagaggccauggagggauguucuucauuggcuugccucaccuggcuugcucagccugcucucuuauagaacuaagacuaccagcccugagauggucccacccacaaggggccuuucccccuugaucacuaauugagaaaaugccuuacaguuggaucucauggaggcauuuccucaacugaagcuccuuucucugugauaacuccagcugugucaaguugacacaaagcuagccaguacaauugaccccuugucaacuugacacacaaacacaucacuaguaagccucaacccuuacaaucuuauucauccccauucuaaauaacuuuaaaagucccacagucuuuacauaugcuuaaaauuucaaucucuuuaaaauauccaucucuuuuaaaauccaaagucuuuuuacaauuaaaagucucuuaacugugggcuccacuaaaacaguuucuuccuucaagagggaaaauaucagggcacagucacaaucaaaagcaaaagucaaucucuaaccguccaaugucugggauccaacucacgaucuucugggcuccuccaagggcuugggucacuucuccagccaggcccuuuguagcacaugugucauccucuaggcuccagaugccuguacuccacugcugcugcugcucuugguggucaucucaugguacuggcaucuccaaaacacugcaugaccccuucaguccugggccaucaauugcaacugaggcugcacuuucaccaauggccuuccauggccucucacagugccaauccucagcuguucugcucaacuccuucaugccuucaaaaccaguaccaccugggugacucuuacacauuaccaaguccagccacagcacaagguacaacuuuggcuauaucuggaacacagccacugugcucucagaaaacaccucccagaagaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaacuacagaaucuucacaaucaaaacagcaauggcccugaaaagagucuuuaauuuucccucugaaauuucacaaaccaaaccuccaucuucugcacuguucucaacauuaucuuccaagcuccuacacaacaucugacagagcucuuaacaacgaauggaucuucaagcccaaaguuccaaaguccuuccacaguccuccccagaacauggucagguugucacaggaauaccccacuccugguaccaauuugucuuagucaggguuucuauuccugcacaaacaucaugaccaagaagcaaguuggggaggaaaggguuuauucggcuuacacuuccauacugcuguucaucaccaaaggaagucaggacuggaacucaagcaggucaggaagcaggagcugaugcagaggccauggagggauguucuucauuggcuugccucaccuggcuugcucagccugcucucuuauagaacuaagacuaccagcccugagauggucccacccacaaggggccuuucccccuugaucacuaauugagaaaaugccuuacaguuggaucucauggaggcauuuccucaacugaagcuccuuucucugugauaacuccagcugugucaaguugacacaaagcuagccaguacaccaccccacccccuccugaggaaggaggauuaaaguuuaagacuugccugggcuauaaaggaaggucaaggcuagacuuugcaacuuaauaagacccugucuccagacuaauaaguaaaauaaggacuggauugcuuagugguacaacacuugucuagcaugcagaaggccuuagguucaauuccucguacugaaaaacaauuaaggcagugguaauuuggagagauggugacuagcuccgugauacagcaccggcugcucauuaugccaggaacccugcgauccacccuggcuacugcaaauaacaacaacaauaaccugaaaagggaauaaacucuacauauaucagaacugacuauaguuuccauuacaguucauuucuggaggacacugaagcagucaagauauuagaaacaguuuuccuaccuucuguaaaaucacaagcgauuauuaaaaagaauuacagaguugugcauccaguugcaugauuucaccugcucguccugugcaaggacucaaaaguccuagccuuaggaaccacacccccccuacgcucgcccucaauccccaacccugcccgaccugccacucucaggcaguucaaagucccugacaggcuucucaaugcagcucucggggccggggaaaggagagggcggcggccguaggagacaggucauccgggcccagcacaaucgguggcugugggcuugacucacccgcgucgccgccgcagcccagcuacaggagaagacagaauuccgcaggugccucaggguugcagugccaagggccgagaaggcuccgccuccccccaccccaccccacccccgccaccgcucggccuccgauugcucucgucuggccgugagccggacgaagaccgagcgcgucgcucccgcgucccgaccccguucccgccucgcuuucgcugucgcagcuauugccccgaguuugguggcucucgugucguagcuggcucugcgacggcugggcccgauggcgccucagcggaggggaccacccagaauucccgagggaaguagugcugcagagcgccggcgcgcgaccagguagcgggauccuuagggaccgggaggccgcgcgccacagcgggcggagccugacug

SEQ ID NO: 6544 - RNA, 7147 nt, Mus musculus
ggagguucccacccagcucuuaucccggaagucugcggaacagaaguccggaaguucgaggggcuguucucucccacucauucuccuacaagucccucguuguccgcauaggugcguguccuacaacuuuucggguuccgacccgccgagcccugugcgggucaucgcuugcggaucuggaccaggcgcaaggcaaauugaggaagccgggcgugugcacuccggaggaggagccagcguaacgggccgcuaguggagcuuguugguaacugaagccagagggaggcaaguuaugugccuaacuaggauucuugaggauguaggguaugaagcuugauugccccugggaauccaaggagccacucagaacuggggccuuggguguuaaucuccagacguccugccgcagugucccauuaauucggcgcauuugggccauuguuagguagucuggcgucaauaacagggaucugacagcuuaugaauguagagacucauacacgaugguacuuucacuucccguucuuggugggaagaguuguuucuggaagauucggguaaggugccggaagccugaguugugugugugugugucggggcgggggagggggagggggcuuacuaauggaacaacuuaaagauaagaguucagucaagaaaaggguucacaagacugggggcuuggaagugaguucagaccaacaccaaauuugugagcuguguagccccgaugcccauacauaauugugaguuaagugggcucauaagagaaagguguucggggucugcuguggaccuuccccuggccuccugacuggacuaaugaggugcugccuaugugcacugguugcaggcuucaguuguguuuuuccaagccuggucggcugugcaguagagcccagguuccaagaauguauaugcagguggagacacgcaccagcacccgccuccaucugaagagggcuccaggcauccggucuuggucccugcuggucgguaaggcuucccaccccccaccccacccccaaucuaaaaagcgacguaaacagcuucuuuguguucuauuagagguucucaauacaaggccuugauaaagcauguuucauuaacccucagggugccuuuucuuucagauggcaugcaggaccgacccccuugcaugcuaggcacacucuaacacugagauacccucccugccuugcaagcugggcacacuucuuuaacacugagaugcccucccagccuaucugcuuuuuaugaggucacuauaguuuuccuucugugugacaggugaucauggguucccaucuuuccucuucccuggcucagaccucuucauaagcgcacuuagccucuuccuccaucgcugccugucagaaggcucuuguaucucagggacaggugcacuuguguuggcugggcuguacagucugaggugaggcacuagcuguggcuucagcagcaucucugcagucuguccuuaugauauacacaugcuuuucugcauguuaugcucggguguuguuauaauucuguaaguagucuucaucccucaucccauguaagcaauaccuaccucagggucauuugugcguuugucauuuguuugcagacaagucuggugaaugccaugaugggauaucuugcuuuuuauuuaauuuuauuuuuaaacuauguguguaucuauauggggguucuaugcagguacguauaggugccuguggaauccagaagagcauuagcucucuuggagcugaaguugcaugagguugcgauggccugacaugggugcuggugcugaguacugaacuggguccucugcaaaaguaguauauacucuuaaucaguaagcccucuuuuccaguccccuucuccuccguuuugaaacaaacaucuuagcuggcucaccaacucuguacuagguagccucuaccuguugccccugaacaagcugugcuaccaugagacagcuauagcacugugaagaaaugggucuucccuuggcuaguuaacaagguacucucucccucucucuacaggaauauuauccacuggccuggcugcugccuauuacaguggagguaaaguauguucuccccuucagcuuccuugcacuuggaaaugaacaaaaagcagucuugguguguguggcuuugggguggccuugugugggagaugaucccaggccaugucuuguaucuuaaaucucuuacuguguuacaaaguccucuuguaaagcucuuuagcauuugccugucaccuugcagggaggaugugucccaucuccauggcaaggcuguaucgaucuacccauccucuagguggaauuaggcagaguuuggggcuuaaguagcuccggugacagaagcacauuaccuaagccucuaaucugagccaaaagaaagguugggcugggaaggaccaccuauggacaucaccuuggcuccugagcuaaugagcugauauacugucugcuugcagauagucugggcuggaagcucuucuaugucacaggcugccuauuuguggcuguacagaacuuggaagacugggagguaagauggaacaguaggacccuucccguucagaagcaccugccccagcucagaggcauucaguuaccuggacucagcccuucccuugauuuugcuuguaaacaucucuggacuuuucuagaaaagcuacucacaacaguuuucacuaagguucuauguaguguguuuuguuauguugcaggcuugccucaaacucaaaagaaagccaauugccucaaccuucugaugggcauaaaacaccccacuuggcgcacaguagcgccccccccccccccggguuguuacaacaagucuguaugucccuuggcugggcugguuccacagggcagggaccugugagaacauuuugaaguucagggguuuggggcuuccucugaccacccagguccucacuguacaccuaacaauggcagacaggaaucugagccuggggaaagucaggugguaccuuuuggggaugcccccuucccuuagucuuggacuucucagaauucuugaagcugccuggccugggcuucugcuuuuugcuuaauggccucauuaccauccuguccuuuuguucuuuuauuuacccaguacuuaggguugaaccuggggccucauaccugcugggcaagauuccccaggcuggucuugcucucaggaagagagaagagcacccauucuaucugcuuucucucaugugucccuuacucacaaggaguacaagagguuaggcacagaagguaccucuggaagaguccuggagacuuuggauuuccaccugggcaaauugcguauuuguaccaguguggguggggcuaauaccucagcauaagcuccguccucucccuggaguucugugugcuuagcauauauugguuugcaggaggccauuuucaacaagaacacugggaaggucaucuuaaaaacauucagccucuacaagaagcugcugacucuucucagagcgggccacgaucaagguaagacguggggaccuacagcuuggugaggccuggauggcuuggguucaaguccaacugcucaaggaaugaggguccucagacauauccuggcuugcagggauagauccaggcagauauuuugcauacuuaaggacuuagccugucaggaagaauggaaacuccuuggcagcuccuaguugggugagggugacaagagguuacugugccagguagacuagcaaggagccauccuagucuucaggaaccacuuggccuuugucgauuauccuguaccugguugucagcuuugcuaguccugcagugagauggucagaggaacccugcaacccuuggaccucuggguuuggaagguagccuuguugugagguaucagguucucauaggucucuuccuuauguauccagcccagcuauugugcauuacaaacauggaaguaaacugugugugcaugcacaggccucuuaguaggcuuuuaacaugaagaguuaagcuacgaggcguucaggucucuagcuuauguggagugcuggcaguguauagcugaaaguggcauagaugaagaccagagcugguuuguggggugugaguugaacuuccccuuaggcagcuuguuggaagccuggcucaucugagagccaguccccacaggcuccaagccccauggccaucccucaugucacugugacagugagaugagauagguuucccaguggcucuugggaaugcaguaucagccaugcauuaguuaagcaaugguuuuucuguacacagaacuaacuggcagagcuaucccacuggagccagacagguuuuccagccuuagguaaaaucaggcaaagaggauaucaugaagauggcagcuugggcuuagggauccaucccuguuguaggacugcucaggaaagccagcaucugccuggaacugcagcugucgggcucuccugagcauccuuauccacaaguuauucuggguccaucguccugaauguggacgagccaaugcuuuugucaccaaugcuccuccuacuauucagcggguuguccugcgcacagcauagggugagagcauaggguggacugcucaucagcaaacccuucuguccccaguggugguucuguugaaagacauccaggaugugaauguggaggaggaaaagguccguuacuuugggaagggcuacaugguggugcuccgguuugcaacaggcuucucccacccucucacucagagugcagucaugggccgacgcagguaagagugguauggagcaagacugggauaucugucccuuaguguuuuccagggcagcagagaaguuagauguuguagacaggguauggggcugugcuuaggagcagcuuugccauagcuucuauggggggaggcaucagaacaggguuagggagucuggugagaauaggaccaaggucagagauacugggccuauuugggaccccuggggguguuguagguguaucauagggggugagacagugugggucuuuuguggugugguguggaacuguacccuuugccaaggugaccugcuuucuugaugauggucuagugauguggaagccauugccaaacucaucacuagcuucuuggagcugcaccgccuggagagccccucagaacggucacagagcagcgacagugaaccugauggcccugguggccagaguugacaguguggacuggcugcagguaaaugccauccacuucugaugcaucuccaaccgacuugacaauuguaaggguacaggcagaucuugggcaccugccuguggcuccuugggcaguucuacuaugggccaccugccuuuugcuuguuuaugcuucuacacuuugcagaaccuugggcuagaccucugccacaacccagaaagguugcaucuaucaggaugcaggguguggaugcuacaucuagggggggcaaggucucagaaaugagugccuucuccagaguuacacugcagcucuggguugggcagcacagccuggucuggauaagcucacccaagggcaaucugaagcagaaaaugccaagcucucuucagcauaggccuagugccugccuuggagacaccuugccacuccaggcuacuguaagcaagacuccauuccuagugagugagacaccuauaugcacgugggcagacacacuccuaugcacagugaugucuguucccucugaccaucccucaagauggacacucucaguggucaggggcuucccugaaggcaacucuggaugcuggacaccugaccacagaacucucagaggaauccgagugcugcugacuacccaguuccuucuuagaccaugugucugagagcccagcaguguuggagcccagcugucaggaauggaaggcucucccaacccagccuggaaagaaggugcuagcagaggaaagaucaccucuccuggcauccugcagccuuuaagaccugggggaucccuuacagaaacagucuuagccuuucgagccuugaaaagaccugaagaaaacaggcauguggagacacagcccaauaaaucccaguguugagaacugcagcgggaagaacguucaaggccagccugggccauggccucuucuaagaaaaguugguaccaaccacuaaugguccuuuucugcucuucuagucuccuucuggguggacucaaguugcucaaaaguacauuguuuacuaaguucccagccuggccucuaggccuggaagcuguggcucucuggccuaacacagcuccucgaagccucauacgcauaccucaucaggcagaacuggggaauugaaguuacauagacaaaggccuugaggccacuguaccuaagccgagcaugguaguuaggcaagaacuaugaacaggucuucugaagugacugccacuaguucugacuuggggaauauggucccuuaaacaugccaaagugagcuuuuuaaguggauaaguuagagauuucucuccccagaugaaacgugaaguauagcuuguuggguuuuggcuuguugccuauaggcucuuaagguacuuuagacaagagaggaaggugucuuaggugcugucauagacucacuccugggugacagcauucaauucucuauggugguaaaaagcugauuagaguuucugcuggugggacuuccacuucuacuggucuuuuuauuucagaaguaauaaagcucuacaugcaacuugcaaaugugccuuucuguuuucugcuuugcccaaaguuacuguucauacaguuggagagccugucugcacagguguccggagcucagcaggaagagcacaggcuccacauggcugggccagugaaacagaaaucuuggugguguccaggcugauauacagggccccagccucucagggguucugcccugugucccagccugggcuggugggugguggcugucgggcagccgccucacccagguccugcagcagauccugcagucgcugcagacucgggagcacauucuccuccagccacuccucuaugguguccggguagaagaccggcugcagggccaccuccaacugcugcacgagguuguuccaccuacuuagaaggcugggggagacagcagccaugauuugacuugagugu

SEQ ID NO: 6545 - RNA, 27560 nt, Mus musculus
cgcacugaugacgcagcacugacgacacacgcacgacgcaaguccccaggacccuggcuuccggccgcggcggcccuagcgccgcgcgaccggagagaucgccugguugcgagcgguaugcggugcugaggagccacagucccuacgacggcgccaugaaccuccugccguguaacccucacggcaacgggcugcuguacgccggcuucaaccaggaccacggugagaccccgggcccagcuccgugguaacaccccagcccuuccgggagaccccgacccaacgcuaccgcgaccgcagggccccggagcugucgcgagcgucccccggacccuaaccggagacucggucgcgcccugagagcucagacucuggcggcucuuucaggaaaucuccgaaccgcucuguagggaggaccccccccccccgcgguccuuuccagcccgggcacccauagcggggagaaacacccaccccaccccaccccuccgcgcgcugccgccgcccgggucggcgggcagugccacuuuuuuaccggguaccuaagaacccgcaggcuuacugcugggcgucagggucuccagcgcuuacguugccagcggguggcguagcgggaccugcccgucgcggggcggcaguuugucgugguucuugcggcuggcaccuucguggaguguagguucuucgccuugaugucuuagcuguacgccucucccuccccucugguauuuucuucuguucuguaggaugaaaggacuuacaugauuugcguucccgugacugccucuugccucuugaguuuggggucuuggagaagguauucuugcuuccaagauaaugggcgggaaccccucuuaguggggauuauauccccgagacgcuuuuucugcguaacccucacuguccuggaacucacucuguugacccugucucugccucccggggugcugagauuaaaggagugugccacuaugucagcuaacuucccuuuucuaaaucuccucaagggaaaaggguaaaggcugauacucugggcuucuaagaguuauaacaucuuagcuuuccguauguaaaauuucgaggugcuguagcaaauguaugacuuacugucuuggaaagugaacuuaacuugauuuuuguuauuguugggacuggaucuugcucuccuguucaagcuuaucuuaagcugugcuccaggaaucuucccuucacagucccuggagcaagugggauugcaugcucacucuauugccccuggcuaagaagaugaguuuuuuugauuuuuauguuuauuuuuauuuuugagacaauuggcacuguguaucucuggcuguccuggaacucccuaaaccuccuuaaaaauguucaccaccuggcuguuuuuauuuuugagguggggaucuuacuauuacagacuauaguuagguagugcuuuaaguagguagugcuauugugcaucccauuugcauauauucucuuagaguccaugugcuaggcauuugaagaaguuugagggaugcguucacuauaaucagaaccuguaggauagcuauaagcuauaacauuuccaagguaaaccaagguaagagggagagaaugugcauagcccauuacaaguguggaaagccuuccuuuagaucggacagagauaggcaaaaguauuauuguccuguggaagcacagacaguucugggaagagagcaguuagacuccagugugguggccuugagcaguacgggauuccaggccugguugcaguguuaggguuggucccauuguggaacugugaaggagcaagcgcauguagcaucagcacgugggggcugagaggcucauggacaucauaugaguuccaggacaguuagggcuacacagagaaacucugucuuguaaaaccagagggagagagaggagagagagagagauuagcuuuuauccaggugugguggcacauaccuuuaguccuagcauguggggaggcagaagcaagcagaucucuuuugaguuugaagcuagccaugucuacagaauaaguuccaagacagccagagcuacauagagaaauccuguuuccaaaaagaaagagagacagacagacagacagacagagaaaaagaaaauagcucuugagcuagcaaauugucuaaguuacuuuucugugugaugagacaccaugacccaagucaacuuauacaggaguucauugugaacuuagaguuucagaggguuaggguccaugaccgugaugucaacggggaagcaggcaugucacugcagcaguggccgagagcuuacaccuguuccacaagcaagaaacagagacugagacugggaauggugugaacuuuuuggagccucaaagcaugcuccaagcgacacaccuuuucuaucaagaccguaucucuuaaucuuuccuaaauaguuucuucaacuaggcaacagguauucaaaaccaugagcugauuggggccauucuaacucagacauucacaggaauguagcccaguuuauggagcuuucaugaggucauauagguuugggcuccaguacuucccuuaacuggaguggugauauaguccuguaaucucagccuuggggaaguggaggcaagaggauccagaguucaaggucaucguggacuacaugaagcccuguuucaacgagacagacuuuaaugcaguuucuggcugcaguuaagccuuauaguaugaacucgcaucaaacaguugagucagucacaauuugguuuuguauauacugauuucuagauuugauuguuuuuguuuuuugagacaggguuucucuguagcucuggcuguccuagaacucaaucuguagaccaggauuuccucaaacucacaaagauccuccugccucugccuuccaagugcuaggauuaaaggcaugugccaccacugacuggcugccauugguguuaaaacaccuauuaaaaauugaguuuagaaaucacuuugugugugugcgcgcguguccuuauauaugauaauguauguauagguacauaugcaagcacaaucauguuaaggccagaggugggcagugggugucuuccuguaccacuugaccucuugagacagggucucucacuguaccugaaacuugcucuuucaguuaaucaaucuggcuagugaguuucugaggcuucuggaaugcccuuaucucugcccucaaugaugggguuuuagguacaugggacuguauugguuuuaaugucggugcaggggauaugagcugaguuucucaagccugcccagaagcacucuuacuauugauaccucucuagccucagaaaucacuguuaaguaccuuugcaaggacuggagagaggacuuaguuguucagagcacuugcugcucuuucagagaaugggguuuugguucccagcaccugugucagguaguuuacaacccucugaaacuccguuuccaggggaucugaugcccucguccagcugcuccaggcacugcaugcacaugauguauauacagacagacacacagacacauuaaaacauuuuuuuugccuauguaauuuuaaauuguugaaauuacuuuacuuuugagguaucucuccagacucauuuuuggguuuuguuuuaguauuuucaaugaggauuuuuguuuagguuugguuuuuuggauugguuaguuuggugguaaaucguuuucaccaauguauaguguuucuuugucaggaugugucacaauuagcuguuuuaccauuugugggguuccccucuucucccaugacuauaguggucccugcagcacuuacuagaccauguguuuggugagcguguguucaguuucugaggugcuuguuguauuccuuccuuuuugccucccacugaggaguucucagguccacaccccagugcgcuuuauguuucuaugauuuugacugcugugcaguaggacuuacugugcuguugugugugucuguuuucuugguucuguaaauuacuggacaucuagauguccacauucucuucuguucucacuuuuuccuccuuucuucuauuuccuuuuucaucuuccugggcuauaugacccaguaacauaaagaggauauuauaagcuagcacaauuugauuaccuagcacuugagaguuucagauucugggcuggauaaauuacguuuuagagcacaagaguugauuuaaaaauuagucuccaguucacaacuaacugucaaagucuuuggaucucuaacuguuguuuuauaagugacuggaaauacaaaaaucuggcuguagaguugaagagauggagcagagccuuuguguuccuuuaaacccauuauacagcugcuguaaggaaccaaacuuuguaaacauugaacugaaacaaaacgaaaaaugcaggauuugguuuuucuacucuuagccaaagcuuguuaugaacagaaguugggcauuguauuugaaguaauuaauguagguuuaugucucuaugauuauaaaaaccaccauaucaucuugaaagcugggugauuuuuggaccuugacagucugaguaugugauuggggacagugacugggaugucuaagucagucacugcuugugaccaggacagaaguuugaggaaucugagcaauucgugggaugaguuggauguguuuuucccguuugggagagugagaauguauacaaucugggcauagauguagagcagagcggcagaagggagccucagauggacgaccuuuccauccuuuaacccagagugaagucacgggagggacuucaugacugccuuccaggagaucacucuggagguggggaagagcagccuugugucuccuuccacaguuuagagcccaugaccccugugcuuucucccagaauacugcaugucccuaacuaagcuguguccacaaugaccaggacugugcguuuauugugagccucuauacaugaacuuugucacugccucuucaggacccauuauacuugacacaauucucaagccgaaaaggggagucuggugagagucugucauuagugugaaguagguaauaugugcaguguuuaagcagaaccugugauaggagcuucccuggaucccuuuugcuggcagcaguguggggauugacauguucuuucauauuucuugcuuuaggguguuuugcauguggaauggaaaauggauuccgagucuauaauaccgauccacucaaagaaaaagagaaacaagguaagggaaugguggucaucuccuggguucucuguauuagccuucagucuagagagagggccuuaacuaaggaggaaggaagguuuggcacuuuguaaaccgggacagaacuguggggcuuuauaggaguuuugcuugcuagcuguauuaggagacaaggguggccagccuguauucuucaguacauuuucauguuuuuccucuuuuacaucuucagccccugcuaccucuguguggaagaaugugauguauuuaaugcugggcacuuuuuuuuuuuuuuuuaagauuuauuuauuuauuauauguauacuguagcugucuucagacacuccagaagagggcgccagaucuuauuacagaugguugugagccaccaugugguugcugggauuugaacucuggaccuuuggaagagcagucgggugcucuuacccacugagccaucuccccagcccgcugggcacuuucuuucaugcuucucuugcugaauguaaaacuauagaaaaaucagaucauggguuucauugcagugucugggacuccuaagcuccauuuaaaauguguaguacuuacgaagcauugauagcuggauauaauggcacauaucuguaacccuggcauucugaucuuagcacacaggaagcugagauaggauuuugaguucaaggccaaacaggcuucauaacaaaacagucugaaaaaagaaaauuucucauuacagagaaaaccugccucaaaaagaaaacaaaaaaaguguuuugccugcauguauaugucuguguauuucaugcuugccuggugcccaagaagccaggaggguguuaguuccccuggaacuggaaucguagacaguugugagccacguguaugcuagggauuaacccugggucuuuaggaagaacagccagugcucuuaacugauaagccaucuuaucaguuaaccuguguaaccuccuuaaccuguguuuucauaaaauaaaaguuuugaaacuggaaucaaaaauuguguaaguaaaauaauugugcuuuucaauuuuaugauuaguauuuacaaguagaguuuuuugguguaguuccacuuauuuuccuuuaacacuuggcaguuucugguucucgccuguugggauaguaaaacacucuuaauaagugaaugauuuucagauaagccguugaaagugaacagaaacaaucccuuucuccccacaguuggguuuuaaaauuuuuaauuccaaaacuauuuuaacucuaaaagcugagguugggcauaucuguaauucuagcauccugaaggcagaagcaggcaggucucuuaaagaguuugaggccagccuguuacauagugaauugcaggccaggugaggauauguagugaaacccggaaguggaaacuuaaggguucuuuguaaagucaguuguguuggaugcuguuuugcuggggcaaacacauuaaggaguauuuuccugaaguugacacaggugaaaggcuaaggcagacucgugaaggaacguuucacuaaagcagacaggagggaaaggcuguucugcuaaggcagacaugugaaaggacaugugaugaaggguucuucuaacaacaugaauguuuuggucugccuuacauugccuaauugugcuccguugucaggacucuauagagaaacgcacccaaaaaacuuguggugugcugcaguuucuugccacuucuguggacucagguugauugucagugauaccagcugagauagacacacaugcugaggcaagaccuguggaggacguaugauguuuggagggauauaaauaggauuccauggacaguggaggaagcugagcuaggcuugcuuauagagcuagcuacauaaugcuuggucucagguccucacugaucuuugcuucacugagagaggcacagcugagaacuuuucuugguguuccuguuggcuuuggucccucgugcucacuugugccaaggcugaggccuggcuaucucugcuaggcagugccacagcugcugauugguguuugcucucccgacuaccaaacugagcuguguagcugccaacuccugugaacuggauuguugauuccugacaacacagauaggauuugcuccaaagagcccugucuaaacagguccacuuccccauauucuuuccuuuccauuaccucugaaaaaguuaguuauaagacccugucucaaaaaugcacaaauaaaaaaaaaaaaacccauuguugggcuggagagauggcucagugguuaaaagcacugacugcucuuccagagguccugaguucaaaucccagcaacuacaugguggcucacuaccaucuguaaugggaucuucuggugugucugaagacagcugcaguauacucauauacauuaaauaaauaaaguaaauaauuuuuugaaaacccacugucuucuauucugugaugaacaccauaaccagagcacuuggggaggaaaggcuuacguaccccaggcacagcccauugagugaagccaaggcagaacgucacguagggcaggaagcugcaggcaggagcugacgcagaggcuaugugcugcuuacugcuuugcucuccauggcuugcucagccugcuuucuuacacuugaucuuagccaaaaggcggagaaagcgaucagccugcuuucuuauagagcccaggagaggcaccacccacgggcuggaccuggaccccucuccccaucucaccaaucacuaauuaagaaaaugaccuacaggccuaccuacagcccaaucuuauggaguuauuuucucuacugggguguccuccucuuaggugaucuagcuucugucgaguugacauaaaacuagcgacauagacaccagaacuaaaaauaagaucaguuugauccaacaguaaugccacugucguguggugugcaucauauuugugcauucacacacuacuguuuucuuuuuauauguguguauguaccauauguguguuuggugcuugcaagggccagaggagguuguuggagacccugcaacuggaguuauagauaguuguaagcugccacaugccuguuggggaucaaauguggguucucugaaagagcagccagugcucuugucugcugugccaucucuucagcuccuacagugccuugguggcucaucugccuuuaauucuuauaacugcuuuauuucagugaguagcucacucuccugaauagugaugugggcguugugcacugguacaguaccauccucuauaugagccccguguugucucgaagugcaacucuuuccuaguuaaggagccugugagaugggcugucagaugaagggacccacugcacacaugggaggccagggacaagagaagccccuuuugaaaaccccaacucuuccauuggggacaaugcuuuccauguuauucccaggcuuuauucagugcugcucgcucagccaucugagcaagauggcugauuuaggaaggcugaaaagcgcaggaaagggcuacguggguuaauuaacagauccugugcuggucccacuguaggaucacauuggcacugaagacauucaaaaaagacaccuaaggacgauacaugugagugaaguacuguguccauuagcuguagaacaaaaaagucuuugugcuggccgugauggcgcacgccuuuaaucccagcacuugggaggcagaggcaggcggauuucugaguucgaggccagccuggucuacaaagugaguuccaggacagccagagauacacagagaaacccugucuugaaaaacaaaacaaaacaaaaaaacaacaaaaaaaaauguucagaaacacaauucuugccaggugugguggcacaugccuuuaaucuuagcacucaggguuagaggcagagguaggcagaucucuggccaaaccuugucuacaaagugaguuccaaaacagucuggacugccacauagaaccccugucuugaaaaaccaaguaaaugaaggaagaaaggaagcaagcaaggacaguucuuugucuagcacuguacaaaguugaagggaauuggggugacacaugccucaccuagcuaaagcagucagaggcaugcugcugucacugucucuguuuauacaggugaggacuaccaauucuguugguaccuguuggucuuuggaugcuaggggcuggacuuacguggaagagaggcagaaaaggcccgacucacuuaacuguuaccagaccuugugcugaccauaguacccagugcacuugcccucaccuugggccuuaauaucuucauaccuuaagcucaccaguguuuuaggaaggcaguagagaaguuggaaguuuggaggcaagggcugaaugcuuagcugggaaugauaugaggcgguucacagugcaguggucaugguaaaaugggcuguaaaacaaauacaagggcuggugagauggcucaguggguaagagcacccgauugcucuuccgaagguccagaguucaaaucccagcaaccacaugguggcucacaaccauccguaacgagaucugacgcccucuucuggagugucugaagacagcuacaguguacuuacauauaauaauaaauaaaucuuuaaaaaaaaaaaaaaaaaacaaauacaagauaggcagguaggugcuaaaugaccuucauuaaaacguuaauuaccuugguuuggcccaccuugcagcugugugugccugcaguagaaaugucaagauugaucuacaaaaaguaaaaauacuuuuacauugcuugugaugguuugagauagcgugcaauacauaguaaauuccaggccagccugggcuauaguaugagcaccugcagauaaauaaaaaugugucuuguugcaggacauuugaucacauugagaaccucaagauugugcuguuuguuaaaaaacaaaaaaaaacaaaaaacaaaaaacuguaguugugguguggcuuaguucuuagcacaguaucuuuagucccaaacaaugaaggugaaguuaguuuguagagggaaguaucuaauaaaaugauuucuaauugaggggcagacaaagugacaaauuggagaaagauuugaaagaauaggauaugcccaacucucacaagaagagaagaaaacaggcuacuuaacagcaagcagcacagagaagaagggagacgguuuuacugagacaguuguagaggcugcagagagaacaagcuagacacagaugaagacagacaagccggagaaggagccagaagauuagagcagguuguaguuugaggccaagcagagcaauucagaagcugagagaagucagcuuggagaggaguuugagacagagcagcuugagcugcccagccagcgcucagagagagcuggaaagagugagcuugaguuuauucaucaguaagucugaagcugaaaacacucuagacccagauaggauuauacggaggcuagaagcuuccaggacuaggcuuccgauagcagaaggaggcaauaagccucauagaugacauuuaauacaggcaaauaaaagauacuuuuacaguguuuaaaaagaacuccuuccaagcucuuagugcagaucuuccacacuuucuuuaagcgcucagguguugugcauuugaggcugcagucuggggcgcugucucugagucccugcucugaaguucugcacccaccagcaguucugcauuucaucaucagauggagucacgccuuaccagaucccuuggaauuguuagacuuggacagauuuaugcugagaagugcaguaguaagguuacuagcgaguuuaaggucacacaacauuaaacuucucuuccauuggaacagagacugaagaauacacuggcuauaucuugauauaauucucagauugcugauacuugcuucguuucuaaaacugguuaaaccagcauugaggagagagucacucugaugcccugggagguguuuuuguuuuuuuguuucuguuuuuuguuuuuuuauuugagucaggguuucucuguguagccuuggcuguccuggaacucacucuguagaccaggcuggccucaaacucagaaaucugccugccucuuccucucaaacucugggauuaaaggcgugccccaccacugcccggaugacgaaguagaacaucuuauuguuuguaucaugggugaagauucuaaaauuuacuaaauuagucuuuuuuaagugugcauaucaguguucuagagauccauuuaacauuuucaucuagaaggagcagaauucuuacuuccuccuuccugguaacuaacaagucucuaacuugacuuccauagaggcuuccuguaggcacuccugcaauuggaguacuagcguuguuccugauuuaucacuuaguaaaaugcccucagaguccauuugugcugcagcuaugucaaaacacaaucccauuguggguguguccauuaguggauguuugaguuaauauuuggcuuuugugaacaguguugcuguauuugugaacaugggcauucaaaugcuuuuuugugucaguucuuuugucuguauacuacaaagcaggauugauggauuagguuuuucuugcuuguuuguuuaaggcaguaucuugaugaguaggcuuaaggaaaugagugauggccucuuguguugccaagauaaagggacuaugggcuucuucccccccccuuuuuuuuuuuuuuuuuuuuuuuuuuuugguuuuucgagacaggguuucucuguauagcccuggcuguccugaaacucacucuguagaccaggcugaccucaaacucagaaauccaccugccucugccucccaagugcugggauuaaagaaaggcaugugccaccacugccuagugggcuugcuucuucauuuauagaucuugcugcaucuuaaaauaugaauuugggaguuggguaugguggugauaugugcuuuuaaucccagcacucaggaggcagaggcagauggaucgcugaguucuaaggccagucuggucuacagagugagggucaggauagcugggacacuggggugacacccguccuuuuuuuuuuuuuuuuuuuuuuugagccacacacacaugcucaacuuuuacugauuuaguuucucagggaauuucuguuuaacucucaagagacuaauggucacacugacaaaagcugagagaagucagaaaagcuacuucagccuacuuuguuuucuacuguagccaccauuucuacuccagaugauauuugguuacaaguuggugauuaagaauaaaucgcaccgggcaugguggugcacgccuuuaaucccagcacuugggaggcagaggcaggcggauuucugaguuugaggccagucugaucuacagagugaguucuaggacagccagggcuauacagagaaacccugucucgaagaaaaaaaaaaagaauaaaucgugccaggaguggugaugcaugccuuuaauucuagcacucaaggugcagaguuaggcuggucucugaguucaaggauagccagugguguuacacagagaacccuguacugaaaauccaggaaagacuaaaaugggucuagaggaauggcuaagcagucaagaacauuugcuacccuuccaaaggacucaggaucaauucuuggcacuacauggcagcguacaacagucugacuccaguuccaggguuucuuaugucuucuagccuuugugggcaguggguacacacaugguacucagauacucaugcaggcaaagcaccuagacacauaaaauaauuuaagaaugaaauacuugcuaggucagguguggugauacauauauuuaaucuuagcacucagaaggcagagacagccagaucacuaaguucuaagcaagccugauuuacuuggugaauuccagccagccagggcuacuauagugagacucugucuugaaaauaaguaaauaauaaagauaagauaaggaaaugcugaauauuguauucauuuuuuucuauuugauaacauuuuaacuuguucaauuaucuuuuuuaaaacugucauuucagaauuuuuagaaggaggaguuggccauguggaaauguuauuucgcuguaacuauuuagcuuuaguuggugguggaaaaaaaccgaaauacccucccaacaaagguacaguaguucgucuuucaaaaccucaucauguauguagugguauccugaacuuuguaggacaucccaugucugcagucaugcagagccucccuacuaguccuuugagguauugaggguuaaccacugggaaagaagcuuccagaaaguguguggauggauggauggauggaugggaagacuggaugucagcuguuauugaacauguugugggugugcuucaccuguaggcagggagucaagauugaggcuaaagcaagguuuaggaaugguguuuccccugcuggaagcuaugaacuucgugagauuaacucacaguucacauagaagaaggagcagcguuggcugugggugcauggauugcgguguuggugugggucugucauugucuaugggggagggggaggggaguaugcuuaagugguguuucucccuucuucccuccccuccccaucccuucccaucccuucccuucccuucccuucccuuccuuuccccuccccugcaggcaucaugcccuuaguuggguuuucucuaacuuuuguuugaaggaggaaguggacauaacugaucucuuuuaaaggaagaaagcuugaggggaaaggggccuaggaggagggggaagcacagggaagguggaaggucacuugagaaggaagugggacagaccauggguaugguggagacuucagugucaauugaggggguacggggaggguaaaguagugucugguaaagaaguggaauagcucaagccugauguaaaagcaaugaaaaggauugugagucugucaggguagcucacaggagucaugcaagccuggcauucuugaagcucugguccuauuaccaagcacccaaaaagaaaagaaaguggaccacguaccaagacagaggugacucugggucuggugcuaaccauucuugguggagcucugugaauauggaaaugucagcacucaagugagguugacccugcaguucugccuuuagaaucaggagcagagaaaugaaacagaaaaguagcuaugaguggcuaagaguuggagaucuugccuacucccuuuucuuuguaguacuggaaauugaaccuccuguauucucaacuaccuaucauuauuuuaaaggcuuuaaaaauuauuaguuauuuaugcauggagugggaagagagaaguuucaggacugguucccuuuucaccauguggguuccagguauugaacucagguuaucagacuuaguggcaguuacuggccgagccuugccuuuccaccugccuauucauuuucuccccuacacuuccccuuucuuuauggugcugggcagugaaccuagggccucaagaagcaugcuagacaauacucagcaauauauauuuccagccaguuuuucaaaaucuauuuauguauauguguuugaguguacaccacauguuugugggcaucagagaaggccagaacagagcauuuggaguuccuggaacuggaguuauaagugauuaugagcugccagacaugagugcccagaacugaacuugaguccucuggaagagcagaaagauucuuuuuuuuuuuuuuugaaagaucaacaaaccugauuuuauuaugacaccauauguuugucauugguucugcacaaaauuauauacaaagaaauauauacaaaaauguucaaguauuaaauuucaauucaaggcuucuguuucaaaagcuacauuuaacauacuucagaaagagcacaaauuagucauuucaaauaaauuuccaacuacuuuugguuucuauaucuauguguauauauaauucauaggcacggaaauccaugcagcugcauuguggggcuuguaucuuacccuuguagaagcaggucugucacuccaaguugugaguuuggcuacuacccauucaugcucaagugcaguagagauuuuuacaaaaugugauagacugaaaaaccagagacuaauuuaggucucaaaaucauauuaucuagcaacaaaacauuuacaguugugcaagaacaagauuccauuuccauaaccaaguaacaaaauaaaacaucuuacguguaggauaacuuacaucuuuggacugcuggagaaauaaccgagcagaaacauucuuaacaauaaaccaucucuucagccccucauauuuugacacagguuucucucuggcauuuaaacacuuaguaacuauagucagguuugcuuuuagcucaaucaggugaagcugugcuugaguguguaagacagguugguuuccuaagaucuugguuaugcuugugccuguugcauuaggaguggggcuuaaguaggaguggguucucgggguaagcccaccuagccagugguacccaccauugcuggguacaucugaguuugcuuggccucaucaauaaggugguagugcuaucuacagcucagucugugggccacuuaugacaccacgugcacucuucugguguuucagugaugaucugggaugaucugaagaagaagacagucaucgagauagaauucuccacagaggucaaggcugucaaguugcggagagauagguggguuugguguuacuuucuaaaugcaguuuuauuucucuaaaaaauagaguguauuaaaaugucaguaacuguagcuugugacccagagcagggaaaaagaguuuucucuucugucccggggaggcuggaagucaggcuggcuucuggacuccucagagggacagucuaggugggcaggggauguccacaggucugcuuaggaagccuccaccucaggggucaggcaggccuugucaaaugcuggguguucccaugcuaaaaggagaggagaacuuggaaacugaucuuauuauugauucuuaccuggugaaaguauacagcagugcgguauagagcuugcccuguuugcuuguugaccaugagaaagcagagguucauuacuuggguuuuaauuugaugugauuuaugcaucauauucuuuagauuucuaucagcuguagaguagguucauuaggguggugcuuacaagcccaaaguaauugacccaaacuaauguucuuguauuugaaaacuuugugggugguauuuuguucucuuuguuuauuuuguugaaucaggguuuuacuagguagcccaagcuggccucgcuguucugccucagccucccaagugucaggagggauucaggcauaugccauuacucccggcacagcuuguuugguuuuuuaaaaauuaauuaauuaauuauauguaaguaaacuguagcugucuucagacacuucagaagagggagucagaucucauuacggaugguugugagccaccaugugguugcugggauuugaacuccggaccuucggaagagcagucgggugcucuuacccacugagccaucucuccagucuccggcacaguuuucuuaacaguagacauguuaagaauaagagcgaggguaguucugagaggugucucaccaugcuaagcucucagugagaugucuggucaugauguuucccuaagcucacaaguuucuuugacgcugaccucugcaaggugauggcuaugcccuuggcuaugcacaacccucaugcuuuguucuucuuggccauauuuagaacucguuucuaacaggagugaugauaacacaucuauaauucuaacacuugggaaauaagggccaaaugauaaggaguuaaaggccagccucaacugcuuguuuugcaguuagccaguuugagcuaugugagacccuaucucaaaaaguaaagcagauggguuagcauauaauaauaauauaaucccagugcuuaggaaucagaggcaagaggaccauucauugcaaguuuggggcuaaagguagcugagcuacaaaguuagacccugaccaaaaaaaaaaaagauaaaaagcugagcucuuguuguaugagguacuuccuguguuugguuuuuuccuggguuuuggugugggaacagaacucacagacacgcuuauuugcuuauuuuacuuuugagaagaggaacucugauuacauuuccuuugcagaauuguggugguucuggacuccaugauuaagguguucacguucacacacaauccccaccaguugcacgucuuugaaaccugcuacaacccuaaaggugaggucuggagaggaugagcaaccgucauggggagauggguccguaugcauggagaccuguccccagcguguccuuugugagcagcucuggcucuguccugcacacacuuuagagugcuaacguuuucuucccugccugccugggugagaguugggaagcuaccaccuugccacaggcugagggguucuuccucuguuccuuuccuccccagcagucucgagcaucacuagccacacugggagccacugagcuuuggccuuuucuuccuuucuuuggaauagucuauacuugaguuguguauucaguugucauccucauacuguuguaaaaauugugaguguuuuucucucucagcuguguuguguuagaaaugacauugcucaccgcacugguuguucccuguauuuuucucuuuucucuguugucucuuccucccaccacuccaccccaccccaccuuuuuuuuuucuuuugaaugaaggcucaggccaguuuugaacuuugggauucaaaguagcuacuccagaguagcuggcacacuagucagaaagcauauauucaacucucuggauacuuuuguuucuugagacagggucucacagcucagacuggccucaacucacauuccuucugccucugccuucugaguggugggauuguuacaaaugcugcgcucuacccugcugagaaccauuguuugugauacuguguuguuuuuguuugguguuacauuacuuacuuuuguuuuguucaguaaaagucaaaagucuuuuggccuuuccauuuuccagugaucccuaugccaguaccuuucugcugaaagguuuaaaguuaucuugaaauuaucucaugucagccuuccacucuuuacaaaaaguuugaucuuuuaguacuuuuauucuucaugaauuucccuaucagccuguguguugagguuuuagcugugccuuugaacacuguggaugagauggauauagacaaagaaggcuuuucuagccauggccuugagaggugugucugggucucugcauuuugugguacaucuguuucuagauugauucuaaguauuugaggguuuuugcuauugcuaguggaauaguuuuuaaaugcaauuuuguucuuguuguacucucaguagcuaauauuaagaaagacaggcacuugauaaauaauuuggguaguaaauuguucagcaaguguucccaguuaaaaacaggucucaugggcagcagcugugucagcccugauauucuuuccagugacagcaauucgaagguaaauuugcuccacgagugguuaaguugugacugaggauugcgggcaggaaggacauuuggguugcgggaaucaggcuuugaccauugucaucucccaaccaguuuucuuugucucugcauaggccucuguguccugugucccaacaguaacaacucccuucuugccuucccuggcacucacacuggccacguacagcuuguggaccuggccagcacugaaaagccacccguggacauucccgcacaugaggguguccugagcuguauugcucucaaccugcagggaacaagaauugcaacugcaucugaaaaaguaaguucaggccaucuaugugagucuaauuacaggacgggaacuaggccaggccuucagacaucgucugcuuuaucuccuguucuuuacaaaccaguuuguuguuaaagcaugauaaagauagaacgaacgcuaaccuagguauagugacacaggucuauaauaccagacagaaaggauauuaaguucaagaccacuuaguaccuuagucuugguugucugaugacacgucagaaguaucuuucacaccugccgaagaauauuuccucauugaauuaucacaaucuuaaaauuugaaguauuggccguuauauuaguuacuuuuuguugcugugauaaaacaccauaagcaaaagcaacccuggaagugcuucuuuuuacuuacacuuccagaggggcaauccuuaauaacugggggagcauggcagcagacggcuagaccagaaagcagagagaacaaaggguaaaugaggcuagccagcggaaguuucaaggcuacccccaagccagcagaguuucgggcuacccccaguaguacuuccucaaggaagauucugucuccucaagguuccauaaucuccccacauaguaacagcagcugggggccaaguguucccacucaagccuguggggaaacauugcuuaucuaagccccuauaacuaugucauccucauuuugucuaaagugaaaacugaucauuuauaccugguuuagauucagugguagggguugggggcagcucagggauaacuuugugaaguuggucucuuuauacauuugugugguuuccaggaauuaaacuguaguugccagguuugugaugcaaguaccuuuaccugcugacgauugcacacaucucugaaaauugcaucuuuauaccgugguuuccauuugauaauacgucuaguaucacuuugucugaaacuauuaauuggaauauaucuauuaguggguucagccuccugggagaacaggucacaguuguggucugcccugucuaguuguuuccugagcugucacagacagcaguggucgggaggagagaaaaagccaggccugcuucuuguccugguuaccaggaggccuggguaggcuucugcgaaugcuacugcugcaagugcagcucaggugcuggagagccugugguggcccagacucugaaguucugcgcuucgcggccuccuagaaccacacacugaccacacaaggacaguuugggguuuuguuuuauguuguuuuugagacagaguuucucuuuucucuguguaggcuugacuguccuggaacuaacucuguagaauaggcuggccucaaacucacagacaucugccugccucugcuuuucuaguacugggauuagaggugugcaccaccaccaccuggugacaagguacaauuuuaucuaaauuuagaaauaggauuuuucaagcuggggauauagcacagcuaauagaaugcuugucugacauauacaggucccugauugugcucuccagaacuguauuagcuaugguagcacaugcacaccuuuagucccaccacuuagcggcagaggcagauagaucugaaggucagggucagccugcucucuguauagcaagucucaggacauagugagacccugucuccaaaacauaacaaaagaaauaaauagcaaaggagagagaagaaaaaugccaaguuuguagguuuauaaaccccauuauuucucaucacacaguuaaacaagguugaggcaguaagauuauaaaaaguucuaggcuagccugagcuauacaauaaguuuuuuuuuuuuuuuuuuuuuuuaaaugcuagugugguagcacacacuuuaaucucagcauuuggugaaugaguuugagguuaguuugguguacuagugaguucuaagcuggccaggcagagcuacauaguaacacccuuucucaaaacaagcaaacaaacaaacaaacaaacaaacaaacgugggacauaaugaugcauaccuguaauucaguucuuaggagauagaaauaagaggaucaauucuugacuagucugauguguagaagacccugucuuuuuuuuuuuuuaaagggguaaacaaaacugauguugaugggaugguucaucaggcaaagaauuuuuuucauuuccuuuuuuuccuuagauucuccauuuucaacuguuugugcauguauaggugacccugugcacaugcauguguggggaauacagaugaguuuagauguucuugaggucaccuuguugugauugaauagguauggcccccacagauucauggguuucagugcuuggccauagagugguaccauuagcagguguggucuucuuggaguagguguggccuuguuggaggaagagugucauuguguaggcaggcuuugaggucuccuauggucaagcuccccucaguguggaaucagagcuuccuauuugccuauggaagacaguuccccuucugcugccugcagaucaagauguacaacucucagcuccuucuccagcccccugucugccuacauguugccacggucccugccauggugauaauggacugaacucugaaacuguaagccagccccaauuaaauguuuuuucuuuauaagaguuggcuugggggcuggagagauggcucagugguuaggagcacugacugcucuuccagaggucaugaguucaaaucccagcaaccacaugguggcucacaaccaucuguaauaggaucugaugcccucuucuggcgcaucugaaaacagcuacaguguacuuauauauaauaaauaaaauuuuuuaaaaaaugggguugaaggggcuggagagauggcucagugcuuaagagcacugacuguucuuccagaagacccagguucaauucccagcaaccacaugacagcucauaacugucuguagcuccuguuccagagaucugacacccugguacagacagacaugugagcaaaacacaguaacaugaaauaaaaauacuaagguugaggauaguagagaaagguaccuagcauugaccucgggccuccaacuguacacacggguguggacagccaccuacucagcgcgaccacaagagugacacaagucagaaucucauuaaaaauaugggauauaugugguuuuuuuucucaguguuuuucaacucagcagugcucugcagauucccaguguaacuuaaauauuuucuuccucagugauacagauagaacuuaggccuuaugcagacuaggcaagcacucaaccauugagcugaacucccugugccagcuuaggaugauguaacuuguaauuccuuuccaacuuuacagugaugauaaaacaacauguucauuacaaacgugacuugaauuuuggucuuuuccuaauuguaaugauagaugauuaggcagcagcaagccucacugaacaugucccacacuugaaccauguugaccgagucuuuuuaucaagagacggggaucagugugugcuucaggccuuccugcagcucacugugucucuacugugucuacaagucaguagugugggggagcauguuguuugguuuugagagucuuacuaaguauaacccuggcaugccaugaacuugucuucuguacuguugugcuuagcuccaaccuuuucauggauacaaauagucagugaauacaggagauguucaccuauuuguuauaaaauaugcucuguguaaaaaagcauuuuaccaauaucaggcuguuucauuuugucaguuacaaaccuuuuuauauucuaccuugucacuccguuaaucuaauauguauauuaauuaauuauguaccucuguauguauaucuguaauuaauauguacaucuguaaugguagccccuggaagcugaggugggaaagucaaagcaggaacauucauugccucagggccagcugggaccagccuuagcuccagugugaaaugaucaaaaaaacauuuuuaaagaaauuuagaaaguagaagauaaaacaaacuaguaacuacaagggugguguuguuauuaugauuucucuggaguggaaauuguuguugucuggggguuuugcugcuauuuuuguuugagacaggagcucacuauauaaacuaggcuggccuuaaacuuagaaaucuaccagccucugcuuuccaaaaaauaauaacacgcuguagcacaccuggcuuuuuuuaaaaauaaguuuauuuuaaacaaauacuguuuugacauuggcuucugaaauaauguuuucuuccccagaguuuacgucggccucaucguguuuacuugguccuuacagccaugucggugucaaggcugagcagugugguggccgggugcaucaagugaauuucaggguuacggcuucuuuaggacacucuggcaguuuggucagcuugagagcaggggaguucccuucuggcuaugcacagggaagcugcugcaucuccaggagcagggcuggagaugagcuuauugucauauaggguugccaggucacuucccacaagaaaugugaccacucauguuuaucccaauaccagaauugacuaaggagucuucacuuuuagugaaacuuuuaaaaaaaguuuugaguugaguauaaucuuuuucuuggggagcuuaaugcguuuguauucuggccguuuauucugugcugccuaauuucuugagagggggaauacuuuauucuugucugagauaacauugcuccagcaaauaacaacaggucuuugaguuaaggaacuggagcagggaugggucaagaccugccuacaaggagaugucuuauaacuccucucucugugugccucugcuguaccugagguagcagacaagaagcuuaaugaauuuuaggugauguggguaagucaagacagggcuguugggcugggcggugguggcucacgccuuuaaucccagcacuugggaggcagaggcagacggauuucugaguuugaggccagccuggucuacagagugaguucuaggacagccagggcuacaacagagaaacccugucucaaaacaaaauaaaacaaaacaaaaaaaaaaagaaagggcuguuggggccaguggguuauaauauaaaucauuucagacuaaugaaagaguuauaaaucguugauaaugaaacacuucacuguuuuucaaaggggacccuuauaagaauauuugauacuucaucagggcauuuaauccaggagcuacgaagaggaucucaagcagccaauaucuauugguaaggacuccacucugggaugaguaaccccagggcgauggcggggcgagaggaugcaguggggcuguugggcuguugggucuuaucucuuuagucacuuuacuuuguuuugggaaguguacacaaagacggaacaccgugggcucucccuuuccuguugcagcauggauguguuugccacauucuguccaucucuccccuguuccuguuugcuuucugugguauuuuaugguagaggccuugcuaauuuaucuguaauuauuguauacuguugguuucaagagugaaugcuucgucugugaggucccacaaugucuauagcaagagccugacaccacccuggccaucccaggccuguggguauugagccaaauuugggagacuaaccugugugccccggcccuuguguguauguaacacacuugauagccacuuccucaguguaugccuuucucaccugaaccuccugaaacuggcauggacgucaucucaggaaacccccaccccuuucacuggcauauaggcauuagccauugugccuaugggguccuggugaacagauuguugccuggacuuuuggcuuggauccuggcuccacaacagaugcuuaaagucgugagaccagggaugaaggcuagugcauuguguauguugaggacaagagaguuagaugucugguccucuguaucugacccaagcccugucugguuucucugcagcaucaacuucaaucaggacgcuucucucaucuguguguccagugaucauggcacugugcacauuuuugcagccgaagauccaaaaaggaauaaacagucuagguggguuuuagaagagcuguaagcaggggacagucccaaaucaggguuaccugggcuucuuacacagacaaaucuaaugucaguuaagguugaagucuauuauaucucauuaauuugauguuugugggguuugaaacugaauuuaaauugaucucaguacccauauuauagcucacaaguguaauucuacugucagggaucagauacccucuucuggccucucugggcacuaggcacagauauaugugcagacacaacacccauacacauaaaguaaauuaguuggaaaaaaaugguccuaaaguguaaagacucuuuagaauuuucaucagcacucuggaauuaagucauugacuucuguguuauuaucuuugugaguguuaacccuuucuuuucuucuuguucuuauaguuuggcaucagccaguuuccuuccaaaauacuucagcuccaaguggaguuuuuccaaguuucagguuccuucaggcucaccaugcaucugugccuuuggaacagagcccaaugcagucauugguaagugccccaucuugugggaggccucagcaugugguccaggcuguaccaacuucccagauucccuuucuuccuucuuuaacugggcuggguccuacucacagccuccaaguguucagggcacuauuaguaccugccugccagguucccagggaugcuuugagagcagaugugggcauugugaagaugacccaaagacuauuugcaaagucaacccucauuggauaagcaugagccuuggcuugguguggcuagcugugcucagguugagucauguuugcuuugauucugggaaguaaccaugaaucaaucuggucuccuuucccagcuaucugugcagauggcagcuacuacaaguuccuguucaguccgaagggcgaguguguccgggacgugugugcacaguuccuggagaugaccgaugacaagcugugacugugccugugagcgcaggugaugccaccacccagccgcccuguggacuccuggggcuggugccagugccccaggccugugggugaggggcucaaggccccccuggaggaccuuggucucgaagccauacgugguugucugccuuccugagcaaggcuucucaucccauauuaaaggaucaucaucaugguucugcagacacuccguggcucugggcgguucgugcccuugcuagccacuacccuucaauucaccugugaugcuagcauuaauggcaccaccauauucaugccaguaggcucccugcaguccuugggaacuauccaagcacgaaucagcagaagcuuguaggaugagugugucggggcuuaaauacuagacaguuccaaugagauaacacuaucagcuugucugguagagcacccccugccucacauggggagcacuguucagagcacacacuggggaguucugacuuuggccauuagagugagucacaucccagaccuaccagagagcagaaugcuuguggcacccauuugaggcacagcccucaggaugcagggugcugggucuucugguuuuguuuggguuaaaacagaacuuucccauuaucuguagggaacagaguaacgcauagucuuuaaaaaucagucccagaagagagcauugcuuuacugaggggccuucucagugcaguguccaugugccucuagcucccguugguguggaggguacugccuuggccuguggcguuuguccugucucaucucucccagcauccauaggaacacacuaacauugggauggcaggcacauccugguacuggcacagacugaagagucuguguuucuguaccacuugagguauauguuuaguuuuuuuacguaucuucuaagaagcucaguuuugcgguuuugauuucagguugcaaacauuuaaauugugcacagcaacagguucucaguucugccaguuccuuuaugcuccuguaaucggcuaacuguggauuugaugucaaguaugcauguuaccuuauguguauuuaaucaugaaacuuaauuuuugcacacuuguuuguacuguuuucuuugaaauaaaagugacuaauuuugucguacucuaucuguaaagagcagagccauauguaauguacccacaaauucucucuuccuccuguuuauguaaugguauugguguuccuguaccugcugcaggacagacuuguaggcuguugaccugauaguagggugccuguuaugugggaccuuaccagcauagccacugaacagagaagcugaguuuguaagguuuaggguuagccagggagcagguacagaugaaauaaaucaugaauguuuaguuuugggcaucucugcccugugcccugccagugcugugugcccugguuucauagaagucagcaugcugcccugguagaagacacuaauagaccgucaucugugga

SEQ ID NO: 6546 - RNA, 165656 nt, Mus musculus
ugggggucgaaggucucagggcggggcuggcaguucucgugcuguaucucuuuucuucccgguugccgguaggguucuuacggaagcugcuggcaggaugguacugagcaaugagccggcugcgagcgccgccgaggaggagguggaggaugaugcgcuuguucgcgccuccgcccuggaagcguucggcgagagugcggagacccgcgcgcugcuccgcagcuugccggcggugcacagagagcgcgcgucccgggagguggcggaggagcgguuccgcggugcgggcggggccccgagucucuaucuugagguccuugcaucugggaggaagggaccuggggagccauaccuccugccuucccugccauguccaggaacugagcaaagcaugcuugagaccucucuguggauagggagggaaccagcagaauuguuggaugaaccugccuccuacgagagcgcucauggcaagcaaagaggagcggucuggcacggcgcuccuauggggcugcgcuaugaggccaggauucugcaaacucagagcuccacguuuaucugggaucuccguuccaggcagagcaggagaguggacagugccauuagauuccuuuggugguucuaaaucccccaaguuuagguaggccuuuacagucguuuguaauggauacuguccgucauaguuuuugucaaccuuacacaaaccuagacauaccucggaagaaaucucaagugaguaauugccaccaccagauuggcuugugggcaugucuuugcgauauuucuuuaauuacuaauugauaaaggacggcccagcccaccgugagauguaccaucccuggccuguggcucugagcuguauaagaaagacagcugaacuugagccuaggagcaagcacgcaagacuccuccguaguuucugcuucuauuugcuuugauucaucccuacacuuuucucagugaugggcugugaaagccaaauaaacccuuucuuccucaaguugauuuuuggccaguuucaucacagcaacagaaaacaaagacaauguccaaaugagcccuuugauaauuagaguuuuguacuugaacaaaaucaucuuuguguauuccuuagcuaaaaacauucucuccauaaugucuuuuuuuuuuuuuuuuuuuuuuuggauggggcucuaguuuuuggguaagacagaguggugggcuuugucugaaguggcaggugagaacugcagaggcagagaaaccauuggauuggguagaaacauuaauuugcugguagggguuggaaagcaggugaccaggguuggggagguuguacaguuauugguuugaacauuguuggaaaugaaaggcaucgugcuaggcaggggagggcucaagaagugaagagggucugacuagcaggggaagguggaguuguagagaguuggagcaccagcauaugugugagaagagaucggagggcaagaugugcagagcaaaagaagagcaggagguguggucacacugguccucaagagccugacagauguugggcagcugugagcaucugucagcaagaagccaggugugucccugggcguuacaaggacuaggaagacccuagcuguuccauuagaguuacugagagacgugaauuuccaaggcucaccugauuugauuuucauguuauuuuccuuuuaguaauuauggacaaauaccaggagcagccccaccuccuggauccacaccuugguaagcauagauuuuggugguucaauaucagaugaucgggaaggcuuauguguauagcuggcaccugugugcuaucagcagaaggugucagaugaaaugucccuagagcucugucuuuuuuuuuuuuuuuuuuugucugcuggaugguuuuauagaccugugauaaugaauagcuucgaguucagauaccgaucuugauugugugcaggugugucuaagcuacuuucugcuuguuccuauugaaagaacacaucuuuucuuauauguguuuuagucaguuaugugugaauagcuguuaucuuccugguaauuguuuugcagggucauaugcuuuauaaaggucccauuuuaccugcacagcaguugaugaggucaucugucaucuccauuauguagagagacacuaagguuguuaucaggacauuaguacaagaguguugugcaggacuauccuccaagcugaacagcuaccaucuguggagcucagcugugugcccugauuaucccaguuggacuuguugacuauuuacauuccaucacauggaggcaagaaggaucacagacccucaccugaguacccacggcucucuacuaccuguuguaugcaacugugcccuaauugcagguggccuugggaacagccuagauucuugguuucaaucuguagguuguaacccccauaggggucacaugagauauccugcauaucagauauuuauguuaugauuuauaauaguaguaaaaucagaguuaugaaguggccacgaaauaauuuuaugggggaggcauaaccacaacuugaggaauugcauuaagggucacagcauuaggaagauugagccucccuaccccccacuccuccguguguguguguguguguguguguguguguauguauauguguauauauaucagacaagauuagggggggggagaaucccaucuauguuagugucauuuuuauaaguguguugacauuuuucucuuaacccagcuggcucucaaacugagacagaacuauuuuauuuauuuaccagcuuuaaggcacagcaacugagcaguauuaaucuauuuuuaaucuucuuagcuaauccuagggugcuuacauuuaccucuaggaagaaauuuuagcagcagagagugacuuuuguuugcuuuucauugcuguuguuauauuugaaccuauuucauauuaauuacauuuuuguuuggcuuuucucuuuuuuguuuugagaaagagucuugcaauguagcccuggcugaccuugaauuuauggaaguucuccagccucaaccucccgagugcugggauuacaggcgugaaccacaacuccuggcuuguuuuuuucuuuuugagguagggucuugcuagguagcccaggcuggcuucaaguacucuugguaauuuuuuuagucuuguucugagcuuuuuuuuuuuccccuuuuuuucuucuuucuuuuuuuuccuuuuuuuuuucugggaggacccaacuguuuuaaucauuguuguaaccucacagucucuguguaagcucugucauuguaagcuacacaauacaaacggggaaacuggaguacaagucugaaagguuaaguaaauuguuucaugccacacaguuggugagauugcaggcagaauuuaugcaucuccuccuucccuuugccucucaaagaugggucuucagcggggccaguugcaggcaaguggcugaugucaggcugaagggcuggcuaugcugaggguggcagaccaguaggugcccugggccucaucugauaguuuuggauuccugguuguccccauguaacagauguagguacuguccaagaaguguaaggugcuguuugaccucuucaggugacagcuuugaccugcccucacugccagaaccucucugcuuacuguguuccauccagugcuuaguaauggugacuguucauuaucuuccgggaaauagaaauaggucccguucugaaaaagaugaugcuugcuggugcugauccuuuucugugugugacacauuuuaugcuuccgcuuuugccuuucagguuuaugugugguguguuagccauugagguuuaauauauuugaguuugaauguuaucaaucucuuccuuuucuuuguuucugagacaggguuuuacuauauaguccagauugguguugaauugucaguuuugccugcaucagccuugugugaagucuucuuugugucacucuucuuuguguuugauuuuugauagcaaacccagagucuaauucuuguuuguuuguuuguuuuuucgagacaggguuucucuguauagcccuggcuauccuggaacucacuuuguagaccaggcuggcuucgaacucagaaauccgccugccucugccucccgagugccgggauuaaagguguucgugcaucaacacgcccggcaccagagucuaauucuuaauugauuauguaaggcuuauuuauuaacugagugaucuaguaacccuucucccuguuugaaauauauauuuuaaaaauguaauuucuauuauuauguauaugugcaugugucagaauucuuggaguugcaggcaguuguuagcuauucaacauggguucugggaaacaaacuuagguccucugcaagagcacaaacacucuuagccacugaggcagcucuccagcccugaaauaccauuuuaugucuguaauuugguacuuauauagcuuauauaaaagcuuuuagaucucaaguucuguuucauuugucccuuguuagcugcuuuaugguauauucucucuagcaccacagcuguuuauuuugcuauuuucuaguccuuucauuaguguagauaaacuucauuguauuuuuuacucuccagaacugacggaucuccucggagcuuuguucgguagacagauucauauaguggagauguuuuuauaagauucuaauuuggcuauuaggaauaauacugcuuuaaaccugcauguaccaucuuuguguggauauguuuuaguuuuucuuaggugacuaucuuaugacugggguuuauggguuguguaguaaauguguaucuuguaauagaaugucacacuguucuguaaaaguugaguccuuaugcauccucaccaaccauguaugaggaucucuguuucuuuguagccucucuaggcaguguuucccuuauuacuuuguagccucacuagacaguguuucccguuacuuuguagccucucuaggcaguguuuucucuguuacuuuguagccucucuaggcaguguuuucucuguuacuuuguagccucucuaggcaguguuucugauuuuagugaguacuuaaucuuacccgacuguggucucacuuugcaucugugagguucagauuauacucuuuuucuauugagaccagugacacagcacagguuugucuggcugaggcuuccaugcauguuugaaugagucuguuggaauaagguggaugaucgugcuguuggugaccuuacugauuuucuguuuacuugguccuguuccugcuuucaguuuuugcuuucuuugcuuugggguucuggcauuuguuguaucaguaacuaaauuguuuaaucuucacaaugaauugguuguucuaauuagaaauguccucuagguuuugcaacauuuucuccuaagucucucaugauagcaaacacucuguguuugucuccuuuuugucuggauucagccugucagcccuagucuuuuaauagcuaagaggguauuuucauuuaguaaugcugucagcguagcuagguuuaaucaacucuauugggacuugcuuuuucuuuauccuguuuccuuuuugguuucuuccuuuauuuuuuuaaaccucauuguuuuauauuaguuugauaguuuuugguguuuguuuguuuauuuugagagagugucuuacuauguaguccuggcuuguuuggaacguguguaggccaggcuggcuuuaaacucacagagauucauuugccucugccuccgagugcugggauuaaaagacaucuguugcaggcaugguauucuauuuuaucuucacuauaugcucaguagguuuuuuuccccuccaggauuuauaugugcccuaaacucacaacaguccacccucagauaaugugcauuucaugcguggugaggaagcuuugagagaagaaccguuuguuucucccuccugcuuucugugccaccuuacaccuuugucacagaacucaguuucauauuuguuacaaauuuuaccuuagacacacacuuuuaaaauaaaagauuuauuuuauguguaugggaguuuuguuuaugucuguguaccacgugugcagugccugcagcagccagaagagggcauuacagcccuugcaauuggaguaacagaugcugugagccaccaugcuggugcugggaaucaaaccccgauccuuuggaagagcaucaggcuguucucucuuuaaacugcugacucaucucuucagcaccucuuuuuuuuuuuuggaaaauuuuauuuuuaauuuuguguauguauguguagauaaugugcagguccuugucggggcuugaagccuggagcuguuguugcagaggaacccaacccuggucuugagcaugagcaauaagugcucucaacugcugagcugucucucaagcugauacucaaauggucaaaugguuuuuuuaaagaaauaaaaauugaggccgggcauaguggugcacuccuuuaguccaagcaugugggaggcagaggcaggcagaucucugaguucaaggccagugugaucuacacagggaauuuaaggucagucagaguuauauggugagaucauguuucaaaaaacaaaacaaaacaaaaaaaaaacccuaaccaaacaaccaacaaccaaaacgaaaaaaaaaaaaaaaaaaaaaaaacccaaaucaaaccaaaaccugcaaagcaaaacaaaaagaaauaaaaaaugaggaacucuauaaucuuuguguauuuauccuucaaaaaaaguccuuuauagagcaaagaguaugucuuauaacucggggugacugugcuagcuccccaauaccaccucagguccauggugcccugggaaggcuuacaggacacagcagagucuuguuugugguggggaugugguugaugguauguaagugucucuugggcauuggguugguggggaggcaguaggauagucaguggguuguggcuggagcuuuguauugcauggcuaacggccuuguggaacucgucucucucccccucucuguguuccuuugaucucucccuguacugggcucugaacauugccuugggauggacaggagaaagcagugcccugcaugacccucuuuauccugucucacugcauuaguuaaccuagccugucgguaaaucagaccgauuuuaacaggcaucaucuguaaaaacuuggugucagauaccaauuuuagauaauuucccuguauuaaaaaugggagagggcuggagagauggcucaguggguaagagcacugacugcucuuccagagguccugaguucaauucccagccaccacaugguggcucacaaccaucuguaaugggaucugaugcccucuucuggugugucugacagcaacaauguauucauauaaauaaaauaaaugaacuuuuaaaaaaaaugagaccauguguuaaggugaauauauuuuuuucagagauggcuuucauaucuguuuuucccuagaguggaugaugaacucacuguuggaccugguacaggaugagacaucucugcccgaccuuguccaucuggcuuuuaaguuucuuuauaucaucaccaagguaacgcuaguauggugcuguagcguggacacacacuuuccucauccgauugcucuagaaguguugguucuuggggaacaugguucuucaacacaaguuauggguuuucauuuucuuuuuagccuguguugggucucaggucuuagugaucuugggguccuuaguuagaacaaaagguuucuuacaaggaagaagcaaaaggccuugguggaaguggaaguguugcuguugcuguugcuguugcugcugcugcuucuucuucuuuuuuuuuuuuguucuuuuuccuaaaugggguuucacucucuaccucugacuguccuggaacacacucuguagagcaggcuggccuugaacucacagagauuaaccugccucugccuacugagugcugggauuaaaggcaugagccaccacagccagcaauagaaguauucuuaagcuauagugugaggaugaauuuauuggggaaucuuuuacuuccccucggaggaagaacaucuggggcucauggccugcuuucuccagacuuagagaugcgggagugacucuguguaagguucgugagucucagggaacauguuuuagcauucuuacuguguagcagcagggugaggcuuuuggcuguugauagaaugcagcuuguuuuauaaaaguguuaguggggccauuugaggugcauagggauuucguuuucauaaaugucagaguaauuguuggacagaauagaagcagaaguuuucaguuuguagcauacugauaucucugguguacacagugugaccuguuggccaaauaggaacauagaggauggguuuugaugacuguaucaaggcagcuuugcugcucguucuguaaucuguauauagcguacuccacauucuguaaaucccaaugucuuuuuauuuggcagguucguggauauaaaguguuucugcgucuguuuccucacgaaguggcuaauguucagccuguguuagauauguucacaggucagaacccuaaagaccaugagguaagucuuucccaaacuucccugcaggcuccccgggcacuggcaacuucgucuuccaacuuucuuugguuuuaucuuagauuuuuuuuuuuaaauuuccuucugcugcugcuuuagcaucuacacauauuacuuuaagucauucucuuuuagaaccuaucuguuacagcaaagaguaugcuuuuuaauucagugugacugugcuaggucuccaagaccguggcagguccguggugcccuagaaaggcuuacagggcacagcacagagcugcgcuuauuguaacagugggcuuagugacgucuucgggccuaugguaggcacuggguuggugggaaggccacuuggguggcaggggaguaugguuggaucucucuuuaauuauuacuugggauggguucuuguuauguaguccagacuaacuuggaucuuacuaugugguauagacuggcuuugaacuugagauccucauuccucagcuuccugaauguugggaggacaagggaaugaguggaugccaaaacgcuuggcugcuuuuuccuucccuuccccuucccuuccccuuucccucccucccuuccagaucagguuuuacuauguugcccuggcuggccuggaaccucaggcuggcuuggaacgaucuaccugccuggccuuuugagagcaaggauucagggcgugcaccaccauacgcagcagcucccuuuucuauuggguucauucugacugugauuuaacuccuuagacgugggaaacacgcuacaugcuucuacuguggcucucugugaccugcuugaucccuuuugauuuuucacgccuugaugggaaccugucuacucaaacuggagaaacacgaguacccaccauggaccgaauucugcaaauagcagagguaacgaugggcacacaaaccuuuuucaguuaguugugcacuugucuugagaugagaguuuaguuauauuuguuucacugacauuuccgcuuucagugauaccccagcuuugaaacugugauguuauguagaggucagauggauugcuuuagcaaaucucauuucuuuacagauaauacaaauguuuguuaaacauaaugguaauauguaagggguuugggggcaagagaugguuagagaaacuauucauuuuacauuuaauuuugaauauuguguaaauaauacauaauuguaggaaaucuagaaagugaagauaaaaaugcuaaauugaaaccugucaaauucuugcagucuuacuugguggucagugacaaggcgcgagaugcagcugcuguccuuguguccaaguaaguuuuguuggcugugcaggacuguugacugagaugugacugcccauuauaagccuguuuguuuuacauacugguguguguguguauguguguguguguguguguguguguagaucucucccaucuguggcugagcccuccauugacacuucuuugcacuuugaucaguagugaguuucuauauuaacuacugugcauugcauagagaccucucugaugaggucuaagaacugugcgaucuauggguagagaugugaaucuagaggacaggcugguaguccaguuagcagggucgucccugggcccugugagcucccuagccaugaguucuugaccagguuuccaguauuaggcauguuuccucuuguggaucaguccuuaaaucccacucagaaagcaguugguucuaccuguaauucaagucacuauuguaccuaugugcauagcauggucaguguuguaguucacaggguucaagacugcaugagauuguugauggugcucccaccaauccccagcaaccuacacaguaacuucuagugcuguagaagcuggcccucaugaaggguugguagauuuuuaccuccucagccauuuuaccagccuuauugucuacccuguauuugcuguuugauuuugucacauacuaguggugacagauguaugccaaacuuuacuccauagaaugccuacaggccacggaagguaaaacucaacaucuuuguucaauucuuaggauccuacagaaaaagccauaaccuggagcaccacagagccucagugccauuuuguguugaggugcacagaauaaguguuucacuugguguagccuggaggggcuauugccagacuuguagacugcaggagcagugcagucacuggccugagcuugugugaugugagcgagugaguacccaggguguuugaguaggcagacguggucacugaaaauggcuccagaggugcucaguguacuugguucggagucaccuguauuccaucgccaucuuuuuggugggguaaagaguggccuaucugcaguggcuggcuguuccucguggaaacgcugucugccucacuacacuaauugcuggcagcgucuugugcucuucucugccugugguucuggaaccacaugcacuuccuuuaucagcuguaacuuuaaguuccugagacaguuuugcucauuagcugagguuuguuucaaacauguguacaauccucuugccucagucucccgguugcuggaauuacaagugugagcuuccauaccacacuuuuccuauaacuuuuuguuuuuccuaauuauuuaacuuuaaauuuuuauuuuuacuuuuauuuuaaaauuauuaaucauuaaaaauuauuuaauacuauuuggaaauuccauacaagaacacaauguauuuauuuagaugauaucuacuaugaccacauuuccaccgucagcuucucugggaaacgcuccacugcccaaucaauucccuucccaacuucaucuguuuguuuguucuuuuguuuguuuuugucccccaccuuccgaguccaguuaguguggccugugucuggagcaugagugaccugccugggccacgcugcugagagcacuaacaccuucaucuccaucaacugugcaaggguccuuggcuaagggugggaccacgugagcccccuucuccucagugcuccaguguuuacugguguuuguuagguuuuuggcugacgagcacaugagugcauagccuugucguguccagaggacuuuuuuauuuuuuauuuuuuauuuuugagacaagauuucucuguguagcccuggcugucuugaaacucuguagaccagacuggccuugaauucagagaccugccugcuucugccucuagcacuggguuuauuaguuauaggugacugucaccugggaaaugcaucucacagaugcuguugaugcuaacggagaacagacagcuccaagagucccacaaguguaaggauaagcagucauguuacagagaguaaguguaugguaguuaaaagagaaacaggggaagcagaagcaauuguuuuuuauuuuuuauuuauuuauuuuauuuauuuuucaagacaggguuucucuguguagccuugccuguccuggaacucacucuguagaccaggcuggccucgaacucagaaauccaccugccucugccucccaagugcugggauuaaaggcgugcgccaccaccgcccagccuauuuuuuauuuuuuauuuuucuaugauuugaaugugaaaugucucccucauguugaugucuugaaugcuuguucccaggcugauaauuaaaggugugcaccaccacugcccggcaguuugcauucuuuccagaccucuggcucuuuggauuuuucugucccaacuucugugauguuugcugaacauuucagggaguuggagugggugugcuacagacccccauggcaggcugagcacuccauagucauuuguucccucugaccaguugugagccucuaauaacugccacccuuuguguaaagaccuucucugauaagggugagagucacacuggucuguggguauaaggauaaguauuuguaaggcaauuugauuucuguguuccuuuggcaaaauuacuaguagggccuaugaucucccuagcaugguuuacugaauaguagucacuacuagauaugaaucccuucuuguggauugggccuuaaauucauuuagaaagcugugauucaugccacuguuguaccaaugggucuaucuugccaggccagucaugauuguagaagcuuccaggucaauacgguuugcuuucuguauguccugugauuaaagugugugcugucuuuagcaauagaguuuuauuauccagcucugguaaguaucuaagagcagugacaagagccuguauuguuugguggaggucucugggacccacuccuuauagcucuuagugucauuacauuguuacaaagugauuuagauugaacauauggggaaauauaggaauuuuguuauagaaagauaaggaagccaggcauaugaugacucaugaaucuaauccuagcgcccagaaggcagaggcagagaaaucucugugaguucaaggccagccugauugauauagugaguuaugggcuaaccagagcuacacuguuaaacucugucuugaauaacagacaaccaaccacaacagaaaggaagaugaggauagagcuugacucuugaaauuuuuuucauaaguugucuuucucucucucucuuucuuucucucucucuuucuuucucucucucucucucucucucucucucucucucucucucucucucucugugugugugugugugugugugugucuuuugucuuuugucugucugugcaccauauucaugaagugcccuuguaggcccagaagaggccgcuggaccccuugggacuggaguuacaaaugguuguuagcuaccaugugggugcauggguccucuggaagaacagccagcaugcuuaaucauugagccaauuccuagcuuugcucuugauggcaucagcuugaaauaguagcuucuguguucugccuauguacacugggcaugguggcaugccccuguaguguccgugcuugaagguaaagcagaccaaucacaugagcuuuggagaccacuguugacauauacacauaaugaugcccucucuaaagagaaaaacagacgaaaguaaaagauaaagcacgggguauuucaugaagaaaaaaaauuuggaacagaaaguuggaagcauccucuguaugaauucuagugacacauacuguguuucugacuuucucagugcuauuaacacaugcaacagucucacaagguaagaaagaaagcauuccacuuuucuguucauuuuguaaccacuggcugacuuuguguaagccgugugucagaccugugguugucugugucaucuaugugauuacaagagcaugaugauagccaguuuuuugaucucaauuguuuucuguggguaaaacccuaagagguggagauccugggcuccagggcucuacugugcagugccucuguugggcccuagggguggcagacagccuggaaaauacccugcuuugagcuggaccaaguauauguucuucauuuaaaauacuuaauugguaucuguauuaguuacauuugcauugcugugaccaaaauacuugacaagaaaacucauugcagagaauccugaguagcucaauucauugugauggaaacauucauugggaagguugugucuauguggugagagcauccugaacuagaguccagguuauaacuucaaggucugcuccucuguccugagcggccuguuucugucggcuaggccucuuaagugcucuagagcagcuuucccugggagugccaucagcuugggaacaagcauucggaaugucagcaugaaggagacguuucagauucaaagcauaaacacaaccgcuucugcuucccaaugcucucuugucuugacuaccauauguucucuguaacaugacugugaucuccacuugugggauucuuggagcugucuguucuccauuagugccugugggaugcauuucucaggugauuuuuuuggccuuuuauucuuuggacuaacguguucuccucuacuuccauuucccccuaccccguccuuucuuccuccagucuuuggaaucuuuccuuuccccacuguuuuuguuucuuguuccuucagggucuucuucuguagcucaggcuggaccugaacuuucuagguuguucagccugguguuaaacucauaauccugguccaucuccucugcuccgggauguauaggugugagccaccgugcucagcugaacuuucucucucucucucucucucucucucucucucucucucucucucucucucucuucuuuccucccuccuucccuccuuucuuucuuucuuucuuucuuucuuucuuucuuucuuucuuucuuucuuccuuccuuccuuccuuccuuccuuccuuccuuccuuccuuucuuccuuucuuccuuucuaagauuuguuuaguuuaauuuuauguuuugccugaaugugugucuguacacccuaagugugcauaauggccauggaggccagaaggaggauuagauccucuggagugguugugagcugcccccaugggugcugggacuugaaccucaggcccucuggaagagcagucacuguucuuaaccaccaagccauuucuccguucuaaacuaaaguuuuuaacucuauuuuuaauuauuuuauguuuccuuuuuaauuucccccuauauuaaacauagauuauuuuaucauacaauauauccugguuacaaguuucccuuccugcuaaucuuucccucuuaaucuucccaguuccugcccauccagauccacucccuuucugucucuaagagauaauaacaaaauauaauaaaacaaaaaagcaguaagauagaacaaaacccaacucaucaacguuggaacaaggaaaaccaacagaaggagaagagcuccaagagaaggcacucuccaagcagacacccaugggcuuagcuguuaaaggcuaggcucucaaccaaaauaaguucacuuccuaacacccauggcugucucuucagccacaaaacaaaaaaaagugaccccaccccccaaagacccagagacccauuuguucauacacucaggagucccauaaagcacgagguagaaagccguaguguaugugcagaggaccuggugcagguucugucucugugaguucaugugaacuuugaucagcucagucggaggagccaggagaacaaggagcucagucagaggaguucuccuggcuccuccagcccuccgucuuauacucuugcuaccuccucuuccuguugcgggaaauauuaaaaggaauggcaaguuccugcacuacgguggugcaggacucagguauucucaucucaacagacucucuggccugggacuccugacuugauaauuuccuuggcaggucuuugccaugccagccccauguaaugacugcccaccucgcaguuagauaucacaauacccaguaaccccuuaaaaucguaacucuugaagcuuauaauuaaccaaucagauuuauauaacaauaaauucucaguucgcaagauucccacauaauaauuucagagccaauugauaaugguacaagcugcccaccuagauuagacaaguuaccccaauuauucugcaccuauaugauauuauaucuaccuguggcuauuuaaaacuaugcuaagucugaaucauccuggucucccuccauauugcuuccuuucugcuccagucuccucucugucucugcagcucuuagcucuacccucuuuccccguccaaucauaaaccuccugcugcacuaguauuuaaauuaauuggacagggaaaauccugccacaucuuccucaggguucugugaggggagagauuuaaugaacauaucccauuuggagcuguguguuccaaauuucugcauaauaucuggcuaugugucucuguucucacucugcuauaagaggaagcuucucugaugauggccgaguaaggcacugacuaaugaguauagcagaauaucauugggucauuuuauugauuuuuuucucucucucucuuuuuuuuuaagaccaguaguauuugguuuuacuauaggucccugagcuauuuagucgcuggcucuuggucaccaaagcaaugucagguauggguucuaucucguggaaccuuaaaugggacuuggucauguccacaagcuuugugucaccauugcuuuguccguuggucacacccacaagcuuugugucccauugcuccagcauaccuugcagaugggacagauuguguugggguugguguuuauguuuuuccuuugguagccuacaaaguacuuuugcauaccauagacacagaaugacggggugaagguuaauguaggcaucagagcaaccucuccauguucagugauuguguguguguugucuucagcaguggggccuggccgucaguuuguggagagcaaccuauugccuuggcaacauucuggguucggugauuucugugggagcccuuuggccaacagaacaauugguuacagcaguaacccagucuuggugccggaagcuuuguuugaugacgagagauggccaguugggacucuguuucccucauuaauuggagacuucguuuggagugcuuucauguauuguaggagauugccauugcacuagguuuccacacucccucucagcugccucuugauucugccucuuccucccucaacccugucucuccucccaccugaucaucccauucccauccucucucucccugcccccagucuaccuguauaaucuauuuccucuuccuagagacguccauguaucccuuccuagucccuucuguacacaucuucccagaaucuacagauuguaguuuaguuaucacuuauugaauagcuaauauccacuuauaagugaauacauaccauguuuauuuuucugggucugggguaccucauuuagaauguuuuuuuuuuuuuguucacggucuauccauuugccugcaaauuucaugauauuuuauuucuaacagcugaguaauauuucauuguauaaguguaccacauuugcuuuaucuauucuucuguuuucuuacugcuccggcuaagaguucagcuacuuuauugaacagguuuggaguggacagccuugucuuguuccugauuuuagcgggauugcuuugaguuacucuucgcuuagguugauguugggcuugcugugaacugccuuuauuauguuuagguaugucccuuguuucgagaaucucucugggucuuuuaucauaaagggguauggguuuugucaaaggccuuuucugcauauaaugagagaugaucaugugguuuuccccuccuuucgguguguuuauaugguaggugauacuuacugauguucauauauugagcucucccugcgucucugagacacagccuauuugaucacgguggaugauauuuuuaaugugcucuaggauuugguuugaaguuuuuauugaauguaguuucuauuuuuuuuuaaagauuuauuuauuuauuuauuuauuuauuuaaaguacacuguagcuguccucagacacuccagaagagggagucagaucucguuauggaugguugugagccaccacgugguugcugggauuugaacuccugaccuucggaagagcagucgggugcucuuacccacugagccaucucaccagccccuguaguuucuauuuuguggaauaauuugaggcauauugguauuaacucuucuuuacaagucuugucuaauucugugcuaaaaccaucuagcccugggcuuuuucugguuaggagacuuuuuuccccccacuucuguuuucaugacaggauuucucuguguagcccuggcuguccuggaacucacucuguagaccaggcuggccuuaaacucaagagauccaccugcuucugucucccaagugcuggcuuuaaaggugugcgccaccacugcucagcuugguugggagauuuuuaaugacugcuucuacuucacuagggauuauaagucuguuuaaguuguucaucugaucuugauuuaacuuugcuaagugguaugcauggaggaaugaguccagggauggcagcccucugcuccugggagcugacagcagggaacuggacagagggaaguucuuuauauaggauuucuuaggggggggggcggagcuuuuucagggcagggauuuccagagugaugauugguggaauuuuaaguccugagcuuggggaccucagggauugguggguuuccugcucaggaauuggugacuuuuuucacccccuuuuccuguguugggccuuuggguuagggugggaaguccuucucgcuuguagccagcuuuugcugaggcaccauuucuguagggcugcuggggggagacuagagagaaggugcugccacuguugacagcuccuaugggacagcuccuguggggacgcuccugugggggcagcgccuguggggacgcuccugugggacagcuccuguggggacgcuccugugggacagcuccucuggagcagcuccugugguguuucaccaaggcuguaggaugaggcaggaaaagaaggcguugccaccauggacagcucuugaagggcagcucaugcugaggugggaaagguggugugccaucguguacagcuccugugauggcugcaggcugaggagauguggugguguagccauuuugacagagcugucaugucagcuccugcugaggcaucuuacagugacaggaagaaggacgggcuucugcuaccugucccacauggaacaucaagauauguucuuagugacagaaggugagaugcucaacagcacaguaucauucagaaugcagcacacaaggccccgaaguccaugggcuucuuucuucccuagcaaugcaucuaugcaucuaucgucugguucuuugugguuucucuauguagcccuggcuggccugugaccaggaugaccucagacaguucuucuccuaguuuccccaauucuagcaucuguaaacuguaacaccugaccuagacugucugcuuagcucagguucuccugacucagcugucaccaacugucuucucacucugcuagcccccuucucucagccucagcuggcuuuuuccuguucucagaaauccaagagcucaccaacacugaaggucauagggucaagcaguucuaacagcuaagaauucuuaaagggccaguugacuagcaguuggugauccuuuaaagggccagguucacaagaucucugucugucugucugucugaacucccaccuccuauuuccugccucagcuccauuagccauaggcuucuuuauuggcaaaugaaugcuuuuacaacacaagaaauuuucucuacagccacccucgcuaugaugauaauggacuaaaccucugaaacugcaagcuagcccuaauuaaauguuuuccuuuauaagaauugcugugguuaugguaucuugucacagcaauaaaacccuaccugagacaaucugauagguguggccacugggggugggguuccagguaaaauguguuuguggguauugggaacuggcacuuaggcuaggggucugaagggguccccaagagggaggaucugcuuaucuugucuccuuggaaugggguagguaaugaagaaaggucacccgaggaggucuacaacagagcuggggaugagagggagguugaaucaggaggaacagguggagagggacgaucuacagacagccuaccugguucccugguuggagugcucuguggguuauagcaggggugccuguugguguugggggcuuggauaaagcaaugauuuggggaacacgggguaagauccaugggguucacaggagauggggggagggggcagggaaggcugcagcagguguucuguugcagagcugggggugagccugggggauugggucuggaggaauagagggagaaguuaaaaccuauaguacaguuuuuaacuuuaaugucaaacaucuuuuuuuuuuaaacugguuauuuuuacuguugaagcuaauuuuaacuuaagagauuuaacaaguagucauuuauguucuuuuauuuuugucauuguuguaacacagaauuaauuucaccucaaauuucuuuugguauagggcagagguucucaagcuguggguugugaccccuguggggauuguacaacuccuucauagggguugaauagcaaauaucccaaaugucagauauuaacauuguaauuuauaacaguagcaaaauuacaguuaugaaauaacaaagaaaauaauuuuaugguugggucaccacaacaugaggacuguauucaagguucaaggcuucaggaagguagagaaccacugguauagaguuugcaucaggaaggguuucuccuccaauagcuagcuaccaguucuagaauaauuuuguagauauuucauauuuccgcugaucuuuauuaguuuguauuaguuugaaguauacaugauuuuugccuaguggggauuguauuucccguuugcugcuucacucugaggccgugucccaggcagugcaaccaccaggguuccuaguguagcuggcuggggaucccuuagcucuucuuagguagaauucacagguaggcaaugaaaaaccucacgacuggucuugguaucuuuugacuaccuuagcaugugguagcaucaaacugcaggauuaaacaggcagaagcagcaagaggugguguccucuugugcaagcuucugauaacagugccauuaguucuacagguguuacaguuccugagaaagccagagguaggagacccuuaguuuuaugaguaucggcgcauccucauuccuuggcagcagcuggugugcagguguggguauugggauuccuaagagcuuaguaauguucagugcuaaagcuuucuggccuggguagcuugagacucuaggacugaagcugugaugguucucaggaacacuagaaccuguaguuuuucauuucugucucuaaauagccucugucugggagucucaguuucccgcucuugucuucucucuucuuuugcugccauucuugcaccagccgugugcauggccuguuccgcugccuguuauugugugauggcacaguuaguucaaaggcaccguccuuuguagaucuagugccuguugcuggaacguaagucgccagucuuacggcucuaccucuuucauaguugacaguaaaucuggaugcccugcugcuuuuuacagcuuggccuaccgauggcuccguguugcuuuuucuuuagcugucaaauugguaggucauaguaaagcaagugugcuuacguuuuucuaguguugcuaugggaauaaaucugugcauaugaggccuggcagcaugaagguagaugcagauacuagacuguguaggugcugccuagggaaaggauuuggucagcucccacuggagugaacaggugacacugaggucaggcaagaauuggaccauguuguauggaaauagggcuggagagauggcucagcggguaagagcacugacugcucuuccaaagguccugaguucaauucccagcaaccacauuauggcucacagccauuuguaaugggaucugauacccucuucuggugugucugaagacagcuacaguauacucauacaguaaauaaauaaaugaaugaaugaaugaaugaaugaaugaauaaauaaauaaauaaauaaaaaggaaauaggggauuuaaacccuugagcaugucuuaugaggugugacccacaggaguugagucuuuaacucauaggauggcgaagggcgccagcuguccacaugugcuuggcuguacauauucugggaggggcuggagcaucguaugcuaguaccaaccaguaugugcugagaggguuuguuugugcagagaguggauguagcucuaacugccuucuggacgacuagguuuagguuccaguguagauggucagggcacuagagggcgaguggaugucagaaucccagugcugacucuccugugccuggugcuucguaugacucccuaauggguauugcauguggaauacccuaaagugaaccccucuguucccaggacucauagccucccuucugggcauacaguucuacuacucagaaggaacuaccuucuggcuaccugcuggcacagccuuguccaugcuccuacaugagacuagccaggacagucauaaaccugcuacuugccugcuuggguccuuugguuccuggucccuguacuuaucccugcacauuuccugucagcuccccccucccccuccccgacacagaucuuucccacuggcugugcugugucucuucuuguucagcuucuccugggcaaggccccuugagauuguccuugagcugccuuuggggacgcagcaccuucccuuccucccuuccuucuccuuucccccucuuuuccuccuucuuccccuuacucuucuuccccucuccuucccuuccuuuguguguuuccucccuuauaggaucugucuagagucacugagucagaggucuggguucacauugucagccagauguuggguggaaggaaacaggcuugugcaacaugagguugugguagaggaagguccuugggucgggguugguuguuggauuagguuguggaggauauaucuugagauuaagggagauacuuggaaggagucagagcugagaagcauguagauguucccuggcugugguggguuaacgaugcccaucuauuuguaaagcuggugguuaguuggggcccaggagggaaggagguaggguggugaggccucugaguaacuuuuugagagauccugaugggcaaucagcugcugggccaugguggucagggauuugguuucugagagagagagagagagagagagagagagagagagagagagagagagagagagagagagagagagagagagagagagaugcaggcaucugaccuaaccuguucagggaucuaagaugacugggaggaaauguguguggugugugguguguggugggaugugggugagcuuucagcauuggagucuuacugagcaucuccuguguguuugcguuccccuguagauuuaucacacgucccgaugucaagcagagaaagauggccagcuuucuggacuggagccuuugcaccuuggcccacucuuccuuccagaccaucgagggugucauuaccauggaugggaugcugcaggcccuggugagcccugccccgggacagcauguggagcuccagcacugugcccaaacuguugguuccauucacucuguguuugaauuacgggaaccugguaggauuaauuugcauuacaggguugugguuucauuuuccacugcugugugcuuaguguguaaggcuggacuggagugguggcuuccaggagaaagcugaagaacugugcuucaccacuagagggcagcggcgccugcagaacugcagccuuuaguuuuuuugucguaaagcagugaaaccagcccaagugaaagaaggcagagggcuugaaaccuguuugcuuacguggguuacaaaauuucuaguucccgaguuuaaauacagacacuggggcccgucuggagaugcccacugugcccauccuuccuauugcuggucuucucugcuugucuguuguauggcuuuuuaguacugacaaggagaaccacucuggugugaaaucucagaggacauggcccuauuaacaaggcuaggaagcuccuggaccaguauuccggaggucacagauggacccccuaaggcuuuguuugguuuugauggucagcauuaagaaggucauggugccucuccaagucugucucuaggguuaauguuuacaagguuacagagacucucugaggccaugguauuaagagucaguauuuuggacgaaggcauggauagcuguauaaggcccugguuucuaggguuuggcauucuggagggugcagauagccuucugaaacugugcggcuccagggucagaaaccucuuccuuguuuuucuuugauuacacuggaugcgauuugacaguaguucuuguccuugucuugaaggcaaagggagcugacaugucacuuagaaguaggauccuuuggagaagucugaaggcaaccagucauacugaguuuggcuuuuuguacuacuccuuaauacagguccugaugcagggugggagguaucagggcaggugccaacagcccugggaaggggacaugcaaccugggacgggaaggcaagucgaggcucucuggaccuacuccaugugccucugcagcugaauguguauccugguuguggggaugagaaacggcuggugucucuuuauuuucagugauauugccauugccuuucagaggccugccauucaaaacaugcaagagggaggccugggaaaauaaaauguuucuuaagaccugagcuucugcucugcugcucucucugaagacuuggcggcuccagaugggcguuaguucauuuuguuaggucuacagaguuguauagccaccguugucucuucucaguaugccauuccgcauacacacugcaucauacuccacaggccaguggcacugagcucaccugucugggaggugacuuuuauguaggauaggcucuuuucccugagcacagcgucuguagggucugcccacccuguggcaggcacgcgucaguucuucacuacuuuuucgcaggccgaaacuguuucauuaugugacuguuuuugacuguugugauuaaugcuacuggggaacauaaaauagguuuuuaaaaauuuauaauuauuuuggguauguaucaguagguguuucucuauuuguguauaguaauagauuguuuuccucagcacauagaacaacccccccccuuuucuuuuugguagugcuggggugucaagccaagacccuuaaacaugacaggcaaguacugaacuaucuauccuuacccagccccugagaguuguuuuuuuucccuuuguuuaacuauaguauuuuguuuuugaaguucuuuuuguuuuuguuuuguuuuuuuaauuauaguuguggggcccaagagauggcucacuugcugcuuuuccagaggacccuaguucaguuccccgcacccaaguuaggagguacauacagaacacccuguaacuaguucugggcgaucuggaugucaucuuucggcuucugagagcacuuacacacacaugugcguauacacccagaugcacauacauauauccauaaauagaaauaaaaaaguaaaauagauaaauaaaauaaaaauuagaaauaaagaaaaauuaugguugcccccacuuaucaguugugguacgcacaugagcacauacacaaacuaaguuauugaugagaugugagguucugccuaugguagauaucuuugggguuugcagauucagcuguacagcccauaccuugggaggccuuuguucuagcuguggggagaggcaacuacagagguuuuauugugauuuccauuuugauuguagcaguagagguuagugcaaguuguggcuuacccugaaagguagugugaggaaggaagaggaaagaguggggcagaggucacaguugauuuauaaaucgugguagguguuguacauuuguguuuuagguaauucugaugaauagguagauagaaauaguuuauuugaaagauuuggguguaaguagguucuuaauauuuuuggcaugaaucuuuaaaauuuuuuuuuucuuuuuauauuugcuuauugccuguguggagaccaaaaugcucuuaauuguugagccaucuuuugagcccagcagcagcaacaacaauaaagaguucgaaacaacuuauugaacguuuucugugucccucauucgguuccagggauugaacucagucuaaacuugaccaacugaucuaucucugccucccugcccgaccugcugucuucucuccacccauccaucccacacccacccaguucccacuccauuuguuuguuuguuuguuugagacaggguuucucuauguagcugugacuguccuagaacucuuguagaccaggcugggcuugaacucagagcucuauccaccuguaccuccagagggcuugaauuaaagguuugugucacaauaccuggcuuucuaccuacuuacugugcagccuugguuuaccugggacuuguagcccaggauggccuugaacuuguguuaauauuccugcuucuuccuccugagugcuggaucucaggugugagccaacacccccggcuuggccugagucuuguugaaaguuuucacaucaagagaauacaggaaggucugacaaaccguagcuagagucuguuacugcaugguggugcuugagggaaggguguuagaccugucuagcguguauaugggacacaugggaggacaggcacaauuaaucucaggggauugauuuuagauggcuuuuguucggcuguuugcauucuuucuuggguuagggacugugagagggaucuugcuuuauagcucaggcuagcuucuguuagcaaggguuaugggugugucccacuggaccuagcucagucugcaguuuugagcuaccugccagccuggcccaggaguuuuucugcucuacacuucuuccugcccauggcaauagagauuguggcuggcaggguagacaggcuuccugcuuaggugaagcaggcuccugugggagguggugauaacuugugggccuuaacugagguccuggccaacgugccuggagcauuccgcagugacugcuuucugucucguuuuacauucuuugccuuuuuguucuuuuugaucaccugagucucuguguaguucccaagauuucuguuucuucuuacuuaggaggugcauggggcauagguugugcucagacacuguagggcaguugcuguuccauuccuugccaguuuugccaguggguugagauuccuuuuagugacuuaaaccagccagacaugugugccuuuuauuuggacaucuuuaaauuccaguguugaggagagaaauucucuuuuugcuuccuccugagguguaaaaaggguucccagaggcuuagaaaguugagucuccuacacuccucccuccccccccacccccccccagcuggguguguuggcaagggaggggaagaugagacccagcucucugccguuggggcagaguacuuuggugguuuggcaacagcaccucugcucuaucuagagagacuugccccgaggauggugagcacuugucugacgcagacaacugaaauccugggaaguggcugaaugaaacugcuguagaccaacagcuacgguggucucaucuccuagggcucgaggugccuggcuugccaccgcccuucccccaccccucaagccuccgcucuggggcagcguugucuccucagucucccucuuggcuucuuuuucucucuuagagggucacuugggucugaucuggcuccagggcaggaggaaguuacgcucaguggguggagcaguuucaccaugggcuugucagaccugaaggcagagggcuggugucuugugcgugaugaaacuugcagguguauugugcuucaggauugcauguuuccuuugaugcacuuggcuucauuuuuauccaccuguucauuaguguggguuaggcgaaacaggugaacucugaacaagucacaucgaaacuaggauugauuuuauuucccucgaagcauagcccucucgcggcauugauucuuaacucuugugggaaggaaacaaguguuuggcaacuucguuucucuggaaggccccuuugcucaugaguguuaguauuaaugcaaauggaggaaauuugagggcagaaaacauauuuuaaaauaaaacauugucucuuaaauguauuuuaccuuuucuuauugguugaugguuguguggucaugguuuuccuucagauuagaagcuucugaccauggcggcuucucuggguuuccuucagugguuaugauggugagggaacuuuugguuccaaagacaggcugcugguagggaagguacugccuguguugauugguggcaggggauauucuuuuguuuacuaccagcugacauagcaucuccucuucacaguuaggugggguuuuuuguuuguuuguuuguuuguuuguuuuuaauuuuuccuauuuuuaacauuucaaaauuugccaggcaugguggcgcacgccuuuaaucccagcacuugggaagcagaggcaggcggaucucugaguucgaggccagccuggucuacauggagaguuccaggauagccugggcuacauagagaaacugcccccaaaccauaaacaaacaaaauucaaaauccagacuuuauuuuaucuauuguugacuaaagguagaauucuuacugaacuuauaguuuggggguauagcucaguaccagagaccacuucuguagcauucuuguagcccuggguuaccuagcacggagagaaacaaaaagccacaaaguugcagcaaaacccagaaaccucacaggcaacaguauuaacacugaagagagagagcuaagguaccaggauccacaggcccaucccaggggcugcauggcaaucugacccacgaggcauguguuggagcgucucucuuccuugcgugugguuuaaaggauaggggucgggugccuggguacaagugacuguugacuagauuaccuguauggguaagcacgaggaaccaguauccuagacuuggcucugucugggccuucagcugccugaccagacuguccuggccuuggccucugaauaggcuuuagcuauacuuggauuucaucucuccugguggcccgaggcauaggugugguaccuugcucuaucuggaagagaagugacaaaccucucuugccucagaguguguggagacuagcuaaucagcccuggucaugcucuucagcuuagccugucauggucuuguggacuuuggccucuuuguuugugggcuucuguggagccugguuucuagagaagcccuggcucagcauccuagggcagaaugucugggggcuugugccuuagugcucagggcaacuuugcuuuucacuuuacuuguuuauauauauuuucggguauagugugauguguguaccagagcauucauguggggacagcuugcagaaguaacucucaccuuucaccguaugauugaaugcaggcuuggcagcagcaagcgccucuccccagagccaucuuucuaucccgaagaggaagguuuuggguggagaaagcgcgugacggauaggauggagaugaggcacugucuauagagagugcugucuccauagacucaggguuccugugccaggcauugaguaggcucugaguaggcucuggcuguuuguaguuucacgcagcucagcacuuuaccuaggugagcccuguaggaacgcguauguacaugugcauggccucauccuccccgucccugcccaccugcgcgugugagcugcguuaguaauggagacccaggaggccaguggggagcccccuccaccuuuagccuggcucguggcuuuugcugcgggccauuugaacaccucacgcuccaccuccuccuccucucaccuggcccacgggcaggugcugauaccuggcugcccugauacuuuccuuggccuuccuucucacaugcuucccucaggccuuggcuguugacaucucaucucugauuugcccuugaucuuuguuuccugcucucuguccuuguucuagagcccucauucugugggccguggguacacuugugacaccugaagucacaaccuuaaccucauuccuguuguccuacagcuuguccuccuuagccuugugacuguagaagccugacagagauagaggcagagagagacacagagacguguguguguguaugcgugugugugugugugugugugugugagagagagagagagagagagagagagggaaauagacauagacagagaggcagagagauggagacagagacugcauaugugagagacacagagacaauguguguguauguguguaagagagagacagagacagacagagacagagagacugcauaugugagagaaacacagagacagugugugugugugggugugugugugugugugugagagagagacagacagacacagagacagacagacacagagagaagcagacagacugagacuucgagccugaggcugucucugcugguauccuccaugccugcuaguuguuugguucucacaucuccuugucuuacccagagcuucagcuggcuuuccagcgaucccuccaugauaccuuuuucccauuccacaagucuucacccuguagugugguuccuuagucuuuuugcccucacucacgcacaucugcugugcuuggucuucaucuucuucugaagggugacaggucauccuucucugaaguaccuccguggagaccuuccuaucguccucgucuguuugguuccuuguaguugugcgcuguuccauggucaagagggaacaaggauugagaagcaucagaggggagacccgccaagggcaguuggggcgucuuccugcccucugagccccgaggauggcaguguguaauuaguaggccacguuuuccaagcugggcaucuggcacugucuuuaugcuuguacgugggcuaggaaacugaacugaugaagcuuugaacaucuguguggcuggugaccaaugucuggucauuggagaaucuggccagcgggguggccaccuauaccuccuauaggcaguggguuggucagcccucuguggcugagucauucuaucacugugggacaacaaaaugccuguaucggcucccugaaauaguccccacucuguuuuucaaaauauuugggcaguugacauuuuguucuaacaguucguucuuuucacugauccuguaaacucugugguuuaugugugcggaucagcuaaccuuaagauuaggucauucugcuaugucuucugcccugccaggagacaccucagucccaaucccuuccugcugguuuguguuaugaccaagggucuggaaccugugcguucugucaaguauccugagucacuggaagaccuuugcacuacacacacacagacacacacacacacacacacacacacacacacacacacacaccccauaggguucuugugcaauccaggcuuguuuuguacuaacccaucuuccuaucuucagugcuggggugauggcauuauagacagguaccacagugcccuucuugcucugucucacguuucucagccagagcuccugaguuggcuuuaugggcacuguguguuccacugccccugcuuccacguugguccugugcugaagacaugguguuugggacggccucaaccuuuuccuggccuguguuuccguuugucucccucacuucccucacuucaccuggggcagugcugaccuugacuguauuggggaguuugagguuuugucucugacuucagguuccucagccauacugggcguuccuccaugggcugagguauuuggcucuguaugcauggcuccuguuguugggauacccucaauccugggcucucaguaggaggaguguuaccauaccuuuuuacauuuaccaguugaucgagauaugguuaucuuuacuuaagaagcacaagaaauugaaauaaguagucauaauacaaacuugaggggcuggaguuaucugccuucaacaucuauccuuuucccuauugucuuugcuauuggugaguuuucucuuuacaucaugaaggcugcagugagugaauguguuuuugauguuaggaaggaucgacucucuugagcuggcugugcugguacaugcuugcccucaaagguaggaggaacuugaguuugagggcuguauagggagauccuguuucauauaaaugaaaacaaaccugaacuugguuuuuuagguuuccaguguaagaaaugcuucaguuaacggugggugucauuucuuucuuuguguagugggagagggucuugcuuuguuuuucuaguaaggaagaaaacacccucuuuccuagaaaucuugccucuggcacaugggucaaaccugaaacugcccagugggugguuuguagccugagaauuugcccugauccaagaguuuagaagugacccacagguagccaucugcggaacuauucacacuagaaguguucagugcugcuuguggucggccauagcugcucccagaacuggggcugugagggaagcauugauaacugauuucagcugucugcuauugggcaggcaaugucuggccuggaugccaucguggggcuggguccugcccuguaucuaagcacuccuuuccagugucagcuuacugcucuacuugggacaguggguuccucaggaugucucucacuauuauucuuuauaagucaguagaggugcuagaccucaguuuucuaggcucuguucucuggagagaguuucuuccccacagugcuggaggaagggcguucaggaaugagcuguuguggcugccuuugcauuggugaaggcagcaagugaagguaguuccucuguccuaggugagagccuggcuuuguuugggugcccagccuagcuagggugguugugugaguuuuggccaucuuuuccugccuggguuuugaucuccuguaugacauauuuaaaagugccuuacaauuccacuaccagugguuugcuaagccuuuuaugauggggaauuuuuuuuaguguuaagacaaagucaagggcuggagagauggcucagugguuaagaucacugacuguucuuccagagguucaauucccagcaaccacaugauggcucacaaccaucuguaaugggauccaaugcccucuucuggugugucugaagacagcuacaguguacgcauauagguaaaaucaaucaaucaaucaaucaaucaaucuuaaaaaaaaaaaaaagaaaaagacaaagucaaggagaauugucguuugccacgucccauugugagguggccuggguacaacaguguguuccugagaggccagagcaggaucuguaaccaagugcucugguaaccugccauuuuaacgcggugguuucugaguuuggucucgugcuggucagugcucccaaggcuucagacugcggagcuucuuggagccuuugcauuucagugacagccacaccugggcucuagugcagggaccuuucuccaagggccugggguggaguugcuuuucuuggcucgaaucuggcagugccuucagggagccucaaaccagcaccucuugcuuggcagcagggugaacuugcuucuguguggcucuugagccugugauuugcggggcuuggagagcaugccccagggaggggaagccagcuuggguggggagacuggaaaggugugguauaguuuaggaugauuacugggaaacucguuuuguuugcaccuugcgcugggcuaguuucuagaacaacagaaacagacgggguugcuccuccugugccgagagguguuuuucccaaacugucggugcuguaauugccuuggugcugccugugcuuucucagaaaugcagguggcuuuagguugguuccuguuucaugcguccaccgaggugggguguguguguguguguaugaaucagcgugaacguucaaguuccucugaagcugagagaugcucucacugaucagcacugggaaggggaagugcuaagaagaaagauuuuuaaaaugaauuauagaccaugcuggcaauaaacuugugguccuccacagguuguugugcuccagccuccugaguguugugaagaugccuuuuaugugaaaaaucaaaagccuauauucaucuuuuuuuccccaggggaaggguucccuuucuucauacuuuuuuccugugugcuucauggagaguugcugucuuccugauuuucucugagagugugcucagaaccuguauugccuuggaaaucaagccugaaacuccuagaaugggucagaguggacagaauuggugcuguacucaugacgauacagauugucauccgggccaugcugguuguuugguuuguggugggguggugggguuaggggacagugggacgcagacuggacauuugcaggugugggagccugcuacaugacugggugccuagugccagggcgucaucuaaccucuguguccacuuggccugucuugcacauugcucccccccauccccaccccaagauggggugcuguaguagggcaagcuacguuuaugucugaggucuuguuucucuuugggcauggucugugucucacacauggugagacugcccucauuuacccacugguuuaggaccugguuguguuuugacacuuucugaccccuaccaguaugcuccagauuucugcuucagagauguugguaguuuaaaugugugacuuauauggaaaauauaugauguuugguguguucccuaccuacccaacuuuauguucucuuuuucaaaacaaaaccaaaaacuuccauaaaaacacaaaaguggaaaccauugcaaacaacaagcaaaagaccaguaagacagggaauccccaaacaaagugggacgaaaagcucacacaaaucagccaaacccauugaguuuguuuuguguuggucaacacgaugggcgugggggccugcccuggacugcuguugaugugcccagugauaccucacggagaaacuaaguuuuucuuugucagaguaucauuugcaaauagccucuugguuagggcuggaaccacauguccacuuccccucucagcgaugggaucuuauuuggauugaaccugugcaggcccugcauguacugccacagucucugugcauucauaugugcgucagccccguggugccuggaagacacugacaucacuucuggcucuuacggucuuuccacaucuucuuccacauugauccucgagucucgagggggaggcauuugguaaagacaucccauuuaggaucaacuacuccaaagucucucugcacauuguccaguugugggccucucuguucauucccauccacugcaaggugcuauucugaugugaugagcaaggcacagaugaguguuagagcccacuguggcccuagggaacaauuccuaauuagaucuugcacagagaauguguguugguauucacaugguagggagcauuauaauccagaucugcguuuuauucucuggggaauauguuugaaaauaagggagcuguguuuuagaaaggcucaguguggugggcaccgcuaucguccauucuucauagaucgagggaagggagaugaggucugauccuaacugcuguggcagucuauccagcauauagauggagaaugaggaagcuuacguagucuucuuuauuuguguguguguuuucugggaaugaauucaggacuuugcacgugguagguaaucauuaccacuaacacauacauuuuuuuuuuuuuuuuuaagaugcuuuaaagcuggggaugguaugacugaugccuguaauuccagcauucugaagguugaggcaggagcaguguuagagauuucuggcuagccuggccaguagagugagauccugucugaaaaaaauaaaaacaaaaccaaaaauuagaaaaagacaaaaccaggcaacauuuuacuacuuaugcccugguugaaaggucgagcucucucuggugugacugaccuccucagggccggggugcugccuuccggcuuugcuccccagcuggcuagugugcugcccuugugcuggcugggucugcuucuucacacuucucugccaugcaguaaguugacuuugaucuuaugauuccccaguuggaaucuguggccuugcuuagcaacaccuuugucucuggauuccugcaagagggaccuggaacuuuuguuuuuccugucaccugcccuuacccacuuauucugccuuaccaugauguugcacacugugguugguaauguauguuuucguuuaccuuuucaguuagguggucagauagucuugaguguaacuggccuuccuuuagacccucaguaucuguuauugugaauaaggccaaggucuggcucugcucugccauccccaagugacuggagaguuuuuugccuuuaaguuuacuuccagcauuuucauuaugaucauccuguuggaucugagccguggcgugugcuugucuuucguucuuccuuagccccuagcauaggcuauggguauauuuccccucugaaacuugugcuucuccaccugagcuccugcuaugucugggcagguccuuguacaccuuuguuauaugcugucuguuuccaaaagcuagggaggcuuuuuggaguuagacuuggggauaauaguggcuucuggaggugacagucaugccaggaguugguaucccaguucaauguuuuauuuuauaauauuuuuaaccuuaguaaacuaguuuaauuagcagacuauacaaguugucacagaguguuccaaguagauauguaauaaucaguguagauaucagacuuauucuacccuaacaagucagaaaagaaacagagugucucccaacauaauguuuuuauuaauuauuuggaaauuucauauaaugcacccugaacacucuugcuucccauuccugucaggucugcauucccauccuugcacucccaccucuccaaacaaaccaaaccaccaaguccaauuuguguugcccacauacacauuggagcauggucaaacucccaguggccagccccuuagagaaaaccaggguccaccucccagaagccaucgacugugaagagcuacucgucagcauuucugucuuuucaauagcuuccugucuagacugcuucuuuuuuuguggagguggaaggagguugucacaaauccuucagugucucuccugcucaguucugagucugcugucauuuauaccacugcagaagaacccuccuuguccacagcggcuggaggcagcacacaucauggacacugacaugaucucuguugucagcacucaucaggggaaucagcguggccucuggcugcagcacggaucacagaagucuuuugaggagacuuaauccagaaaaugaaccauucccaucucucuuauuuuaaaauuauuaaauuauguguauauguguaugucuuuguuuguugucauguaucgugccuguggaggccagaaaaggaguuggauccccuggagguacaggugugagucaccugauguggcuguuggaaacuuaacccagugguuaagugaccgucccuccagcuucccuagcugccuuuuauaagggucagaaugagaaggcuuuuuuuuucuuuugaacaauuugacuuucaucagaaaaaugaucguguguucuuauuuauuguuauguuaaucugacacaucauauuaauggauuauuggauucuaagccagucuuagauucuuugcagauggggaauaagccucauuuucugguguaauuuguuguuggagucgguuuugauacccauagaugcugguuguaauuuuuuguuacaagcuuggcuauguauuggggacagucauuuggcaagcauuucucagaguuuggguacaguguuauuuuuuuuuuuucucccuuggauguuagcuaaaauucagcagugaaaucacuaguuuuucuacuaggauuugcuuggugggaggauucuaaauaacaauuccauuuuuuuccaugauacacuucuauucaguucuacucauuucuuuagaaacauuguuuauguguguguguuugccuguguaugugucuguaugugugccacaugcauggaguucccguggaggucugaagagggcaauggagccucuggaacuugaauuuuaguuggcuguaagcagccaugugggugcugagaccugaacauggguccuucgcaagagcagcaagugcucuuaacugccgagcccuccuucguccccaaagguuccuauuucuuggccuaugcuaauuucuuuugagggguuugaucuguugcccuaaaggucauaaaacuuaaaacuucuacuguccguaagucacuguucucugacauucucaugcucugauuuuggaaguuuaucucccuguacgcugcucuuuuuuuuuuuuuuuuuuuucuuugcuguuuguuuuuugagacaggguuucucuguaguccuggcuguucuggaacucucucuguagaccaggcuggccuugaauuuagagaucugccuuccucugccuccagaguucugggacuaaagaugugugcccaugguugcuccuuggauuuuguccugccuugcuuuucuagccaggguuuacuuugcagggacuauguggucccuagagccugugggggcaggguucuguggacuuaaaggauacagggcaguuuagagaugaaaggugauuaugcaugugaaguuugaccuuaguuuuuuuuaacuuaauguuuuuauugauuauuuggaaauuucacauaaugcaccccagucucauucacuucccaguccucccagguccccuaguccucccagguucccccaguccucccagguuccccaguccucccaccccuuacaacuccccaguccucccaggucccucccccagccucccaccccuuacaauuuccccuuaaacaaaguggaaaaaaagaauaccaaguccaguuugugcugcccguacacucacuggagcuuguugacugaacuuuuuaaaagugaaaaguaucuaacuucuguauuuucacccaugagcuuaugaucugagucugaacuaauugaguucacaguuugcgaaccuggacuggcuuggggcuacccagccucugucccagagggucagguuagccaccaggccaugcucuccuuucuuacccuggugccaggccagcuccgguuacaguguguaguauucugguugugguggauugugugugugugugugugugugugugugugugugagugugugagaguccucccuucugcucagcugcuucucuucccuggcagcucagugggguaggucuaaugagugggaaggugcagagccugaggacacacugaugggguccuuauggccugcccaaaccaaagcuucacuugguggcaccucucggagaccucuccagguuuauaagggagcagugaugggguucagagaauucucuuucuauaaacccaaguucacugaucauuuugggaaugacuuuccaaacuaugacauguguuuuccaaagggaggacaguguucuaguggaaguggaagagaacuacaaacaaacaaacaaacaaacaaacauacacauauuuaacuuauauauaaauauguaaccauauauauguauuuauuuguguguauaugguguguauguaugugaauaugggugaaugcuagucacagugcguguguggaugucaagaucaaauuccaggaguugagagaagcauuguuauaauugaaggaaggccaguguucuaucgaggaccaguguuuuaguaugcucgugagagagaauuaguucuagugaagaucugauaguuuuuuuggcugcugcccuccaaaugcauucauaguacuguguacagagacugcauggugugcagccaccaucacagugagggagagcuugggagggaccagaugcagugguaaaguguggcagaguguggaagucgguucugugagacccuccuccuggguggauuaagguagugggcgagaaggaaagacuuuuguggcuucucgguuuuguguggauccuuugaucugcagcucuugaugagacuucccaccccucuccaguucaguuugcacucuacagguuagggucuaagcuccucagaggucagacuccauugguguacucuugcuaugaagggaccugagagaagaucccuuuccuagacucuccucuguugugaacugaaucuuucaccuguguguugguguaugcgcagcaaaauucuggaagaagcaaugaguuuguucugauaauguguguguguguguuuuaaaguuagaaauguauuuaaaacaugcuauuuuuuuuuucaggcucaaauauuuaagcauggaaaacgugaagacugccuucccuaugguaagauuaauuuggaggagaguguuugcccagugaguuugugcguacauagucaagugugcugcucucacguuuaacucaagcauauaggaaccuguagccuuguguauuuggauacugucguaguucuuugacuuucugcuuuguguucuuuaauauaacuuugauagacuagucuaccuauaugagauacagaaaauuucugggaucuggguucugcagugcuccaggugcccugacuuaauccuggagggaccuggaaacagugagcauggcccuaggucacccaggagcccacagaagccuuguuuuccuggugcuucacuccuccacgucauccugucuccucucaccccuucauucucuuucauuccccuucuuaccucauccccuuaacccgucaccucauuuccuccccaucaucuccuuccuucugauuaccacaucccuugcagugcuucaccuuccuccccaccaccucacccuccucccacugccucuccuuccuccuccaucacuuuauauccccuucucauuacuucauucucccuuuauagcgggauuucuuggaccugccagaggaagaauaaugaauaagagaauaggucuagcuuaggcuaucaccuagcuaacucaucuaaauuaacccaacuauccuaguccaugucccaucugagaucuagcccuaugcucccauccuagguuuuuguugucuccagaaugucauuauuauucucuucugccccacuuuaauccccugaauggccuuuguagcccagggucucauccaagagauaucauuaugcuccccugggcucagucuccugucccagcauugccuccauuccagcucagugcugacggagcaguccaugaguaaagcacacuccagaagcccugugccucucaaggcuugcagcaagauggcuuccccuaugcucugggccuuuucugcuuucugcugcauggugaagacaguaaguaggcuucacuguagcucuucuuggaugauaaccuggggagaaaaggggucauguggccagggcucagagagucagugugguuuaucugccaccuaccugaggcccgugggaucguauguucagggaugcgugccaccuccugccacgccaagucucguguucuccuccacagccaacacugugcuccagugccucgacggcugcagacuccccgagagcagucauaccucgcugcggaagcuuggugugaagcuuguccagaggcuggggcugacuuuccugaagccaaagguggccacguggagguaaguuaggcauggggcuugcauuuuucucaggaggagggggcaaugcggacugaacagcaaacauuuucuuccguuuucauuuuuccuuugcugucugaguauuucugguuucaaagggagugguuuucccauuggcuauuuucuggcucaguauccucaguuagaguagcugaagacaguggagauggagaagcuugcucugccucucccuaaggugcugcucaugcaccugcaagugguugguucuggcucuugagggaaaagcuuucuguucaguugucucucagagaaaacaugguucaguguugaagguuuauucugaaacagaagugucuuuucgagccgggagugguggugcacgccuuuaaucccagcacucgggaggcagaggcaggcagauuucugaguucgaggccagccuggccuagagugaguuccaggacagucaggacuauacagagaaacccugucucgaaaacaaaaaacaaaaaagaaguaucuuuucuugcugguggacucagacucuucuaauauccucgcaguacaguuguuuuguuuuguuuuuuuguuuuuugcuuuuccuuuugagacagagccuugcuguguagcccaggguagccuuggguuuacacuccuccugccucagucuuagugcugagauuccaggcaugugccaucaugucuggaagcugcugcugcugcugcugcuguuauugcuauuacuguuauucuugugguaccguagcuuaaacccagggcuuuaugcaaguguuguacuacugagaugcauucaauuaucaauguaugugauuugggaagaauuauuuaaguuuaguuaaaauguuguccaguguguagugaacuccaaagaagugugcuaugauuuagagaugucuuacugaaguaucccucacaugcacacuucagucaaggugguucuguaggcgacauucuagugaucuguucucaaaacaucauggaaauuuuccaaagaaacgaaaccgacaggauguggacagugcagauggaagccggugaaacccaagaccuggagggugcaaggcagucuggagacucaggagacugcucuggucagaggcuggcaggugggaggggcagccuuauguuuugcccaggcuaucggcugauuggacaagacuugccuguauguguucagagguaaacucagagacguaccagaugugcucaguuaaugcucgcagguacuaggaaccuuaauuuaagaaggaaaaauaauuuagucuguauuuuuuaaucacauacaguaauguaauuauuaacagaauuagguuuugaaggcaugcugacucacacucugggaggcaggaggaaaguucaaggcuggccucaucuucaugaugaauucuaggccuacuacggcuacauaggaagacucuguugaucaaaaaaaucaauccaaaccaaaacaugacugaauuuuuguuuuguuuuguuugagacaguuccucuauguagcccuggcuauccuggaaccugcuuuguagaguaggcuagccuugaacucacaaaguuuccccugucucugccuuccaagugcugggaucaaagggaugagcauggcuggcuaaugauugaauuuuaauucacccucuuccuauuuguuuucucuuccuucccccgccccccuuucuuucccuccccucuuaagggaaugggucucauuuauguaacccagacugaccuugaauuugcuguucagaugaccuugaacuccugauucuccugccugcaucugaagugcugggaugaugggcaugcauuaccaugcccaguuccccuucuuaucucuuuuauuuuuagguucuuguuagaucuccuaggcuacuuucuacagguuuuccccauugcagguggugcaguuugguccucauaggcugugagugcugggugcauccacuuuccugucugcucuuaguuuuguuagucaguuaaucucaguucuuucucuggggugcagccgucuucuguagcacagguuuugcuucucauguggaucuucuuaagugcgagcuggagcuuuugaucuucugcuggucccacuugccaguggccccgacauccccugagcucugaguucuccaugcagcuuccccuucauuguccugggucuuuuccuguacuuucucauuguggggcuuacucaggugcgagggagaccaugugugaguucugugcucuuucuuaguagcugcugccucgcuagugacgugugugugugugugugugugugugugugugugugugugugguguguguguguguguguguguguguauguguguguguguguggugugugugguguguguaugugugugugugugugugguguguguggugugugugguguguguguguguguguguguguguauagcacuuccgguguggcugcuugcauuuuggugcuguucuuuugcagcagucuugacagugccuauggggcaguggugaagggaguucacaugacuuucuauuggggagggaagcaccuuguaucgguccucacggggcucgccgcaggguagagagccaggcagaagcuaccugccucuuuugaauucccuuuggagguaagcuuugguuacuguggcauaaugacucuuaggagcgaguugcuuggucaaggcuaguggucaaggcuuggcuccaggugguggugcaguggugaccaugagccacauuuucauuggcuauucuuuucuuguucccaggcaagugggagaucccuuuugccugggcugaggccaaaaagccaagcagguggagaaggcagccacuugcuugugaacaagggugaggcccuggugucuuucaugugcacguauagguguugccauugccuucuguuaugaagcuuugcuguagaaggcucuucagaaucagggccugcaucugaccuagguuggcuuucuuuugagguuuguaugaauugagauuuccgcuggcaucauguaugauuauucugagggaugcuaaguugaugacaucaguuaccaaaaauuuuauuuucagggccaggcugaaccuaccaacuugagaugguuuuguugugcauagguaucagcguggcugucggucuuuggcugcuaaccugaagcucugugccccggguaagagugaccagaagcugcugucugauaguuugaccucugauggugaugaagacuaugaugucccagaggggguagaaacugugauagguaaguggagccuacagcagaucugugcaugccucucucugcaguacagucugggcuuucucucuguuuacccucccuuuuuuccucuccugguuaccuucugcuaccucaccuagcauguggucagugacugacgucauggacucuugguccagcaguaccaccucuccacugucucuucaccccgcccucuagccuaucggacaccugaccuuaaguuucucucucuggguguccucagguacauggacuugaaccaugggaccaugguucucugccuccuccauauucuugucuuguccaagcaugcuuuccuugggcaucaucucagaccacuuuagguguccauacugaugaggaaucuugacccagugucuguucccagcaguccuuuacugugcccacccucagguucccucccucuuccugcuuucuugccucgugcuggaugaagugugaucccgacugggaggcacaaagccagcggccaugucucuugcugcguucaguccacucaugcuuuccccgcagacuugucuguaccugcugucuccacaaucuccuugaccacagugcuguugcuuaugugcccagugcuccccauacauuuggucuuuucuuugagccuuccugggauucucuuccuuggcugcugugugcugcaugcauccugaguggcucuaagccaccuugcauuccaugggccuaggcuuaguucucugcuccuuuucucuugucaccuacuugcuuaggccuguugcuuuacacucaagggucugcugacuugucucuucccaccccaaccguguuagcuauuuauccuugucaguucuucugggguuugcucucuggccagcguugguaccauccugggcuugcagggaugugugacucgggauaaccuucugacuaucucugugcuggucucccuaauucucauuuuucucuguggaggccuccucagauguuuguuuccuuugaccuccccuucuauuggcucacagaggccuuuaccuggggaggcaucuguucccugcugauugucguauuggguuggcuccacuuguuagaaaguggcagaaaugcccuuuucugugauuaaaaacagucauuguaaauaaauuuaaggucuaagauugaagagauagcucagcuguuuagaacccuugcugguuugguucccagcaccuauaaaauagcucacagucaucuguaacucagguuccaggggauccgaccccuauuuugacugcugcagguaccagucaugcacagguacauauacauacaugcaggcaguaugcucauacacgugggguuaacauuuaaaacacaaguaagaccucuugggaaugcaagauggcucagaggguaaagggaccaaacuugacaacucaggcuucuuuccugggauuuacaugguagcaggggagagccauuuccuagaaguuguccucuugucuccacauucaugcagucgcauacacacaucauacccauuccuccacuaaugugaaaaacaauacaauaaagacucuuauuuuaaagggucucacuguauagcucuggcuggccuggaacucucuguagaucaggcuggccucgaacucaauugaaaucugcuugccuuugccuccugagugcugggauucccaaagugccuuugaggaaguccuccugccucagcuucucaggcacugagguuacaggcauguguaaccuauggcuggcuaaaauuaagauuucuuagcacaguguauucuuuguaauccauagaauacaugauuccaaguguauuccuacauagugaaguguaggauuguugggauaguuuauauauaagcaagaggauuaagauuuuauauaggcugaugguucuuguguucugguucuugcagagcagcuacugguuggguugaaggacaaggacacuguggugcgguggucugcagcgaaaggguacguauggaccccuacaugcugagugcuagaggcaacgggcaggugugucucagucaguguugauuccuuaaaaagucuucauuccauaaaaaaacuuuacgugggguuugauaguuguaaauaccauguagaucuucaaaugauagaacuauuguuuuauauaauguccauuuaaagauaacuauuggcuggguacaugccuuuaaucccagcacuugggaggcagagguagacggauuaaugugaguucaagaccagcuggaucuauguaggaaguuccaggccagcagagcuacauggugggauccugccucaaaaaacccaaaauuaaaaaaaaaaaaauuacugagguuaaauuuuaggcuuccuaaagugguaugaggccaauuauuaguagaaguugauuaauacaaauuagauguugagguuguugaagagacucugugggagcugugaaguaaggcagugcaguuucuugcucacaguugcccuggcaucaugauguaaagcuccccagaagcugaagagagcugccacggggacuuguauuuaugccaaccaagucuguccugccgggagggauagauugacacaugcacagugagacaggccugacuucaggccucuggcuucccccugugcagagccugggcuauccuuuguggaaaugggacagucuaguuagguaggggccaagguuggagauugcagcaucuaucuagaaguacucgugggccguuaacacugaugggcucaguguccacgucacguuacugugcagaaaggugaccauguacccuguucacauguccaaggaguccccugccccguccuggacacuugguuggcaguauucgaggcuugcccuauucuggguuaauaggaaacuuacucaagguaaugugcaguugauggaguauugcuucucuuuuucagaauugguaggauggcuggaaggcuucccagagagcuggccgaugaugugguggggucuguguuggacuguuucagguggguuaucacucucaaaggcaaaccugcagcuuuguguucuucuguauuauuauauaugcuuucaauugagauauuuauuagaacccuaaagccuaauuuuuccuuguuacguuaaacuugauaauugcagugauguuguuucaacaucauuauauaucuaaaaccuuuagacagagaugaagccuuugcaaauguaggucuucaucuucaagugaaggcuuugggccugaacugugagugggcagagcuucuuaaaaugagggaauuuucuggaugcaugccucauauugcuacuagccccaguggcuacugagacucuugagugacugaggccugaauuuggaguuguauuguaaugaacugaaguuucuugacauucugaguguauggggcaaauggcgugugguguguguaugauggcauguggguaggugugguccuggggccauagacugauauuguagacucauagacaggaaccuuggucuuguuuccuucccagugauuguuccucugggaguaaugguuucuuagaggguugaggagggcauaucccuuaucccacagucagguugcauggccauuuauuggcugugcuguucugagccugcuauucugugugggccugcuauucuguguggcugugacugucuggcaggaagucugcuaucaguacuuugagcccuccagcacuuguccuugugacuuuagagaugguccaccaacaauccaaaguacacuuccuucugaacugggccuuucauuuugccucaggcugcuuagugacaguuugcaguuuagaggagauagugugccagagacuguuuuccaaugguggcaauauauaguagaaguacuagcagaaaacauccuuauugggacugcuuuguggagugugacgagaagacaccguguauagcugcuuuucucaagguucugcagauuuguuucaggccuugucccugggcucccccuggagccaugggauggauagguugcugcucucccugggcuuugugcugccagauuuaggaagagcugggauuccaucauugucagccuucccugagggucaagcacuguuuuucccaucccccauagggcauuucugcacauucccucuggucacuuagaacuuuuuuccaggugcccccucucccaacuuuuuucuacauuuucuuuccuccaguuucucuggcauccugagcccauucucuuuggaguguuguuggguuucuaguguauacagcuucuccagacuguguuuuuucuccuggcuuguagucuugguuuaauguuggacccuggcucauucaaccuucuuaugggccugcuguuuuaauagauggcagauacuaaaguguguccuguuuuugugccuguguucuggagagaggaaaaggcccagcauggagcaagcaugcugaugggaggaagggucagggcguugggucuguguggaggccugagucucgaaaccucuucugcagcccaaugaugucaucuccagcauucugugcuuuuucucucuggauuccuaagcuugggagccuaggcuuagaugugagauaauggcuugcucuuagcacuuggccacaguuucuuacuaugccccuguuguaucgaaggcugggcuuuaucagacaugagucuggaguggaugauagcagcuuuucaggccugccugccugaagccauagugcacuuuuguaguuuagaagugauauauuugaguuaacauuauguugauacuguaucaaguucacuaugacgaugaaucuucaugaaaaguaugaggaagcaucucucucuccauuugaaacccugaaagacauaaagauuuagaaguggaaaaagagaauauuuggaacuggaaccagauaccagcauuugagcaguagagguaggaggaucauaguucaaggccagucaaggcuacauagugagcguagugagcuugaggccagccugggcuacaggagacucucucuuaacuaauaaaacaaacccuccaagauuugaagugaucacauagccucugagcagacaccugcuaagacaucuggcacuuucaaaaauuguaauuaugagugagucauacgaauuguggugagugggaggacagcuguaucugacacgaaggcccaugcuguccaucuugaauacauuagugacuucuuuucucuuaauaguuugugugcuguuggcuguacaguuuaguguugauuuuccuacacauuucuuuacuguuaaaugaacucagccagaauagguaaaagccugucauuugauuuugcuuuucugugaugugcauuuccauguuuauguuggcaacaaaauacagaaaccucagagcagcucugaccagucugagaacagucacucacauuguaauaaccauaggccacacccugaagagaacuuuugaguacacaggcacauugauuucaaauauaaaauguuacuugugagacccaauuuaguugggugcaaaaucgguuuuuuguagucuugguuacuuggaaggauuacuugagccugcaaguuuacaaucagccugggaacauagccaaaccugacaccuccaugccuuugaaaaucucucucucucucucucucucucucucucucucucucucucccucccucccucccucccucccucccucccucccucccucucucucucucucucucucucucucucuuucuuucuuucuuucuuucuuucuuuaauuccuuccuuccuuccuuccuuccuuccuuccuuccuuccuuucucucuuucuuucaaugagaucucaugugucuuagcagucuaggcuuaaauuucuucccuuccugucuuuucuucccaggggauuagaggcacauggcacaguggccaucuuauuuuaucaguuuuguaaucuugaauguugagcauucaaguaacagugggugccauuuaaaggcauccaccuguuucuuuucuauuaauguccucugagugggguggaaucuuuguugagucucugcugucugaugagaguaggcugagguugcagcauuguggucaugguggcaggacaccaucucaggccggugacuugguuugauguuguagaugguugaaugucucugggcuggucuuuuaaaauuguuuuuacacauucacuuuacaucccacucacuccccucucccaguuaccccccacccccaauccuuccccauccccucuucccuucuccucugagcaggugggggcuuacccuggguuccucucacucaggcacuuucagucucugugagacuaggugcauccucucccacugaggccagacaaggcagcccggcuagaagaacguauccucuggacugguuuugcauugauccaagucuuuucacuauuauuagguguuguaaugaguaguauugguguggcaguuauguucaauuagguuagagugucuuauuugucuagccaagaaguaauguaguuuuagcaaggcuuuugggcccagaauauggaccaacuuguguuucuuacaaaauuuugggcucuaaacuuggaguugacuuuagaacucugguuucaguuuucaggagacggauaaggcauggcaugguggaugucuggcauuggcagagcuggguagacgaggccuguugcuaccauccagacucucagaggguaaguaaccaaacugcaugaaucugcauccuuagggcugcugagacuuggugggguuccucaguguggcuagccauggacaccagugcuucuauggaagggcaugccauaugcauauuucucaggcaucuuucucaugccagccuuuauaauguacuaauuaucucuucagccuguuguagcugcaugcuguauaaaccaugugugcuggauuuggagggucauggacaaugguaauauuugauuuucuuguaucuagaaccgccuuucacucuugaggggugccuagagcuguagguugacauagcuauggcagcaguggagcucagcuuuaggagagcggguacaguguagggcauaugcagaaagaucaugaacccaggcuagcuguuagguccuggugagggggagucagaggauaguaagacuguggccaugugccaccaucugguugguggacccguccuuguuggugguugaaggugccuuaugaguggaaggaaaagaaauguaacggccugagugugcuacagagauugugcagggugcagcuuuugucuagagcagugguucucauccuuccuaaugcugccuaacuuuaauauaauucuucauguugugguaacccccagccauaaaauaauuuuguugcuacuuaaaaacuaugauuuugcuacuguuauaaauuauaauguaaguaucugauaugcaggauaucugauaugugacccuugugaaaggguuguccaacccccaaaagggaucauaguccacagguugagaaccgcuggucuagaaucuggugguugcaucucacuaaugcccagcuguagugucaguauugggcacuggaacacaagggacuucuagagcagcauucuauuuagccuuucugcuuuuaaaaaaguuuuauuacaauaacuuacauaccguauagucuacccacuuacaguuuauaguggucucugacauauuuggaguugugcaacaucauguaauuuaacuucagaacauuuucuuugccucaggcugaaauucugcacuacagagcagccacuccuacccugcucccagcccuaggcgcucugguccucugguugcuguccuguuuugcccuuuucagacauuucauuaaacagacugcuguuuguucuuuugugucugaacuuugugugguuuuucugaugaucgcuguguggggcuccauuccuuugcugcggaugggguuucuaccauaugcaaggaaacacugcuucuuccuuagucuuaucaguagaaguaaccauugugguugccuccgccuuuugacuuuuugaguaacgcugcaguggacauuuguuuaugaguuucuguguagauauguguuaccauuuguccugaauguugaucuaggaguagaaaugauggaucaguucaagaaacaggccaggcucuuuuuuuuuuuauucuucucucauacauuauguccgcaauuuucccucccuccacucuucccagucacucuugcuacuuccccucucacccaggucaacugcuccucuguuucccuuaaagaaaaagaaagaaggaaauagagaaagaaaagaaggaaggaaggaaggacggauggacggucggauggaaggacaagccucccagagauauccaccgaacauagcauaauacaguauaauaagacugggccuagacccucauaucaugacuggauguggcaacccaguaggaggaaaagagucccacacacaggcaagagagucccccacaggcuagacucuuguaaccuggcugcccugcucuacauucccaccagcucuuggguuccucacauccccauugguuuuuauuuuugucuucccucuuuaaaaaaguaguuaccaucguauuuguugugggaugucagucaccuuaccauggcuugguuuguguguucccgaugaccaaggaggacgucugaaacugcuccaaagucuugcuagauggugacugcuuuuauagcuaggccugccuccuuggucaggaauugcagccaguguggcaaauucacacuauuuugugagguaggacugggcguagccuuugggggagcugagaggacuuccuagaacauuaaggcccauguguuggauuaguccuuuccugaggucagcagaucuuuucagacagcucagcuguggaaaccucauuagugagguucuacaacauggcuguacauggaaccuauacuagugcugcuucucuuuggucuucuucuaugggacuagcguguaugaaauauagcugggacauauuucaggaucuuagacaucauugauccaucagcuggagugaggacacggguauuacugguaucauaacugagaagugucaagcugccauuuaaaacuguaaaacaugauguggauuaaguuaguccaugaucuuucucuugggaguuguccuucugcccugcacugccuccaugugaacggaaccucguuaaagccucuuuuugugccggggcaugcuguacuguguccugacggggguagcaucaucacaagggugacagagacucuggaacacaggugugugaagaugguaacagcaacccugagcaucuuaaggaugguuuuauauuuuuacuuuagaccucacaccauuccucugagaguggucuuauuugcuuaaggucauagcugagggugcuucuuuucauagccacuguguacugacuuuugcuaaauugucagaaaacaaaaacacuacaaucucaaccuuuggaaauuagaggcaagagacuuagggauucaaggcuauucuugguuacagugaguuugaggucagccucaacuucuucagagaccccguuucuuaagaaaagaaagagaaggaaaagcgcaugugugcagugagaaaccuggauaaguguggucuaggggaggauaaagguagaaagaugagcaugcugcuagccagaacauucgcuuuugucccagaggacguggggagcuuccugggugcaugcugaaguuggggagaaagugacuugggggaggucagaucggcuuuacacacagcagacuagaguauugagcugagucucaggaaggaacagcguggucaucuuuuaaagaguucugccagguucucuucauguauauauuuccauauauauguccccacauacugugccucaguuuuuauuuugaucuuugcuuugguggauaaggacguaggccaucaucaaaggcuacuuagccuuuguuucaggccacucagaugcuuuauugguccugguuuuaguccuuuuguuucuuuggggacaggguuucucuuugaacccuguacacugugaauauuccauagggcaucaugauuagccugggaaggcuugucuaggguuuuggcuauauuuucucugugguuauauucgauugguguuaauauugugaauagaguguauaccugcguuccuaauuuugugguugauuuuuuuuaccccuaaguuuuauguuuugaaauuaaacauuuuuaucucuuuggaugcuugguuaaaccguuuaucuccuuuucugcuguuuuuguucaguggaggacccugugccuugugaguugugugggcuccucuuucuuccagauuugggauaugcgcugccuucacuuccguaaauaucccagcugccaugcucuccuucucacucugggaucugaguuuucgguguguagcugugcuccauccugucccucuggucucuuagguucuauuccuuuuccuugagcauuuuugucccugcuccucaugcugggugauuucaguuucuguguucagugauuuugucuuuuccuugugcagaucagccccuguauuaguugguuuaguuggaguugguuuguuuugaugcagucggggaaggcuugccagcaggagugcgaggcagccacagucagcaagcagagaaagcuguuggugcuuagcucacuuucuccuucuuauguagucugggacucuugcucauggaauugugcauccuacuuuuaggauggguuccuaucuuaguuaacucaaucuagaaacuccucauugacacacccagagacuuguuuccuaaguaauuauggacccugucaaguugacaguuaucacaccccucuagagaaccugcauuucaacuguugacuuuucaauuuuagaacuucugucucuuggguugacauuuugaguuuguucagauaaggucuuugguuuccucugaacauuuaaaaagucuuugguaauuccgaauguccggcugcuucaguggcgucuuuucucccguguuuguguuguacuuuccuguuccuuuccucccuuacaauuuuuguuuauguugaaaacagaauauuuugaauauuuuaauaggagccuccagaagaaaucccccuccacacauccaggcaagugcucuuaggauguacugagucccauuguguccucugucccagugacuacaaucuguccuguaucucagcaucagacaugauaugauagaguaucugugagugcugaaacaaaguagcuuccucccucuagcauucuucugguugucauaaauguuugauuaguauccagaguucugcaaacauugauccuaucaguuuuggccagcuuagcacuucagcccagaacucguguuugccucacugcaugacuucauuuaacaaggaacuuucggauggugguauggcaucuauuuggguccucuuaaguagcaaaugccauauagaauuaaacauacaacaguuuuguuaggagcaugcuugugaaagagaugggggaggagacaggaaggcuggagaucuccacuggcucugaugauacacacgugggaugucugacauuucaugugccaggcgaacaggucccugggaagggagggccauguugaccaaugucuagaacagguggguggggccaucuugaccagugcucagagcugcacuguuuaguuuuagcauuugugccauuuugagcugccagacacccgaguuuguaagaaaaugaggacuauauuguggcgucucugacuuugcuacugggugaauugucugccuguucuuuuuuccuuugagggagugucuguguuuuguaucuaucugucauuuccugcccuguaaaaggugguaugggaagaggacaaaucacagcugaccacuguugggauuauuuagaaaggguuuuugauuuuuguuuuaaaacauaauuugagauauaguuuaccuacauuacaguuuucucauauaaaauguaguucaguggauuuggguauauuacauuuucauuaaaaaaaaaaacccucauguuaaaaauacguaaacagggauuuguugcugccauuuccaggcguuugcucaauggcucuaacuccguucaugcuguugggcaaccaucucauaccccugggucuaaaucaucuguuguuccaaauaaccuguuucccauaccgcaugacuccaguccacuucuauccuauguuuuuuuuuuuuuuccauccuugggucuucauguaaguacaaaguguuacaauauuuugccauuuguggcuggcccauuucauagaguauggugaucucaagaccugucuugguguagcacgugcaagaauguccugcuguguaagugaugcugcagcgcguucacucuccccacggcccaucugcuggcugccguggagaggagacgagcaugucuuuugcuuuaagucuguguaaugugucuggcacuaggauuacuacuaggucauguguuaguucuguugaacucaucuuggaagcuuguuuuuuguuuuguucuguuuuaucuguaaugugaauguagagagguaguacuugggaaacaagacccuagguugguuuuuuuuauuuuuuuauuuuuaacguaguuguagagauuccuuuuguuuuauaggcagauagaauaccugcucuaguugccgugaguaugcuguugaaacuuacccuuggagcaacucuccagggaggaugauauuuuuccaugguaggucucugaucugaggcccaugguaccaauguacagaccacuuuccugcaggccgagcacaccuccuauuugguagaguagauucucaugguucacccaggcauggguggcaccuggcuagguucuucuuguuugccauuuaagaugacagaggcagugggugaguuacccaucgucuaucagagcuucggggccugaguggagggcugaguucuuauguggguugagcaugccaggaggauuugcaagugccagacuuugggucaugagcacgggcuauagcgcuccguucaccguuccccuccuucaggccuuuacuuguuggggaguggaaggggucaugcuuugguuguuugccaaacauauugguguauguuuggcaaacacacaaaaaaaauagucaggcuggaaaguaagauaaauuuuguuguuuuuuguuuuguuuuguuuuaaucauaagagaguaaguuugggcuuauauauguggugguuuggauggaccuaaaggccuuugcuagcuccuuggauggaaaggucuucuccugucuugccagguuuaacagagguuuucccugcuucuaugagugggaaaccuguugcaccguuagaaaugguuugcagcacuggccuuauguauuccauaacuguuguuaaagaccccaucucucucucucauguugguauuugaaguuuuauaugcauuuaaccaguugcagaguguuucucuauuucuaacaucaucugaagguacaaagauagaaagaauaucggucagcuucucugggcaugcucuguuggggcuggcugggagcugggaauugcuggcugaacaaaaggggccgugaguuccugcacucagugcccaaguuuguucuagcaaguagggugaaaggucgccuguguccagacauaguggaagggcuguuguggaguggaggaguggagcuccucccacgcaucguuagcugccagggcuccugaucuuggccuccagguacucugagacucaggacuccuuugaaaagccccauaggugaggguuacuacaugccuggacucuguggcuacuaauuuauuuaccaaucccagaagcacuuucauagucucagugcugccucgacugucggcucccucuuccugaauacuaaggaagaagacucuagagaauaacauagagcugauauugaucuuuguuuuauguguucucaaaguucacacaugaguuuauugggaaauuaacagguacaucauuuuagggaguggaaagugagccuaagugagaaaguuugcuuugacaucauaagcaaauagaauaaggugaucaaaccuugaccagcaagcacuucccugauggaaauaaguuacucuaaaguaacuuaaagucagccucuagauguuuguggacgguucaguuagaaauaaucacaacacuucuuacguguaacaguugauauuuaaacugaagauguuucuggcaucaaaacacauagcuauauuuaauaguaacacaacaacacgguaaaaguuuuaguuuugaaaaauaguacuuguuuaagguccuuucugugagucuacucacauugcugagcuaguucuguguauuucccuggugugucacaaacaugaagucccaguguaagucauccgucuuggagaguauaagccacucagauuuuuuuuuuuaacaaccagaaguagaaacaccuuuuaauauuuaucuuaauguuuacaaaaaaaacuaaagauuacagccuuuuguccuuuuugaggagagaagaaaaauuguauuuauaaaaacugacuugauaaaaagugaagguaaacugugggaacacuggcuggcccagcacuuaggaggccaaggcaggaagaucacaaguuuaacgccagccugagcaacauggcaagacaguaccuccuccaaaaagcaaaaaagugaaguugcugccuggcacguagugugaaaagccucucucuagccauagcacugagugcacuugaggccucaggauacccggguucuucugcggagaguaagcacucuugggacggggucauucagcuuuggcuuuuuaguuccuugcugggauuuuccugugucccuuugacuuguccucuuuuguccuuugggucugaggucacacugagccuccagguucucuguagcacugagggugggcacauccugacggguggguuccuggacugugccuuccucaucggccacucggacguucccugggcuguaggccgccagcugacagagagcuacagcugccgucugcuucuguucaucacugcuguccuccgugugcacgucugggguuguccugcugugggccuugucuugcggugucuccacgcggcuuguccuaucuucagaacccuuugucucagucuuuggaguggcagcggguucugcaccuuggggugggccugggagggcgggccuuggagcccaggcguugcagagauccuucacggacagauugaguggcaggucuugcagagugucugccugggcguugcuugcauacauggguccauacguggcugcaggguuugucuccagcuucuuagagagauugaggggaccuauucuggagugguccucugggcuggaggguggggccucugugaugaaagaguuacugcucccugucugggccggagggucaccauucauggccugaaggcuagaagacaugaagagaaaucuuaggaaaaugaucauguaaagcauuuggaacaagugugaacuaacuugguguugagcaaaaaaaaaaaacuacauuggagauuuugaaaaagaaauucucuuaccuuuuuggagacucuguucuguuugcaggagguugagagugagggcuuucugaaccccuuuggacagguuugaaggcgguggggcucugcucagcuugcuggagucgcucuaggguuccggaggaggcugcuuuguuugagaggucacacaggccuucgaauguuuggcuuguuugggugaaguugguggggcuuggccuccccggggagcccguggcagcgcucccugcucgggggcucauuuuggcuucuucugcaucccuuugcccaucuuuagaaggaucuuuagccucaggaacuggacuucccuucucacacucuguguguuuccugugggagcuugaaagguuuaacucugagggacuugaggcuggguaagccaggguugcaucuucaagcaagcgagagcucugaucucgggugaugccagugacagaugggagccugagacuguaggagggaaaugcagacucuggucuguaaaacccauaagggaucggcagauuagagugguacugcuggaaaaaucuguaguggucauauguugauggggauguguucaagugcuugggaauuggcccagcaggagacaggaagugucuuuggucuugggucccauagacagacagcaaaguggucucacacucaggcguguucccagucaggagguagggggaguagauggcagccagcccaugcucugcguagaagggauggggguacuccgggauugcaggaugcauauagggggagauggcaccaaaccccuuuguagaggagauuuuauguggaaagucaggagggaggaauggggagccagcuuuccagggguaaccgggcguguggaaugcagacuuggcauggaaugaggaggcuuuggugguagaguuggccagcacuucaguggccucuguaucuucuggcccccuaagucuguguuccccaacuggaacaaaugcugaaugucuaaccccacugucgaggcagggcugggugcugagaauggcuucuggugccauuucuuucuguagggcugguuucuggggaccuuugugggcuccccgagccugcauuucuagguucucuuuggcauccuccuuugcagagcccuguugagacuuuggaucaaagcuggagaguccauuuaggagagauuuggaaguggcuggcuuugaggugggcucuggcuggugagucugcuuaggauccagcgagcuagauuugggacacuugggaauacgaucuugcucugacacuaaaguaauggaguuuuuacagagaccguacuucaugugauugaaaagaugugacuucucguuacauguaaaaggacacuggaagcauuuguacuugaagggcuuuccugggggccguggaauauaguguggcuuuuuugguuuccguuccuuuaggagacucauuauccuuuguguuuggacucuggucugcucgguguguggucacugcugccuccucuuugaccagaaugugguggcuuuggaggaggugaguacugucuucuuucuugcugugaguacucuauuugaagccagcuccaugugcugagggccuaaccaggagaguuccuuccgucaggcaccugcagcuaugaggacagacagagacuggugucagguaaaggguuagagggucacugucucacuaaagacagacuaggagccuggugccuuuagaaagcaggcgauaucugcaucccugauagucugcucuccuggcugccagcauccugggauauuuucuuaagucuaaccugaaagacuugccugggaccaagagagcagagugucaguagccagccucugaguuuuggggauccauauccugcaagcuugacuuccccuugguccguuuguuuggggcuucugauaggauucugugaccagagccuccccucugcaugcucugugggagcggacacuuaguucaaugugcucuggcguuguuuagcugaguguuccaagguccugcuuagcuaugcugcugcuauauuaugugugugaauauuuaaaauaaaaaauauuuaagacauaggacuuacucuacugcuucuaaaacuacagaaaagcccauuuuaucagaaaguacaguggguaaauguuacccacugaacuacacccuuagcccuaguaaguagcauuuaugauggcuuaauacaaaugugaaugcuauauguaggucaacucaguuugcaguuguuguuaggaugauuugcaagucccggauuggcuuuuaugucuugccacucaucaguguuugggaauaacucauagauuugcccuucccuuccuuggauauauaaaccuucuuaagagaccagagcagcaguaaccagguagagggaagaagccacccugccccaugugccccuuguacccagaucuuacagugugcuuccuaauccaaggcuaagcacuuagugaagcugccucccuggacaucuagggugacucuggguggccuuggguagagggagaagguugaggccaggcuccuugauuuguacaggauaugugaaaaggggaaggucuccuacuucguaugcuaaacacuuaaaaauaacauucaguggaaauuguuuaagaaacguguuuucagcuacaaaacugaguuuguaaaaaaaaaaaacauguaaagccacgcccucaaaacuuagacacacacacacacacacacacacacacacuucuguaaaccauaccuuuagaaacauaacuacauucuuaugauuaaguccucacucuugucugucuucccuguucccaguguguguguauggugggcaguggguguagcagcuucagggacugacucuuuaucucuacuuaugugcuucaaguuucugaggauucuaucagguuucauuugguuucucuucuaauuuacacacacacacacacacacacacacacuauuauauauauaaaacuauaucugccacugugguagcagcaauuccaucacuuaggguagacuaaggcagagggucucaaguucucaaguucaaggccugacugugcugcuuggcaagacuuuuuccucaaagcaagaagcagccuacaaagagcuaaaguuacccgaucaucagcauuuagggcucuuaaguaguugucugggagagcaguggcucaggcgguccugaaaguaguccacugugagagucugcauggcagugagagugaagcccccaugcuaggaggaagcuaggauccuaggcuccuugcaggaggaguaugggagacugagcugucaaaguggguccugccuggacuucacuuuugcuguagaagcuaaagugaagacagaaguccuaugucaaagcugaucauauuaacacuuaguaauagccuugugacuuuuccuucuuauuaaaaggaaaaauguaaagaaacucucugugggcccagcguauaccuggagugcauuuucccugccugcgucagggagcccgagaagccucccuugucugacuggcugaugagggcagcucgauaagucagugggaccugugcuggcaugcucauuacacucuugauucugaaggcgugagaaccucugcaagucagguucccauggcuguauaggauaugucauggcacagaucugagagggaugauuucaucacuagcugggagcaucaugaucagaaugaugacaguugcaaacauucgucgaguaugagcugcuucccaguuccuggggacagacgugggacagugccccguguguccugggcaggcuagaagagccccucaggacguaaggaaauaaugacgggcccucagagaagcagcuguaguaaacguuacugaugguuucgggcagcaguaagcgugccacugggguuaaguacugaacaucuacggagguuaaauaaguacauugucaugguaaggguuuccugucuuauaagaaagaggaguaacugaggaaauaauuauuaccgagugugcgugcaugcgugugugagugugugcgugugucaugcuaugugaaguuuugguuucagccuuugucuuuuaauuuuuuuggcugcugauccccaggacagugagcaggcuggcugggauaggcagcaguggcucuuguguaaggguucuagagugaggccauuuccugagguuuauuaaaacugaaagggaauggauacagaagcaggcucggcuguaaucauuucaguaacuucggauaaacugacccucaggauuucacaauugcuaauuaaggcggagagcucacugcuuggaggcagguguaaggcgggcguaacucaucuauaaaacuaccguguuagagaaguaagugggauaaaauugaugcuuuuguaagcuuuugaaugaugaugucagccugugaguucucuguccuaagcaagugagguuuaugacuaucaagaaauaaacccacagccaugacugcagccaggcacauaugucugugggcauggaggcuuacaauaaguccuguuuggucaguuuauaccugcuggacuuugaacugucuggcagccgcugguguuaaauauucccaaaagcacacauuguugccaaaacaggaaagccaagaacuuugacuguuuacaguacuuuuggguuuauauucaaaggugaagcuuuuccuaaaggcauaagaaggguauguggcuucccccccccccccuuuuuuuuuuuuuaagguugggccuguuacuacuuugggaauacaucucuggaaggcuauauguguagcuauggcugucugagaacuguaguguuagcauguuugauacugaaacagucccagaggaauuuuacuuggcaccauacccuccucccuucuacuucccauuugauggucagggggguucaugagggugucuucccacaggcacucagcccucaucaagggcuuuuggcagagaguuguucucugucuucccuggggaagcccuguucucaaacaugccuccccagaccucaccuuggccccagacuuccuucucugaaucaucuugcaaugcagcauacaguauguacaauaauacagugaccuagaaacauguacaguauccagcuuaagaucuguaagaugugucccaauuuuuuugcugacacacaucaggcuguaugacuugagacuucgauaucucuuauauuaaaugacuugacugcguucagaaagggcccagggcugagagcaccuuccaccugcccacagugugccauccgggauaccugcccacacacagagugagcacuguguaguuucgauuggccacaggguccuguuugucuuuaaagcauuaaacuucagcagucccugaguguggacauguaguguaguugcugcugucaagacaacagugaguggcuggcauguuuuuagaaguuucuaaggggcuugcacuuagaaaucagacaagagaaagaauaauuuaagagaacccugauaggauacaauagagguaauuacagcuuugcuuuauaggccagcgaugugacgggccaggcagcuauguuuguccugugaauugaccugcaaaucaagacagugcaguacuauuccuccuggugguguccagcugucuggcgcagagccucgcagguggaacgucgugaagggcaugcuauaauuacagcacugugauguggcguuauugcaccacucaagggcacgccacugucgucuacccacuggggugucgcaagaacgagauuugugaguuuuacuucaugugggcuuuugcaguagcuggccgccgcucccucccaaacuuucuguucuuuaagaugaaggugaacuuagggaggccauagucuuagaagaaagcuguuuucuagaguguguuuggaaggaaggaucuagaaaacaaauggguuguguugugcaggcucacggcuucccgaccagcauggcaccggagcucgccuugccuguguuucuguaacacagcaguuuaaaacaucagagagccuuuucuaaugcaaacacucagauaggaaaugcaggcguuucugcuuaaaccaagucugacuuggucagauuuggccgauuauucggucgauaauuauuuucauacagauuuauccccccccccccauguauaaucuuaacaaccaaaccaaaaaccuaaacuuaguugguuucuuguuuuugaaagguuuugucaaagcagcaguuauuuuaaauuugaaaagcuuuagauguuaaacuagaaaugaaaccaaacaguuguaucucucucuauauaugugaguuuugccucuuuuaugucaaaauuuauuguaauuucuuugaaaaguagggaacaauuaagcaauacuauaaauccaucuuuuguuuuuaaaauaaauuuuauagcagaaaggauggcuugauuucuaaauaagcuugcucauagucuuggaauaacguaucagccccauuaggaguucuguaauuguggucugcauccccgagaugcaccugccggguucugaguaauccuuagggaauagugagagcaggaaagagcagacaacagcaaacaauuuacccagacagauuccucaagacacauuaaagaguaguuuugaaagaaaacuugaagaaauaguaagcacuuaccaaaggugggcagugcugggaugcggaguccuucuucugugcaaggugcugaggucugaggagcaggaucuguucucacgcuggcucgcuggcucggugaaacuggagccggcuguuccagugggagggauuuaaguguaggaguugagcccucggggcguagagaugcaccugauauuccuccgccugcagcuacaauucaaguguuugcacccacugagcuccacguagccucacugagcagggauccagagaguccugugccacuccaggugccccacaggacucuagguucacggugugugggguccugggagggcugcccaguugcagaggaaucaggauaucuggaugcagagucuagugcugauguacuuguaucacaagcacuugaugcucauuaaagacucagguguagagcuucgcuugcucgcuucaguacuccagcauaggaacauagaagcagagaaauauaacuuuguccugaaacacaugucaccgauggaaacaugacaaguguuuuugcugugaugcccagagaagccucuggccaccucugcgauuucuacccuucucuaggaguuuuguugaggucaccgggagaacuaggguggcagagaggaugcuaaccuugcugccuugucacagggaccugccggaacaugcccagggccuguacugguuguggagcugacaugugcugucugucauuugggcgucggcaguguguucaccuucacacccccucuuuaaguaauaacuuagauuuuaaauuuuggagccauuuuaccauccccuacccccaccccccaccccacccccaguguuuacuuguuugcuuugaggcuugugcgggcugcaguggaggcuggaaugugaugucaguuuggggacagggaaaggacacugugauagcuggcuaggcucuuggucauaccugaagcugcuggcaagggccagcacgcauuuaagacuuuagauuuuacuuggcuucaccuuuauguuuaauucuuuaaaaccuaguuuaguuacuuugucucauuccuaggaagagucuaagccaaaugcucagucuuauaagaacagcgagcaguucccuaggguuucucacaucucuagcugaguagcaaguuaccuuaagcucugcucugagacagucaccaguuuguuacaguuuguuacaucugucugggcggagguggucuguacugguuccgguucccccaggcagugcuucuacucuguggguguuuacugaggcuucccgguauggugaaguccucuagcuacucugccacuuuccgggacuccacaguagaggguagccuuuggacaucucaggacuugaagagagcaaaauggagaggcaaggcugagaauuaucucagugccguuucugcugcaccucuuucuggagcaguuggggcaggccagcuucuuaggaaggcuggcagggacuugcugaaagucuuacccuuuccccucugcucucacucaccuuuugcugagaguuuuacuccuugauucuaauuugcaaucuggacuucagguguuuuuaauggacccccuuaacucuuugccucccacauccucuugagggccaucccuccucccuuugugcugcccucucacuugggccaguccuaucuuugcugugucauagcuucuacauuuccuucccucuucuuuuuuguauuucauagucagugagggcagugcuauacuaaucccuaaacccuccaacagacguauuggccuaaugccacuuuacagugcuuucuuccaaggagagucuucaugcagcaggaguucugaucugaagggugacauuuagugagcauccccuguuuugaggcccagccuugccaccaugucccuacauggccuggcaucuguggcuugaugauauccacacgcucuagauguugaucaagggcaaucucuagcuuuaugagagagagagagagagagagagagagagagagagagagagagagagagagagagaaagagagagaaagagagaauaugaauguuuuuccuccucuucuuuuuccuuauauucucaguuuccuuuacuauaucuucuaguauuucuaugaagcauauuccacagucaggaucucugguuucuggggggguuugaguagcccugcuuugauaccuuguucuaacugcucugaauaguucagugaguuucuugcaggauaggagggcuuggggacuuuauguagggauucaacucugucugcugcagagugggguuucuuuauugcugcugguugacagaaugaucaagaguugaugauagccaagaccuugggcuuuuaauagguucuguuguguaggucagggacuggcagugcuuccucuuugguuccccacugaagguucaugugcuuguaaccuccuagugguucuuucuguugcuauguucccugcccucuuugacuucuuugcuuaugccuuagaaagugaaggauggggcuggagagagagcuuagcauuaaaaacacugggugcucuaucagaggaccuagauucaauuucuagcacccacacaguggcuugaaacuauagcuacugucccaggggaucugaugcccucuucuggccucugaaggcaccaggcaugcccaugcaggcaaaacaccuacagauaccaaaaagaaaaaaagaaaaaaaaggaaaaaaagaaaaaaaagaaaaaaaaaagaggaggccuuucuuuugccacuagugaggucugaacccuuguguuuggucucacuccucugcaugaccuaaaugucuugaugaaguuucugagaaguaaaaucuuaggggguaggacugggaguggcaguuggcauuuccugagcaucuuccauguggguccuuggugcugagugguacuugcaucauucccuguagucacaggagcuguugugcaccugcuuuauaggaguuaaaugagcacagagcgguuaaguaacuugacccagguaccuagucugguaggucacaguuucaucaugugacaugggagguaagaugggguauagagugggugucuggggcagcugccaucucuggacagcagcaucucaaucgaaugcagacaggugcuguuggguauagauagugcugugacucuagucugcugcaucagacucuuuuccugggucccugcuggagccaucuguggcacacuucccugcaggguauggaaggcagagcaguguguuggguuagccuagguacuccuccacagcacggcuuggcucugagcucacuuccugucccuucaacaucucuuugccuguucuugggcuguccccugcagugcaaugcagggcugcguaaugugggagagggucagcacaggcuuugccaggccuguugagucauuucacacagcagccucucucacaaaacauuuuugaagaaggaagggaagucacuuauuuucugaccuccuuacaaauagucacaagaugauuuuuccuguaauuuuuugugcuccuuuugugaggaacaucuggaaaguaaaaaggaaaugggaauuguuguagugaugucacaagucugguuucagcuucccagugcccugugaugccccggggcaguuggaggcagcaggcagcucacacuggggcucucuacucuggucuccccagaacuugaguucuguguuggugacaugauugggauaggaguacaggguccuuggguggcagaggacaacagcagcuccaucuugcccaguuccagauuccuggggcgugcacaugcuucugcgguuugugggaguugugcacuccugagcuuuuuaagaggaauagccgaaggcccagggccugucccagguuuuaggagucuggcuuuguuugaccuugccuucauggcuucuuucccauugaagaggguaucuuuuagggguuuuuaauuggaauuccuuucaguuaggauuguaauaguaagagacuauccagagaaacaaaugauuuugccaagcccuuaauaaccuggucuugagcuagcucugaggugauggauggcccuucccaucaugccuuauucugcuucccaagccucccuccuauuccauuuguguuaagguacaucccgacuggacugugaaaagcucuguuccuaguggucuggacacuuuccuagacuuggguuuuggcccuaggcacugcucuuguuuugcucaaagccacaggacagaccuggagcuguagcccagggggcaaguguugcuguucaguagacagagcugcuccgagcuucuguaggcccagcggggcaucuggccaagaugggggaugauccacccuccuccuccugugcuccuacugccuagaaccucuccaggauuggccagaggugggcugugaucauagauugcuccacugaggccuguguuccaaccccacagccuuagggguccacaaggcagaagguggacauguuaguggagcccuuagugcugccguacagacuuuaggacucagguguguccaaccuuuugacauuggaacacaaaauucuugucuacagaguucaugcucaagaaccugcaauugaauuaccaaaaacaaaacaaaauaaaauaccgaagaccacgcccccuaaaaacaaaaacaaaaacaacaaaauccucucaauguuuuaaguagcuuuacaguuuuacguggaggcuagggcugcauuuaucacucucccucaaagugugugagaaaguuuuauuguucgcauguucuccagagagaggguggauguagagcuuagggaaccugacggcucagaggugugacaccgucacuuagguuuuaauuucuugauuaaggugaugccacucuaggcuuuuauagacuggagauacuuuauuuuguugaguacgcaagauacuuuuucuacaaaggcccgcaagggugaguggugucucugaguggugcccuguggugggaggccuggcagcaccagaauguggccugugggcagcuuguguagggcgcauguucuccuggcucuucugccucugagcuguauggaaccagguuccuguggcucuugaagagccuucagggugaaugauugagggugaaaggcuuuuugcuuguguuuguguaaacagucccugguucuucccgucccuccugguguugguuggcgccaaugcugugucuaaagggaaaccugaaacucugugcgcugcggcucgcuuugucuuugauugggaaauucaguuugaguuugugaacuugggccaagucuugaggauucccacaguuuuccucaccugucuguucucccaggccagccgugcagcucuggggccuuguuuucuggcccugcuugggacuuguuauucuucuagguguagcucaagaauuagaucuccugggcacauuuguucugcucacagcuauacacagaggguaguuaagcugaacagggccagguaacguuaaaaagugacgugaagaugauuuccuuuucuguccucaugcuacaccuguaaccgucccuguaagaaauaggguaguaauagccucaacccuucuucccugacuggucuuuccagaguggaguaucugcugucuguugggucguauuguuuaccaagcuuuaucuucaagguuccucuuucugcuuggcuguguccugaauccaucacauucaguuuguugcaaugagcgccuuuuagccucuuacuguuuucaaagcauucacuuugcucuguuuucucuccuccuuucgaaugccaugaucuucguugcugcuuuucuuaacuuuguagaccaggcuggccucaaacucacagagauccaccugccucuugcuccugggugcugggauugaaggugugugccaccaagccuggcaauuucaucuuuuauuuaagcauuucauauaguguuacaaaauuguucuuuuguguaugcacauaucugugaaugcacacaugcacggacauuuguauaaacacuagugugaagagucuagagaacaaucucgggugucauuccuuggacacuuuucaccuuuuucuuaaagauuuuauuuuuaaauuguguguauguauacaggugccuguagcagcccagaagaggguguuggauccccaccuagcaugggugcugggaccggaacuugagucuuguucaagagucauaaauguucuaaaccccugagcuagcucagcucucuggccuuccacuguccuuuuugagacaguguuucuaauuggccaggagcuucucuagcaggcuagccugacuguccaguagucccuuagcauucuggcugccucaucuccucagcacugggacuacaguacauaucacuaggccuggccuuuuuuuuuuuuuuaaacaugggguucuggggauugaacucagguccccucacucuugcaaggcuuuucuuuaccgacgggacugucuugcggacccacggaaucaguggcaugugggguguguaguguugcacagacguugcuucucucuggcuccaucccaaucaguugccauauuuuccccaacaccgaagaccgccaguuugcuuucugucucugaguuagaacuuuuggaucuggcuucugucacugaauacaaugaauccaaagcucacccauguuucagaacaucauuccuuuuuaaagauugaguacagugaugucuggguuguuucugucucuuggcugucauaagugguuuugccguggaccuuucuacagcaguauugguccagugacagugcccugccuaucaagcuacuucucauggcacaguauuaucuuaugucucuaguagugguguaccacaauugguuccuucuggaaaaaggaagccaaccuuuauacccaaucuggcgggucugaaggaguauguugaugugauuuuggcuugcauuuugccucagugacaaugaucuugagcaucuaucucucacggauuuguggcugugaauuuguuugggcaaaugucuuuuuuuuuuuaaagauuuauuuauuuauuuauuuauuuauuuauuuauuuaugugagcacacuauagcuuuacagaugguugugagccuucaugugguuguugggaauugauuuuuuuuuaaaggaccucugcucgcucuggucaacuccacuuguucagucccugcuugauccggcccaaagauuuauuuauuauuauacuuaaguacacuguagcugacuucagaugcaccagaagagggcgucagaucucauggguaguugugagccaccauuuggucacugggauuugaacuuaggaccuucggaagaacagucagugcucuuaccugcugagccaucuagccagcccacaaauguguuuucaauagauacauuucuuuucagcugggucuaauagcauauauguuaccaucucagcacucaggagaacagccugguuuaccuaguaagauaaugucuccaaagaaacaaacaacaaaaaaccuaaacaaaauaaaacaaaaccaucagcccguaccugguguguauguguggguggaggugauguugagagacauuuguuuuuuuugagagagaguauguuucuuuuuuuuuggguuuuuuuuuuuuuguuuguuuuguuuguuuuguuuuguuuuuuuucugagacaggauuucucuguauagcccuugcuguccuggaacucacuuuguagaucaggcuggccucgaacucagaaauccgccugccucugccuccugagugcugggauuaaaggcgugcaccaccacacccggcugaguauguuucuugaaugaccuugaauuugugaucuaccugccccagucugcucagugcuagaguuccagguguauauauauugucaugccuggagaguguauauaguauggauagaaaacccuuacuagaugugugcuuuguagauauuuuauaucauccuguugcucuucuaauaagaaaauacuucccuuggcaguaucucuguuaacaucaauauauauuuaccauucucuguaguguccuuugcuugggugguuuuguguguguguguaugcgugcauguacaguauguauaugaugugucuaaauacaugcacacauucauuaagaauggguuuuuaguugggcaauggugacacacaccuuuaaucccagugcucagaagguagaggcagguggaucucuucaguuugagccagccuguuuuucagaguuaauucuaggacagccaaggcuauacagagaaacccugucucaaaaaggggguuggggguggcuuuuaacugggcaugaugguucucacuuuuacucagagcaauugagagugaauuucugugaguucaaagucagccaggguuacauagugagaccuauuucaaaaauaacuaaacaacucccccaaaccuuuagaagugucuuuaauccuuuugcuuuuauuuggcaauuauuuagucagauuuuguauuuugugugaacuauuauugauguguuguccaguaaaggaaagugcuagcaugucaaggcagugcguggcccaguuacuguugcucaugugucuguaggaaccauguguauaaccucccuacuuguguuacaugguuuguuguguuuguuuucgaaaguggaaaucaguuuagggccagaccugccugaccugugauacuucugagcaugggugauaguaucuuggcuuugcaguacacucagagugccucucuacccacaucuuucuauuauuuuaaacacugugaugguguuuaugccauuugaugaaaaaaauuuaaaucacauuuauuuuuauuuugucuuuaaugcaugucauaucacacauauggaggucaaaggacaacuuuuggguggaggguuucuuuccuuguaucauguagaucccugggcagauugucagguuugagacaaauaucuuuaccuaccgagccaacuugcuggcccauugaugaaaaauaacuugaagagaaaucuugcucccaagucacaaccuuucauuuacggagcuugcauucacacugucuaguccugucuggggugguuguggugaugugugacccacugaguuuacuggggaguuguggagcugauuuugccggaugaagaacacagguucuagcaguucagguuagcugugacagcaggacacugaaacugcugcacacaguuccugggccuugagugcuacugcacuugaaagccauucuucaugugccuuugugggaguuccauguguuuuguucucuguucucauuuuuaugcuugcugaucucuguugugugaagugucaguugugaacagacugauaauaguuccugaugcccagugccugcuuuacucagccauauugggcuuauggggauaaagggagggacuugaguuacauugagccaguagauaagagcagaacuuggcuucuccaugggaauccaggcuuggucuuuggucuugagucuagguguaaugcacucaccuguggccccauaaaguggcagugucuucggggcugugucuuccauguuccucagucuuuuguuacugugacaacguaucugacagaaucuaagaaaagauuuauuguggcucagauuucagaucuuucaguccaagguuggcuggacccauuccuuuggcucaagauggcagaaugucaugguggugcaaguauauggagaaggaagguauagcuugcuucaugguggccaggagggaggaggaaaggggggggggucauuuggcuccugaauaucuacccccucacugacuuacuuucucuaaaagcuucuaccucccaaaguuucucuucuucccaauaaugccaucaaaguaaacauccaucaauagauuaguccauuaagucagcaccccuauuaucuggucaacucucaaugauuggcuccaccagcugggaaccuagccuucaacacauaacccuuugcauucauagccauccuccuauagugacuuaguuuuccaaagaaaaaugagugcugugaaaaaugagcauccugccugugagcuguuccugcagaugguaggcaccauuuuuuuuuuuuuuaauuuuuaauccagccccuguagugaacacaaguaauggggguuagaauucguaauugcagauaccaacagagcauccuuuggaauugguagucaaggcuggcugccaggcaguauaaugguggaaagucugagacuuacuuaguggggcucuaccuaccaggucaugaccaggaaagguagagacauguggaaugaugacaucagaaccucuccaguuacuuaguugggugccaggcuugugaugaaaccauguuagaugugcccucugugaccuugggcuacuugcuucuccuggagucuuguguaucuuuugcauuguugccuugcccaucucugacacugcagucuccugggaucuugcugucuaugaaauaccugugauguucccagaggcuagagccggggucaccaucuugggccacugguggccugggccuuagggcuggggacccuggcuguaagucagguagaacuggucucgacuuccuggguuagccuuuaauccuccaggacgcucuuuuucuucuuucaugcugcugugcuugccacucugucauuaguuguggguguuucugugccagcagcacagcaucagcagaggagcacacccuugguccuggaggcaccuccugcuucgugguuuugccaugccauguccuccuucugugguggccuguggugcuggugguaguaggcaggaacugacaggcccuugccucugugacagcuggcuagggugauaacaaaaggaaccuauggcagagaaaaagggagccaacacuaggucuuguuggaaauggucacuaggggauucuaggaguguuuaacuggcaaagaaccaguaggaucacuugaaaaaugacugguguaauccugaguauuaaucuggagggccuugacuuggcuggaaggcagcaccugaguggcuuugaaaggcagcagauauacuggcugacugaugauagagaagguauugagucuuuuuugucagccuuguggucuuuuugugugccuuugcuggguaccacuaaacuccugucaggagcccuaaccacaccccagagaccauguuuguugagguacuugugugcuuaggcaggugugaggagcauauuccucugcccuauguugaggagucuguguucuguuucccugggaggcugugcugaccuugcuuggcuaucccaacuugauucugcuuggcuaauacaggauggggcacauguggguguuggcauguuuaguaauggagaacuuagagaagcagaggugcaacuguguggacucccugcucugggcaugugauaugaagccuguggugcuguguguauguccuaucaugggcauaugaaauggggucugugguacuguguaugucauggacucguagggugggguuuuugggggcugugugcaugcucugacacggggcagguacaauaauaaaaaguuugugggguuguaugcacauucugugaagacaaguaagauggaacccaagggacaggaugucuugggagacucaccuauuugccucuuaguccagcauggaagggaaaccccucaggagcuuauuuugggagaggccuccagucgucuugucuaggcccuaaauucaggccucaguuggccaauagugguaaagugggguuuggugggaaaggaauuggguguucccauggacgucuggcuuucuccucuagccucaucugucaucucuuguuggccaguugcugucagagcaugugacagcacuuggacaccauauuucauuaguugcagccgcagcucaauuuucuccucuaccaaaaaccuugugauauggagcagcgacucgcauuugacgaugacucuccauucuggugaaagggcggauagcauagaccuguugugccgcuuugguggcagcugcuacuucuaggguguggaauaugggugggagguggcuguaaccuuggacugagagguaggcacugcugccuuggguuagcuggcuuguaaguaaccccuccagguagggugggugcuccuucuggagagacacacacacccuggggaaagugcaggugucccccaagggacagaacacuugauuucccccuugucuugaaaacuuucauggucaaucuucguaucuucugccaacucucuggaauacauggggacacagugaacucuugcugccuguccugucacccgaacugugugggcucucacacaaguuguuuuauuuguuugcuuuuguuuuuuuguguuuuuuuaaagacaggguucauucacuggcucagcuaaaccagaacucauaggaauugaucugccucgucuuccugagugcaggaauuacagugugagcuuaagccuggcuucacauggagguuuugccuugcacgcugggacaaagcucuguggcuguauucuuucagacaucuuugaauguagccuaguggguguuuucuuguuguccuggaucccuaauugcucgccaaugccuucuccaugucuucccagucacauuuggagagggagggccucuggccuuuccauccaggcaggugcuaggccaugcucagucaguauggcuuuucagaguccugugcuuuucaggauauagugucaguucuuuggggcucuuauaacaaaccagcucauacuggacaguuaauuuguagacaugagaaauuuacuguuuguacccacuuuggagcugggagucccagaugaagcagcuagcacauugugagucugacagugucccuuuacucacacuugguguguccuucugugaggaugggcuuuagaccuuuauuaggcuaccuuaucauacaccauuccaguuuuugguggggacuucauaaccugacccuaggucacauuguaccaacacuuuagugaucauaguucaagacacgagcuuuagagggacacagcuauucuaaguacagaacacuguuuccucacgccacuuguacacagguauucuguggguacugaaugugacaucguugucauaccuguacaaaugcagccugugcugggcucaaggcauuguuuguguauacaggugauacucaggcugcucuuuggcgcuucuuaggugaacuaccaucuuguacaccccaggcuuuugcuugggucucagcuugguuugacuucugugcuagucguucuucauugcuuugacaauuuaccugaggaaaguuaagagggaaggguuugcuuuggcuuaugauaccaagguaucagaccgugaucaguuggucccgugguguggugcaaaccaucauggcaaagcaaacuguugugcuauaccaggggccaggaggagaacucgggaaagagucgaauauauauauguacacacacacacacacacacacacacacacacacacacacacacacacacacacacacacauauauaaucuuuuaaagcauuucccuaguggcuaacuuccuccauuuaggccccacuggccgugcauugugaggucaucaguauccauugauaaaguuagcaccccugugaucgauccuuucauuucaguagugccaccaagccuucagcaaucucugggcauaugcuucaucuccaaacuguaacaccuucuucugcucuucuuuuuauuuuucauucugaagcacuuaacaaguuuauaagaguacaaagaaguguucaggaagacccgguggaucuuucagaauuacaguguugguuugggcacaacacuuguagcuagcagagauucccagaugagugagugagaguguguguguguguguguguguguggcuuuauagugucaccauaagacuuguguucccucaguagcucuccccugucucccucuguuaucuacuuccagucacaccaaucaggaauguugcguuuauaggugccccauacuucuuacuaccuguuauauggauuucaucucauucuccaguuuauagggauagaaguggauguggucauuucacugaugaaaugucauuguucccaacagaaucugcuguaccacccaggaggcuaauguagguggggugggcuuagaauuucugaaggguccuucccuagugagucuuaauuucaaguggaaaugucuucuccugugaaugaauuucuugggggugggggaagcacguuuggaauaaagggcacugccaaacugguaacuguguaccugcuuguuggaguuucucaugagaucuucaggacaccuggcuggguuguauggacagaugaaccuuggcucuugacuguauaguuggaggguuucugggacccaggugaguacagaaccuuuuucuggauuaagugugggcuuaauguaaugaccugcuugguagguagacccccccccugaagugccuuuggaggguacagagccagaugauaucugagaauguguucccugcagcacugggugugggcugagucgucccuggcccuucaagggcaggccagauccacaaaucugcccuuccuucccacacaguugggauuccauggucauaggccagaugcugcuacugcugcugcugcuguaggcuagugaggggcuucuggaggcauucuuacauggccugugggaaauuaauccagauguucuguagaucauucuuccuaucuucagcacauucgaggggcauuuuuccugagcaaguugaacuacauucuuaagaacaguacaauggcuguugguacaaggggcagguccugcagccacaccugaucucggaaacugggccccugaggcucaggcuuggugggcaggcuucugggucugaguguggcuccacucgugggaugaggugggucaggauuugggcauugcuugggagacacugcugcucccugugguaugucugucuggccauggccaguauuuuaccuguuguuggccuccuggacugcauuagaauaguugauuuuuucauacucucuucucaggauugcucacaccacuguacaccuccaucucugcaaguucuuuaccauugaguuugaguugggaaggucgagcagagccugggguuugcaccagacacaccucagaaaccuguacaauccacgauugcccaaugccuuaacuuguuuuaaauuaguauggccgaguggcugucaggagauguaaccguguggugguuuuuaugggcugcuuguuucugcuuacgcagaugauagcugaaucuuugugucccuggcuuacaggcucuacagacccugcagugaggaaugcggagcucuggggguuaacucacugcucucaccuggaggcugcugcuuccuuaggcagccuguguuaaacaaacgacaugcugucuagagagaaggguguuuaaauuaccuugcuggacucccaaguugccaaaaggaagcccucugggguaugauauauauauuugacaugcauuugcaguguguaauuggaaccaugagaaagguuuuuguucaaagcuauugaacaguuuccuuauuuuaaaccuguugaaucuggaaagagcuguuuuugacuuucagucugauaaugauuauauaaagguugaaggcaaagaguuucuuguuccaaaucaccaucucccuccccugagcccagcuuugugagugcccuuguaaccaugaaagauauucugacuucuguuucccagaucccugaauaccagagcuggaaacucaaugucuuccuuucacauggcagaggcuggacagcccaggaggucaccccccccccccccaggagcagcagaccuaggcccaaccugucuuugagugccaggcugcuacucucacaccuugggaugaaucggaggcaacagucuagcuucccuauuuuucuguuacaggaucagccauugcugucuuucccacguuguccuuucuacaaaucaguuccuuuccagugauccguaucauagcauccugcccuuacuaggccagccuccauucaggagccagucguugguggucauugccucaugccauauuccuuguuagcuccuggugugugcugugcuucuguggaggaugcuuuuaaguaucucagcacaagaaaagccaggaugcugucccugaagacugcugacugggcugugggccagaauaggggaggacugucaggucuuugcuggacagcauuggcaccuaugggugccuguggggccugaggcccuaacgagcuuuauuuccugcuuuucuagcuuagaguuguggaaggacacaggcaugagagucucagcauaguuugacaucugaagguccuggcugucuggagacaggcaagaugugaguggguucuuggagccugcaacuccuguggucucucagauggaauggguaguuagaaccaucagguauccucccaggcaguugguccucugaacaguaaauggaauuacacucugagaaaguccaccaagacauacuuuuaguggauucagacccaucacuugauuuccuugcagcuggcuaugucaacaaguccccgagaagggcuaguuucccaaauuaucuuacuucaguuuggggacagaaaccugggugcuguggcugggcuggguauuguggugugggaggucuguguuugccuguugggguugcucguggguggcaccaguuuccuggcaagguguaggagagaugugaaguggacauggagagugcugacacugccacuugcaguugucugucuggaaauugauuuuguccuguggagugauaaguugacacuuagagaacacauccagguuucccugaggccagaggcuugcuggcuggccuugcccagagcaucugggcucuggugccuacugagcuccagggaguccagcuggcagugacucuacgcauauggaugcugcccucccacaggugccacagccaaucuucuugacauuguuugcucccuagugggcaaccuguuaauuaacagaguuguggauucgagcuauauacuaguaaacugggaguaguuccgggucagcugggccuguuucaaugaacagaggaccuuuucagcauugcagauuggauauaguucaaauugagauaacuguagauauaauuucuaauccguagcccucaaggugguugucuuuugcuagguugauauuuaaccaucagcuccauguuuggggggaacaucaaguguuuacaggaguaaugaauagucugucagauaacuggguucagcuucuggcuuccugcuggucugcuuccugcuccugagagucugccuguuuccuggggugcagagaagccuuguaggauaagggagucucugggacauagucugcgaugggaauucuggcagaguagggggacuguaaggcuaggugggaacuggggaggaguuguagggaucucaagaaugcugugaaggagcuggccuuugugaucacacacagagugccucuggaaagcacgggaaauggggcugggccgagcugacagaguggaggagcuguuucuguggauggagcugacucagagauuggcuuugaagaggccaggaauagcuggcccuacacuaugcccaagacuccaguguggccacuuauaugugaaacugcugggaauguggacucuaucuuggacaucuagaagcuacacucacauuccuaaugcugugauauuugucaggggauaggccuuauuuggggguucucagcaggaccagcuuaggugacuccucaucuucaugaggacucacuacaucccacauuguucccuuaggauguccagggccucgugcucucucucucgccugugcacauuuuuacagccucugugaaauaccacggcuaugugaaauagauuccauugaacaauuacuauuuauauaggaaaauuuagaagcagaaaggcagagauuugguuuuauaacauuaauaaugacccuucagggcuuuuguuuguuuuugguuugguuugguuugguuugguuugguuugguuugguuugguuuuucuuuuugccaauauauuucuaggugcuauuuucugguggauaauugcacaugcaggagaugggcaccucacaugcacauagcuaagugcugccucucuucacacuguuuguagacacaggcuugguauucaugcguggugaggauguagacagagcacagguucugaggguggcgugcaugcaguccuagaagcagcaugguucugaggguggcgugcaugcaguccuagaagcagcgugcuccauuuaucuugccuuuggagacccuggacacucacaugcccuuugugucugcugccgguauuugacuaaauccuugauuuaucuaucagcugugaauccucccuugguagccuucaguguuugugucgagcuucugccaguaagguuaaucauugaaccccaaauugcuuugaaacccccgucuuuucuuuuucuuucuuucuuucuuuuuuuuuuuuuuuuuuuuuuuuuuuuugguuuuucaagacaggguuucucuguguacccuggcuguucuggagcucacuuuguagaccaggcuggccucgaacucagaaauccuccugccucugccucccaagugcugggauuaaaggagugcgccaccacgcccugcccccuucuuuucaaggaacacauagcuacagacacugucugagcuaugaugccagcaggaggcuccucugucucuguagguaugacacuggacauugaccccagggccacacacaugcaaugcaccuagguucuguaccagugaaccauauuccuaguccucaaauuauguuuuaaacacauuuuaaagauaccagugagagcugcccaguguuccuuacuacagcacgguugucuaacugggaucaagaaauugagacuuucagcaugcucuuuuagaaaagucuacuuagugugacuuuaaaagaauagccuaucuuugcauuguaaaaaucaaguuuuuuucuuaaguuuuucucuguugcuauuuuccauuacuacuuuuuagaggcuuuuaaaaauuaacaauugaagcugggcggugguggcgcaagccuuugaucccagcacuugggagguagaggcagguggauuucugaguucgaggucagccuggucuacagagugaguuccaggacagccagggcuauacagagaaacccugucucgaaaaacaaaaaaaaaaaaaaaaccaaaaaacaaaaaaaaauuaacaauugauuuucuuauaaaauuaaauucuagacugucgagauggcucagauaaggccacuugcuaccaacucugacaaccugaguuggcugcuuggaucucauaugguggaaggagagaauuaauuccugaaggcuguccucugaccucuaugccugugccaccuguacaugcauccaccacgcccccccucccccacauaguagauacauuaaauuccuuuaugugguucagaaguguaaugguucggcuuuaagacguguauacaucuuaauaagcagcucuuuacaaagaaaugaauauacagaacagaauauacaguaacauuuguuuuuccuuuuucugugguauauguguaugugugcacaggugugcacauacacauguguauuuguggaggccagggugcaauuuugggugucuucuaucucuuucuacuuuauuucuaauauaagguuauucacugaaucuagaguugcaccuauuuggugagauuagucguccagcaagccacggggcuccucuuacaucucucuguccagaguuggagugugcagcacuauccuggauuuuucugugugugcugcagauguaaacuuagguccucgagcuuacguggcaggcacuuuaccaauggagccauuuccucagcccugauugcaccuuuuguuggcgcacagcuauagaguauacaguacuggaugucaaaaggacauuuucauaaaagugcauaauauacuuuuacugaguuccucgccauaucccccuccuuuucccuccuuuuagcucccuucuguuuucccaaaugguuugcuucugcuuucaugucauguguauacaugauuuuugcauaaaaucuaggauguacaaaugagagagaaaugugauauuuaucugagcgagcuaauuuguuugaugugauaaucucuaguuacagccauuuuccuguaaauagcaugauuucauuuguguuuguuuuguauguagaguguaugugugugugagagagagugugcgugugugugcauacacaugugggagucagaagucaaugucagauaucuucuguugauguccaucuuauuuuuugacagauucuuucacugauccuggaacucauagauuuauuuggcuaugcugguuguccaaugagcuccagagauccccuugucuccuuguuuaccaagagcuggggucacacacccuggcaugcucggcuuuuauauaggugccagagagcccaugcagcucuucauguuugcaguacagauacuuuauugacagagcccccugauuuguuuucacuuaugguggaagaaaaccuaguuguuuagauguacuauauuuccuuuauccauucuucucuugauggauaccuggguugguccuauaauuuagccauuugaacagugcugcagauaaacccugaugaguguguugggcauggaggcacacagcuuuacucccugcacuugggaagcugaggcaggcagaggucgaggguagccuagccugauuuacauagcuaauuugaggccaaccaacuagagcugcauggugagacacugccuuaaacaaauaaaacaaaaagcauuggugagcaagucugucugugaugugaugacuuaagaacccuucaaguaaauacucaggagugcuaugaauacaggaauaacuuaauguuccaguauucuugcauacaucgccucuuuguaucaacugcuguguguguguguguguguguguguguguguguguguaugcgugucuguguuugugugugugucugucugucucugugcaugcauauaugucaauugccugguuguauauuuuuacuagaaccaaagaggaauucauaugacuuuaucucuugguuacuauagacacuuucuauggucaaacaagcagacaguccuguacauacaaggcaaccuaggacuggcuuuccagacacaugggugucuguggagguucccucucuggucuaggucuggugccuucuucucucucugagguuguugaagucugugauaagaagauuuggaugguguccuaugguuucacauccauucgccucacuugugggugucaccagugcuccccauaaacacacggcccuuccuauccugcugugggcuucuaaguuuuguacucuguugguguggccacagauuuggcagccuagcuaugguuauuguucugaagaacugucauuucuuuaugugauucuugggaaacccaaauuuccuuuguaccuuugagcugaugggcuugcuucccuuucaggguuuuuuguuuguuuuguuuuguuuuuccugagcagguuuugacuccugucugugauucugccucaugguuugccaucaacugcucuuuguuuuuguuuccugccaguugucacggugauccugaaggcccuuaccuacgaugagaagcggggugccugcagcguuggggccaaugucagggaugcugccuguuaugugugcugggcuuuugcacgugccuaugaaccucaggaguugacaccuuuugugacugccauuucaagguaaugccucuugguugcguucaagagugauugugucauguggcagacgugccucagauaaacauaccaucugccuguaaccuguuggcuuuagguaagccauucucuacaacuagcugccaauaucagcauccuugugcccugccccuccucucuaagagaugggcaagagaggaaaagacuaccuuaucuuguggaacgggacaggaucugcuauguggggagauaggguuccaaacauggcuguccagggaagcaaaugggucccagguuccacuucagaccuuuccaaauguucagaagagauuacaugcaugggaacagaguaaaguccagucacuugaauacucuggagccaucccauagugugcugaggacagagcagauuauugguguugcccuaaugagcaugagaagacucagucggagagcacccguugcaccauccacaccagauggacagacacccugaacugcguggugcccuccuuuggcuccucagaaacagaaugaagcuugaacucgaaagguuacugcuaucccucccaccucccaccucccaccccccaccccccaaauuuauguaccaauugcuguacaaaacugaggagaugucugugcugagggcacacuuguccugcauccuuccaagggaaaggaaaaagaaaaaaaaacuccagaaagucgggcagaagagccugggcaccaugcccaaggcaugauguuucugaggucagaccuggagccgccgccguugccccuacaccuaggacccucagguacuggagucuagugaccaggcaccugccacuccucgucuaagaauacuuucccaccucacagagcucuccaguacuauuuauucuuuaaguugcugaaugaaggugagguggauguggccacacaacuugggaaaucagaacagacaaaaccagccucaggaaaagcagauauuccaguacuucccagauaccugaaagucugagccagcugcuaaauuuccaggacccccuagaacauccuuauggugcuacuugccccucaccucauuucaagacucagcuccaggacauucccccuccaccccccuccucccuccacccccguuaccccccucccugacaucugacuguggggucuuucagaagggagcuguccuggaccugucucauucaauggagcauaaacauauacugaugaggcacaacucauggggaccugacauaugcacaguuaccaggaagcugugcuguugguuguagacuugguucugggugggaaggagcaagagcccagcugcccagggccuucugcugauccucaggccugguccauagcugugaccucccugcgucccauucuguugccaugcaggugcauccucuguuugcuguuuauguggcugugagggagguucuugcaacuguuucuuguccucaucuucaacuugcauaaguagugaacaggucuuucucuugcucacaccugccccagagcagcaaagcuccuuuacacgacagggucugguucaguucacaggcucugucagguggguagcugcagucaggcuuccaguuuccuccccugaagaugaaaaguguugaguaggaguuaggcauagagccagaugugacccugacgugacccugacuugguaccagugaccugccaggagauggugaaggaugguaggaccuuggcucugaugugcauuugcuuccuguuucaaaauaaaaacaguccugacagacuguguucggucucacaguuuuguucagagagcagcuacccccacccccaggaugccauggcucguccuucucccucuucugauccagaauggaggaagguggauggccugagggagggaaucauagaguaaagggaacaggaguugaccugcuggcccgggagcauguggccauguuagagggggcauuagguuagcucucucaugcuucauuuuuguuggguguggggucucaaggccauucugccacuucggaaggcaggagguacagaggagaggucccuguagggcaccugguccugagggaaaagucggggcuacacaguucccaccagagugucugucuucacucugugcuguagaacucacaucacagcaaugauggaucccuggguggauucaguaaaggaaauggacagucugugaaaagcuuggcucugaaguuggcugcugugucuuggugcuauggcuguaggugggucuuugggcucugcucugucuucuccagcuccagcuuucccuacgcuuagaacaguauggugaggagcuuccauggcugcugaaggaacaugguaccuucuucuucagagucaccauuuaccacucagagaagaaaaggcaacugcacagcagagccaagucccaucaguggugacuucucaggcuccuggcagucaucacugcucugucagggucauggucauaccuggcuccaugccgaccuccuacucagcacucuguucucuuuccauagugggggaggggguggggagcacaaaaaggcucucugcucuggcccugcacaagcucuuagccacgagguuacugucugaggacuguagaaggcggcccugacugagccuggcacugucuucccagaacuuaagugaacuugcuugcucugaguuaggugugcuguggggagauacgaggcccucuucauguugggugugguguggagagugcggcuucuguugagacuuagugggugaacacagaagugcccuucacuucacauacagcucagucucuggaaugacccugaauuuccuggccaaggagaaguuguuguacagccaucucuacuucuagucuguagaaacucuuguggguccacguguuucuuugggcuuggggagucuagacuugcuggcuuaugggacaagccugagggguugcuggggaacucaugucugcauguugugcguggaaacuguagcugucugguugcagggcugccagccucugcuucacagccaucugauucuaagcuggcagccagcagaugggcagcagugcccuuuggagcugagccgcugcagauuucuagccgguuagacagguucugaugaaccugugccuggcccuuccuggcccaucugacuccaggcaucagcgggggagggcauguggugagucaggugcgccagugagcuuggggcauguacuaccuccugccugaagcucugugcgucugaguaucggucgggugugcccugcagaccugcuugugagguucgucaugagugaccaugcucuuuaauuaucagguuuuaagcccauuauuucuagccgaugauaaaaucuugguaucuuuacuuucauaaacuccucagcguauccuguaccaguacaguugagauccaaauauaguuuccagaguaaaauagagccagggaggcgcuguggggcguccugcugcaccucagugccugaugcagggaaagccacuaaccuuuucuaauuuuggguugaagaaacuggauuaacuauucuuacccucacaguguuaacucugcuuuaggaauuuuaaaagauuuucaaggcauauuucuaucuuuuugaaauuguuuugauugccuuuugaaaccaucuuucuuugucuuugagcagacggguggagccagaauuuaugccacuguuuugcggcacuaucuggccuccugaaaagccuggugcaaggcaggaguaguaagaugugguguggaaaggugccggccugguuguguguucuguaggugauuccuucuaaccagaagucaaaaucugaucuacaggaaggaaaagaaagcaaacugucugcugcugccagagcacccugccugucaccuucuagcgauuuccucaccugaaacucuuuuguaagcugagcuccuguugacguucacuccgcccaggcacagacccgccugugccaggggcagcuccugacucucaccuccacugugcaaaccggcagggcagcgugggcugccugugaacggccugggauuggcucuguaggaucucuuccuucagggcaagauuguccugaaaaaaaaaaaaauaaggaaauagcaagcauugcucaaagcuaugucuuauucuucucagccucucugaauggcccaacuuccagagagaagaaaacuguguugaggagaaggccagcaauuggagacagucuuggucugccaggcccaacuuuguacuggcuuggcugugaccccaaagcacaugguucugcuuaugacuuagagaaauucaguaaaaugcaggguuuauauuuuaaugugacuugcaacugaaaaaaccauggaguuucacaaugaguuauuagucuucucuuuaaaaaaauuacuucagaaugcaaauguugucauuucccauguagaggcaagugugcuugcuuugaaacgcuacucaguaucacacaaaugaaaaaaaaaaaagaguuuggggugaaugcuguucucacuguguaugcugagccaaggucuaagacugugggaaaggagaggggcaggcuaaggcuugccucucacuuucccuagguuuguaccagaaagagaaucccuucugugugguuaaauccuggugagcugucacagcuucccuagagaaauuaagcagcuggacacacccacaaacaccucuccucagaugguggcuuucacuguggugccagguguugcucuuuagguuuucucugaagugagagagaagaguagugacuucugcaucgggucuuccugcuggggaugagcgaggcccaggugaaggguaguaagcaugaacaguggcuuaggagagcaguggcuuaggaauagacuucccuuuucuguuugacuaauaucauuaaaccccuuugcauucaaaacuuauuuuuauuucuaaauaagccagucuuguucugaaaguaggaaauuaguuuuaaggaauuuaguccagagcuagagagagggcucaguggcuaagugcacuggcuguucuuccuggguuuguucagugcagcccucaaagggcagcucacaacuguccagucccagagacucuaaagcccccuccaggcacguucagacuuagcacacauguguuacacacaaacacacacacauacaaauaaguaaaaaguuaaaaaaagaauuuagcccaaauugaaagucuuuaaaaaccuguuaugguuggguggugguggaacacaccuguaaucccagcacucuggaagcagaggcagacagaucucuguaaauucaaggucagcuuggucuacagcuuggugagggugcuacacagagaauacacagagaaacccuguuucaacagucaaacauuguuguaucauaaguacaugcagauuuguuuuaauuaacuuaaaagcuuacuguuacuuaaaaagcaguguuuuccaaguacuguuacaguuaccacaguguaauuucugaaguuugaugaaacauguaaauccugauuuguuccuguaaucuuagcacuugaggggcuaagggaagagaauuacugaguucaaggcagccugagccacagaaugaguuccuauccugauacccuguguagcccuggcugucuuggaacucacucuguagaccaggcuggccucgaacucagaaauccgccugccucugccuucuaagugcugggauuaaaggcgugcgccaccacgcucggcucugauacccuuucuuaaaaaaagaaagaaaauaauuaaugaagcagugacuuuuaaggcauuugcuuaaggaaaagcuaacuugauggaguguaugaggcugcugcuucuguggugacaccuguuacauacagacuuucucugugcugacagccaguauuggacucugacauccugucccacuccugacuuaccgcucacuuugcuuacucauaccuuggagaggucugcauggagcaucuuguguauguuccaugucagagaccaagagccgucacuggcaaucucacugcucagagaagaauggcugcaguguuccuaggaucugaggaucaugguagcuggggcuuuugggagcacacagaccagugacagugguugugggaaggguggccccauaagcaagguagguggcuaaggccugcugcaucugccuuccgacugggcaugguccgcaucucggggcuucuugugucagugcugagcauaggagagauaccuacagauucaugugcgugguacuacucagccacucacauaccugagaaggaugaguaggguuagaagugucccccccccccccaggagcuacccuaaucccaccaccuuaucaggucuuauccgcagcuguagaacugccuaguaauaaguggaaagugcuuuaggaaaaaugggcagagccccaccccucagagggaggaagugaaugagucucaugcugacaucagcuucuugaacagcuauggcuuuaucuccacaggcuacauugcaguugggauucuccucaucccgugcccagugccuggauggguagaauguguagagggcugugaacaggcagcuuuauuuucucaacggccugacuccucuagaaugaacacuugguugaaauuggacuuugguccguuugcccgggcagaguaauauucuuucuguaccuaucuucuagauguucccugaaccuugaggguguguguguauguguguguguggcuuguggguugcuaggagcccucagucagcuuuaugaucugaagacuguucacaaaagcugcuguagugugcucaagguagaaacaauuuuaaaauguucauggugagguaggaugaacccucucuuguuucagguuucucugcuucucauuguggcaaaguauaaaucccacaagccaggaaaguugugccuccuucccucucccauuuuccuauuggaauuaaagacaguucuuugucaccucucuuguugcacaaguucucuccuggagcacauuaccugcuuagcagcguucugauguuuuuaacauuaaaauuaaaguaagugugugugugcgugugugcucaagugugagcgcuuguguuugaagaccuguguguggaggucccaggacaacuugcaaaggguugguuaucucucuuaccaugugcugcgacccagggaucagacucaggucauugggcuuggugguaugcugagucaucuugcuggccucaguucuuguucuugaggguuucuguuuuuguuuuuguuuguuuguuuuuacuuucuggaccccaaagaccuucugaccuuccaaucauuucuguccucuggugaucccugguugggauuuggagucugggaggguagccaguggucucacagcucuaucuccugugcuugaugcgcagugcccacugcaugccugguaaaguugaaaugagauugaaaacuagacauggcuggcccgcgguccuugcaccuugcuguuugcugagaaugucccuggaaugugggaaccaagaagagggaucccugacgaggaaaugcuucccugagaaggguuccccuuggagggugggacccauagcaguaacuggcgguggaugcaggagaggugagaggccugacauggagaggagcaaggaguuucuaguuucgacaguaaugaaguuugguauauguacuggcuaguuuugugucaacuugacacagcugaaguuaucacagagaaaggagcuucaguugaggaaaugccuccaugagauccaacuguaaagcauuuucucaauuagugaucaagggggaaaggccccucgugggugggaccaucucugggcucauagucuugguucuauaagagagcaggcugagcaagccaggagaagcaagccaucccuccauggccucugcaucagcuccugcuuccugaccugcuugaguuccaguccugacuuccuuggugaugaacagcaguauggaaguguaagcugaauaaacccuuuccuccccaacuugcuucuuggucaugauguuuauguaggaguagaaacccugacuaagacaguauauaagaaaaagacauaauuaaagccugucgagugucuugggagauaggaaaagucgagauaguguggcguuauugcuucuggcuguaggaaggauugagaccuagcagcugccuuccaugugcuguuuccauggugacugcucuaacuggcugccugccuguuagcagguuucucauuacuuuaucaaauacuugcaggacaccacuuuauaaagaaaaugcuuauuuugaccuguggucuggguccuccugggucaagaggcugcaucuaguagugaccuucuugccaggagaguugugagcacuaguuucacuuugaaaggggcagagagcagaguuuauggcgugucuucuuuugugaaacccagaggauccagccuuggucucuaucccgcugaccucaucuaguccucauuaugucccauaucucucaacccagauguggacagggcauugccccaucaugucucacacugggucagaccugugggaaauguuggaaaccauauguuuggguguuuccaagggucaggcugccugcaggguauauggagcuccugcugcucagcguagagcuagcugugaucuaggcguguuggugucagccacccaguugugaccaucugcacacggccaguucucauccucuggaaccguuuaucaugaucccugcaggccaaaggcauuguucuccaagccacuagaggcucagcguauaccauccaaggacguuugauagggcuggggcuaucuauaauguuugauaucuucaagguuaguugugaaucgguuguagccuguagaaccuugagcuucccuagagucugucaggcucauccgggugaccagcaagugaggaaaugagugaacgauguaacgauggcacacgguguaugccugugcuuuguuacgugugcagaaaacaacuuuggguaucgucgucaggaauccaccucuguugagacagggucuccuguuggccuggcauucagccauuaggcuagacuuguugggcagcagucccagggaaccuccugucuaccucccagcaccgggcuuacaagcaugcgccaccucaccaacguuuuuaugagggaaucccaugcuugcaagacaagcaguuuacugacugagcuauuuucccagcccucgcgcacuucauuuuaauuaauaguuuuccuuguuuuuacagugcccuggucauugcugcuguauuugaccgaaaugugaacugcagaagagcagccucuguaaguuucauuuuccccagugcauuccuuuccuggagguggggcugucgucguugccaguggccuguaugugggccucugucucuuuggaaaacccauaccccauggcagcagaggagagcagaugaaagaacugaguaaaacagucaccaugguaacacuuguagggccuuaacugugggguucuugaggaggucaggguugaauaagcauaggggaacagguuucuguucaauagccagaccaguucaggguagcucaagcucugcagaggagaagaaauuuauucuguguuucuaaccuucaugacacggcaggacugguccagggaugacaggauagggcacuggaggcuccguguuccagggggagcuguuaccaagcuguaguuagcucugcuuucccggccacacuggaguggauaccccugguuaugcuuuagcuuugcagcugccugugggccuuaccuuccgaacucaguucuccaguucccccccgagauccagcguuugggauggguuugcauagagggagcuugaguagcuuuggcugccaacagagauguugguuagagucccugcuccaucuaccuauggcuuuccacuucugggacaguaaugagacugagucucgugaauugcgaggggaagagacagugaaauguuucccuaggguuuccugcauauggggguguguugcagcaguggcugacucuacguaggugacugcugugaucagugacugaggccagguccaugggugcuuugggaggcuggaccccagaggaccucagaugagaaguccaggcacugucaggagugcugugauaccugagcagucugcggcugucuuccccucauagacaggccagcaggcgaacacauucagggauaucgggaaccgaggggaagucucugagacaggugcaggcugagacuugcucuggcugucagcuaugaggaguugggaagacccauggugugaguauaggggcuccuucuacauccuuguuucaacuggucauggagacugacugggcaugauauacuauuacaucugcuuugagacugaggcaaaggucaggagugguguuuguuagugccaacagaugucuaaaauaugaaggggaugcgguugaguuggcaaugucccagauguauucuguguggauaggagccaggccucaaaguaggauggagaggagacuccugaggucagguggaaccauggagcuaggggaaagggaacacuguccugaccugcguguugggcguuguuggugggaacuuccugguuagcaggcugaaaaguucuuuccuguagcuacuuucauuuuguucauguuuuaaaacucugcacaguuauuugauucugauguaaugaaguggccuuugccuuuugcucuggugaugugguucauucuuauucugacuuccccuugaguauagucccuucucuuaugcuggacucaguuugucaacguucucagagcagaaucgguucaugaggguuauuagucuuuugucugcuuuugaacugaaggugagcuagcaucauggagagaguggaaguauuucucuuguauuuuguuccauaguuuuuaagagauugauguuuuucuacuuuaauuauuugguaguauugucuuaacccauucuagcaauuuuuuuuuugaaaaaauguccacuauuuucgauaguuuuuacuuaauauagaucugcccagcuuucuuauuucucaagucaugccuuuguccugucuucuguguuguuaaaugaagugauuugcugucaucacaggcuucaacugauuucaucuuuucucucacuguggccccugucuugucccaucgccugucacaagugauggaguuucugucuuguaacuuggcugcuggccucuggcugcacuuuggcggcugugugcucagguccugugugccgaguucaugagccauguacguggcauggcagccaguguauuggauucucguguuugaagaccuacuguggagggcuuaggcagcccagcuguucccaugcugcaccauaggcucucagccaaggggcugugccucuggcauucuggucaggugacuugugagguuuugcuggcucaggaugccuguggucuuccauggcugcuguuggcucucugccugcaucuguacugagaagcaaccaggaugcaagcacuccccagaguccuuuaaaacugucuguguccccacagggacuccauuuugucugcaguguuaguaggaacccauugauuucuugagaggucuuagcagucuugccuucauaguuaacugauaaacaguaacuguaagacugauauauaauacaauuuuauaauaaaucuguacuaauauauuuuuauguuucauuuauuguuuucuguaaccuaagacauauuugugggaagcaacaauaaaauaaaguccuauggcuuuguguggccugguuugaagugaaaaacaaauaaaaaacuucuguaaaucagguuuuuuuaacuugaaauuaaaacccuauuaaacuagcaagaaauucuuugcguuccuuuugaguucagcacucuuuacagaauagucuguaggauuuaaacagaggaaggugagggaugccucugagugagacucauuugaaggcauaaggguucucguagugacagaagagagucucacgaagaguugcuucuuuaggcagacucuccaguuucacauuggggugugugagaugucuggucaccuggccagcguccaggagguugagcaguggagcaguagagcauccacaaguucccaguucuguggccuuagcuuucauuugaugauuuuccauagccuguucccuggcuucuugucugguggcuacagugcuucuaagguaaugaagccauuguuuuggauccucauuagaggugucuuucugguggucagcacucaggagcuggauaguagagaccuggcauggcuuaguggaaagaauuaguucaugguugcuaaggacucgagguuuugcauucuagacaguaucuagcaggccagauaugcugacuuugugaaaaggccuguuuuuguuuuuaauuugcuuuuuugucuuauauuuugacacuauugagauuuuccccgaggaguaauaagaauacgggaaagucugagucugcguucccuugcucucuauuggguaaccacacaugucuaagacaacucgggaguccugguuaggacucucaguuguauauguccugugcacaugguuaguucugugaggcuccaucccacacauaugugagaaucgccuacaaucuaggcacacaguauuccuuaucacagaugucccuacaugauccuuuuaacuacuaccaacuaucagucuacuuuccaaucuugcaaugcuguuacaucacuaaagugacaguccuugggacuggaauucucacuguguccaguauguugggaagucccaggccauuaaauucuccugugagcgggucuguucucugagugagcccugguucuccugugagcagaucuguucucugagugagcccugguucuccugugagcagaucuguucucugagugagcccugguucuccugugagcagaucuguucucuguucucugagugagcccugcugugucaagccacuuaccuguaaaagggccucuggguuguggcuugcucaggguuacuaugaacaccguagugagaauucuggaauuuuuguuucuuuagaaacagcaguauuacggaugguugugagccaccaugugguugcugggauuugaacucuggaccuucggaagagcagucgggugcucuuacccacugagccaucucaucuagcgcccucuucuggagugacugaagacagcuacaguguacuuagauauaauaaauaaauaaaucuuaaaaaaaaaaaaaagaaacagcaguauuguaagaauguuuucgauuuaaucccagguguggggacaugggcuacuuuguagcagccggcuaugauuuuccuugugcucuagcagacgcacguuuugccagaugcagauaguuucugugaauauaugauguuuggaauucugagaaauuuucagaggacauauaagugcuagagcccugauaggcgggguuggugauuaauagucauucaaggggguugguuguaauuuguuaguaguuguucucaaagaagaaacaaagggaaagaaauuagaucuagggauucucugucucccuccucccuccuuccuccccccucccccucccccucccuccuccuuucuuuccuaucuggugauaggaggagaaacaggguagggguaaaagguugggaaaaagaagaaccaacaaaguagcuaagacuagcuauagaacccuuucauacuggcuuuccugugagcauaguuucuguuucuuagguuauaugcauagaguacaguuugugggacccaucuuuuaggaugcugcuagacagugccugucucuaggauucuagcuguuccccaggguggcuguacuacuuacuauguauucucccaucuuugcuaacuaaggcaugugucaccuaagaugggguugccagauuucuuccuggguuacuacacuauuucauuuuugcugauaaguguguggugguuuucguuuucuuuccugugacaauguugagucuguuugggugcucauuugcuaccuguguccuccugaguaagaugcguucuuucaagucucagucauugucuagcuggauggcucauuucuguuguugaguuucaaggguuguuuauggacccuggauaucugucuuuuauggauauguguauugcagaugcuuaguacaucuccaugacagcuuucagucuuguuucucuguuucuuuggugagcgcuuucagugugagggcuacaaaccacuuagcccuguucucagccuuuucuuuucucugcugugcugauagcacauucugcagugaugucucuguggucucccuucauauuguguugggugauccccuaaccucuuaguuucaagauuguuucaacauaaaucuuguauuagguuuuacuuggaagaugauccugcuugcaaauguuacauuguauuuaaguugacauuguauuucuuuacaucaccuuucuuugguaucuguuucuuuaagaauugguugcaaaggccaggugaugguggcucaggccuuuaauccuagcacuugggaggcagaggcaggcagaucugaguucuaguccagccugguuuauaagccagggcauccagaauuauagagaaacauccugucuuguaaaaacaaauagacagaugaacacacacacacacacacacacacacacacacagagagagagagagagagagagagagaauauugacugcaagaggcuugaguaauggcucagcggugacgaacauuggcugcucuucccgaggaccccgcuucaguacucagcacccacaugcuaccauccauaacaguucuaaggcauccaacauccucuucugaccugcgcaugcacuaggcaugugugucauaugcauacauacaggcagcauuuacaaacaaaacaaaaugaaauauaaaucuuaaagggagggguugcagaaguuacaaaaugguaagaagcaaaaaguauccuguuuuucccucuugaaacuuguugguaguacccugacccccacugugaggcucugugauuucuggagauggcacacauuucugugcuggugcuuaccaguccugugggauccuugcacguaugagugcucucagcccccuaacccauauugggaugucuaccuaggucagggguguuucuucuguuaccucugccaccucugccuuacgcccugugccugacccaccucugcuugccaggauggcgcacugugcgaggcuguguguuacuucucuccaucuccauaagaagcuggugucagcgccugacucuaaucccgguugggacucagccguguaugcuuuggggaaaguucaaaccccacugggcaauaagccaggcauaaggggccauugucauguuggucagacaguccuaggucggacaucgugagagacagggaaaguggucaacaaagaaagaagagucauccguacaagguuuaccuagaaguacuuaguuuucuuuacguucagaugggccgcugugagccccaacuuguuuguugccuggcauguaggccucagguagcucagagagcugguuggaaacagguuugcccucuaggaggcagcgcugauauguugggaauggugaugaguugugaucaugggguuccuaaaaauggguguuuuaggaguugguuucuacuuacugaccuguauaguuuguucucagaguuaaauuccgggaucuuccuugggguguuagugugaaaauguauuccuagugaaaggucacugucagguuccaucugaucuucuaaauagaauucuuacccuguggcuuuaaagagcacuaggacauagcaacagugacaagccaccccagggcucuggucagccaacaaagagggcuuuuauuuaaaaagugaagccaugggucauuuacacugaacuguguuuguuuugaauuaucuucugguguuuagcagaggcaaaccucacucaccugcuguguuuguucucuuugcuccucaggcugccuuccaggagaacguggggagacagguauggccacuuuauaaaucuuuauuucugaaacuuccuguaggcuuagagguaggaacccuggcagcuuugguuucacaucuucuucuacuguuggguguggguaauggaugaggcuuaccucagagcaagcuaauaaacauggcaguucugguccaagacucaccauaaggugaccagggagcacugagucccacgugucuuucaggaaaccccgugugagaguguuucaggcauguucugauuuugccucacguauuguugugggcuauacacgugucaggcaccagguggcuuggaggagguggcugagccccuggauccuguaggucccugaccgucccuagcuugugauuuggaggcuggcuccuccugcucuugauguucaguaguacuguagcugugcucgggguugcguaaacugugcccauuacacagcugauacccauuacagaccuugaaagaaggguuuaaauucauccauguauaagauucuguauaaaguuggucuagcaggagacuagagagggauuagggcauugguucuuaaucuguggguggcugccccuuuguggguggucuaaugacucuuacacagagguugccuacgacugucagaaaacacguaucuacauuaugauucauaacaauaucaaaaucacacuuaugaaguagcagugaaaauaguuuugugacuggggaaucacuacaccacgcggagcuguaugaaagguuccaagcauuaggaagggugagagccauggguuaggguccgaaagcauuaggaaggcugaggaccauggguuaggcucugaacaaggugggcagcugccagcaugagucuggacagggaggaagagucccugagagaaaacagcuaagaaugacugauuuaggguuuuaucucaguuaggguuuuauugcugugaagagauaccguguccacagcaacucuuauaaaguaaagcauuucauuggggcuggcuuacaguuuagagguuuaguccauuauugucauggugagaaaacauggugcuggagagacuucugugucuggguccacaggcaacaucaagagacugugagccaguagauuugguuugagcuucugagaucucaaagcccacccccuagugaugcacuuccuccaucaaagccacaccuacuccaacaaggccacaacuuaauagugccacucccuaugaccaagccuucaaacacaggauccuguuugcaccauuucuauucaaaccaguuucuugagugcuuguuaaugcuacaagugaggaaggcagaaggauagcccugcgcuaugcugaugugaagaguagacuugugugaaggcugauggggcuuagagaggucaaugccaagaggggugugcucuaggugagagaaccuggagauggcuugggucaagaauauugugaggacagauagaugugucuauaguagaggaugcugggcgugguccaggaaguaguaggccugcccagaggaauggacuccuccacuggguuggucuacuuaugaugaaggucuugacaccagcauuaauuagauccuggccaagaucccugaguggcuaguugagcaugcucuauagcagggauguguguguaugaaugucugcuagguucccuugcuaucgccuaggagucuuugcagguuaugauuaaccagugaguaguugccaugucuaggaccagcaugaggaugcaucauccuguggcugcuuagaguguugcuggguuacagcugugugcuggugguuugcccagaccccagacgacccuguauucaagugagaaugcuagagugugagugcuuaguccccuuucugggaaggaaggacagcugucuggccaggccgagccuuaggcuguugcuuauucugguugagugauauggguacugcugagcacaguucagaccuguccuuccuucucggccacagccaaaccugugcuugcacuugcuugcccagucaugugcuuuggucuucuugggaauccggcugcagucauaguaacuuuacuuaggcugugggcuucucucucauauaugagagaaugagucuggggucuccuugauaaauaacuauacaauccaaagcauuuuuguaaagcaaaagguuucacuuaugcagaaaagugcgaagcuacucaauccagcaagcaagcacacccaguagggguccugcucugcuuuuaaccccagggugagggauucugugcccuacucugggugguuugagugguuggaacuaggacucauaaaacuuaacaggcuaauucaaaacggacuagcauuuugcuagggagaauagaacuugaacauguaucuugacuuuaagaauauacuaaucugggggcuagagagauggcucagcgguuaagaucacuuacugcucuucaaaagguccugaguucaaaucccagcaaccacaugguggcucacaaccaucuuuaaugaggucugacaaccucuucuggggugucugaagacagcuacaguguacuuacauauaauaaaugaauaaauaaauaaaucucucucuuuuuuuaaagacuauacuaaucuggagauagucuaacuuaguggugucuuuaccaauuucucuaaacauggaacuacuucugucuucuuucaauucugauaaagacaguacauuucauuuacauuccccacaccaacugugagguugguuuacacaggaagugguuagagcacccagagugugcacugugcagaucaagcagccucuagcaaucccccuccggcucacccccuggacggcuuucugguacauaagauaccucaguugguuguucuccuccugugcugagggggagacagcuugucuuugaguagaucgaucccugugugagguaugggauguggcagguaggugcugguggugugugccuggugcuuuucuuggcuuuugccuguuagacuugugccagcuuugugcagagauagggagccuuaucuccuacagggauggagccaccucugggccaauagcuauaaagcuuccuacauacuuauauuugucaagaaaguuauuuauaugguuucuagauuguaauauuuuuuucaccacaaaugauaauauuuggucauaccaaucacgugacaguuuuagggcaggggcuccacaaggaguauucuugguaggugaggaugaggaccugccucugguuuugggggacugauggcuugcuguuagugaugcucuuagagguuggcuguuagcccugagccugguuguuucugucagccacauccauccuuguggcagcuagugagguguggguccugguccagguuucaaagccaggcaggcgcuugccuaacuuccauuggccuuccugcuccagcaggcucuggagggcuaugcuguugucuuugugaccacagagggagaccaagcaccaugaguaagcacuugagcaccgcugagaucuggugucacuuuuauagcauuugaguugaaacgguuuugaagaagaaguugcacugagugcagccccuggugggcaggcagggcagugggaugagcagugacauaccaggugguccuuucccgugagcccuguggcucagccucagccgccugcccguuguccccucagaggccguuucucaccuuucagguuuuuucucuauuuuuacuuuuuuaggguacuuucccucauggaauugauauuuugacuacagcagacuauuuugcaguugguaacauaucuaacuguuuccugauuauaagguaaguuuuaacguguguaauauaacugucucuuugacuugggugucaaaauucaccuucaauauuuccuucauuauccuguggucuguauauaacuuauguuguagagagggaauugagcugagaacagcuucugaaaccguucucauaccaaguucauccugcacgguacacgcuggagaaaugggcaccugcuugugcuucagggcuagggccacacaucuucucuggacauuaaucuucuccuuguccuccugguuggugcuuuucugccuuggaacuguacagggaauagccacaagcacagcuaugcaugcccuucugugugacagcuuucccaccuggugucacacauguauugaucuuucaaaaugacauuuuggauuugaagugacugugauugauuuuuguuguuguuguuuguuuguuucaauaaaauguguuccaaguugaaauuaucugauuguuucucaggugaguaugauagagauauuugaaaauucaagucaagggauaaauauuuaacccuuaacugcuguuuucagaaaucacauccaauuauuuuugcuguauaacauaaauacuagggagcaguuucacacucuaacaccaaugugaaaaggguaugaugcuucgugaaguaguuuauuugccuugaauuaggagaaacaugucaagugcauuuuaaagcauuuuugaccacuguaaacccucgggguagauuuccugacagccaugcugugcagaccacgcagaauuuacaccucuccauaaccagcuuugacagacuuuaaaaaaaagaagaagaagaaaauaauaacuaaaaaaaaacuaaagggugaccagccucuuuuccaggaagaaugcgaucauauuugcccuugccugcauaccauuaccccucaguccagcacuucaugucuguguccacauauucuuuguccucugauuauuagcaugugaauguuguauaugagggucucugcccuuucucagagauucuuagguaaaauagcugguaguuuggcaaauuuuacuuguugcuaagguucccacaccagucuaaaacuuauacauacuuuauaauguccauucuguaaacaugcaugacagggggcuggagagauggcucagcagguaagagcacugauugcuguuccgaagguccugaguucaaauccuaacaaccacaugguggcucacaaccauccauaaugagaucugaugcccucuucuggugugucugaagauagcuacaguguauuuacauauaauaaauaaaucuuuaaaaaaaaugcacaacacagaacaugaccuagcucuaguguguggguuuuccaguacacugggucuuugugacucucagauccgaguaucagauaagcugcuguauuuugaggacagucuaauagcaggcuuuaccauauccuagcaccgcagagccucuggccagggucucagcucccuuacugguauuucucucagucuggauccuagagggcaggauucacagaaaguagcauguguaugguuucuagaaggcugugacuaggagcaagguguggggccucagccagcggggaggugaauguaguuuguccugaggucccugugauaaacaauuuuaugucaguuugauagucgcuaaagucaucuucgaugagggaaccauaguuuugaaaauaacuccauacagaucuggcuauagguaagucuguaaggcauuuucuuaauuagugauugaugagugagggcccaguccauuguggguggugccaucccugggauggugguccuggguucuauaagaaaggagacugagcaaaccaaggaacaagccaguaagcagcaucccuccauagccucugcaucagcuccugcccuguuugaguuccuguccugacuuucuuugaugaugaacugugcuguguaacuguaagccaaauaaacccucucuccuccaaguugcuuuggacaugguguuuguuagagcaauggaaacaggaaguaaggcaguucccaaaugcagugugcuuguucagcacuguguucuggugaauagaaauuggguggcauugggauacuaacuguaaagggcagagggaugaaugaagggugugaggaaggggguagguaccugggcuuguaacucuccucacuugggacaguauucaaggaggagguugcagagaagguguuucugaaccugcuuggucugcuauauugaguagcuucaaaagugguagaggguccccggggaggcauuaguugggccacugcaacugauuaucauuugaguguuaaaggcauaugguagacugaauguguucagcauaugcauuuucauauauuguaauggugcaaaucuguaaauucauaaguguaugucguagugacgcuugugacccucugcugugugcccguugggaauuugaagguucuuucacugaacacaguggucucuuguuuuaggugcuucuaaauugugauuucuggugcugcucagcuugccaugucgaucagcaguuugggcauuuuugaguuuuugucaugauaaacuaagcucuugcagacacuuauuuagaaauguuuacuaggauauacauuuuaauuuucuuacguaaagacuaaccagagauuuaacuuugcaugaaacugugaaugugugguuucggcuucuccauaccuccuugagauuggcagcagccaggcugugugagcaucuuggcauucagagcacucaccugugcggaugaccauguuggacagacucccacaugcuuauugcccuucuguuucuccuuugcugaugcuccaaggcaaauguaggccagguuuuguuuuuuguuuuuuguuuuuuuguuuuuuuguuuuuuucgagacaggguuucucuguauagcccuggcuguccuggaacucacuuuguagaccaggcuggccucgaacucagaaaucugucugccucugccucccaagugcugggauuaaaggcgugcaccaccacgcccagcugcaggccaguuuuuugcugaguuuuauuuuucuuauuuuuuuuagugcaaacuguuugccaacugugccuuuuuguuucuguauauucuaauagucucacugauguguaauuaacacauuacaugcauacaaaguguaaagcuuacugagucugacaaggaggucgcaaaaacugucagguggguaagcugucaggguucugagcguacuuguuacccaacaaauucuguuuuuauuauagauugcuuuucauuuugucuaaucuuuuccucuuaacaugauuauuuagugauucauucauuuuuauauguugugucaagaaguucagauggcuggagagaggacucagugguuacuauugcuguuuuugcaaaagaucugaguuugauucucaguaccugugucagaagguacacagcugccgguaacucuagcuacaagaaagagauccggcaucccuuucuggccuccucagggacccucacacauguguauaugccaacacaggcugcacgcacacauggaugaguauaacagauccuguguguucgaccagucugaugagucuaccugacccuagccuauucauacuauaccuaaccuguaggccuaggcuaggucagacauccuguguucugauccagucuggugaguuccuuggaccuuagccugcuuguaccuuccccacccacagaccuagccuguugcacaucuugugugcuggcccagucugguaaguuccugaaacccugcuugccugugucguuccuuccccaaggcccauagccucagccacacagccuguaugcuagucuaacuuuguggccaucugugccgcccucacacucucuagguguauauaggguaaaucaagcagauccaguuuguuccacuugcauuccauuuuucuuauuucugaaccaaagucgucuugguugcuccaaucuauccaucaagauccaccaggucuauagaaaugagaauuaccaagauggacccauggacacagaauuuagaagaacagucaugaaguucaucaaaggauugaagaaacaaacguaaaguagaugcacacacacagcucauuuaccucagagaagaacugccugagugauaacucaagaaagcacucaccugcggcagaggaaaaggaagacccgagugaugcccaggaaagcacacacguguggccaagggaaaggaagacaguucaggacuggaaaccugaauucaguagagagauaggaauauugaagagugcucaaaugaagaugcacugaaaacucagucauucaaucagaaaacccagagggaagccguacagguagagugggucauguggaagauagaguguugagacuugaagauaaaguagaggaauuagacacacaggcaacaauaugaaaaacauuuuuauuuuuuacuuuugggguguguguuguugagacaggguuauucuguauaauccuggccgucccgaaacuugcucuguaguccaggcuggcuucaaacucagcgaucuaccuaccucugccucccgagcucuaggauuaaaggugugugcugccacugccuggagcgaaaggaaaaaaccaaaccaaaacaaaacuuuuaaaacacuaaaguagcauguuggaaauguggaacaucaugaaaagaccaaaucuucaaguucuagacauacaaggagaagaaucccagguuagcgucauagaccacagaucuuaagguucauagaagaaaauuuccccauguuagugaaagaaauaacccucaaagaugcacacagaauaccaaguagaugacagaaaagaaacuucccauggaauauuauagcuaauacacuaguuauacaaaacaaacagaggauaaagaaagcugcaggagaaaaaccagaaguuaaauauaaaggaaaacccauuagaauaauauagucucucaguggaaaccuugaaauugagaagagcccaaagcaauauauuccaaguucuaaaagaccuggauacuaaccuggacuucuauaccagcaaacuguuugcuguaguugaaagagaaagcuuuucaugauauaaauaaacaggcuaaaaaaaauggauauucaccaacccaacuuuacagagaauacugggagcaauauuucaggcugaggcugggcagugguggcccaugccuuuaaucccagcacuugggacacagaggcagguggauuucugauuucgaggccagccuggucuacagagugaguuccaggacagccagggcuacacagagaaacccugucucaaaaaacaaaacaaaacaaaaaaaaaacaaaaaaaaaaauucaggcugaggagaagaauaagaccauauguaaagugaaucaaugaaguuauaauuagugaaacagcauacaacaacaacaaaaucaaagcgauagcaaucaauacuuuucaauuaguaacuaaauauuaaugacauuuacuuuuuuauuagauauuuucuucauuuacauuucaaauuuuaucccgaaaguucccuauaccuucccccgcccugcuccccuacccacccacucccacuucuuggcucuggcauuccccugaacuggggcauauaaaguuugcaagaccaaggggccucuuuucccagugauggccgacuaggccaucuucugcuacauauacagcuagagacaugaacucuggggguacugguuaguucauauuguuguuucacguauaggguuucagaccccuuuagcuccuuggguacuuucucuagcuacuccauugagggcccuguguuccauccuauagcugacugugagcauccacuucuguauuugccaggcacacccauggaaggaguuacagagccauuuacuuuuuaaucaaaagcccugggcuaggugaauggauuagaaacaaaauccaucuuucuauuaucuauaaaaaagucaacuuaaccuucuaagacaggaaccaccuuaaaggaaaagguuggaaagaauaagcaagugggauccggaagcaaguagguauugcuauccuaucauuuguauaguagacuuuaaacuaaaucuguauuauggauugaaaucagaagagauaaagaaggacacuucauucuaaugaagagaacaauuaaccaagaugacaucacaauccuaaacguucuguguaccuaauuucauacaaaguguagugcuagauuucaagacauagauuaacuccaacuuaguaggugauuucaauaccuuagcuuucuucaacagacaggccauaaaaauaaaaaucaucagaauuuaaacagcauuaugcauuaaauaggccuaacagauaucuuuggaacccaaacaucaaaaaaauacacauuccacucaacaauccauaaagcuucucuuaaaauagauacaaaagaaaucuuaacagauuuagaagauuugaaauaucucuguguuguauuugaccacaguacaacagaacuuaaaaagacagcaaaugaaucuguaggaagucuacagaccugugguggagauuaaagaguacauuacuaaaugaugagugggucaaagaagaaaucaagaaagcaaugaaacaauucuuauaacuuaaacacagacaccccacccccaaacauuggguauauuaaaagcagucuugagagggaaauuuauuagccagcuacauuaaaagaaucagagcaaaaguacaugauuuaaugaugcaacucaagaauuuggaaaaucaaaagcaaaccaaauccaaauguaguagguggcaagaaauaaaauaauuuacaaaaagaaaaaaaaaaaaaaaggcuggcgagauggcucagcaguuaagaacacugacugaucuuccgaaaguccugaguucaaauuccagcaaccacaugguggcucacaaccacccuuaaugagaucugacgcccucuucugguacaccugaagauugcuacaguguacuuauaaaagagugagcaaagguccuaaaaacucaauucucaacaaccacaugaaggcucacaaccaucuguacagcuacaguguacucauauacauaaaauaaaaaucuuaaaaaaaaaaaaaagaugaggccugaccaagagcuagggacacugggaggaaagagagccccuagucugcugucugguugaagccucucaccaggugagagcagagacuuccaccacaguuaccaugugcuaugcagguucccagcauggcgacacuauuacuuucauacagaaaugcucgcaaaagaugagugcuaauagacuuaagaccaagguagaugaccuagaauggggccuugcugcaugccuagguggcauuuuuacaguaaaucuguccuaauuucuuauuuccugucgaucuagaauuuuaccauagaaaguauaacuaugucagguagacaucaggaaccucccugugauuuaauuuaguuuuccuacaaacaacucuuacaagacaauagcauuaaaauacagcaaaauaguguacccuguaaagacaaagggugugccuccucuuugcagagccauccaugccuuuggauauaucuuacuuucagauuccuuuauauauguuucuuuuaaggguuuuuacuuaauuuguaugcaugaauauuuuaccugcauauaugcauguguaacauuuguaaggcuggugccugcagaaauaggaaaaaaaaaaaaacaaacguugaauccccuggaacucaaguuacagacaguuguaagcuucuaucuugguucugagaauagaacuuaggcccucuaugagagcaucaagugcuuuucaacaaccaaguaucucucuacccuuaaauauaucauacauucuuccagagauccugucucuuaguauacuuaaaaucuaagcuaaaauaucuucuaaugacauucaccuguguuagaagaaacucagaaauuaaugacauagaaacaagcaaacaacaacaaaaaacaguacaaagaauagaugagucuaaaagcugguucuuugggaagauaagcaagauuguagaacccuugacccaacuaaccaaaaggaagaucacccaaauuaccacuuacauacaaauagggaaacauuacaaaagacacccaaaaaauuacagaauaugauggcauuuccuguaggggaauacuucaaaauuguguguacucuacuagaaaaaucugaaagaaguagaugaguuucuagacucauccaaaccaccagaguugaaccaagaagagaccaauauuuuaauagauccauaccauguaagaagauuaaagcaauaacaaaaagccuuuugacuaaaacagcccaggcccagauggaaucacagcauaauucugucagacuuuuaaaaagaucuacaaucagcaugucuucugugacauguguuuauccaccuggugcaggcaugcaacccugggacuggaguuguagauauugugaaccaccauguagacugggugcuggaaaugaaaccugugccugcugcaagagcagucggucaucuuaaccgccaagccagcucuccagcuccuauaacuuacacuccugaaaucuuuacaaaacaaauaaauaagucagaauagaagugcuuccaaacuccuuuuaugaagccaauauaacuuuaauacccaaaccagguaaagacacccacaaaaaaaagagaaaacuauaggccaauuuucucuggugaaccuaauagaugcaaaaauccuuaauaaaauacuuacaagcagaauacagggacauacauacauacacacacacauacacacacacacacacacacacacacacacacacacacacacacaccauccacuacaauuagguugcuuuaaucuuggagaugcagccguguucaccauguaaaucaguaaagcaacaagccauauacuuagagacaaaaaugacauaaucgucucaauagaugcagaaggggcuuugacaaauucaaaaugcuuuaugaucaaaggggagagugggacaagagggaccauacauuagcacaguaacgacuauguaugacaaacccauaaccgacaccauccugaacagaagaacgucgaagcagacccacuaagauugggaugagauaggacugucuaguauuuccaacccuuuucauccuagcacuugaaguguuuccuauaauaauaggacaagagaauuaaaagacuauaaauaggaaaagaagucagauuguucuguuagcagauaauauaaagacauuuuaaaaaguucuagcagaaaacuucuagauaugaucaacauuuuaagcaaaguggcaggauacaaaaucagcuuauaaaagcuagaagcccuucuguauaccaacaacaagcgcaucgagaaagagauuauggaaacacuccuacucacaauagacucacaaaaaguaucuaggaauaaaccuaacagaagagguaaaaacuucuacagugaaaacuuuaaaucucugagggaggagauugagaaagauacuggaggauagacugaccucccgugcuuauggauggguagaauugauacugugaaaaugaccauauuaccaaaaggaaguuauagguucaaugcagucccaagcaaaauccccauggcaaaaaaaauccucaaauuccuauggagccacaaaaaauccuggauacucaaggaaauccuaaagcaaaagaacagugcugggaggcuuccguaccagacuucaagcuaugcuggggagcuguaguaauaaaaacagcgugguccuggcacaaaagcacaaacaagaaauaagguagacccaaacgugaggacacauagucauagcaaucgcacaucugauaagauacccaaagcacacaguagaaaugacaguaucuucaacaaaugauucagggaauacugaauaucuccauguagaagaaugaaauuagacccauaucuaucucuuugcacaaaacccaacuccaaauggaccagagauuuaaugugaagccugaauacugaaacuacuaaaagaacaauguaaagguguaggaaagaacuuugugaauaugacuguguuugcuuuggaauuaaggccaacuguugaccagugaacaucauaaaauuaaaacacugcucuauagcaaaggaaacaauggaaaagcaagucuacaaggcaggagacaaucuuugccaccuacacaucugguaagaggaucagaauacauaaauaacuaaaaaaaacaaaucaagaaaacaacccaauguuuaaaaagggccaugggucuguacacaguucucaaaagaagaaauaaaauagcuaagaaaucucuugauagaaaugcaaaaaguguuuguuuaucuuuagcaauuacggaaauguaaauuaaaaacuacuuugacaguucauuuugccccagugacaaugguucagaucaggaaaacagcugacagagaaugcugacagggauguggggaaaggggacccucguucccuuuggugggauugcauacuggugcagcuacucagaaaagugguauggagaguucucaagcuaaaagauguaccaugugacccagccacacugcucuugaggacacacccaccccacggguagcuucucagguguguccauugccaccuucuccacaauugccagggcaugcagacaaccugucaacugaugaauggaugauagaaguguugugcauacacacagugggauucucuuuagcuguaaagaacagugaaaccaugaaauuugaagguaaauggagagaacgagaagauauuauuccaagugacuuaaucaaguccaugaaagacaaaugcagucuguuuucucuuauuuguggauccucccuuguaaucuuuagaugugagcauaugaucuagaguuaccuaagaaaugaaaagggaccauggucaggggcacuguagaaggaucucuggagaggggcauauucggucacuggaaaauauggauaauguggggagcacuuuaccuaaugaggggcuagagaggacaauacacagaaaaagaagggaugaauagcauuaaggaugguugaaaaauccauagagaaauguuuuacuaauaaauacauaaguauauguuauauauauucaaguaacuuacauggaguuauacuacuuaguuguaaugcugcucccaagagccaaagacuauaucaguuaaauuucuguuguuuugauacagcacuaugcccaagagaacuuacagaagaaagagauuauuuggguuuauggguccagaggaaugacuccguuauggcagcaagccucagacaugguggcuggaguucacaucucgaccaagaaaaaggaguguaguggauugcuuguagauaaagccuacucccaaugacauacuuccuccaacaaggccacaccaauaugaaccuuccaaaacagcacuacuaccuggggaccaaguguucaaacaccugagacuaugagaaacauuucuuauucaaaccacaugauuauuuaacaaagaccccagugccaggcaugggaaaccuccuccuaaguuauuggucaggaaaauuacaagagaccuccaaaaugaaauaggucauugcuguugccuuuguuuaccuuccagaacuugaagguaagauccugucccugaagauacaacacacauaagacgaaggacuuaauucucccugaaggcuagcccucauagaaccugagggugcuauguaagcugccaaggggaaaagcagugacuaauucuaucugacugauagcacagcaaaauauauccagaggugcaguaguggcacuuauaucuuggguguaaugaacaacagucucaagauccacucaauaggagguacuuuauccacacuugguacuguacaccuagccaacuacuuguggcuggugaggucauggccucuaggagagagcagaguaguccaucccagaaauccacaacugauaaaaauucagagaaaaacuaaccauugauacccauccucaguagaucugcaccacaacucauacacccaaggcucagggaacauuauggagagaagcagggagcauuguaagagccagaggaccagaaugucuucuguggaauagugucuuuuauguaugacucggucuacaccuaugaaaguuuaacaauaugaucaucuaaacgagaucugcaccauggcaacaccaguucacacuccaguguagaugaagaaaaucucacaaggccccaucucuagaugaagagcuauaggcaguuaauggcugccaacaggagaguaagucaucugcaggaacaagcccccugguagguuaucuaaucccaagugggcagccuuagguaaacauauuaaacgaacucagcauguuguacguguacauacauacccacuaauaauugaagaggccaugacauuguaaagaaguuggaagguggauaggaggaguuguaugaaauucuuuaaaaaguuaaaaaaaaaaaacccaaaucaaauggaauaaaaaugaaucuucaaaacaauaagaagccaaguuuguugacgcaugcuuucaaucacagcacuugggaggcaggcugaucucugaguuugagaccagccuaagcuauauagcaagauuuaggccagccagggguacauaguaagacccuggcuccaaacggaaguucuugcaugcccauggcauggguggcuaagcagucugccucccgaucagcugcacaugcauggaaugcuguuucuagucacaguccugggugugcugcugagcuauguacaugguuucuugcucuccuguuuugaguuauugccgaugcaggcaauguucaggucaucugguagguagcuuuuacuuugauaggaauggcuaaacuauuuuuuuaacauaauuguuaguuuucauucucaagagcaguauaugaaggguuuggcuccuccaaguucuuagguauuuuuaaaccuuaaguaauacauaaaauaaugucuuaggagaauuuuauacauauguaucauuguaucugcucauauuuccccuuuucucuuucaugucuuucaguguguuuauugcuggcuuccaggaauacaccaagcccaugauugaucaccuggucuccaugaaaaucaaccauugggauggguagguuuugucuuugugacucucagaaaacucuuuuuuucccccucaauggcaagaguuuaguugagcuuuguaaguuuaugaguguauuuucucauuauagguaaacuauuuuuaaaugaauuauuucugagaaguaaugaaacuuccaguuuguguguggcaugcuguuaaaggucuauuuguuucauuucuggggcuguugguugggcaagucugaguuguaauuauuucugaauaccuugucacauguaauagggaagcuacagccugaggacagugcaguccaacugggguagccuggucuucuucaucaguugcccugccugcacacugguucugcucugcuuggcccccccuagguaucuuauauguuguaacuuaacugcugagcagucuuuagugguaguuuucauaguuacaguagaagcuuuggggcucucaugguauuuuauagguaguuaagugugucuuuaaagaggaaaggcaaguguguaacucagacguuagcacugucauguuuugccaccaucucuaggcaggccuggucagccaaaugcagaugcuggggaaauuagcaauauaaucauggugucccuuccauaaaucccagugucagagugguuucuuuguaguucacuggggaguguuucgguuuccaaaagaacuaaagccuuaaaaguauuuuuuaacugcugccauguuucuguaguguggggcucucuggcgugaagaaacucuggcccaagccuccauauugaucaugcacaucauccuguuauauuuguuauuaugaaauauuucucuuuguuucauagauuucuucaaguguaacgugauauugaaaugugugcaugggcaauuggcuuuuucuuucuuuuuuuccuuuuucucuuuuuaaagaauuauuuauguaugaguacacuguggcugucuucagacacaccagaagagggcaucagaucucauuacagaugguugugagccuccaugugguugcugggcauugaauucaggaccuuucuaaauguagacagugcucuuaaccguugcaacaucucuccagcccucagcuuuuccuuuaaagggacagauaguuaaugccuuaggucucugacucauauauguauuaucuuuucuuuauauaacccuuaaaaauauaaaaacuauccuuaacuuagagccuuacacaagaaaccugggcaguuuuugaucugcugacuauaaaucaucauuuuuguuauagcaagugucagaauucuuuuucuuguuaguugaacaauauugcauugucuauaucuaucauauuuuaccuaucuguucaucuuugauagaucuuuggguguuuccauccuaaggcugugugaguguguaaaucuguccuuacuaacagcuccguuacuucucagggccauccgagaacugucugcaaaggcauugcacaaccugacuccacaaguacccgaguacauagccaugcacgguagguuuacacacuacugccuguugcacucucucacacaugugcacgugugugccccuccccaugcacagacacaacagaaaugugcuguucucauagugggugaugauaaugaaguccugaaucuguugcuaaagaguaagcuuugggccaagucaggguagaacaaugaagacaaaugcaguguguuuguccaguggcagccuuggguggcaucaggcacaggugccauccaaaaaccaaggaauuguacugugggcugcacugugcagguuaaggaugauggugaacuccagggcugauuggagugggcggggccucuagauuggccugcacucggaauuuggagcuguucugcuuucuccuuccuaagugucagaggcugagguuuucuguucuuguugggagggaguaaugaauggaagugccugucaccuuucacggauguguggccuuugcucuccucaggcagaguacugccaccaccuagcagguagaggugcaggcaggaaaaucagcagacaugaccucuuucucaguggucucucacugggcaucggugccuggauaucuauacuguuguauaugcuguguauguguauauaugccuagauguaucugcuguguucuaugacaucgcuugguugcccaggagggggcucugcccauuagaaacagugguggugacccugacagcguugacuuucagaggaaauacuuguaaguaacguguuguucuaugugucucucaacccgacuauugcaguauucccugcacuacuguugaugacacagaguccagaucuacacacgagacauggugccauccuugccugugcagaggucaccuaugcccuguacaagcuggccacacagaguaacagguaggagaugccauuggugaagcuaggugauaguagugauuuggggguuugagaagagcuucccugcucugacuguugaucauuuguguauuuaaggcuccauuuuuacacugagguggucagucauaauucugugcuuccuugucuaucugguuucuccucaucaucccaaagcuaugacucacaugaugagagaaacuguucaaagguggcacuugucauuugucacugugugugaaugugggagcacgugugugccagagaacaugcgcggaggucagaggaacaucuuccucauguuccacuuuguuugagacagugucugugagcuucagcugauucucuggucuguaccucucgucucccugggauuacacauauaaaugcaucauugugucuggcuucuccccgggucuggggaucugaacucaaguuguuugacuuguaugguaagauacuuucuugaugagucuucuccucagcccccaugugucacuugaauaauuuaaacugcuuugagcuaggcaguaguggcucaaaccuuuaguuccagcaccuagaaggcagagggaggcagaucucugaguuccaugacaggcagggcuacacagagaaacccuuucuggggagaaaaaaagucaaagaagaaaaaggaagacaggguaagauuggaaguucuccuugaauauuucccucuuuggcugagccuguaauguaaccauaaaguaacaggucaaggacaugcacaacagugcauuucaagagcugugauuuccuuaugucacugugcagccgaguccucgagaguaaggacuuagugccucacagucugugaccuuccuuccccuucgagcuugagacuuguauauaaguccuuugugguuguguacgguggcucccuaggccaaaaugacagcagaugggcacauggacuucauuccuaccugucagucagucccaagggcauuugcuuguccccuggcuccagagcacagcucacagucuauauggguagaaugggcaccuaguuguugaugacccugcucuccuugguuguggcaaaagucccaugggccgugaccuuccucugcagugcauugugaugaugguaagguacauuugagacccguucccaaguugcugggucgauaugugaccucaggguauuaggcaguaugguaguucugugcagcacgcaggagauuucagaccuccaggggacuggacucuguguggcucugucucucacuuagcagaguagcuucucccagggaguuggaguuaguuaccacguagcucugccuagcaaguagaggauauuagauccccaggguguuguggcugugcauaguuuggccuaaagcacaggagguugcagauccauaaguaacucacacugcauaauucugcuagcauauaccauaucuccaaaaaaaucagauguucagugcagacuguaguuuaucugauagccuguguucagcgagcugcagugggagucagguaggguacccccugcugaagacuuaagugcuggguugacuagcagcagccuuucugaugacaacagaaaacaccuguggaaauccauguccccuguaggggccuuaacucuuccacagugucagcaggagcauaauggucaguaaaggugcuucuguuuugauaauaaauaagauugugucuuuagcaaacugaauguaagcauaaagguguaacacucagaugcccaccuucuguaaccaacacagauugugugucugugugugugugugucugugugugugugugugugugugugugugugugugugagugauguacuuguccauguguguauguguggaggccaaagauugacauuguguaucuuaccuucccugguugcucugucuuacuauuuguuuuauauuuuaaauuauauuuaggggcuggagauaugacucagugguaaagaacaguucagaagacccagguucaguucccaguacacucaugguggcucacaaacuuguaacuccaguucuagggacucuaguaucuucuucuggacuccauggacauccgucaugaguaugguacacauacauguacaugcuggcaaaacuacucauacauaaaagaaguguugaaauuauacuuauuuauuuauuugagagagggagagacaaacagaaacacauggggaugaguuugccaagaugcacauguggaagucauaggacaacuugaggggaaucaguuuuaccuugugggucccagggauugaacucaggcugucagucuuggcagcaagugucuuuacccacugagccaucucuccagcccccaauacagcuuuauuuaaggcugaaguggcacauuuucaggggcugugggagcaugaacaagaagcugaucuuucugagcuuaugugaaccugggcuccaguguaauccuuaugaacucggcauugugucucaccuucugcaggcuugucacagacuaucuggaugagaaggcagugcaaagccugaagcagauccaccagcagguuugugugguccaucugaacccccucuaccuggacaggaucugcuucuuugagcauauuguauugaccaggacacaauggcccaaugggcucuuuccaccagcaugacuccugugaggguuuaucuggaauugguaacugggauagauucauccucuggggccaaaauccaucuuauuggaugggcauuguguaggucucagggcuguguugguguuucacugugggccuuaacaggaguucccaggugagggaugggcauguccccucuguuuggaccagacaguccuucuggagugucaaguacccauaaaacaaaggccuuugcuucuguggcucuaauuucuacuguccugaaauuuaauacugaauuuuacacauuuuggggacuagaagaaaauguguauguuuuuucugggaguuugagauucucaaagccaucuaugacauaaaagaaaaaguaauuuauuuccuaaggaauuaaauuauuuuuuuguuuuuguuuuuugguuuuuguuuuuuucaagucaggguuucucuguauagcccuagcuguccuggcacuuacuuuguagaccaggcaggccuugaacucagaaaucugccugccucugccucccaagugcugggauuaauguaaauauuuuucuauuccauacaauuuuccucuuuuuauacuaacgaacuguuugucucagaucaugacuauggugaggccauuugauuaguuuuauauuucuugcuuccaaguggagccuggcauucuugucaggcauucuugaagugaggguguugagggcagcccuaugcaguggcugaaggaauggaggcucuguguccuccauugcuaggguuuccuguugcugaggaacauggguggugacagggcugcuacuuuuaguuuugugggaauuacagauguguaugaagggguugugaacugacaguaguugugugaauauccagcaaguaucagauguacucacaacaacaaacuaaauuauauccagcaaacaucaaacauacucacaacaaacugaauuacuucugagucugaagacugacuccagagccauuugucaggguuuguuuuaugcuugugugucuaucagugggcuaggauggaaggggacacccucuuucuccccacugugugccuuaguuuucccuuagaagcaaugcaccugaagaaccuaaccaaggccaggcacagugaguugggggccuuugucuucugaccuuccugauggacuuucuggcagucaaaagcucagcucugucacccugccaucauucuuguguugacagccaucacuauauauauaacaaauucuuuaacucaaauaacugauuuuuggcucuuuaauuuuagcuuugugaccgccaucucuauagguaagucuacagaguuaagacaucuugugucuaauggaaauguguguuguggaauaguugguucaccgaagcacuuaaauuacaucuaugugcgugcguguguguguguguguguguguguguguguguguguguguguguaacacauaccauguguacuaguggcagucagaggacaacuccaacuuguaggaguugguucuuuccuucuaucuugugggucccaggaauuuagguugucagacuuggugaaaggaaccuuuguuugcugucccuuguuguccuuguaaguagccaauagcugaccuucaccuguccucacucuuccacgugcaacugucacucaacccaguagucaagggaaugaugguugcaaaucuuuggugccuuucagcuuuuuggaagcuaaagucacaggucauggcaccccauguuucaguguguccuuggcauuucuguggcugaagaccauuguguccugcccaaaugagcagguguugccuacugcucuugguggcuguuggcucucggggucagaaagcuugagugcucucugucucugcagucuuccuuuuuuuagacucugugcaggaaggauaauauguaaagccuuuaggucugguucuuucucucaguguuuuugagguucauccaucuuauuguauauauaauuuaucucucuuguuuuauuuuagauugguauuacuaugucucauucuggucuuuuaaaaauauugauuuugauuuuauguauauugcugguuuuccugacuguaugucuguagucaauguguaugcuguucccaaggaagccagaaggugucugauauccugcacuugguuguuagcugucacaucggcacugguaauugaaccugcauccuuuggaaaaguagccaguguucuuaacugcugauucauuuuucuagccuugagaauuauucuugucuucaucuucuucuucaucuuugucuucaucuucaucuucucccccuccucuuccucuuccuccuuuuccuucuccuccucuuccuccccuuccucuuccuucccuuccguuuccuccuccccuccuccucuucuuccuccuauucuucuuccucuuccuccuccucuuccuccuauuccucuuccuccuccucuccucuuccucuucuucuucuuccuccucuucuuccuccuccuccuccuucuuaauaguuuguuuuuguuuuucuguucccuagaucugccugucuccugagugcuggguuaaaggcauaugccaacacauccagcccucauucaguuccuugaaaauauucaccaucugucuuguugagcaguaaaagcucuguauauucuggaucuaaguucuguuagacacaggauuuccccguuuuccccucccucucuuucaugucuugcuguguuguuucuuuuugugguguggggcugaacauuuacuguccugaacucuggaagugaggagccuuacuucccgugccucuuacugacuccucuccagacuuugggaguaggcagugaaggugggcacacacagugaguuaugcugugccugggagcuuuugugggcuaauauuaucccagucugggccucugggcuugucagaacugucacauaagccucaccaucuuaaccacuucucucugugaggacuuugaaacauuuuuauuucuugcuuuugccauaaccuacuccugaaacugccuagguuuugaguaaagauuccuuggguuuuuuguuuguuuuguuguguuucaguaggaugaaaugccuugcagaaaacuuacuaaaauaauuuaaauugggggacuggaaagauggcucagcaacugagagugcuggcugcuuuucuagaggacucagguuugcuucccagcacccacaugacaauucacagccaucuguuaauuccaguucuggggauuuaaugcucuuuucuggccuccaugggcuccagguaugcaaaugacacucugaaauacaagcaggcaaaacucccauauguaaaaaaaaaaaauguuuuucuauuuaauucuuauaguguuugcuuaaagcuacagaagagacuuaaauaguacagaauuugggagaacagugugacuuuauuuggagagcuuguaagcuacaaggugucagagaaguggcaucucaggcccucaguaggaggaugacgacugggguggcugcugauggccgugccuuugauggucacaguguacuuaucuccaucggguucgauagcuucucgcagacagcgugaugaugaacaugaguguacuacagcuuugggccaugugacggucgucuuggcauuguggaguguguuaagcagcauuugggauugguucugugugauauauuggugaugaccaaguguccuguggaagcuaaaaggacgggagucugcccgaggaugaucuuuucauggcaauuuuggguuuuuccaaaaauguagcgcuaaaucaccugauuauugaaaacugucauaguuuugggggccugaagguguaucuguugcuuagugggguguuucauguguaaaagacuuuaacugucuucuuccuuugguuuucaggggucuuggaggagagcuuaugagacaagcagguaggucuggggucagaagcugcuguccuucacuugaauaugggggaagaguacccugaggucagaccagaccucccaguaacaggugguagcuguucccuucuguuggagaucuugcuacugccccuggcuugcucucgguaugcagucagggauaugcagacaugcuuccuagccuaguauaucuaguuacccuaugucaaucuguggggcucugaugugucuuacaugccacaggacuggucacugugauuaggcauagggauauaucagcugccaauuucuucuauguacuaaguacugcagaacaaggaaugguuucuuagaucguauguuaauguccaaggaaucuuacagcauaaucaggugaauauuccuaguuaguugaauaugauagaaaacucagguucuugcuggcuuaucugggucucaagucgagccagaaauugguuggcuguuccaucaauuucuguuccaucuuuaccccugcacaucuuuaggcaggacaaauuuugggucaaaggcuuugugacuggguuugugaccccaucucucuauuagaaguccugccuggcuacaggagaugagaguuugagguuccauaguuguuaggagucuuaccuagagucaccccacagauuucugggaguuuccaucauccuagguuucuaggaaaaucccagagauucccuacuaccauuaccagcaccaauucuaguucgcuuucucucucucucuuucucucucucucucucucucuacccuccccacacuugauccuccuguucuccuucucccccuccccccucccaguuccuucucuccacucccaauguccauucuauuuucccuucugagugagauucaggaauucccccuugggcccuccuuguuauuugguuucuguggauuguagcuugguuauacuguaguuuauggcugauaaccacuuauaaauaagaacauaacauguuugucuuucuggaucucaguuccucacucagagugaucuuuccuaauuccuuccauuugccuguaaauuucauaaugucauuguuuuuaauagcugaguaauauuccauuguguaaacauauuacauuuuccuuauucauucucaguugagggacaucuggguuguuuccaguuucuggcuacuaccaauaaagcuucugugaccauagucgagcaaguguccugguggcuugguggaacaucuuuugggcauaugcccaggaguaguauagcugggacuugagagagaacuauucccaauuuucuuuagaaaccgccaaauuuccagaguagaaaucaacuguacuaguuugcacucucaccagcaauggaggagugcuccauugcuccacaucauugccugcaugugcugucacuugaguuuuugauuuuagccauucugauggguguaaaauggacucucagagucauuuugauuugcauuucccuagugacuaagaauguuaaacauuucuuuuuuuucuaaucaaauauauuuauuaaaaaggaaaaaucauuucauuucaguaaauaauaaaacagacagugaacuguuacugugaaaaaggacauggguguuccauaaaugacaaaaguuuauagaacagugaguuaaagucuacauuguacauggugccauacugcacagagaguggagaugggaaguggaaaugagagucuguacagauuucugcaaucacugcuuaggucugaggaaucacugaguaagcaggagagaagggagagggugguggaauguuggucauguagcacagagaaauuauucaggucucaauauagagccuaucaccuggaggaauuucauuugaauuaaaucaacucuguccauaaaaggucaagaacugucuauaagauaaaggacaggaucuuccuagugaacgauguuccauuaguguuaaacauuucuuuaagugcuuuucaaccauuacagauuccucugucaggaauccuguuuagaucuguaccccauuuuuuaaauuggguuauuugguuuguugaugucuaauuucuugaguucuuuauauauuuuggauauugccccucugucggauggaggacugguauagaguucuucccagucuggaggcugccacuuuguccuuugccuuacagaggcuuuucggguucaucaggucccauuuauuaacuguugauuuuagugccugaaguugguguucuguucaggacgaugucuccugugccagugaguucaaggcuauuccccauuuuuucuucuaucagacuuagugcauucagucuuacacugaggccuuuaaucuauuuggaguugaauuuugcgcagugugauagcuaaggaucuauuugcauucuuccacaugcagacguccagucagacuaucgacauuuguuaaagaggcuuuuucuuuuccauuguauaguuuuagcuucuuugugaaaaaucaagugugcauaguucuuuuauuuuacaggguuuuuuuuuuuuuuuuaaagauuuauuuauuuauuauauguaaguacacuguagcugucuucagacacuccagaagagggcaucagauuucguuauggaugguugugagccaccaugugguugcugggauuugaacucgggaccuucagaagagcagucggcgcucuuaaccacugagccaucucgccagcccccuacaggguuguuuuaacuauccuguauuuuuuguuuuuccauaugaagcugaaaauugcccuuucaagguauauaaagaauugaguuggaauuuuuauggaaauugcauugaauauguagauugcuuuuugguaagauggccauuuuuuacuauguuaauucuaccgauccaugagcauaggagaucuuuccaucuucugaugucuccuucaguuucuuucuucaaagacuugaaguucuuaucacacaggucuuucacuuguuuguuuagaguuacaccgacauauuuuauguguguggcuauugagaaggguguugucuccguaguuucuuucuuggccuguuuauuguuuauaaugaggaggaguacugauucuguuuuuugaguuaauuuguacccagcaccuugcugagguguuuauuaguugcaggaguucucugguagaguuuugaagucacuuauguauacugucaucaucugcgaguagcaaugcuuugaguucuuccuuuccaguuuguuccuccuugaucuccauuaguuguuuuacugcuuuagcuaaaccuucaaguacuguauugaauggauguggagagagugggcagccuuguccuugguuuuaguggaguugccuuaaguuucucuccauuuaauuugauguuggcuauuggcuuucuguauauuccuuuauuguguuuagguaugugccuugugucccugaucucuccaagacuuauugugaaggggugcuggauuuugucaaaggcuuuuucagcaucuaaugaaaugaugauguaggguuguuuuuuuuuuucuuuucuuuuguuuguaugguggauuacaucgauggauuuucaaacauugaaccaucccugcaucucugggaugaaaugugcuugaucauaguagauguuguuuuucacauguucuuguauucgguuugcaaauauuuuauugaguauuuuugcauggaaguucauaaaggaaauuggucugcaauucucuuucuuuguugagucuuugugugguuucaguaucagagugacuguggccucauaaaacuaauuuggccauguuucuuuuguuucuauuuuguggaauaauuugaggacuauuguuauuagcucuguuuugaaagucgguagaauucugcacuaaaaccaucuggcccuggacuuuuuuuuugguugguagauuuuuaaugacugcuuauauuccccuagggguuauaggucuauuuaaauuguuuaauuguuuaccugaccuugauuuaacuuuaguaaguaguuucuaucaagaaaauuguccauuuuguuuagauuuuccaauuuuguggaguacagauuuuuuagaguaagaccuaaugauucuuuggauuuccucaguaucuguuaugucucccuuuucauuuuugauuuuguuaauuuugauauuuucucuuugccuuuuuguuaguuuggcuaagggccugucuguauuguugauuuuucucaaagaaucaacucuuggcuucuuggcuuuuuuguaucguuuucuuuguuucuaguuuauucauuucagcccuggguuugacuauuuccugcugucuaguccucuuggguauguuggcuucuuuuuucuuuagagcuuucaggugugcuaugaaguugcuaaugugagaucucacuaauuucucuaugaagguucauaguucuaugaacuuucuucuuagcauucuuuccuuguguuucauaaguuuggguauguuguguauucauuuucauugauuugauuuuccuuccuuccuuccuugacccaguggucaaugaguagagaguuguuuaguuuuucugaguuuauaggcuuucuguuguuucuguuguugauggaguccagcuuuaauccaugaugaucugguuacauacaggaguuauuucaauuuucuuauaucuguugagacuugcuuugggacugagaauuugguggguuuuuuguuuuguuuuguuuuguuuuguuuuuuugagacaggguuucucuguguagcccuagcuguccuggaacucucucuauagaccaggcuagccuugaacucagaaaucugccucccgagugcugggauuaaaggcacgcaccaccacugccuggccgggccugaguauuuggaaguagagauaugauacuugguaguggacuuaugaaaaggaugucaggcuggagacauggcccagugguuaagagcacuaacugcucuucuagcgguccugaguucaauucccagcaaccacaugguggcucacaaccaucuguaauggaaaucugguucccuuuucuggugugucugaugauagcaacaguguacucacauacauaauaaaugaauaaaucuuuaaaaaaaaagaaagaaaaggaugucuauuggaaucaacauguucuccucauguaucugaacugugaggugugcccaucaacuguaacacggugacuggccgucagcagaauguuaugggcacauauuugcuuuacauguuuauauuguuuuuaaagaauuacaaauuauucagaagaaagcccacuaaauguuuucauuuuaguguaguguauauaaagagaccaacugggcuguuguagcagugugaugaggaggagguugagcaggcauugacaaacaggggccagggaugaggugaggggccugagccaucacucaggcgugaagagggggacccaaguggucauucugggggagugugagggagaacccaagugaugacucuaagaacaggugugagaaggcaccagugagugugaggacagaccaaggagucacugugggcagaugguauaaggagagggacuggcugugcccaccugugucaccugcgucugucccugguccuguuauuacaauagaggcuuuaucacuuagcaccauacuucagggaguuugucccuguucauguugauuggcaugagauucuagguuuauaaauaagagaaacauacuuaaaauucucuuucugcauugccaugugaugauguguauguggaaaacaagaggggauggcagcacaaaggagaggcaggugugagcaucugaauucagguggugcccaggcaggccauaucuggcagagagugaccacucugaaguacggcccuuucggcuaguuucccacacagcuccuugcaugcacagcuccuccucugcugauagagauguucagauguuacugcauuugaccacugccuuaaguugucuucucuaugugauuuaauggcaugccagccuguuuuguucccaaccguggauugagucauuauuuuauuaugucacaaaucagauagcagcacuaauagaugacuagcauucaccagagcaacauccaggcccaucucugagggcaguagguuuuaccaaucugauucuuaggacugcacugcauugugcuucuauaaugaccuugugccuuacaucuguuauaucccuagacauccucuugccuuauaucccuggauuccaggugcuuaucucuccuacaccuauggaucucuggugcuucccucccuguauuucugaaucucaggugcuuaccuauccuacacugguaugacccaaguguucaccucccuuauaccuguggccucaagaugccccccccaacauuuauggaaccugcauacuugcccuccaucuauaaaccccaggugcucaccuguccuaugcuugugugccgcuagguguucauucaagcgcucugacuauguagccuuugagacuuuuuuccuuggggaauguauauuuggguccaggacagccauuguuuccuaaguagguaauuuuguuuuuucuguuguaguugucauuuugugagacaagacugaccucagggccugggucacugaacugcuuccauugcuauuacaaaauaucagaaagaaaaaaacaaaacagaaaaauaccagaaaggaaggcuuauuuuagcuuguaguuugauguugcauguauuuaaaaaaaaaaaagaagaagaagaagaagaccgagccaauugcugggcagaagguacagguuggacuucugggucccaggaggaaaagagagaugaagggaaugagaggggcuuuuuuuuuuuuucuuccaagacagguuucuuuguguagccuuggcuguccuggaauucacucuguagaccaagcuggccuugaacucagaaaucugccugccucugucccaagugcugagauuaaaggcaugcaccaccaccgcccagcuucggccuucuuuaauaacaagucaagaaccaauuugggaacuauacguuaguaucagcaucuccccuuacacagacccaucauggcagggaaacugaggcagcgagaacagcugugguuguagcuguaggagugugaggcucugguuacauaguaugugcgauuagaaaguauagaaauggggugaugcuaauguuccauuuuauuugaucauggagagaaaaccaugcaacgguguugcccacauucaaggugggucuuuucuccucugggaagcuucucuagaaacucuaccagacuaaauacaaucaagugacggucuagauuaucccacggccaagugaggcuaaggugcuccuccacuggccguaccugacuugaaguguucuuaaccuuacuuggaucucuugaguucacacagguucuuuaagagggcuccccaagcuucugucuucaggauaggucuggaguaucuucuuccuaguauccaucuggggagauagccuggacuugccagcaugagaggugggagggaagguuaggugcuggcuauacccuguuuaagauguagugaggucagcuguaagagucauuuuggaaaaauaauguguuuucuuuuucuuuuuccauagugugcaucuuaauagagaagcugucacuuuccagaaugccauuuaaaggggacgccacugucgguaggugcuuuccucaaccacauagauaacauuuccuuacaguuauucaaguucaaaguaagagaugaaccugcaggguggguggaugaugcacuauaguuuaaaggaucacagcauugcuauugucuugaaauugcugcaaacuccugucauccucuuccagaaagggcagggaguccuucugggcuccaccauugucuguggcucugccugucaccauuguacccaauccugagcauuucugucccagguagaugacagucuagauggccagguacucauuuauuaucuaauaauccuagugcuacacaaagggcagucccaggccugcauacccugucuaaaguuacuaauuuuauuuagcuggagacagugaguauaucucaacucauuuauuggauguaguugaguugaaguuggguuuaaauugucagggaucagaagaaauugagggagagagauaggaaaagaucacuugaagcuugcaacuguaaacaaaacaaaaaguucccaaacacagugugcaagucuuugguuuaacagugaauugcauuuucuccacagugauggugauagcaggguguugagggagaugacucugagcagccugaggugggcuucuuccuggaacuggggcucuugggcuuuugugcaguuggaagaauguucucgagagagaagucaccaucugcucuaagaguaagcagaagauguuuguucucaggaucagcgaaguauucugaggugggcuguuucuuugcucuuuuggcagaagguuggcaguggcugauaaaugacacucucaggagucuucaccuuguuucaagccauuccagacaacagaucaagguaugcuaagcaagauuucuuuccccugcccagagagugacgcuagugcuguccacagugccugucucaguggcugucucaguggcuguccucagugccugucucagugccugucuuagugccugucucaguggccccuucaugcacuaacccgacaguuuucaauacugucauuaggccugcaugguuugcacagguaggcuagaaugaccauuaguaaccacaaauuccucucucuuacuauacuuucugucuuuaccaaaguuuuucccucuguuuugcuaguaaugguuugcuuaggucaugccugagugcugguguggaaaguauuggcaugaagaugaagaaacacaaaagagacugugcuugagcagauagaugcucaagcuccuguccaugccucagggucagguggccuugcagaagcagagcugugacaugugacacauuuuuuaggcaguaagcugugauuguugauauuuuggaaaggcagugaugugccaggugaggacuggaaacacaguuauguuuacgugagcccugccaaccuguguuuccuucuguuuuguuucuuaggcaacauuaucauucuguggaaaucugggauugugauaguuuuccugguuaaaguuguaggccucaugguugaugucucagacuuuucuuuuaaaacacugugcauaauccggucccaccagccaggauuaugguauucuuugcuguuugauuagugcauguagcaucugugugguguacugaggggucuccccguacugaucuucacccugucccuccucaguuccuuucuccuuaguuuugggaagaguuugaauggaaggcuuggauugaguuggaggagauugggauccaaggauaugccacgcagcccccuauucugugugacgcugcaucaucuagcuucaacuuacugggcugagauugguuccaaacucuauguucugcaaacccuccuguuagagaugccgagaaacccguauucuguaaaccagguuccaccggugccguuugagcucuuguccacauaaagaacacccuccauccccacauuccuucugcugggaagggaaaaaauguuuuguuuuauauuaacugugccauuugagaguacauagaaauuguacuguauggaagaaguaaagaguucuuacuuucgguuuacuggugcagagaauuuaaagugauugauacaucuugacaggugcugauaagacaagccagaguguaacaaugacauacauugauuuuuuuuuuuuaaaccuacucauugugcucuauugcagagacccagucaccugucugugccugaggacuucucggacagagccacuuucacuuauguccucuucuguuuuaggagguggcugucucugcccugacugcccucugcagugaauacuacgugaaggagccuggggaggcaggcuccuccaucgcgagugagugagcuguauguugggccuaaagcagggaucugcaggagcugggugaagcccaggaggcuugggcuggguuggccugagaagcaaccgugucuggucaccuuucuggaguuacucucuuaggacccacccagcucgugccaggcgacuaggcuacaggaaggagggaggucucuguuacacagaauccuucacguagcucccccugagccacuuggguucaggacauguccuuagaucuguccagacaacauagcugcccaaggaagcauuuuaucucugaacagggagcuucacuagggcaugacuuguagagacucugcguaaaagugggauacaacaguguccaguaauuuacauuuccuuuuugugauuuugcaaaaauauaaaaauauacuggaguuugaucuucuggcagauacuuuuguguaugguaucuguguguucauguuugugcacauugaggucagagguuggugcuggguaucuucuuuaguuuucuuucuuccucccuucccuucccccuucccccuucuucccccuuuccccuucccccuuuccccuucccucuucccuucccuuuucccuucuugagauaaggucuuucagugaaccuggggcucacuaguuaugcuggccagugagccccauaaauccucuugucugccagguccucaugcuugaacagugagcccuuuacggacugaguugccuucccagcucccuggcagacuuuccccuguuuucuuuuuuuaaucuuucuguuuuguuuuauauguauguguguuuugccuguguaucguuugugugacugaugccuaaaggggccagaagagggugucagcuucccuggaaacugaauuaaagaugguugugagcugguggcagacuugaaucuagucauuuuuacaguguuuaucaaccaugggcaacuuuaugcauugauaguaacauaauuguuuauacguagucuguauuuuaaaaguagagcaauaaugucacauuguacuuuuccaacaaaguaccaugucaugucgguugacaauaaauggcguccccauuggugcacugaaacaugaguagacuaaaaagacgccccucuccucacauggcuacuguagugaauuuacccuggugugugugaauugagaggauuucugccuccacauuugaggauggauaagaguauauuucugggguuucagugaauggguccuagcagccaccaauggcuaaagucugacuggcagggcacagggaugguauccgccuccuugccaccuuccugagcuguguuguaaaagaacagaacugacuuagucaguuuucaaauucuuccccucgcccugcucugacugccuaggcucgucaguuucuguuucucccuugagaucuuugauccugucacugcugcacgaauggcccugugugcuucaucagcauugccauugugcucugagugucccagaauuuggggaaucuaacuuguauuucuaagggguccuugaggcagcggucacuucugaacacuucuuucuuuucagaggagcugauuccccaguaccuugcugagcuccagagcccagaggagauggcccguuguggcuuuuccucagccuugggugcccucccagguuuccuucucaggggccaucugcagcagguaagggugacaacagcaccacaggggcacagaugugaagggccggcaacuaaucugcacaccuccgaugaggaaggaauucccggagguagcacauggccaugcaaggcaguggcuguuggaccuugacuccaguaugugggcuaaccugcucuugcaagacauacuuacagaguugugcacaagucuguagggugggcaggcacugucugaagaaacuguggcugccuggaugagaaggcaguagccucugugcaguagcuagugcccugaacguaccuccuaggcuuauaaccaucucaguugauuucccuaauaauggagccgugaaguuaaaauuccuucugaaauuccauguaccuuaaguugcuuuugauccaccauguuuauagucaugguaggagguaggcuagguauggguaaaggcugccagccccaugucucagccuggugcccuaugggccucugccugcaccucagaauauaucaugcauuauuguuuugcuacccuuugggacacuauuuccccugccauggcaguggcaagcuguaaagagcaagguuguucaugcucugcccugugaggugccaaguggaccucucagccuuagcaggccccucauccagccccuuugaucuagaaagaccaugacgcguuuccucugcuggaucuaucauugaaagccaugaguugagaggcuuguucauuucuuacaucuagguugucaccccaggugccacauggagugcucugucuccuucagucuccucucauauugucucaucuacucugguguagccugcucucuccccuguauaagcucuggacauaguuccagucuggcucuggagacuuuccuuuccacacuuaccuaguccauuaaguucauccgcucuucuccucugaguggaaacaccaggcuugguccugccaacacgccccaagauccucuuguugucugucccccuugccauacaagcugggaugcacuaagacaaauucaccacauuugcuuuuauauaaguugguguccuuuccuccugugggaccagauagcuuuugauggugugccgauaggccucuuuauccuuguacagagccuauauacaucugucauaauaacugcccuccccugggguuuaugcacuugauauguggcuaaaaaugaaagagauuuuuagaacugagcugucagcccaagaaguaguagcaggagcuguagagauggcucagugguuaagagcauuggcuguacuaccugaggucugagcucaguucccaauauccacacgguggcucacaaccuucuauaaugggaucugauccccucuucucccugaugcccucuucugucaugaagucauacaugcaaauagaauauucauaugcauacaugcauccauacaugcauaaauagaaauaguagcccugggcuuacaugguagcucagugaauaagucacuugcugggcaagccuaaugauccagguuugaccccuagaacuuauguaaagguagagagaaccuuuagguagaacuuauguaaaggagagacaacaacaaaguuguccuccaacagccuccauauagaggcuguagcauauuugauuauauagacacacacacacauauagaggugggugguugggaucaagaauaccaacuguucccucuacaaaauggaaacaguagacaggaagaucuuguagggaugagcuccaauccauggcagucacugggguuugagugaagcugagagggggcugugggaugaucucuucauuaaguccuuccagaagcugaaucagggcauguugucuagugugggaauuggcuccugugagcugccuagcaagccccacccauggcuacugugcucuguggcuccagagcuacaucucugaaagagaagcguguugauagccacacucgacgguacacacucauagcacugaggguggugagacuggauucucagguucaaggccagacugggcuacuuacugcaacugucuaaaaacugugcuugcuuugugcuugauacuucuuuugggacccucuugcccuuagguucucucaggucugagaagagucaccuguauuucucccaaugaugugagcuuugcugaagcccggagagaugguuugaaagcaaucucaaggugagccucuagccuggcaggcgggcaucaacaggcgccacgugguuugucugucaggcuagcccagagcaggaauguagagguguuuucagugcaaugucagggaacauuugcaucuucacucgaaggcuaccucagaaaccgagcuuugaggcuagcccuggcaacagugaggcuuuauaugaaaccaaacagaaacaaaccaagccaucaugugggccuuggagcagcacaguggcagaguucuuguuaagcuuguacaggcuauggguucuuucacaguacugcuaaauaaauaaauaaauaaauaauaaaauuaauaaauaaaguggaugaagacaugaguugaggcauucagcaaugccugaaucuuucaucuuagugacuucuguguguagaugcaguguguagggccauguaugccucuuuuagcuccccgugguccuuccugugagccauuuacuccucugaguucucauagcugcauuuuuauagggguggaagaaagagccagcuaccuugcagacugugggggcggugaaggugacuucacagcgagcaccauucuguaccugcagugggaugggugcucugccccccuaagucuuccccugaggcuccuccggcaugcccaauguuccccucagcaagauacuugaggucauuguaaugugaagggugagcucacagacacgcauauuuuaauuucagaauuugccagacgguuggugugaacacacgggggccuccagaugaagucauaugcaaagagaacaucucugagguuuaugcugcauugcugggcugcaugagugauuacaccacagacagcagaggggaugugggagccugguaaggacaguguuguaguuugucuccccugcugacucaccugagagggcauggcaucucagggaacccaggacaauagucauuaagucacuguagaaacucucauagcagcugucugcacugacgucucaggugaguagccacgagcuucugcuucccuguuaugcugcucaggcauccaugguccuuugagucagaccgacugucuucucucuccuccuguacggcaagguucuugcccagguugcagaaacaccuuguaagguagagagcaaggcuaaugcugcuguuuacguuaacagcugugccacgugccucacacucccuccugcuggcuguaagcacuguugugaagaguucagaaggagcuuauagaagauucugucuugaucgauguaaucagacauggagagagcauaugaugugccaggcuuuaauuuuugacauguucuuccugccuucucauuuucccuuccucgcauucugggugccagacauuguuucuucuuacaucuccuugccuggugguuaccccacuuuacggaucacuuugaagaucuccgcuguccucacguuccagaaacucaagcacuugucacaugccaaacagguccugaaggucucuucauuuugucacuuuuuguuguuguugcucuuugguuguauaaaaguuaauuaguuuauguucugcucauugacuuuuccugauuuucuacugugaagcucauuuuauaguuuuaauuucauguaacguuggucacuaauuuacauuugcacugggucuucccaguguguguuugcugacauuuccuauagucuccuuauuguaaauauauuuuccuccaccugaggacaucuccccucagguccaucagcuguuauggauugaguugucuggauauuauauguacagacacaggaagggcuucccuguggcuaaccucagucuugucagagccugguaaauggagacuuugaggggccccauggccauuuccagccuugccaagauuucccccaacacagcugaaaugcugugcagggaagggauccccaccuaccugcuaccugcucuccuuugcagacccuucuagaaugugccacaggauuaacagcaggcaguagccuaagcuggcauugugaacccagcccacacguggccaguggcuugggccugugauagauauuggcaggcccuagacuucuuuucugaggccccugaacucucaagagaccugguugaccuagauuccuuugcaguucgagauggaaaaauugugaauguugaguguuuuuuccauggaagauguuaacaaacacuuguuuauccaguacagggcacugaagacagaccagaggacaauuccaccuaagucuaguuuagagggucuugaaguuacuuacaggagcauagguaagggguuauuuacauagaugacuuaaaggcagcugcaucacugaaaaggacucccuagcagggaugacagcucacaaaaccugcaucucuggagacuccugcacuuguagguagcucugccagcugagagugucgucuccacagcaguuuuuacugcuuucauaccugacccugggcagcuuucauuagcuuccugugccuuauaaauuccaacagcuuccugagucuucggguccccucccccuuccaaagcaauuuuacuuuggacuaaauaguuacacaacaguguauuccuuugcagucugccuggcacugggacacccuucccagcaaagcagaaagggccagugaugagguucuccccgagaccugguccuuagcaccuuacucucuguggaauuuuucuucucaacucgcucugcaaaggguggacaggauucugcuccagaguaggguggggguggggguccaguguagaauugccaguagugaaugguucaauuccagacacuuuuacaccaugucuccuguuucuuuccuuucucuaaauucccauagacaccucuccuuguucuuucaaaugcauggccuccuuuuucauuaguuguuaugcacugugugugugugugugucugucugucugucccacucugagcauuccuugguugccuguaguucuuuguguaggauuaaggccuccugagccuugcccaccccaguccacauaagcaugucuauuguucuuguucagcucagcuuuaggcagugaugcuggugagacuuuaugaucucacagcaaagucccuguuccucugguucucacaauguuucugccuccucuuccauaaugauuccugacucuuaaggcuccacagcucugcauuuagagagaaguuuccuugaugggaggugaggacugcacuuaccuguggguuuaaggaccgagguuuagaauguaguuagggauuuugcuaguauaguggcaguuguagguucucauccaggaucccugacaucacaagccuuggguaguuggcugggcuuccaguauaagaccagauuucccucugagcagauauugaauccaauuagagggcuguuaguuacacauacagaaggaagaggguaaaaaaccaguaaggagucuaaaaagucauauggaauuauacgguguucccuccaaaagccaaagaccauuuaauaaaaacccuaacaagucacaagaagccuucuuuugaguuguuggucgcaguugucuaagaaagucauaaaauaauauaggcuacugcuauuacccuugauugccccccagagguggaagguaagucccuacugcucaagauaucaugaguuucagacacagccuggaggccucugagcuggaacugaccugaaagcccccucccugaggaccaguucccaugguagcagaaggcugcaugcaagccuccacaggaagacaaugaccaacagcugccagcugugguguuucugaaccacaacaaucaucauggcacaauaaacuguauggucacauuaguggcacacauaccuugacacuguuuuuuguuguugucuuuaauucaacaguaucuaguccuuucucagagaguccagguguuuuugaaauucugaccuuuucauuuacuuugcucuucauauuucuccuucauauuucucagauagagucauuguaaagacugcacauuuggucgaucuguuguugcuacugcuauuuuaguauuugcuaucuuuuauuuauaguuuauuuaguuuuuaacugaguuuccuaaguuauaguuaaauugcaggcauuaguguugcauaguuuucuuuuaucugguggugauaauaaccagccagguaccacugagcucuccugucuuuaccuccaggucaccgagaguagaagggcuguacagggagggguuccaggucugaacagaccgggugguauggggcaggcucugugaugaugguuucauuaaauugcucuugcucccuggacuaaacagcauuuuugagcauaccugugggguguuuuuaccaagaggcucaggucccagcucuuuuuccuauucaugugcucagcaaguacagcuucuccuuguugcugguuucugcugugguauuuggagcuucauccuguguaucacagcuuaagaggugguaguccacaugaaggagauguacaggcuacccccacagugugucugugugugcuuuggaguugugcaccugugucucuggcuuguuucacaggugugcacgugugucccucagcacacuucacagucugccaucccuuuguccccuggcauucauugcagauauguaccagugucccugcacacaccuuucccaggcuugcuuuguguccagcacccucaucugacuuuggggagugcccuggaacccuggccugcacuugucugugaguucccccucacagcaggaaccugguacaggcuccauagaggguuugauagaggcagggaugaccccagacccgagaguuuguaucuuucuuuuccucacucuggcugaaugcacuuaaauuccaguuuaaauggcugccuuugcucuggaauuagaccaguauuuuuuucuuugguacaaauuaauaacagacagcucuguuuagcaagaaaguaagucuaggauggaugugaguguugguugcucuguuuguuuggugagaaccagaagugccagccuugugcagagagacuacaggaggccagcuucacaugggaggaggcugugggaaguaucugcuauuacagugugugcacaugucuaaggcuuugcucagacuuguccagucugucuucagguguuaagaaugacuucucuugcuugacaguaugagagagagcacgucccucauuccccagucaagggauuuaaguaaagacugccagcugcuggcaucggguuucucugaugguucacacugugggauuucuguaaucucugaaacuuucccugcguuugggccuuguggagcuaagcuuguguguggccagugggugucucaagacuuuuuugccccucaugagcugcuuguagggucugguugguagacccaggcagggcuuggacucccugucauagacugaccuucuccuguuuccuuauucacaggguucgugaggcugccaugaccagccucauggauuugaugcuuuugcuggcacggacagagccggugcugauugaggcccacaugugaguaucuaaagccagcugaggcuggccuggggccuuaaugccuucucagacaagcuucucugacccuuguccugguccuccagagucuguggaccauggccaggguccuccaccuggccugugucagaauccauaguguaacauacuucccaaccccacaccaggaccuccuuugaacuggccuguuugacagucagcuucggggugggggagggggggaggcuguaguaguggccucugaacucagggcucuguagcugaacuucaugccaagaugggcuaccaucauuugauccagccucuguggguuucaaccuccuuggccauacugcuugagacccuaaguuugcuaucucgugugugccauacuuucucagccuggccucucguccuccuuccacugaccugcaauucuguugcagugacuguugcuucucacucuugccccaagaguacacugacauucacaugugccugucauguggcuccugagauguuggagcaggcagggugcaggcauacccauucuguguugguuaguuucuugucaacuuggcacaaacuagaauucuuuggaaagagggacucaguugagaaaauauguccauaaaauuggccuauaggcauuuucuugaucaaugauuuacgugggagguuccguuucugggaaaguagucuugaguucuauaagaaagcaggcuaagcaagcuaguaagcagcauuccuucauggccucugcuuuaguuuugccuccugacuuccuuuggugauggagugugaccuaagacccuuuccuauccaaguuguuuuuggucaugauguuuuaucacaacaacaaaacccuaacuaacuaagacacaaccugaugugguuucagcagcugcugauaauaaagugaccacguuucuccaggcuggccucauacaugugcccuccauuugcagcugugagcgcgucauguguugcguugcccagcaagcaagugagaagauugaucgguuccgugcucaugcugcccggguguuccugacucucuugcacuucgacagcccucccauuccccauguuccccaccgccaagaacuggaaagucuguuucccagguacugucagauacagauccccugguagcccagucccuccaagcauggccuucacuugaggaaaucacugaaaucacuuucuuucaggucugauguggccacugugaacuggaacgcaccuucccaggccuucccucucaucacccagcucuugggauugccuaccuauagauaccauguccugcuggggcuggcugugucuguggguggcuugacagagucuacggugaggaagcauuuggcugugcagagcaggggacacgggauucuuuccagaggguucugacccagaugugugcacuucacauguccacugucuuaccagccccauaccugucugauccucaugucucuguagucugcaguuguaucuguuuggccccaggcauuuacugucauuguaguagcccugagaaccaagggagaagcuagccaugcugagccacaauaccgccuuuuggguugcaggucagacauucuacacagagccucuuugaguacaugaaggggauucagaaggaugcucagguccugcagagcuucagugagacccuccugaaggucuuugaggacaaccuuuugaaugauaggugaguggugucuucagacaggguacuugugaccugauuguauuuccacagaguccaggucuuccagggacacauuugucauaauagaugaggagcgggacccagccaacucccaaguucuagcuccaacacucaucuucuacggaccccaggaauucaucuccucugugucuugcuggucccuaggccuggcacugauugguaaucccuuucccuugaugcacucucagcaggaaaaugacuuuguauguguggagaugcagaauaccaagugaaguggagugaggcucuagucuguaggaauauucuccaucuuuucuugucuguaauagccccacugagacauaagagcccugaaagacaacacacggagugugugcccugguuccuugggaugcguauuccacagauccuuucccguucaccgaguuuuccuccugcuccuuggagcccucccagcuguucacuuuggcagacaagcacaguuacuucugucuguccuuguuguugccuggccagggccuguuguggacaggaacugacucguuuggauauuccccauuuccugcccuacagacagcuacaguggacauuccgagauugagucucuguagacgcacauucucuuuccuuggguacucauugaguaauggacagcugagucacguggguugcuuguuuacauguaaagaugcuggcucccucuguuccauggcucaccagcauuagugguccgucucucagguggcuguuggacacucgguugcccuccuaguaucuguucauugccauagcuuguguagaugggcuuuccuucucacuguuguuuuaggaugacuucacuauauggggcaagucucugucagauuuguaguuugaaggacccagcuaccaccuguccugggcuucagugagcaaacaguugcugaggaauccccaccuaauuuggaagucccugagagcucugguacucuccagaagguucagcuuuagguucuaucgucagcccuacagucugaggacacacaaaacaaacucaaaacuguuuaauuuugcaaaugguuguucagauguucauacugucugcuggacuguccacugcacuuguuuugcaucuugucaaaaccguaagguguacaggugaaugcuggacucuaccaggccaucugacaucuaugcaucaggaaucuuguucuuaucuuugcuguagguaauucacgaaagaagccacauugucuccagcuauauucuuauuuuccauagucaguuggcauucuuguaagcauaaugcuggugugucugauucuaggaauuuaacaggacugucuugaguuaccccauuuaggaagggcuaucaugguguuaaggguuuuuuuuuguuguuguuguuguuguuacuguuguuagguuuuuugguuuguguuuuguuuuuacuugucaagagcacgucccuguuucucacaugggugucucuagguucuuggguguuucugugggucucauguuugcuuaucuccuucucucagggugucuguaucacugcugaaaaugcuggaccagcuguuggcuaaugggugcuuugacaucuuuacugccgaggagaaguaaguaucugcuugcuuagugcucccuguccgacaaagccuaguuccccaaaucucaaaaaaauuuuauugauugauugacuugccaucucacuguguugcucagacuagcuccaaacucgugauucugcccacucaaccuuucaagugcauacaaaucuuuggccaccaaauauggcuguuauuuuaaagacagaacacuuggauuaugaucucagaacccagaagaagacaaugcaaacucaggcaacagacaacaggauggggugaaguagugcccugcucuccaggugggaaaguagacuuggccaggugagauggcucacaugcuagggcuaguaggcagcgaggucuggacguuggagcuugagauaaggcuggacggaaacaggacagugcaugggccguguuaugggacccaggaguaugccugugcccaucccagcuggacagaaguuauggggcacagggcacacacaaagcagcugcuuccuacuuuugugguuugugguuccuuagccuccuguugagaggagcagacagccauggugcacgacagcucucuggaaccaucuaggugccagcuucgcuuccugacugagugauagauaccaucuuggugacuuuagcuucuaugaaugccuuauggucuucacugaauucucucuugauuuggacagcuuuguauuucaugaagaugugugagcaucuacuguugcuuagaaacucccuggugguuuuggaucuugcuuuauacugacugguggauucagaucaagaggaucucaguugauguccucccucucugagucuuugcccacuccaguuugccccauuaagaggaucuaugccuaguuuucauaggaucuuguaugggguuuuggugugguuuucucccuugaucuugagccucgucuuugugcuuacugcugaccagcauucaggugaagcccuaaggccaggcgcuccacugucucugcgcucugccuugagauccugcaugcaucacacacccagggcugcuggaggggaccagcuugcuuugcuugaagucuguagugucuuuguuguuuaacugucugucuuugcuggaugcugaagauggcguuucaccugacacuacagggcucccucugacacuguguagcacugccuuucuaaaaccuucccggguagcuugaacacucacaggggcauggcccggcuaggaugcucuucuccacaccgauggauucaucuaggaaaaugcucuaaggauuugacaucuauuuuucuggcuuaaaaauuucaaaauaagauaguaggaaaauaaugauauaaauguuuuuacuucucuuuuuuguucuuuauggauuuugaauuuuggcacauacaaauguagggcugccucaaauaucaaaugaugauguuuuuggagguguuucugcuuacauucuuuggcuuuuuuuguuguuuuuuuuuuuuuuuuuuuuuuuuuuugguaguguuuuaauuuuuauuauguuuggguuuguuuuguuuuguaugucaguugcuaacaguauauguacuuuuguaaaaauucaaccugacaaucugaucuuuuaacuaagucuauaaaucuauuucauuuaaucuuacuaguuuuuuuauuaaaguaauuuuguguguucuaugcuuugucugauuagcagaaccauuuuccuccauugcauuuucuucauuucugggacuuuuuccucucucuguguuccucgagaguuccuaauacuauuuccauucacugugccuuuguacaguuagugcuugaaugaaaaauaaaagaaaaaaaggaggacaugagugcuccuagguaugguggaguaaaagguuuauuguaaauaacagaggcagagacgucugggagaguccaaagugaacacgacccgagugggccuuccuugugaggagaggggcgaaggagaggggagagcuaggagaccaagagccccgggggguaaaggguaaaaaggacucgcuuagcuaaaguggguggacuauauacagaagggcacugucuuagucaggguuucuauuccugcacaaacaucaugaccaagaagcaaguuggggaggaaaggguuuauuuggcuuacauuuccauacugcuguucaucaccaaaggaugcaagacuggaacucaagcaggucagaaagcaggaguugauguaaaagccauggagggauguucuuuacuggcuugcuugcuuuggcuugcucagccugcucucuucuagaacccaagacuaccagccuagagauggucccacccacaaggggcccuacccccuugaucacuaauugagaaaaugccuuacaguuggaucucauggaggcauuuccucaacugaagcuccuuucucugugauaacuccagcugugucaaguugacacaaaacuagccaguacaggcaccuugggggaagggugggguaugccagccguacccuguaacaggaagcaugagggaugcugggagaaccuggaaggaagacaggacaccucacuuagacaggcagagauuagacccuauucauugagggcucaugccucuuggauuagcucauuggaagucuuucaggaaugcugguguauaaacucacaggguugcuagggaccacaaagcugaauguagacuugaaggguccuaaugagaucauagacuguauguguuaugucuagaagagcauuagaacuaugcauaugcccuguaggaagacaaacugaggguguagaguccuaugcaagcugggaaugacaaugaccacagcucuaagccauacgacauucugugcccaguaagcacuuuagggagcuagucagggaaggacuggacuccugugaccuggaccaggcagggugaccugggagcugcuguccuggacuguccuggaguguagcagcuccgaauucauauuaucauuggggcugacuaggacuccucuguaaccuaggcccaucacaugguuucuuuccacaugguagcacuugcugguagugucuuuucuguugggcugggucacuuggauaugucacaucgugacuaugccagggccugccugcccaguuguugacuauaucucugccaugcauuuuggaaacuaaagaagcgggugaugucacacaucccagcacagacgccaugacagugugccucauacugcucuguauuccugugaaagguggacuuacaauaaugucuucuccuucaagccaccccuuuugugugaaguugcucacacuuuguaaggaagaaaucaagaagucaaaagacauccagaaacuucggucaagcaucgcagugugaguuuuuaaguguuccuggguggagacagaaauaagagggacuuggugguuccuggugggagauaaaguuuuaacuacaaagcucuuuaaaauggaguguuuauguguucauuaugggaaagaaaugucagaccacuccuaucaggagugguuuggggggauugaccaaaaaaggaaaaaagcuaaaggaaagccacaucucucauugguucaucauguacaucugucacucgcuccagcaccugacuggcccuguagaugcucaaaggccaucacaggacagagaauacaccuguacuagugcagggaucugggcacacgggcauguacauguuagcacagauaacuggucauguacuggcaaucacauagauguaaaaacaugcacacauggggaugcagguaucuggguacauaagcaugcacaugcuagcacaaagaucucaccauguauaagugagcacauggaagcauauuagucuacaaugcacaugugcaaacaagauagcauaggucacaugggagcgcacuagugcauaacacacagaccuguacauagauaugcacaugacucaaguucaugcuguguacuuucugggucucccaugugucguggauccuuggguaacagcaugaguguggcacagcuccaugucacccgugggucucuugcaggcucugugggauggugcaguucaauggugaugugagaaagaagauucuucuucagcuguuccuccuccucggccacccuuucccugugguaagugugucugccccaccucaaggccaccugccugggacccaggacuauccuuacauguggcuuauaaagaugagugcaugucgggagggcuuugaaggaagcacuggugagauggguuccaggugugggcagucaacugguugguguuuguaugaaaggaacacgggugcuggugcuggguggggagagcaugggaagcacugcugagggggggggggcaucucagcccgggguuaggaagucugagaaccuguccugucgucuucugagguagagugggaugaccccacagcccagccuauuugucagaaacacacauugccagaggaagaucagaucuccugugaaauaguaugccaaaggaaauaaccaaaagagauagcgagacagacagauucccuuguaggaguuccugcugcaccuucugaugggcaugucuaugaaucagaaguaccugggcugugcgggacugaguucaucuuccuccugucauugugcucucuagguggugaggggcuuuccucccuuugaccuguuguucucauuccagauccggaagagcacagcgagccaggucuacgagauggugcuuaccuacagcgaccugguagaugccgaggugcuugaugaggucaugucugugcucagugacacagccuggugaguagggccugccugcgccuggugccacuuucucccauccuuguagcuuuggaugggaaggggagcuauuuccaacccucaacagcucagggccaucuaacaacuuuccacaaggcugaggacacauccugggaacuucaggugggaaauguuuaaugugcaauugcuuuucuccuccugugagcaaggugggcagugggucagaccccugcuggucagaaguugguguuucucaggaacuggaauauagcaugccaccaaguggaugucagcuagcuacugucauuuugcugcugcaaggaccuuguggucuuuccucuguucuaaugaacuuagagacuugucuccaaagucaagaggugcagaagagaugguaguggugguggugguguacagccugugggugugauucacagccugugggugugauucacagauguucuagccuggaucuagaaacaguuauggucacaacagcaagaacuuacaacacggaauccaggcacuguacacaugcauggcccugcacauacuuauaugcagguuugcauacauguagcugcucauauaaucacauauguauguacugccaagcacauacaaucacauauauggaacuaucaccugugcacagguguacuuugagcuggcuugucaccauucuguacuauuugggaggcacagccagguagcccagauuacugcuacugccuuuggacacuguccccucagacuaauggagagggggauugcugaccucagauacuaguagcucugcucggauuggccagguugcuucaguaagucaggguuugugguauauucaugcauaccccucagaacagugaccuccccagggagcucgugcuaggguauggccuuccugccuagauaagagcuguggggaccuggaaggccagagugcacuucaagaucuuugcugucaguaggagcucaacuuggugccuucugaggagacaguggucaaaccucaggacaguggacacugcuuccaacuuucuaauaaacucagcuugaguaaggacagcugugaaucucuaauacuauguaugcauguguggcugugugccagggcuugugugcauguuuguguaguugccuggggaugccagaaaagggugugcaauuccccuggagcuaggguugcagagaguugugagcuaccaacaugggugcuaggaacucugcuccucugccagaguacaacaccugguuuucagagaagcugggguuuuuuuguguuuuuuuuuuuuaacuaauuuuacauauagagaaaaacaugcuuaguacuuaacagcguauuacugcaaugaaagcagucaacagcuaaauucuaauaaauucuaagagggcuccagaagcccucuuagcccgagguagcauuucuucuguaugccccuagaaugggguguggcuuaguccugugaaagagcuagguucuccuagugucuacucugggggacagggucuuaccccaugcccgccagaucucaaggggucggggagcugaaccacgugguacaagggacucaaauguuuuccuccacagggacgcagagcuuccaguuguaagagaacagcggaaucgccugugugaccuucuuggcgugcccagaccccagcugguuccaaagguaauacuuguaguauucugaggacacauggcaccuguguugccugcaguucaggucuaaaguaaacagagucccacggucauuauucauugcugccguuacuuucuccagaccaacugggagagcugcuuccgcugucagggcagacaaguucugucuuuauagugugcuggcugcauggugucgucuaauuguuggaggcugucuuagucaggguuucuauuccugcacaaacaucaugaccaagaagcaaguuggggaggaaaggguuuauucggcuuacauuuccauacugcuguugaucaccaaaggaugcaggacuggaacucaagcaggucagaaagcaggagcugaugcagaggccauggagggauguucuuuucuggcuugcucagccugcucucuuauagaacccaagacaaccagcccagagauggucccacccacaaggggccuugcccccuugaucacuaauugagaaaaugccuuacaguuggaucucauggaggcauuuccucaacugaagcuccuuucucugugauaacuccagcugugucaaguugacacaaaacuagccaauacagcugaccccuugucaacuugacacacaaacacaucacuaguaagccucaacccuuacauucuuauucauccccaaggucuaaauaacuuuaaaugucccacagucuuuacauauucuuaaaauuucaaucucuuuaaaauauccaucucuuuuaaaaauccaaagucuuuuuaaauuaaaagucucuuaacugugggcaucacuaaaacaguuucuuccuucaagagggaaaauaucagggcacagucacaaucaaaagcaaaaaucaaucuccaaccguccaaugucugggauccaacucacgaucuucugggcuccuccaagggcuugggucacuucuccagccaugcccuuuguagcacacgcgucauccucuaggcuccagaugccucuacuccacugcugcugcugcucuugguggucaucucaugguacuggcaucuccaaaacacugcaugaccccuucaguccugggccaucaauugcaacugaggcugcacuuucaccaauggccuuccauggccucucacagugccaagccucagcugcucugcucaacuccuucaugccuucaaaaccaguaccaccugggugacccuuacacguuaccaaguccagccagagcacaagguacaacuuuggcuauaucuggaacgcagccacugugcucucagaaaacacuucccagaagaugucaccucaaugaugcuggucucuucuuaaucaccgcuaauuucuuagcuccagcuaaccagcaucaaaagucccaguaaugcaaaguuuuugcuuuaguaguucugguaucuuguuaaucacagcugauucuucagccccagcuaaccagaacuacagaaucuucacaaucaaaacagcaauggcccugaaaagagucuuuaauuuucccucugaaauuucacaaaccagaccuccaucuucugcaguguucucaacauuaucuuccaagcuccuacacaacaucugacagagcucuuaacaauggauggaucuucaagcccaaaguuccaaaguccuuccacaguccuccccagaacauggucagguugucacaggaauaccccacucugcugguaccaauuugucuuagucaggguuucuauuccugcacaaacaucaugaccaagaagcaaguuggggaggaaaggguuuauucggcuuacauuuccauacugcuguugaucaccaaaggaugcaggacuggaacucaagcaggucagaaagcaggagcugaugcagaggccauggagggauguucuuuucuggcuugcucagccugcucucuuauagaacccaagacaaccagcccagagauggucccacccacaaggggccuugcccccuugaucacuaauugagaaaaugccuuacaguuggaucucauggaggcauuuccucaacugaagcuccuuucucugugauaacuccagcugugucaaguugacacaaaacuagccaauacagaggccacacgcugucuucuaguucagcuucugucuucuaggaaugugggaagaggcuguaguucccucccucuucccugccuugauguacauccuguuaggggcucugucccucuaaggaccccugucccaucaggcuuccauuuccauuuccuuccuggcugccugugcuaaggccugucuucuucaccuagcuuggcccugguguguuuaguguuucugaggaccuuguccugguguugcacuuuaaguugucaugaaagcuguaaucuguuguguuccugagcucucuuccugcguuuuaugggucagucuguguauggggauuuuuaaaaauucuacauauugacuuuucauccuagaaauaugcucccagcuuaauucuuuuaauaccuuuguguuguggucuacuauaagguuauguaguguuuuuguacccaggaccaccagcugaggguggcuccacccacaguggguuuccaaaugacucuagcuugugucaaguugccauaaaacuagccagcacaugcaggcagccagccugcuguuucugaaagcucuauuuaccaacucuuuauagagaaauucaguuuacuugggacaaacuauugugugaagggaaggucacuuuaugcugucagcuggccccaauccccagaugauucagggccuugucaccaccacugucaaaggacugcacuuuggagucucuuuuauacgcuggaucauacucucaaucuguaagucaguacaaacuuaugacggaagagguguggauuucacaacacccauggugcucaccaugucucuucugcaguuuuauucuguccaagauugucugugcucuugauccuugguuuaaacucucagaacuaauuugucaguuuacauacuaccagccagguuggccugggacuguuuugggagcuaagguuccugauugacacuaggccccgacacucccuggaaggugcccuuggaaggucaccuaugaguccuacaaauggagaugcugucugugugauuggucuccaguucaugugccacuugaaucucugcuuagaaaguucacgugccaguuuaaugacuuuuaguucgucuuucugcagcuccuccugauccccucccgacacccuagcuagguuauauuuuaccuuuugacugcugugacaaaauaccaugacaaaggcagcuuaagaaagaaagcacuuccuugugcuuaugcuuucagagggcuagucuccuaauggcagagcaaagacauggcaguaggagcagcugagagcucacaucuugauccacagacaggaagcagagcucacuggaaauggaauccuuugaaaccucaaaaccacucccagugacacaccuccuccaagaaaaccacacuuccaaauccuucccaaacaguuccaccagcuagggacaggguauucacacgugagcccgugggggccauuguacuuaacccaccacauccaccucauccagcuccuguaugcucuccacagcucaccuuccuggugagcuuagcuugauaaucccaucuucauggcagaagcugucucuccgaguuguguuuuucauagcuuauacacaccuuuauuaacaaguagaugugcugaucaaauggacagcaguguaugugggcuugcuuuucuuccuggaaggggcucuuagauguuggcuguuauagaccuaagggucuuuccauuuguuuccacccuugaccuuaggcucccugcccuuacagaacuugaguccuucuggagcccagcaguauacuggagggcugugggugagucggggagaggaauauucuaaucagccagccagugucuaaccucgggcugggccuggccugcagccucccaguuguuggcacggcccaccuggccuaggagcuaguagaccugguucuggugugccugacagaggugacucuuuucuuccuugcugggugugaguggauguuuuucaggucucaugagguaagccuuggaagcccccuugagugguauucuccagccuaugcagagacauauaugccuuuugguggacuucgcuagguucugugucucauaugcucucuccaguuucaggaugggggucucaguucucugacauucugagaaacaacuucaguugugaaacucucucuguauugagugagacaccagacccauuaguacacauuuuugucauuuuacuccaucugcugaggaauuaauguuuugcauuugucucgaguguccuuuaauuauguuuaaacuuuggagaggggugcauuuugaaacuguuacaacucuugaugucucuuuugcuguuaguguggcgacaucugguuccugucacacugucaaugucuaugaauguuauagucaagauugugccuuaauaucauuuuaaaucuuuauuaauuaguguuucaugaauucauguuuacugcauaauuacagacaaguuuacauccaucaucuuuguuuccuauuugaccuuccuguuuaauguuucuuucccccuuaucugaauuucauuuccuacccuguuaacuuguuucacagcucuguucuucugucccugauuacccuggggccagcacucuuucuugacacauuacguuaucccuggccaugaccuccagcugcagagcccugucugaaacuggcuuguucuaacccugaggucuuggaauuuagcaggcauggucucacuggucagcuucuuaacuugcucuugucagcucugugccugagcuccugucaugucugugucauguuguaagagguuuuguuuuuuccucucugugugcccaagucuucccagggcuucccccugcaggagccauaugagagauacacagguguugcucuaggaguggugacaagagauggggccaugguggagucuuggucccuuaugcaaggugaacucugcccuuuacauuguuagaaaaguuuaaacauaugcaaacaguuuauuaauguacucugacaaggccacagagcuauuacuacacaauucaagcugccaggauucugggacauggcaggcuuuagccaucuaucaagagagggugagguagcaaccagccugauguugccaugucucuuuacagccuauuccaggaagcugagccuugccuaccuagcugggaugucucgcccugaggcuccacaacaagcuuuaccaucauggaaacuuggugccacagacaucugaggaagguagcaccuucauugggaggccaucccuggagagcaguaauuccucaugcgugcuuugcucugguggccgggacugcccauacguuugcugucacagacgugcuucucauuaaaucauguaucacacagcccagccucugccuaucucugggacguccgugcacaaggagcuggaggaucugcuguggcucucuccccuucagugcuuugcugugugauuccuguagcaugaggggcguuucagacccugguguagucugaagugcugggcagaugaagugacaggcagcucccacgugcucggccagccaagacaccaacaaugcuacaacagucugagagaucaucagaagccagcaucccugugggcauaugaauggcaccucuggucccagggccugcaugccuaccuguccugcugugggagucccaugucugccuccucugccucuuuguaucugaugccugaggcucauuaagcuguugcagaugggcagaauucaagguaacagcucacagugaaguggccagggccucaagccaagucaugguaguauguguccccuc

SEQ ID NO: 6547 - RNA, 257 nt, Mus musculus
cucgcuagugacgugugugugugugugugugugugugugugugugugugugugguguguguguguguguguguguguguauguguguguguguguggugugugugguguguguaugugugugugugugugugguguguguggugugugugguguguguguguguguguguguguguauagcacuuccgguguggcugcuugcauuuuggugcuguucuuuugcagcagucuugacagugccuauggggcagugguga

SEQ ID NO: 6548 - RNA, 9667 nt, Mus musculus
uaacguaguuguagagauuccuuuuguuuuauaggcagauagaauaccugcucuaguugccgugaguaugcuguugaaacuuacccuuggagcaacucuccagggaggaugauauuuuuccaugguaggucucugaucugaggcccaugguaccaauguacagaccacuuuccugcaggccgagcacaccuccuauuugguagaguagauucucaugguucacccaggcauggguggcaccuggcuagguucuucuuguuugccauuuaagaugacagaggcagugggugaguuacccaucgucuaucagagcuucggggccugaguggagggcugaguucuuauguggguugagcaugccaggaggauuugcaagugccagacuuugggucaugagcacgggcuauagcgcuccguucaccguuccccuccuucaggccuuuacuuguuggggaguggaaggggucaugcuuugguuguuugccaaacauauugguguauguuuggcaaacacacaaaaaaaauagucaggcuggaaaguaagauaaauuuuguuguuuuuuguuuuguuuuguuuuaaucauaagagaguaaguuugggcuuauauauguggugguuuggauggaccuaaaggccuuugcuagcuccuuggauggaaaggucuucuccugucuugccagguuuaacagagguuuucccugcuucuaugagugggaaaccuguugcaccguuagaaaugguuugcagcacuggccuuauguauuccauaacuguuguuaaagaccccaucucucucucucauguugguauuugaaguuuuauaugcauuuaaccaguugcagaguguuucucuauuucuaacaucaucugaagguacaaagauagaaagaauaucggucagcuucucugggcaugcucuguuggggcuggcugggagcugggaauugcuggcugaacaaaaggggccgugaguuccugcacucagugcccaaguuuguucuagcaaguagggugaaaggucgccuguguccagacauaguggaagggcuguuguggaguggaggaguggagcuccucccacgcaucguuagcugccagggcuccugaucuuggccuccagguacucugagacucaggacuccuuugaaaagccccauaggugaggguuacuacaugccuggacucuguggcuacuaauuuauuuaccaaucccagaagcacuuucauagucucagugcugccucgacugucggcucccucuuccugaauacuaaggaagaagacucuagagaauaacauagagcugauauugaucuuuguuuuauguguucucaaaguucacacaugaguuuauugggaaauuaacagguacaucauuuuagggaguggaaagugagccuaagugagaaaguuugcuuugacaucauaagcaaauagaauaaggugaucaaaccuugaccagcaagcacuucccugauggaaauaaguuacucuaaaguaacuuaaagucagccucuagauguuuguggacgguucaguuagaaauaaucacaacacuucuuacguguaacaguugauauuuaaacugaagauguuucuggcaucaaaacacauagcuauauuuaauaguaacacaacaacacgguaaaaguuuuaguuuugaaaaauaguacuuguuuaagguccuuucugugagucuacucacauugcugagcuaguucuguguauuucccuggugugucacaaacaugaagucccaguguaagucauccgucuuggagaguauaagccacucagauuuuuuuuuuuaacaaccagaaguagaaacaccuuuuaauauuuaucuuaauguuuacaaaaaaaacuaaagauuacagccuuuuguccuuuuugaggagagaagaaaaauuguauuuauaaaaacugacuugauaaaaagugaagguaaacugugggaacacuggcuggcccagcacuuaggaggccaaggcaggaagaucacaaguuuaacgccagccugagcaacauggcaagacaguaccuccuccaaaaagcaaaaaagugaaguugcugccuggcacguagugugaaaagccucucucuagccauagcacugagugcacuugaggccucaggauacccggguucuucugcggagaguaagcacucuugggacggggucauucagcuuuggcuuuuuaguuccuugcugggauuuuccugugucccuuugacuuguccucuuuuguccuuugggucugaggucacacugagccuccagguucucuguagcacugagggugggcacauccugacggguggguuccuggacugugccuuccucaucggccacucggacguucccugggcuguaggccgccagcugacagagagcuacagcugccgucugcuucuguucaucacugcuguccuccgugugcacgucugggguuguccugcugugggccuugucuugcggugucuccacgcggcuuguccuaucuucagaacccuuugucucagucuuuggaguggcagcggguucugcaccuuggggugggccugggagggcgggccuuggagcccaggcguugcagagauccuucacggacagauugaguggcaggucuugcagagugucugccugggcguugcuugcauacauggguccauacguggcugcaggguuugucuccagcuucuuagagagauugaggggaccuauucuggagugguccucugggcuggaggguggggccucugugaugaaagaguuacugcucccugucugggccggagggucaccauucauggccugaaggcuagaagacaugaagagaaaucuuaggaaaaugaucauguaaagcauuuggaacaagugugaacuaacuugguguugagcaaaaaaaaaaaacuacauuggagauuuugaaaaagaaauucucuuaccuuuuuggagacucuguucuguuugcaggagguugagagugagggcuuucugaaccccuuuggacagguuugaaggcgguggggcucugcucagcuugcuggagucgcucuaggguuccggaggaggcugcuuuguuugagaggucacacaggccuucgaauguuuggcuuguuugggugaaguugguggggcuuggccuccccggggagcccguggcagcgcucccugcucgggggcucauuuuggcuucuucugcaucccuuugcccaucuuuagaaggaucuuuagccucaggaacuggacuucccuucucacacucuguguguuuccugugggagcuugaaagguuuaacucugagggacuugaggcuggguaagccaggguugcaucuucaagcaagcgagagcucugaucucgggugaugccagugacagaugggagccugagacuguaggagggaaaugcagacucuggucuguaaaacccauaagggaucggcagauuagagugguacugcuggaaaaaucuguaguggucauauguugauggggauguguucaagugcuugggaauuggcccagcaggagacaggaagugucuuuggucuugggucccauagacagacagcaaaguggucucacacucaggcguguucccagucaggagguagggggaguagauggcagccagcccaugcucugcguagaagggauggggguacuccgggauugcaggaugcauauagggggagauggcaccaaaccccuuuguagaggagauuuuauguggaaagucaggagggaggaauggggagccagcuuuccagggguaaccgggcguguggaaugcagacuuggcauggaaugaggaggcuuuggugguagaguuggccagcacuucaguggccucuguaucuucuggcccccuaagucuguguuccccaacuggaacaaaugcugaaugucuaaccccacugucgaggcagggcugggugcugagaauggcuucuggugccauuucuuucuguagggcugguuucuggggaccuuugugggcuccccgagccugcauuucuagguucucuuuggcauccuccuuugcagagcccuguugagacuuuggaucaaagcuggagaguccauuuaggagagauuuggaaguggcuggcuuugaggugggcucuggcuggugagucugcuuaggauccagcgagcuagauuugggacacuugggaauacgaucuugcucugacacuaaaguaauggaguuuuuacagagaccguacuucaugugauugaaaagaugugacuucucguuacauguaaaaggacacuggaagcauuuguacuugaagggcuuuccugggggccguggaauauaguguggcuuuuuugguuuccguuccuuuaggagacucauuauccuuuguguuuggacucuggucugcucgguguguggucacugcugccuccucuuugaccagaaugugguggcuuuggaggaggugaguacugucuucuuucuugcugugaguacucuauuugaagccagcuccaugugcugagggccuaaccaggagaguuccuuccgucaggcaccugcagcuaugaggacagacagagacuggugucagguaaaggguuagagggucacugucucacuaaagacagacuaggagccuggugccuuuagaaagcaggcgauaucugcaucccugauagucugcucuccuggcugccagcauccugggauauuuucuuaagucuaaccugaaagacuugccugggaccaagagagcagagugucaguagccagccucugaguuuuggggauccauauccugcaagcuugacuuccccuugguccguuuguuuggggcuucugauaggauucugugaccagagccuccccucugcaugcucugugggagcggacacuuaguucaaugugcucuggcguuguuuagcugaguguuccaagguccugcuuagcuaugcugcugcuauauuaugugugugaauauuuaaaauaaaaaauauuuaagacauaggacuuacucuacugcuucuaaaacuacagaaaagcccauuuuaucagaaaguacaguggguaaauguuacccacugaacuacacccuuagcccuaguaaguagcauuuaugauggcuuaauacaaaugugaaugcuauauguaggucaacucaguuugcaguuguuguuaggaugauuugcaagucccggauuggcuuuuaugucuugccacucaucaguguuugggaauaacucauagauuugcccuucccuuccuuggauauauaaaccuucuuaagagaccagagcagcaguaaccagguagagggaagaagccacccugccccaugugccccuuguacccagaucuuacagugugcuuccuaauccaaggcuaagcacuuagugaagcugccucccuggacaucuagggugacucuggguggccuuggguagagggagaagguugaggccaggcuccuugauuuguacaggauaugugaaaaggggaaggucuccuacuucguaugcuaaacacuuaaaaauaacauucaguggaaauuguuuaagaaacguguuuucagcuacaaaacugaguuuguaaaaaaaaaaaacauguaaagccacgcccucaaaacuuagacacacacacacacacacacacacacacacuucuguaaaccauaccuuuagaaacauaacuacauucuuaugauuaaguccucacucuugucugucuucccuguucccaguguguguguauggugggcaguggguguagcagcuucagggacugacucuuuaucucuacuuaugugcuucaaguuucugaggauucuaucagguuucauuugguuucucuucuaauuuacacacacacacacacacacacacacacuauuauauauauaaaacuauaucugccacugugguagcagcaauuccaucacuuaggguagacuaaggcagagggucucaaguucucaaguucaaggccugacugugcugcuuggcaagacuuuuuccucaaagcaagaagcagccuacaaagagcuaaaguuacccgaucaucagcauuuagggcucuuaaguaguugucugggagagcaguggcucaggcgguccugaaaguaguccacugugagagucugcauggcagugagagugaagcccccaugcuaggaggaagcuaggauccuaggcuccuugcaggaggaguaugggagacugagcugucaaaguggguccugccuggacuucacuuuugcuguagaagcuaaagugaagacagaaguccuaugucaaagcugaucauauuaacacuuaguaauagccuugugacuuuuccuucuuauuaaaaggaaaaauguaaagaaacucucugugggcccagcguauaccuggagugcauuuucccugccugcgucagggagcccgagaagccucccuugucugacuggcugaugagggcagcucgauaagucagugggaccugugcuggcaugcucauuacacucuugauucugaaggcgugagaaccucugcaagucagguucccauggcuguauaggauaugucauggcacagaucugagagggaugauuucaucacuagcugggagcaucaugaucagaaugaugacaguugcaaacauucgucgaguaugagcugcuucccaguuccuggggacagacgugggacagugccccguguguccugggcaggcuagaagagccccucaggacguaaggaaauaaugacgggcccucagagaagcagcuguaguaaacguuacugaugguuucgggcagcaguaagcgugccacugggguuaaguacugaacaucuacggagguuaaauaaguacauugucaugguaaggguuuccugucuuauaagaaagaggaguaacugaggaaauaauuauuaccgagugugcgugcaugcgugugugagugugugcgugugucaugcuaugugaaguuuugguuucagccuuugucuuuuaauuuuuuuggcugcugauccccaggacagugagcaggcuggcugggauaggcagcaguggcucuuguguaaggguucuagagugaggccauuuccugagguuuauuaaaacugaaagggaauggauacagaagcaggcucggcuguaaucauuucaguaacuucggauaaacugacccucaggauuucacaauugcuaauuaaggcggagagcucacugcuuggaggcagguguaaggcgggcguaacucaucuauaaaacuaccguguuagagaaguaagugggauaaaauugaugcuuuuguaagcuuuugaaugaugaugucagccugugaguucucuguccuaagcaagugagguuuaugacuaucaagaaauaaacccacagccaugacugcagccaggcacauaugucugugggcauggaggcuuacaauaaguccuguuuggucaguuuauaccugcuggacuuugaacugucuggcagccgcugguguuaaauauucccaaaagcacacauuguugccaaaacaggaaagccaagaacuuugacuguuuacaguacuuuuggguuuauauucaaaggugaagcuuuuccuaaaggcauaagaaggguauguggcuucccccccccccccuuuuuuuuuuuuuaagguugggccuguuacuacuuugggaauacaucucuggaaggcuauauguguagcuauggcugucugagaacuguaguguuagcauguuugauacugaaacagucccagaggaauuuuacuuggcaccauacccuccucccuucuacuucccauuugauggucagggggguucaugagggugucuucccacaggcacucagcccucaucaagggcuuuuggcagagaguuguucucugucuucccuggggaagcccuguucucaaacaugccuccccagaccucaccuuggccccagacuuccuucucugaaucaucuugcaaugcagcauacaguauguacaauaauacagugaccuagaaacauguacaguauccagcuuaagaucuguaagaugugucccaauuuuuuugcugacacacaucaggcuguaugacuugagacuucgauaucucuuauauuaaaugacuugacugcguucagaaagggcccagggcugagagcaccuuccaccugcccacagugugccauccgggauaccugcccacacacagagugagcacuguguaguuucgauuggccacaggguccuguuugucuuuaaagcauuaaacuucagcagucccugaguguggacauguaguguaguugcugcugucaagacaacagugaguggcuggcauguuuuuagaaguuucuaaggggcuugcacuuagaaaucagacaagagaaagaauaauuuaagagaacccugauaggauacaauagagguaauuacagcuuugcuuuauaggccagcgaugugacgggccaggcagcuauguuuguccugugaauugaccugcaaaucaagacagugcaguacuauuccuccuggugguguccagcugucuggcgcagagccucgcagguggaacgucgugaagggcaugcuauaauuacagcacugugauguggcguuauugcaccacucaagggcacgccacugucgucuacccacuggggugucgcaagaacgagauuugugaguuuuacuucaugugggcuuuugcaguagcuggccgccgcucccucccaaacuuucuguucuuuaagaugaaggugaacuuagggaggccauagucuuagaagaaagcuguuuucuagaguguguuuggaaggaaggaucuagaaaacaaauggguuguguugugcaggcucacggcuucccgaccagcauggcaccggagcucgccuugccuguguuucuguaacacagcaguuuaaaacaucagagagccuuuucuaaugcaaacacucagauaggaaaugcaggcguuucugcuuaaaccaagucugacuuggucagauuuggccgauuauucggucgauaauuauuuucauacagauuuauccccccccccccauguauaaucuuaacaaccaaaccaaaaaccuaaacuuaguugguuucuuguuuuugaaagguuuugucaaagcagcaguuauuuuaaauuugaaaagcuuuagauguuaaacuagaaaugaaaccaaacaguuguaucucucucuauauaugugaguuuugccucuuuuaugucaaaauuuauuguaauuucuuugaaaaguagggaacaauuaagcaauacuauaaauccaucuuuuguuuuuaaaauaaauuuuauagcagaaaggauggcuugauuucuaaauaagcuugcucauagucuuggaauaacguaucagccccauuaggaguucuguaauuguggucugcauccccgagaugcaccugccggguucugaguaauccuuagggaauagugagagcaggaaagagcagacaacagcaaacaauuuacccagacagauuccucaagacacauuaaagaguaguuuugaaagaaaacuugaagaaauaguaagcacuuaccaaaggugggcagugcugggaugcggaguccuucuucugugcaaggugcugaggucugaggagcaggaucuguucucacgcuggcucgcuggcucggugaaacuggagccggcu

SEQ ID NO: 6549 - RNA, 1699 nt, Mus musculus
guuuuuuuuuucuuucuuuaucucuucaguuuucuggagcuacuacuuaaaaaugaucuuugugucugggauauagaugguaaaguauuuaagaugucuacuugucugcagugcccuuaaaguccuacuuaguuuguacaaagaauucuagaggcaaaacauuuuucucauaauuguacagggccaccucauuaccuucuaguguaucauuaugauucuugcuauuuuaaagguauuuucuuugaaagauaucuuaaaagauaguuaauacuuccguuuugaaauuuuugauguugagucaagguuuuuguuucucuuucccuuuaaaugauuaaaugauuugccucauagucuuucuucucacuguaauaagucagggacuuuaaggucuagacuugaaaagaaugcuccucauacaguacuuaagauuagaacaggggagccgggcgugguggcgcacaccuuuaaucccagcacucgggaggcagaggcaggugaauuucugaguuugaggccagccuggucuacagagugaguuccaggacagccagggcuacagagaaauccugucuugaaaaaaaaaaaaaaaagauuagaacaggggguggucuggucauucuuagugacagauggguccucucuggcuaggacuucuuuuuaauaaaaagaaauuuaauuuuuuaauacuuguuuaauuuccagugugcguggguaugagugugaggucacacguguguaggucagacgauaaccugaggggucgauucucuuucugccggguggguucuggaaucacacucagagccucacauugguggcagaggugcucacacuuacuaagccaucucagccagcuggguagagcugguaaguugauuacuugcuuccaggauuggcuguguuugaagccaucugugauacuuuaaaaccccaggcgccuaagcccugccuaggacagagucugucugucugcaacucuguuucagcacuggaagugguggaagcaucccagggguucugaggugaauuuaggguugaaagccacugcccugacguuuuaggaguagcauacugccuuagucagguuuccacugcagugauaaacaccauuaacaaaagcguccuggguaggauaggguuuguuucaccuuacaguaucuagucccucaauaagggagucagggcaggaacucaaagcaggagucuccuagaggcagacauagaagcagagaccguugagaaccacugcuuaucuguuuguaaguccuggcucauuugguuugccuucuuauauaccccaauaccaacuuccuuacaccccacaaccaccugacaaggcuuggugccaccuccagugggcugggcucuaucagucaucugccaagaaaaugccccacaggccaaccugauagaggcauuuucucaguugagguucccauuccucagaucuagcuuaaguugagugucaagccagcacagagacccuguucccauuuuuaacaguguccagaccgggcagucuguguaguuccaguguauuucaagggcagcaggcagcagguaaggguucccucucgaggacucguugugacagcugcugcugcugcuaacucccugagccugggcucuuaacagcuuccugugagaucuuggguagaguugugugggugagagguggaggaaggaggugaguguaucu

SEQ ID NO: 6550 - RNA, 42579 nt, Mus musculus
cgguggggugacggcuggcgguggcugcgccgcauccgacuggugggcgcgggaccugggugggcaccggagccugucaucccugagggguccguggggugcgggcggcgaugcaccgcugucccucgcccaagggccgcgccgggcucuuguuccccgccccgcggccccgccccuugccccaccccagacgggagaccuaacccgggccgcagcgcagcggccgcagcaacaucacucucaccgccgcuguuccgccccauccuuuucuguuuuucucucauucuccgguggcggcggcggggaaggcgaaggagaggcaacagcagccagccuuggcugcaaugaaugauccuccacccggaggggaggacuccaggugagccucugaccucgggaggaucgggacccuccgagccgcccaggacucgcaucccccgccauggaucccuaggggaagggaaaaaggaggaggaaaagacagcucugccgcccacccccaucucauuuuccucuuccuuuaucucauuguugccgaagcuguagccguagcgcucacucuugcuccagcaugggguggauuccaggcacuacccuucggcaggagcagcuugcgcgguaaccuagggauucugccuaauucuaccucuccagacugugcacagaaagccgcggagagcuguggaggccuggacugcagcagucucggggccaacucccugcauccccacccugguaggcugcaugcggauugaagagaggugccugagggcugggccagcccgacugaucccgaccuaggaguagggcagaaggaccgcccaggcugcagagcggcccaccuggaaggacagaggugcaagauggccaguaagaccaaggccagcgaggcccugaaggugguggcccggugccgcccccucaguaggaaggaggaggcugcuggucaugagcagauucugaccauggacgugaaacugggccaggugacucugcgaaacccccgcgcggcacccggggagcugcccaagaccuucacuuuugaugcuguguaugaugcuagcuccaagcaggccgaccuguaugacgaaacggugaggccccugauagacucagugcuucaggguuucaacggcaccguauuugccuauggccagacuggcacuggcaagaccuacaccaugcaggggaccuggguggagccagagcuccgcgggguuaucccgaaugccuuugagcacaucuucacccacaucucccgcucccagaaccagcaguaccugguucgugcuuccuacuuggagaucuaccaggaggagauccgagaccugcuauccaaggagccaggcaagaggcuagagcugaaggagaauccugaaacaggggucuacaucaaggaccucucuuccuuugucaccaagaaugucaaggagauugagcaugugaugaaccuggggaaccaagcccgagcagugggcagcacccacaugaaugaggucagcucucggucccaugccaucuuuguuaucacaguggagugcagugagcguggcucugauggccaggaucauauccgaguaggcaagcucaaccugguagaccuggccggcagugagagacagaacaaggcuggucccaacgcagcuggagggccagccacacagccaacagcugguggugggaguggaaguggcagcgcuagugguucugccagcagcggagagaggccuaaggaagcuucuaaaaucaaucucucgcuguccgcccugggcaaugugauugcugcucuggcuggcaacaggagcacccacauccccuaccgggacuccaagcuaacccggcugcuccaagacucacuggggggcaaugccaagaccaucaugguggccacacuggguccagcuucucacagcuacgacgagagccucucuacccugcgcuuugccaaccgagccaagaacaucaagaacaaaccgcgggugaacgaggaccccaaggacacacugcugagggaauuccaggaagagaucgcucgcuugaaggcccagcuggagaagaaggggaugcugggcaagcgaccucggagaaagagcagucguagaaagaaggccgugucugccccagccggcuauccagagggguccgugauugaggccuggguggccgaagaggaagaugauaacaacaacaaucaccacccaccccagcccaucuuggaggcagcuuuggagaagaacauggagaauuaccugcaggaccagaaggaacggcuggaggaggagaaggcugccauccaggaugaccgcagccuugugagugaggagaagcagaagcuucuagaagagaaggagaagaugcuggaggaucuacggcgggagcagcaggcuacagagcugcuugcagccaaguacaagguaagguccccagacaaugcgaguacuuugauugguagauuuucauuugagggucugugaguuggccugagugggauaucccaccucaggaccacacacugaugacugcuccggagcagcuaagcaaaguaccauaauacuagguagcuaggugcacuuacaugcgagcauccacaccaagcaaaguggggagaugucuuggaccaguggacuccagaugcuccgaccaccucugccacugucuaccugugcaaaugaccccaggauuggccaggucuaugagaagccacgcaggaccucugugaguauggcuucucacuucugcauggcccccucuccugauacuuuuucuucucucugcagugucuuugggccucguaucauauuaauaguaucagacauuuggauagcacuuuacaguuuacaaaguaccccauuuuuauaucaucuggucucaucuucauaggagccauuccaaagaguagcuuuuaaagccccaucuuacuguugaggacuuaaggcucaggaagugccaagguucuuucuauucuucagaguagcugggcugagaugcuacuugcagacuucaugcuuuuagucuucaguagcaaggccagagaauccugcuuccuauggaaauagcccaguggaugacaaagugccaggccuaccccuuggugucauuaauaaggagacucagagugucauguaggaggaggugggauggagagagaagugggcucaaucccagaccuggagucuaggccucuuaggcucaggcccauugaguggcugacuggcuguggguuucccuuuucuuccuaccuccauuucccguuuuauaaauaguauguuagccagggguucuaccaaucaucgggggggggggggggggggaauaaaaagaaaaagaaaaagcaacuggccuacacacugaagccucuugucaacuauggcuaauuccuuauugucuugagaggugccggggcuucugcauccuuccugagcugcccacuucccagagaaccuccggcccuacguggaacuaaguuacugagucaauuauagaccuguuacauuucuucaucucucucccucccccgcuuuuccuucuucuuuguaaauggaaucucggguguagucuaggcuggccuagaacucucuauuuagcugaggaugaccuuguaguaauuaucuugcugccucccaucugcugauugcugggauuauggacaaguaccaccaccaagcuugguuuuaugcacaguuggagaucaacacccucucugcccccccaccauguuuagagcauucuaaucaacacucuaccaacugagcuccauccccagcugccugugaaauuucagugcugcagaugucacaacccaguguuccaggcauuuccggcucucuggagccuuccacacagggauuguagaaaaaauaugugaacucgcugggaagaucaaacauuucuuauuuauucacaggagugugggcuaggaauggggaggcccagcccacagccaguggaagagugacagcuugaucucugugcauugucucuguacuuggaaugugcugcugcaccaggggcuguggccuggcguguuuaauauuuaauucacucauggagaagcucuaccaggguuauacugaacuguuuccucagagggucugauaccagggaaacucaagaugauaaaggcaaggcuguuaguccaguccugucuagcagggggagaaucuaacaugcagccugcuguuauugacuggaaaauacuauuugguccaucagucauugauuucuccucuaagacaucccuuaccuuguuaagcugggaggcuguagagguaauacaggcuaagaaagggagaaaguggauacguuaaauguucuuauaggaaacugacugguauuuuuccauaagguauuugaauuuaaggcaauguaagaacccagguaauaagacagucaaaaaaucagggaagaaucaugcauaguagcaugcgucuggaaucccagccaugcagaagauggaggcagaauaguucaagccuaggaguugagacaagccugacaacgugaugagacccuauuucgaaaauaaauaaacucacaaguaaauaaacucacaauugaucaaaauaaagacugagguggccagaacuagaaucccugcacuacagguauagcccauacaaucuuacaaucuuccugguaguguaauuuuuuucuuauuaguguauaucaguuauauacaguguauauacagugaguuucaucaugacacuuuuauacaugugcuucauguauuuuuauuauacuugcuuccuauacccucucuuguccucucccuacuuccacugauuuccuuacucuuucuucuuugugugugugugugugugugugugugugugugugugugcgugcucgaguguuccagugaauuucauuaagguugcuuacaagugcacuaacaccuuaccaguaccuagaccacuguggggcagggagaaugucugccaccuucagcaaccauuaacuacaugaaaauaauuuuuaaggcuguauuuauuuuauguguaugugugugccugacugaugugcaucauguaugugcaggagccugcagagagcagucaaaagagggcaucagaucuccuagaacuugaguugcagaaaauugugagguaucaugugggugcuaagaacugaacuugaacacccuggagaucaguaagcacuaaaucaggaauccacccagcucaaggaauuugucuuuauguaacacuguaccaucauuuuuuuuuuuuuuuuuuuuugaagcaggguuucucaguguagccugggcuguccuggaacuauguagaccaggauggcuuugaacucacagagauccaccugccuuugcccucccagugcagggauuaaaagugugcacuaccaauaccuaguuacacuauaacaucuuaauccuauucuuucaacaaccagaagucaucugcaucauuuuaauuuugcaauuauggaaacuaaggcuaggagauguuggcuggucuaugaaucugguuaaguggagagccaguuuuagaauucaggucuucugguguccccaguccuguguucuuuucaaaucaccuaagguuucuccauguuugccuccugugcgacuccgggcaaaggcuuuugcuucucugagccuuggguucccuguccucuaaugagaaacaagcuuuacagagauuccuggggagugggugagauggccauuaaguacuggcugugagauagauagaagcugagggggaagagcagucugggaaauuccaggaaaggaaugagucccuaucguuugauuucugaaguagccaccccaggauaaccagcagggauggaggccagaauggaacccaggcagaggacccagccuuccugugcuggcccuagaguaaaccugguagagcagugcacggguucugagauggcagaaacauuuugacagcuccuuagggagccacaggauagcgauaacaauccuguccugccucuuucccaggguugcauaggagaugaaaugagauccuuagcgugugggcauuuaaaauagguugaaaacauugaaaggaauggagggcauuagcagccgcagggugccuucugucugccaagcagaggucugacugacacuuuuguuguucguuuaacucuuucuuuacccugccuuucuaagagccuugucccaccucugcagagccuggcggggaaggucuuggagaccucaggagccugggaguuuucuguuucugugugcaguuaacucuugccuacuuucugaguuaagcaucagcugcccuucucacuuccugccuucugccauuccuuuccuccaguucuuaccauccccgaggucaucucagugucgcugaguggaccccgugcccucauucccugugacugacucaucuucuguaugucuuuccugcuuucccugccugucacccccaagguuucagauucucuuuguucucuccaugugcacaaacacugugcaugucucuucuaaaucuuuuuuuuuuaaaucucuuuggcuuuuaccacauuugcugugggcucagaauagguauacagacaugugagguuuuggugaugacugguguccuguuuagcauuaaucauuagcaagccacauacuuaggucauauccccagggagcugaaggacucgauacaaucucauccuaugaaguaggaggaauaaauaacauuacagacucacagugcacuacaaaugcacagugacgacucagcucugagacugcacacacacugguguacucauguagacugagagaagaaaggcccucucagauuuaacuuuuuuugagagguugauauugauucuacaaaauuugaugcucauuggguagaaaggaaacuguuugggggagguggguaggacccaaaacccaggcugaagcaggagcagggcaacugcagcaucggggugaauuuggaggaagcaggucugaagaucgagugagaagcagggacucuggcuggagcccagcucucucucuguaguggguuucaaaaaagaacccucagaaacagccaccgaagccagggggaugagaucacuguggggaggacaaacugaacugaauauccauugugcccuuuguggguuccucuucuuccuccuguguuggagaaugagcacuauccacuaugguguuggcagacaggaaguuucaacucaagcauuaacaaucucagcaauaauaaugagguuuacuaagaucuacuuugccaaaucauaugcagauaugcaaaugaggucauuuguucuacccaugcacuagcaacuuccaggaaaugcauugguuguuacugcuuccauuuuauuuauuuuuucuuucgaggcaccaggauugaaagcagggcuuuagcuacaccaggucagccuuguaccacugagcuacacuccuaaccugauuuuaauuuuaauucgguuuccuuuuuacuaugcuguggauugaacccagcaccuugcucauuuauacaagacuagcaauggccacugagcaauauuccgccacauaacacagauaaccuuuuaaaacuauuaucaucaucauuauuuguuugguuuugagagauuuugcuauguggugcaggcugagcuggaccuugguaaguagaucagauuguccuugcacucuaagagaugagcuugcuuuugcuccucaaguguaggaauuagagcuguacaccacauaccuaucaaaaccauuucuuuaauuuaauuuaauuuuguuauuuuguggggggauuuuugugugugugcgcgcaugcacuagcaugcacuacacuggcaguuagaagaaggcguugaauacuuugaaacuggaauuauggaugguugugagcuaccauauggguucugggacucaaaccuggguccucugcaagaacaagugcucuuaacugcugcaucaucucuccagcccugcaaacuauuauuauuauuauuauuauuauuauuauuauuauuaagucuugcuguguuguuuaggcuagucuccaaaucccaaagcucuuguuucaauguccugaaugcugggacuguaagcaugaaccaccaugccuguuuucaagaacugcuugacagaauccacuugcuuuaagcaugagugugggcuagagauguagauuaguugauagagugcuuacuuauuuagcaugccugaaacuguggauccaguacccagcacuuaccaggcgugguggcacaagccuauaaucccagcacucaaagguagaaaagucaggaggaucaagggucaaggucauccuuggcuacauagcaaauuggaagccagccugugcuauaugaggcccacuuucaaaacaaacaacaaugccacaauguugguggcuuugguggugaugguuuuauggguuuguauuuaccuccaaacucauuuauuugaaugcauuaaauaugugcagcauuaguuuguguuaaucauuccgugauacaguaauaagcucuaccuggaaguggagcucagugguaaaauagucgcuuaauuugucaagaucuaaauaagcuggacaucacccuuaaaccuugccuaguaaccuagacagugucuucuuuccaaaagcugaucugguuucaaacaccuguucucaaggacauaagccccaugcaggcagugggaaaugggccuggucauccgagcucagcguguacccugacccaucccaguugagucuucuacugucagaucuuuggcaaaacuuggugguaacacauggcccguguuccagguugggucuagcauauaagucagugccuauagccucuccuuguuggugggcguguaucagucccucugucccuucuaauuccuggugaguguggucaguucacagaagaguucugugcccagagcauuuuguaagauaaaaaucugacuggaggaagccaaggaggaggugugguggcaccagcacuugaaagguagaggcaggaggacacuggcuaugacccuuucccagaaucugagggcauauaguggcagagcuuugccuagcugauacaagguccuaaguuugauuuaaagaucugaaaacugagauuuuuuuuuuuuuugagacagggucagacuguaaauguagccaaggaugaccuugaaucucucauccucuugccuaaacauucuuagcgcugggcucucaggcuugcacagucauccgcaguuuaugugguguuggagauggaacccagggcuuugugcaugccugugagcacucuacaagcugagcuaccucccugguagcuugguuuguuucuuugguugguuuuugagacaggucugcuguaaccuaggcuagccuugaacauuugauagucuugccuucauaucccagguauguaccaucauggcugacaauacauuuaaaaaaugauuugaccauugggaaauauauaugaaaugguuuauauauauuuccauuugcgauuugggcuucaggcucugguugaagaagacccuuugguuaguucaggucucucagcucugugcugacuggaggaagggcugagcauuguugccuuugguccuuccagccuccggaaacaggagacuggaugaaguggcugugauaauguucccauuguguucugaggaccaagagcaaacacuuggaauucagaucaagaaaagcacuuugcucuugacuuggcccugccagccauugugccuggccccgggcacuucuuuuguaguugcagaacugcguggcaagucugaguggauagaagaaugucucuccuuaguaacugcuguguggguguguaagaccaaccuccaugcucggagcccauauaccaucugcauucuaggguugggaucuagaauuuuuuguuuuuguuuuuguuuuucgagacaggguuucuccguauagcccuggcuguccuggaacucacucuguagaccaggcuggccucgaacucagaaauccacuugccucugccucccaaguguugggauuaaagguguguaccaccgcugcccggcucuuucugcguauugauacaucucagccccacagcagccccaugaagcagugcuguuccaauuuccaacuaaggaugcugaagugucacaugccucggacaugguggcuccggaguaaugaggcuauggcuucuuucucuccacccugcaacacaccugaucaaguuuaugccagaucccuagcuaacaggucccagugggagcuccugucuccugggaugcuuaacucagcaaccccgcccuuccauaugaugcaagcccucagacccugcuguacucaggccaucaccccaagucauauaaucaaaucucaucuuaaaauuucccgaugguggugacucacuccuuuaauccaaguacuugggaggcagaggcuagcagaucucuaaguucuaggcuggccuggucuauacagaguaaguucuaggacagccagggcaacacagaaaaauccugucucaaaaaaaaaaaaaaaaaaaaaaaagaaaacuacuaaaauaaaaaaauuuuuuuaaagucaaucuuauuggccaaguuguccuaaaacuugcucuguaguccaggcuagccuugaacuugauauccuuccaccucaaccuccagccuccaaugccacaauacuuuuuauuuuuuuuuaaagcacugauauuuuguuuaauaaguuaguuuuuucuuuuuagacaauaguggggaauugaacuuauucucugcauugaacauggauacaaggcaagaaaucuaccauuaugcuacagcuauaauuugcuaaaaaauauaauaugcuauauuuuauuugaaacaggaucuuguuauauaauuuaagucagccugcaacucauuauguagcccaggcugaaccuugugauccuucugccucagucuuccccacagcuguauguugccagauuccacuuguuuauuuauuuuuacaauaagcacauauugcugccaggcagugguggcgcacgccuuuaaucccagcacuggggaggcagaggcagguggauuucugcguucgaggccagccuggucuacagagugaguuccagggcagccagggcuaugcagagaaacccugucuugaaaauccaaagggaaaaaaaaaaagccaggcaugguggcguacaccuuuaaucccagcacuggggaggcagaggcagguggauuucugaguucgaggccagccuggucuacagagugaguuccaggacagccagagcuacacagagaaacccugucuggaaaaaccaaaaagaaaaagaaagcauauauugcuuuuguuaguuuugcuuugcagugcugagcauugaauguaauaucguguaugcuguggugcucugcagauaauuuacaucuucaggccuuuguuuuuaugauguaaaucacuauguaguccaggcuaccccugaacuuaugacucuccugucuuagacccucuaggaacuaggacuaaugacacuugccuggcucuuuuuucuucuucauuauuaaauuuaaaaauuuuacauuuauuuauuuguauggagaaaggguguuggugacagggcaauccugaaagucagaggggaacauuugggaaucugucaggauuggcaguauguaccucuguacuucaaaccugcugagccaucuugccagccugaggaguuuuguuuguuugguuuuuaaauuuauuuuuacuuuauguuuguuggcauuuuggcugcauguaugucugugugagggugucagauucccuggaaauggaguuacagacaguugugagacaccuugugggugcugggacuugaaacucagguccucuggaagagcagccagugcucccaacugcugagagccaucucuagacacacacacgcgcacacacuuacuuuuauauucaauaaaaaugaaccuaaacuuuuaaaugaaggaaagaaacucuugucaggguucugugguuaaaaaggggagagagagagagagagagagagagaguuaguuuagacuccacagaaagaaagccagaugugguggcucauacuuguaaucccgguauuuaaacuguagaaucagcaguucaagcacagccuuggcuacauaagagaguuugaggucaaccuaggcuacagaagaaccuauuuugaaaaaauaaaaaaguguuaaucccaucccaauuacaaaggcaggugaucccugcuacucaagugaugacuaaugggguguuuacacuuuuauucuguccccagcaccacaugguggcucgugagcagagcaccagcucuagggacuaugaugccaucuccuggccgccuuaagaucuugcauguauguggacucucacaggcuugugccuggauacauaauuaauuaaaaacaaacacugaaacgaagaauuagaaauucaauguugaccuggcuacugagugaguucaagggcaaccuggacaacuugugaaacugucucaaaaagugaaaagacugucauuauaacugaguuacaauaaaaaugauugccuaggaagaaugagacccuagguucaaacccaguauacugcuccccaaaaaagugugugugugugccuguuugugugucuguaugccugugcccugguagaaugauugacuuaaaagcaguaaauaauuuagaggaaucgggguuuguaauaauacucacuugauuuaguugcugauaauccugagauuguacacaucucuugaucuuccaaggaauggaaggaguaaucuuucaguuauuguucagugaaucacuugcuaggccugccaggaagccgagggucaagaacucaggcucagacagccugagaggauugacagcggagccuggcugagcccaagcuggaagccuggagucugucaccuugagugauccaacccucuggggccuguacuuccucugccaaacacuaaggcuagauagcccaagugcauccuuagauuuugucacgucugacacucuucuccugguuugcaugucagauauuggagagaaccuucuagaaaacuacaaauacaagagggaaauggcgaguccagugacauagaugccccaggguaaagacaauggccgcggacucccacaugcccaccaccaccacagcacaagcacacacguaugcauacacaauaaauaaguaaguguaauaauuuuugagacaggguauuucuguagccuugggugacuugaccucugccuccugcgugcuaggauuaaaggcuuauaccgugugcccagcacaguguuugguuuguugagagggugaagaaggaugaguuacaggucagccuaggugcuccugcucugcccauugcagggaacagccccacccuuuucuuagugcuccucucuggcauggaaggaccacuucugggcauccccaccuuguccagugcugaggccagagccuggccuaccucacucccggacaauguuuuucccaaucucuaauuuuucuuuuuccuaaugagaguauucuuggcacuugaaacaucagucauuuauguugcauuugagccaucugaggaggagacucagacauaauguccuaguuuauguccccagggcagaaaaccacugaaaauagcucuauucaucugaaaauagaccuauucauccucuccuuucaucucuccuuucuucuucccucauugcugacuccuccagaccugcagucagggagccugaaaaggagaaagagggcuggguagaaauggcugucucuuuaagagauggaaggagggacuguugaaauguuuuuuuuuaagauuuauuuauuuauuuuauguauaugaguacacuguggcuguacagaugguuguaagcauucaugugguuguuggaaauugaauucaggacuucugcucacucuggucaaucacacucauuccauucgguccugcucacucagaugcaaagauuuauuauuauaaauaaguacacuguugucuucagacacagaaaagggugucaucucauuaugagugguugugagccaccaugugguugcugggauuugaacucaggaccuuugaaagagcagucagugcucuuacucgcugagccaucucaccagcccgagauggcauuuuuugguuuggucuuuugccaugaguggugagugcaucccagugguucagccagugaguuacccacauuucauuuccuugugcuugauuuguuuguuuguuuguuuuugcuguuguuguuucccaagucagaguuucucuguguaacccuggcucuccuggaacugacucuguagacuaggcuggccucaaacucagagaucuacccgucucugccucgguagcgcugggacuaaagaugugcaccaucaccacuaacugauuuaguuuugcaguguuaucauggagccaaggcuuuguuaggccugaguucuaccuaaugagcuacauuccuagcuuuccuguauacguggucacuuaugaagcacuucuaucugcggccuaaccggucuucuuuaaccaacgcuuauaaaagaguguguucuggcuccuccuuuacagauaaguccucugaaacccagagggcugaugccucagaugcuguagcagagguggcagagcaugaagaaaggcucacucucaugcccagcacucuccaugcuaucuggguacacaucuuguacuguggauccuucccaugagccuuccaggcuucagccucucucauucuaaugauagagccuccccaagcguauggguaagagcucccuagcccacccucaucgcagaguccccauaagugccuagcacaggcaaaagcugucucagcuggaaaagaagucaaugugcucugauuuuuccugguggcucuugagucagcaaagauacaaagaucaaaugcagcuucuuuccacauacugcugcccugagcagagauaagagcacugacuuggaaucagguuagcaucuagauauccucuuguuggccggcucuacaacugugggcaagugugaaccuuaguuuuauuaugugucaaguagagaccacaaguguaaugucaugucauaagguccuaaugaugaaggggaaaacgaucugguccaggacuggggagauagauuagugacugaggugcuauucugaucgccuaaggcacacagggugaagaagaaaacugacuccugcaacgauguccucugaccuuuacuugcgaguccuuuaauauaugcaugcaauuuucauaaaagagacccagucuagccacagacauagagcaagaugcaucugagauucuuuuuuuuuuuuuuugguuuuuccagacuggguuucucuguauagcccuggcuguccugaaacucacucuguagaccaggcuggccucgaacuaagaaauccgccugccucugccucccaagugcugggauuaaaggugugcaccaccacgcccggcacaucugagauucuugucuucuguagugugccucagcauagcugaaagcacugggggguggggagucgggggguggggagcaguucccagcuccucugguucucucucucucucucucucucucucucucucucucucucucucucucagagcacaccuauaguaaugugucaccaugccugguuuaugggguacuaaggaucaaacccaggguuccuuguauauuuaagcaagcaaaugauugaaaucccccagccucccuccuuuuuccccucccuuccuucugaaaucuugcuauguagcuucacuggccuugaacuuggggucuuccugccugagccucucaaguacuaggaucacaaguguaugccuccauucgaaguucagccucuggcuuuauacuccugcucccuggaacugggaaaagugaccucugaaaauucaaggcugugucuacaagcugacauguccccuguggugauccuguuaauuguacagcagccgacugccucugauaccccuugguggagcccuaaucaaauugggaaauuacuuggaaagugcagaguuaauguaacaggaguuaugcacacagacuccuuagugaggagacaccaagcuuggagagcugcauuucugggccucuguguccugucucgaaugcauggaguucugcagcaaugucuaccuggucaucgugugcucaguuucccucucucaagacucagaccauggugcccuggagcucccagucagaucugcucuaucccacagccuuuuacucacacuggaccuguuuaacauucagagaggccaaugguccuguccccaggccccacccacccgcaccugugccuugagaguuugaaaaggaagcaccgacccaugcagcugagagcuccagggaccagcaccccaaauggcagccccucugccccacacacccagcuugaacuggacaaggguuagaggcuccuugucccucugcuuuccacaggcgaugguuaaggagagagaucuccaaggcaaaggagaugagugugcuauccucagaaagaacagaaaaagaaaaaacaauacaaaaaaauaaagaagcuggugugugacauauuucacaaugugggagucaaauagcaugggcugagacuuugccccuggacuccaaucuugguuucacagcaggaccagccccccucuccuaacacaaggcuggucuugucugccaagccuggaagacacuaaggguuuggguaaaugugcaagacuuacuuagcaagaaagcaauaaugcagauucaguggucauuuggccugggcggggccagcugaggagagggacacugaauaaguagaaugggguggaucaggagaucuuuuuuuuuuuuuuuuuuuuuuuuuuugguuuuucgagacaggguuucucuguguagcccuagcuguccuggaacucacuuuguagaccaggcuggcuuugaacucagaaaucugccugccucugccucccgaguguugggauuaaaggcaugccaccacacccgguuaagccaggagaucuuaauggagguccagccagaaggaggggucuugaagcaguuauagguccaagaagcccguacaggaagcaggcugagacucaugccaugaugacugugaaugaguggcugggaucuuggggacucauauagucuugguugauguucuagauaccaggcuugauagccagcucguauucugucugaugaugugcagaugggauauguagccagguaauauauagccuuuggauaaggagaaugugauccuagauagagguaccaagggaagauggaggcuggauaucaaagguccacguguucacucaacagucaccccaacugggcaucaugaaacaugccugaauggcagaagggucacacgaguucaagggcagccucgucuauauuguaaguuccagguuaaucucgcuacacagcaagacugucucaaagacaaaauaaaagcugggcagugguggugcacaccuguaaucccagcacuagggaggcagaagcaggaagaucucugugaguuugaggccauccuggucuccugaaugaguuccaagacagccucuuaaccuucuuugucauugcagcccaaagacuccguagccaugggaaggucuuuguugcccuucucugacucuccugucuccuuugagucccugaagauuugaaauggaacuguacacagcacuccagaccuggcugcaucauugcucucugcaaggggauaauucauucuguuuccaaaaagccuucacaaagguccuuggccacuacuguaggauuuucggcuguggcagcacauuaagcugcugucuucugggagcaguagagaaucccucccuucccgcuccuguccuggucuggcucacagcuccuugcccacagcuaucauuuaaugagcagagucaggaucaguuuccccucaaauggaaagcuguaacaaaagcuugacuaccugccuuucuuccuuccuuccuuccuuccuuccuuccuuccuuccuuccuuccuuccuuccuuucuuucuuucuuucuuucuuuuuuucuuucuuucuaucagcucacauuguuccuuacaaccuagaaugauuugagaguaucugugaaauugagcauuuaaucaguaugugcuuucuuggacaguuuuuuuguuuggggguauuuuuuuuuaagauuuauuuauuuuauguauauaugaguacuaucuucagacccaccagaagaucauuagauccaauuacauaugguugugagccaccaugugguugcugggaauugaaccaaugggccaugcucuuaaccaaugggccaucucuucagccuuuuguuuuuauuuuguuuuucuguguagccuuggcuggccuagaacucacagacaucuccccaagucugccucccgagagcugggauuaaaggugugcaacaccacggcccagcuuccuugaacaguuuccaacagaugaaucugccaucccacacuugggcauuuucccacacacucuauguguuuccuuccccuaacccucuucccuuucuccaucucccaugucccuaugcaauguugaaugaccacugaucuacaaccuucucauggggcguuuuaacaucuaaaguucuggcuacuggcuucccuagugcugcaguaauuuugucccaguuuaaagaacucugagaggucagacacaaucuucuuuuacugaaaauguguugcuuuuccuguagcugguccuguuuucuaaaguccucaacagagggacacauaaaucuucuagggacuuaggaaaaugaagguguguguauguguguguguguguguguguguaugugugugugccuauggaagccagauguugacauuacuaucuacccucuaucucuucccaccuuacacaccuuauuguuucagacaaguucugucagugacccuagacuggcuggcaagcaggucacagggaccuuccugucccccucuuagcacugcugaacuagacuuagguuuauuaugcuuacacagcaagccuuuuacccacaaagucauguccacagaaagagaugcggagacuggguggccugcuacuuucccaggugauuccaauaugcggcaaaauuugagaaguauuaucuuuuugcuuggugccaaaguaaaggaugcuagaguuacauaaagugcugagggaaauguaaagguucagggcuggaguagacaaugugccagcuaugaagacuggaccgaauggcaggccuuuggaaacuuguuauccaaguguuaggguguguuagcucggggcuucuccucacaccucucccgcacguugcuggguuuccugguagaugauuccccaugacagggaacaugaguuaauggauaaaagaagcuagcauggaauccaguaaaaaggcuuggggccucccuugggaugaucccaaggauucuguaccauuccucaaauacucacggggcacugcuguccgucaaggacugugcugggacccugacagauaggugaggcaugacucuugccuucauagagcuaacaggaugaggcagggaauggggaaacgguaggaaugugcccugguugugguggaggucugaaccggcagcuuugcagggauugaaagacauuuuccuaagcuguuccugcuaggucuuucaagaugagcaacaguuuuccaggaagcuguggaauggggagaagaaaaugucagauauccuccuguggggaguagaagcccauugauaauuugagcagaagagacauuguuuagacuuguguuuuuggcgacccagauggauagaagaggaaacugggacuguaaaagccuaugggugguucaggcuagucuagaagauuuuagugaggacagugguaccaguaaggacaaggaggagacaaugauguaaacugcacugagaagcauuugauggugacuggccauucauaggggugagcacaaggcuauuuugaggcaagcugccaagggcaccaauguagaggguuauacaaaucauaacucugaacugagaggagucaagaugaguuaauccugugacagcaauaggcugauuggauggaaagauagacagcuauccagggugcagagggcuguggugugcaucaagaauagcuugccccuccacagccccuugcucucuccuuugucuuugugacuguacagggcugauuugagccuccugcaacuccaaccauccggccauacugcaggagccagcuuccgaccuccccacagcaugcuuuaaccccuguucugcucuguucccaaugauauaaugcucaaagugggcugccugucccccgucccagccuggcagcacccccagcucuaagagcccucggacaugucagcuggucccacugggacaaauuccaguggggagacagccaguuucuuccaguagcucaaggugaugccaaccuuccaagaggccaucgaugaaaucaaagggcaguuggcugcccgaggaaagugcccucuuccuuccaacagugacagugcauuucagggagucacacuuuguucaaauccauuuuugugucagcauugguuuucagaagcaccugcugagggcgcugauggugugggggcuuucacacagcaaggcuggggacaugggauguagaucuguuauuuucucacuggugguccaagacuaguuauccuuccuuccuuccucucucucucucucucucucucucuccauuuguuacauggggaaaugaacaguguugaggguucuguuuagcaccugacauugagcuuccugugcuugugagcuguccagaaaagaagugagguucugaugcugccgaugugaggaccgagacccugacugugccucccgcuuaguuggcagagcugugaugcugccgaugugagaaccgagacccugacugugccucccgcuuaguuggcagagcgggaaccuuuuagguggugucuaaagcugauacagccucuggggccucauuuuguccccuguugcuauggaaucucucccuuguguuguucuaauuuccuuagcagcccaagauuagaccaagguuuccugcugcccggugaugagcugucuucccgagucaggaacucaguacagggcuggacugcccagugacugccguuucuccuccugcugcaugccaucuggggcuuggcugccaggaauagauugccacccacccuccucgcaggcauggugacccagccgcuucuuguauccauagcagagaucaggugccuuauauucccaaagggcuucucucuucuuuucauccuuaaggauccuguccacaaugggagcuuugugccccagcucuaggggcuggaggggaaaacuccguucccaccaauggcuacaaggcuccauccauauggauaugcuuuaugucuucuccuaaaaggaucaaagggaaaagggauggagucucugcucugugguccugcuuagaauggacuuauggaguggaagcaggaaaaucagagguucaaggcuaucccuggcuacuuuacauaaugggagggagggaggaagagagggaggcagggagggagggagggagggagggagggaagaagagagacacacacuguuucucucucucucucuaagacaggguuucucugugaagcccuggcuguccuagaacuugcucuuuagacuaggcuggccuuuuuguuuuguuuuguauuuuguuuuguuuuguuuuuguuuuuugagacaggguuucucuguguagcccuggcuguccuggaacucacucuguagaccaggcuggccucgaacucagaaaucuaccugccucugccucccaagugcugggauuaaaggcuaaccuuaacacucacagagauccaccugccucugccucccgaaugcugggguuaaagguggaucuuaccacaguugggcugagcaucuuaaacugucaauaggcaugauaauacauaccugcaaucccagcacucagauggcagaaacaggaggauugccacaaguuccaggcuagccuggccuacaguguaaguaccaggcuagccaacauuacauagugagauucuuucucagaaaaccaagggaagggccauguaugguggcacacaccuuuaaucccagaaaugggaagguggaggcaggcccaucucugugaguucaaggccagccuggucuauaaagcaggauccaggacagccagugcuguuacacagauaaaugcugacugaaaaacaaaaacaaaaacaaaaaacaaacaaaccaaacccgaaaacaaaacaaugaaaccaauaaaguuaugugcuagaacgcgauuguaaugcuagcacugcuguucuccacugcagagaagguuuaagguuagacccugcgaccaacaaacacaaaguccaaaauugagauccuauggcccuuugccaguccggucucugacccugccccuccuuguguucucaggccauggaaagcaagcuacucauuggggggcggaacaucauggaucacaccaacgagcaacagaagauguuggaacugaagcgacaggagauugcggaacagguaaggcugcuggcuuccgguucucugaggcauacggccuuggggucauguguuggauaggcuggugcguaagcccuguuggacugggaauccgggaauuauaaugcaaaacccgcacuaccuugcuugguuucccuggguguaccagcucggggucucucuuugggugagaggaagugguagauuccccugcagauucauugccuguauggcuguuuccuaagucaucaaguuaguuaccagucaacuaugaugcuaccgguaaugcccccaagguaugccggcucuuagggcuggggccuccaugcacacaggcccauaccugaaaaagcuguauucacagggucugaaaaaaaugggucuguguccacgaacaagccaggugcuacaacaggcagaucgagccagcccgugugcuccgguagccuuccccagugggcgugguuuucccuugugacccccuugcucugccuugcccuagaaacgccgugaacgggaaaugcagcaggagaugcugcuccgcgaugaagaaaccauggagcuacgugguaccuacucaucccugcagcaggagguggaaguuaaaaccaagaaacucaagaagguaagaugcgcagcggguaaacaggccgcugccuaagagggugggccucaaaggccccuccccaaaguucaaccucugagcuuggacugugggguggggagacagccaggaggcaggcaucuggugccagggugucacuugcaguguacuguguggucauccucaugguccuggcuaacuucucuacacugggagucaccagugaauccuaguuuugguagcugggucagggaaugcgguguggcuauggaaacuugcguccagggaggaagacaagguccuacacgccacaccaagggacaagaaucugcucacccggauccugcagaagucauggacauuugugacuugagaugggccuaggguaggaaguuccaguguggacucaggaacgagcccugggaggccccaggauuauuauuguggccacuucgagcugaccaggcccaguccuuaaagcaguuacuaguacagcacucagcgguuaggagggaaaugggaaagccauugccggcucucaugcccuuacuuuugaguagguuaccuucucaacucauucuaccuccaacgcuaaccguggaucuccaaaaugagacaugguuccauccuuuuuaguuugucuauauuuauuuaauuuuuugguuuuucaaauuggcacugguuucuccauguagcccuggcuguccuagaauucacacaguagauaaggcuggccucggacucaauauacucaccugcuucugccucccaaggucugggacuaaaggugugggccaccaccaucuggccuggcucuauucuuucuuuauucaguuaugaccuuaugaccuuuuaguuagucuacaucuuauuuuccucaccuguagaaagaggaugucgggcuggagagauggcucagugguuaagagcacugacugcucuuccagagguccugaguucaauucccucauggugauucacaaccaccuguaaugggauccaaugcacacucuacuggugugucugaagacagcuacagcauacucauauaacuaaaaauaaauaaauaaauaauuuuuuuuuaaaagggagaaagaaaaugucaggcuagcaugcauuccaucaguucucuuucaguuugaacacuugaugauacagagagagagagagagagauauuggugagucccagugagugggagggacugagucacggggaggacaguggcugcccuugagauagcccauccugacggagucauagggcuaggcagccauucugaguucagagcaggaagcccaggcugggugacgggccugacugaacucugcugagucacacuugugccugacugaacuccgcugagucacacuugugcauguacagcucuaugccaagcuacaggcggugaaggccgagauccaggaccaacacgaagaguacauccgcgugcggcaggaccuggaggaggcgcagaaugagcagacccgggaacuaaagcucaaguagggcuggcuccucuucugguucuggguccccacagucucccccaucccucagggcuucuguaagagacucuucggacagccauauuuugacuaagcacucacauguccauucuuccccccuuguuugcauuucugguuggguuggguuuuuguuuguuuguuuguuuguuuguuuguuugagacaggguccucccacucuguagcucaagcugucuugaggcucagcugucuuccugccucagcuucccaguuacuggguuagcacauguaggcaggcuugugcgucuucuuguuuugggucuaagguguauguauaugcacaccugugauucaaauaugggggccauggguugacauugacgaugaugauuuuggagacugggucucucacugaaccuggagcucaugagcuagaccagcucuuaaguuguucuacuuccucagccugguuugauggcuccaccucccucugucagagugucugcugagugcuaguggaaaauaaccccuagggcccugggcccacagucuuugcauuagaagcuguggucuucaaguuccauuauuguguggcaauggcaucccuuccacccuuguuaccuccacccccacccccccguucccucugugaucucugagaucucucccucccucccucccucccuccauuucugccuuguacccacccccagguaccucaucauugagaacuucauccccccugaggagaagaacaagaucaugaaccgccuuuuccuggacugugaggaggagcaguggagguuccagccacuggugccagcuggagugugaguuccaguggccgucugucgggaccuagggacuugcaagccucucccagggucaugaguggugaggggcuugagacccuguuccaggucgggucuuggggaguggauuaagaggugcacauggaugaguuuugccaggaucuauccuguauggaucaccaugaaggaaguggucaggauggaaaaggagccuguaaggggaggggcuuguggugggaagcgcuucuguccccagugguuaguuccgguggauacaugcaugggcuuguguugguugccagaaauuagcaacaguuguuaauauuugcucagcucugcuguguaagaauacaggcagaaguuaagucagacauuucugagcuugugguccagagggaaagauggagaagugucaugacugggcaccauagaggccugcugcagucuuucuagcuucucagcuggguguucagcaauuccaacuguuucuacccuggagagcuugaagucugcacaugaugugcagcugcaucaguuagcugggugugcagcgcccucugcugguagcugcguagaacgaggcggaccauacaaagcggacggagugccucuugcagugggaccaaaucuguauauaaugauggaaggauaguacuucucuggagauucuuuacucucuguaaccuagggacgcuacuuccacggcagggcaggauccuccccagagcugggaucgaagcuaguaugagguugguagugucuaagugcauacaaccguuugggacaggucugcuaguguacauuuuuaaucccagcacuggggaagcacaggcaggauuucugugaguuugaguccagcuuggucuagcaaaguucaggccagcccagggcuguauauagagauccuaucucacaagcaaagcaaagcaaaacauuaucuuccauuaccacauacaaugguuauuuuuaggaaguuucauacugagagaauuuaauucuauuuauagguuauauucacuuuuuccaguucccuaauuauauaauuuacagauguuucccuuccccuagcccugagaucauuauuacauuuaaaugccuguuuaaucugcaauugagaagggauauuuguuuuuguuuuuuuccuugagacaagagucaugcaauguagccaaggcuggccugaaauucacuguguaguucaggcuggcuuugaacuccugaguucaguccuccagaucccugccucaggaaugcugagguuacuuguaugugugacaugugcccuguuuaauugaggaaaggaaacaaauggggacagcauaugacauguacguaugacaguuccaccaugagacccauuucuuugcauucuaacuuaauuuuauuuuaaaaacauacuuuauuuuauuuuuuuaauugccaacuagucacuuuccuucuuaaauuuuuauuuaaguuuuuauugcauuuagcuguguguugggagauaggugagcuugacccagcguucauuugaugucagaggacaacuuacagaaguugagucucucuaccaugugggucccagggauugaacucagcuugccaggccaaagcacaagugcaugauuugugugugugugugugugugugugugugugugugugugugugugugaguguguguaugagugugugcaugcucuguguguggaugagagugugugugauuuguguguguguguguguguguguguguguaugaguguguucaugcucuguguguggaugaguguguguguguguggaugagugugugcauacuuuguguguguggaugaguguguguguguguguaugaguguguguaugagugugugcauacuuuguguguguguguguggaugaguguguacaugcuuugugugugucuguguauguuuguaugugaguuugagguaagcacucaugaaggcagguuguaccugccccuuuugcccuuuuuauguacuugaggcuguccuugaacuccugauccuccugcuuccaccucccaaaucugggauuacaggcaugagccagcauacuuaguugagucagggucucacuauguagcccaggcuagccuugcuccucugucuuaggcuucccagggcugggauugcaggaaugugcaaccucaucuauuugaggcaauucuuuaaaauuaaaaaauuauuuuuucucuuuaguuuaacuuuauguuuuaugugcaugcgggcucugccugccuguaugucugugcaucacgugcuuucuugguggcuacaaaggccagaagguggcacaggaucccucgugagccacuguguuggugcuaggacuccucgggaggagcaguggccgguguucuuaacuaccaagcugccuucccagaccccacuccuuguuucuuuuuaauaucugaaaguuguuaguguuggaauaaagaaaauaguuccuccugcaaacccuagcugagacugagaguucacagagaagccagggggugggcugguggcggaggggagugguggccaccccccaucucccagacuacaucuguccccuugaucucuacuuucacaacuggagcuugggggaggggaaggccuugaacauggguuucugugagaagagggugcucuggaaucugaggcgguggaaggacccucccuccuuuccuucccagacaucucccacaacucacaaaacaugacucacgcagggcugaaaacacaaaagcucugucucucaccacuaaagcauuguucaaguugugggcuguuuugcuuugcugaggccugggauacucugggaugagaacacugaagacugcacugaguggagagacauuguuugaaacaaauuaccuaaggcugggcugucccuuaggaaacagcuuuuguuagaagcagccacccucccuugaugacagccacaaggaucaccccgcccaggccgcucuccaaagcaaggggucauuguuaccaugggacaauguuugaacauggcuaugucagcuuauuugggaagucuuuucuucuuucugucucuuuuaccuucauauuuugguuagaguugguggauuaugcugguuugugagugugccuguuuaauuucucccuuguuuugcuucuagggauagagguuaaacucagugauaggcacugagugucuacuuuggugucuacuuugucacacgagaaaaugguugggcuugacuuuguuuuaaaaaccagucuuagccaggcguagcggcgcacgccuuugaucccagcacucgggaggcagaggcaggcagauuucuagguuugaggccagccuggucuacaaaguuaguuccaggacagccagggcuacacagagaaacccugucucgaaaaacaaaacaaacaaaaaaacaaaacaaaacaaaaacaaaaaacaaaaagagaaagaaaaaaaaggaagcauaaagaccagucuuaguccauugcucaggcugguccccaacuccuggucugaaaggacucuccucccuuagcuccucaaacagcugguacuacaggcacaugcuacccuguucaacucugagaaacuucuggcauuuauuuacuuauuuauuuauuuauuuaaguuagccucucacucuauagcccuggauggcccugaauguagcauguagcuaaggcuggcuuugaacuccugacuuucugccuccccaguucugggauauauaugagggugugagaccccgugcccagacuugacccagccauagaggagccagucuacaaacauucuccaugccaucauauugaugaagacaccaaucuccugagucacaaguuggccucagaugccccucaucuucugagucuucugcuucuaccucccaaaugcggagagcauaggcccguggcagcaugccuguuugguacagugcuuaggaucaaacccaggacuucaugcaugcuagguacacucucuaccaucugaacuauggucccacccuccccacuuugcuuucauaguuuugagacagggucuccugugcacuagguuggccuuaagcucacuuuguagccauggaugacuuagaccuccucaucccccugccuucgccacccaagaaccuggacagaaacaugagcucccacaccuggcuccggguuaggagagcauucccuccuccuacaggagggaagaaggccaaacuggguuuguuacagaggcaacuuuauuuuuaaaaucuugguaaaaacauuccuuaaaucauaugugguagcucgcugcuguaaucugaguacucuggaggcugagauaggaggauggccucauguuugagguuagccuaggcugcacuuaaguuccaggcagccuaggcuacauuaagacccugucucaaaaaagucucuaugugauaggugaugguggugacauggcucagcuuaugaagggacuugcuagcaauccugaggcugcauuugauccuuaggaccacacuguaggaggagagaccuccuccuccaaacuauccucucaucuccacauugggaccauggcauuuguguccuuacccccaaaugaauaaauuaagaaauuuacagcugccagguggugguugugaaagccuucaauccuagcauucagaagacagaggcagguggaucucugaguucaagguuaucccggucuacagaguuccaagacagccagggcuacacagagagacucugucucaaaaagcaaaaacaaacaaacuuuaaguaaagcuucgcagggugugagacuugagaggaagaggacagugaaaugcagacgcacagggcugugaaauaaggugagcaggugagcugaggagaaaaugggagcagacacagaaaagucccaucugcugcccugggaauguauggaagaccaggaaguccagagggugcuggaugccuguucucagaguaagagaagaaugccguagcagggagcuggagacagggcucaguagucaaaggcauaugcuggucuuacagagaaucuggguuugagucccagcaccugugucaggcagauuacuaugccugccuguaacuccagcugcacacacacacacacacacacacacacacacacacacacacacacacacacacacacauuuucaagagaaaagagugacuagaaacaacugacaaugagaacaguguccacccuugagauggagcuuaaguuuccauuuuaccacuguuguuuuauuuauaugggcguuuugccugcacaaaugucaguaccaguugugugcuagccgcccacaaaggcuagaaagacaguguuggauucguggaaauugaaguugugagcuccugugugggugcagagacucaaacugggguccucuaggagaacugagugagugcucuucagcacagucaucucucuagccucuucuccauugaauuuaaagucagguuuucauguagcccuggacuggcugguggaccuugaauuuguuguguagacaaagaucugccuccugagugcugguacuacaggaguacgccccugccugguauauguaugugguccugagugcugguacuacaggaguaugccccugccugguauauguaugucguccugagugcugguacuacagggguaugcccccugccugguauauguaugugguccugagugcuaauacuacaggaguaugccccugccugguauauguuugugguccugagugcugguacuacaggaguaugccccugccugguauauguaugugguccugagugcugguacuacaggaguaugccccugccugguauauguaugugguccugagugcugauacuacaggaguaugccccugccugguauauguaugugguccugagugcugguacuacaggaguaugcccccugccugguauauguaugugguccugagugcugguacuacaggaguaugccccugccugguauauguaugugguccugagugcugguacuacaggaguaugccccugccugguauauguaugugguccugagugcugguacuacaggaguaugccccugccugguauauguaugugguccugagugcugguacuacaggaguaugcucccugccugguauauguaugugguccugagugcugauacuacaggaguaugcccccugccugguauauguaugugguccugagugcugauacuacaggaguaugccccugccugguauauguaugugguccugagaaugacacccagaauuuuguccaugcuaagcaaguauucuaccaacugagcuacaacuccagccccaggaguaggguuuuaauauuaaagagaaagauaggauguuaguccauugggggcaggguguccuaggagccugggaucugcugacauguuaacugucauucuggguccuuuggagguguggauaacuacagagccgcaacccagccauagccuguuuacuacauaguaggccugggcagcaaagggagcaauggaugccuggugucccaauuccagacucccuucccccagccccuucuucccuaugcaggccacccagaauaacccuggccgcuuuauugggucggacugccaguucccacugacccgcugcugugccgacuuagccucgucccucuauccuauuuccugagugugcguucucaaaggcuguuccuggccccagcaugucccacaugcacuccugaaagacagugcagagucauaagaagaguacuuggggagguucugauuuuugggguugcuaauuguacgaccuuaguacaaagggcacuuggcuuuucuaagccugucucccaguuucaucuauaccuuaggagcauuguuagaaaauucaaagagauguggaguguuccuucucauugauaaacuacuuuccugguauucccacucuucucuguggggugaugaugcaguucuaccugugugcaaggcugcacuaaagcugacucucuggcaccuagccuuucuggcuuccuagagccccugggaacaaaagggaaugggacuucuagagccuucuuaucccuuguuuucauuuguaaagaggcucaguuaggaccacugaguggaguugggcacuuuuuggugugcaugguaaacuauauuuaagacaaacuucucagggcuggagagaugacucuaucagugacauauauaggaaccugaguuuagaucuucagcaccuauauaaaaagucaggcaugguaguauaugcuuguaaucccagcaugggagaggcagaaauccuaggcuccugagggcuugcugggcagccaaucuagccuaauuggaaagcucuagguucagaauuugccucaaaaauaaggugguuguccuaggguuucuauugcugugaugaaacacuaugaccaaaggaaaguuggggaggaaaggauuuauuuagcuuacacuuucagguaacaacauuucaucacugugggaaggcaggacaggaaccuggugggaggagcugaugcggaggccauggaggagugcugcuuacuggcuugcuccucauggcuuucucagucugcuuucuuauagaacccaggaccaccagccuagggaugacaccacccacaaugguuugggcacacccuucaucagucacuaauuaagaaagugcccugagcugcgugugguggugcacgccuuuaaucuuaggcagaggcaggcggguuucugaguucaaggccagccuggucuacaaagugaguuccaggacagccagggcuacacagagaaauccugucucgaaaaaccaaaaaaaaaaaaaagaaaaugcccuauaggccugccuauggacauauauauaaguacacugucacugucuucagacacaccagaagagggcgucagaucucauuacagguguuugugagccaccauguggaugcugggauuugaacucaggaccuucagaagagcaaucagugcucuuaacugcugagcuaucucucuagcccacccuuugguuuuuaaauuacacaucaauuccuuguuuuguuugcugcuuauuuguuuugagcaauucaaauaguauguuacauucaucaagcugcucagaggagaagucugaagguguggacaugguagcucaugccugugaucccagcacugcagaaaacaagacaggaugagcaagauuacaggaugaugaagaguuuggggucagguugagcuacauagcaagauacuacaguauaaaaccagaacaggcugaaugugcuagcucaugccuauaaccccgagcuuggccaguagaggcaagaugaugaagaguuaaaggccagcccuuggugacauaggcugucugaaacagaaagaaagaagaaaaagaaaguaaaagagacaggggcauggcucaguugguagacuacuacguaucaugcaugaagcccggggcggccccuagugucaugauauauuaccuguauuauuauauaccuauaacuucagcacucagacagugcaagcuaaaggaucaaaaauccaagguugugcuaugcuccguaguaaguuccgggucacucuggccuaugugagacucagucucgguaaagcaaagcaguacagggaugggucaaguagccaacuuacaaaaaauuauuuuuguuuguuucuuuguuuuugagauaagguuucucuguguagccauggucauucuguaacuugcuuuguagaccaggauggccuuaaauucagagauucaucugccucccaagugcuagaauuaaaggugugugccacaccacuguccagcuuuucuuaauuaugaaugaauuauuaauuauuauguaugaguguguuuuuuugcaugucuauauguguaccuauguucuugccugguguccucagaaaccagaagaggauauuuugaucuccuggaauuggaaucaggguccucugcaagaguguaaaugcuuguaccagugcagcuaaauacccagcucuaccuuuguuauuguuuugaaacagaguguucccuggcuggccugggaaagguaaaccaaauugacucugaacucacaccucccuguuucuaccuccugagugcugggauuaagaguguguaccaucgcugggcagugguggcgcacgccuuuaaccccagcacuugggaggcagaggcagguggauuucuaaguucgaggccagccuggucuacagagugaguuccaggacagacagggagggcuacauagaaaagcccugucuugggaaaaaaaaaaaagugugcaccaucacacccagcuaccuuauuuuuuaaucuuugucauuuuguguguauaagaguguuuugcccacacauaugccuacguacugcauucaugcauuguucagaaggcagcgucagauccguuggaacugggguugcggaugguugugagccauuauguggaugcugggaauugaaccuaauccucuggcagagcagcuaaugcucuuaaccccuacgccagccuuaccuuaucucuugagacagggucuauuucuagacauguagcucaccaauuaaacuaggcuaacuggugagcaaucucugaagaucuuucucucgcugccucccaacccugggaguuauuacucugucuagcuuuuacaugggcacugucucaagacaaaaggcaagugcuggcacucuccauuucuccuucuguguuugccugucuguuccuuugcuuuuguugugcuagggauugaaccuaaggucuugaacuuggcaggcaaguguucucgcacuggaacagauccauggcucucuuuuuuugcuucucaccuuuuugggguguuuuagacaagaguuuauguagcccagauugaucuugaacucuuugauuuuccugcugggaucaaaagcaugcaccuaguuuaaccauuuuauuguuuuaacucuuaugaaugacauggaaaagcagaccaucaauaaucaauguguguguguguguauguauguauauagacaugugcacgcacaaguaagagugugcacaggaaugcaugcaugcuagaguauacaugacguguaugcacauccuguggagguaaaaggauaaccccgggugucauuacuaagcaccauccaccuuuuguuugagacagaguuggccuuaggcaggacugacuaguugaggucuuccugucuuugugucuagaaugaggguuauaaguguuugugagaccaugcuuugccuuuuuuuuuuuuuuaacacgguuucuuuuuugguuuuucaaaacaggguuucucuguuugcccuggcuguccuggaacucacucuguagaccaggcuagccucaaacucagaaauccgccugccucugccucccaaaugcugggauuaaaggcaucugccaccacugccuggcuuuaugugguaucuuagucaguguucuauugcuuugaagagacaccaugaccacgcuuauaaaagaaagcauuuaauuggugcuggcucauaguuucagagauuuaguccauuaucguuaugggggcaagcagccagaccaggugcucuagaagcagcugaguguucuccaucuggauccacaggcaacgggaagagagcaucauugggcuuggcucugacuuuugaaagcuucaaagcccccccucccaugacauacuuccuccaacaaggccacacccuggugaccaagcauucaaaucuaugagucuuucucauucaaaccacugcacguaggcucuggggauuaaccucagcuccucaucccagcauuuaaucagcccuuuuauugugagagagucauaagacagauauauguugauuuccuuauaccaguuuacguugucagauuguauuggaacaagaaaacuguagagcccugagugcacagggccucccagauaccuggguaauaguuccuaaugaugacauuuaguuuggguuugaggaaaucccuucuaauccauccuggugauuuaggacuauaauccuagcauuggcaguugaagcagggggcucaguagcuuaagaucauccuuggcuauauaaguucaaggccuaccuggguugcaugagaccgcaucuuaaaacagguaaaaucucacuaaaccaacaauaagcucuuucuaucaucccaucucccuauaggaauaacagccaaaugaagaagcguccaacuucugcggugggcuacaagagaccuaucagccaguaugcucggguugccauggcaauggggucccaucccagauacagaguaagaagcugggaagcagaaaccaggaagggagagaaacccaaggagaagggaugcuuacagcaugugcuuccucuugggguugggguuggucuuguguauucagaugcuaaguucugugccccaagauaggaugcagucuggauaugcgcauuguauugagcaaugugaccccaauaauuuauaauuauuuauuauuuauaauuggauaauaaaaggcuagaggcuaugacuggacaggagaggaagguggagccugagauggggauaugugugucucagguagggaccaggaggagaaggaagaagguaagggaagauggagguggucaugaggcaggauggaccaauaguaguauguagucaagagaaaaaacacccugaggacccauaaagagcagagcaaaaagagcaagucucaguuggcaaguaacacagggccuauggcuacgauguacaauagaacaacucagaaccugccaggauuacagcucacuaauaaaacuguaucagguuugugucuuauucaggagcuaguugggcuagaguguaggaagaacccucauagauuacuuuuauaaguaucccauccuauuuguuacuuaagacccagugccuagaagauguauuauuuuaccacaggcugaaaauauaauguuuuuggaacuggauguguccccaccggcuaucuuugagauggaguuuucucaugaccaagagcaagacccacggguacuacacauggagaggcucaugagguuggacagcuuucuggaaagaccguccacaacuaaagugcgaaagucgagauccugguuaguacaaccguggucagagugagcacuggacugcacggauuggucaaggcugaagagggucugaguggcaaccaaagagaguguggggaggcgggggaggagaggggaggaaaagcuuuaauuucuguucucugguuuuccuaaucuuuccuuugguccaucucauugccucucuacaggugccagaguccucagcggaugccuccacccuccacagcucaugcauccaugaccucuguuccuuugcacccugcaacagugguagaccaugacugauaccccccagucaggcugcccaucccugguucaucccaucugaugcuuggugcguguguguuugugugugugguauguaugcaugugugugugaacuaguguguguaccagugugugugaaggggcaagaaacuaucaggugaugucucugccuguucucugugccuccuuuauuuaauucauguuauuuauucacggagcuugguuagugagaagagaucccccugcuugagaugccugguccugccauggucacagcacagccuccuguucucuuggcuagggagagacuuaggcaggccccaagcuccuuaugucagcugccuccaagagggaagauggcuagugccugagaagacagugcuuccuuuacccauccaaguccacaguuuccaucuucuugugugugauggugagcagccguggaugcuuucuggcucugggagacugcugguguccucugaaggugagagguguccuaaugguguugggcuugcacucccgguggacugagcugugcucgauucucucugggcccuagacucuuccagccuccagggcucuuucccaaggacuuucaguagcccaagacucaugccaggcuuuccagccuuggcaggaacuuguggcuuccccaacuccacuucauugccagcccucucugcccuuggauugggaauugucaaccaaacaguuguugccaccaugagaccugcaggaaauggagcaguguggagaaccaguggccugccgucaggggcaaucuuucuucagugcccucucuucuccaagaagcuccuuuggagaacaaaccaucaggccaccucuccagugagauguggcuccuucauguucucaucacuguucccugaagcugucaggucucgguccacagcggagagaaccagagcccuucuccccuuacugaaugcagauaacaaaauccuuugcuuugugccuccagcuaagacaagaaacaaacccaggcccaauuuuugccagauuuaccuuuuacucuuacuucuuaguuacaucuugggggagggggcacuauuuuguugaaaaaucaauccauucuuuaccacuuguguggcuugguccuuccucaccuuccuuugugaccaccccaaaugucuccagguauugcaagugauaaguaaauuucuauuuuaaaaaguuaauuuucauugaccuuuauuuuuuacaugcaagauaaaacauauuuuuuuaagauuuauuuuuauuauuuuuaaaccaugugugucuacauacaugaaugcaaaggccagaggcauggacccccuggagcuguuguuacaggugguugugagucaccugacgugagugcugggacuugaacucaggucuucuggaggagcaauaugugcucuuaacugcugagccacgucuggcugcuuccucuucuuuuucuuuuuuuuaaugugugguccuggcuugcuacuaguauucacuuacucuguggcccaccuugccucaaaauugagguauuccugccucagcuucccaggugcugggguuauagaugugagcuaugaugcccagucucuuuuuuaaaaauguuuuuauguauauguacauauacaauuccacaaaaauuguuuggagucacucagguugagguagaagaauugccagugaugauagcccauucuauaaacugaaaccuuguuuaaaauuuuuuucaaagcuggagagaagguucagugguuaauaguacuugcugcuguuccagagggacccaagguggguuuccagcauccacaccaggcgucuccaggggaucuggaacucuccuauggccuuugcauugaccugugcacacgugaacguacccuccuacagauacagacauacauauaacuaaagaugaaggaaguuucuuacaguuggguuugaacugaguucgguggugcacaccuuuaaucccagcaccugggagacagaggcagauggaucaggaguucaaagucucccuugacuccauagcaaacaagagaaaauaaauaauaaauuuaaaaguuuacauuaaaaccacccaguccuagcuguucuccaaccaacuuggaucccuucccuaacugugguucugauaugccuccaaggaaaaagagaucgauagcucucuauuucuguuuuguguugcuuuguuuuauucugagacagggucucucuguguguagcccuggcuggccuggaacacacuauguagaccagcacggaugaagcuuacagcuacuuuccugccucugccucuagagugcagauuacagguguguagcaccaugccgagcccaguguugaaucuuuuccaaguccuggagcuaugcagaagcugcugcuaagcacacaguuuguuguauaaggaauuguaauuucugcugucagcacuuaacaauucacuacuuaauuauuauuuauugaguguaaaauuagguugaaaaauuaagaaauucucuuaguacuaaaaaucauacugccaaauauguugacuuauuuucaauaugcauauuuuggugggugguaguggguaaauucggggagagaaaacagggaguuaggauuuccagugcccuaauguugggcgucuccuucccuggcuuaggagcaggucuguuacuuauguaagacaugaagcugacagaucugccagaaguucuguguggcaaagggcagcaguccuucucgaccuuuugggaaaugagccccucuugcaccauucaggguccugucugcgcaucauuugcuuugacuccacuguugugcucucugcugcuccacuggacugaauggcggagccuugcggcugccugcccuucaaagggaucccagguuucugucagaacccugugauugacacucaggauucaaaucagaggaauggcuuucucuggaacaggagcuguguguagaaaucuccugaugugaacugggcauugagggaccucccccugagcucucugucauuuguagaugaagcugcaugagucaccccauucaucacuuggacacacugacuccacauugucugguccacuacccucacagucuuauagcacaauacaccccacuucagcaccgcagccaaaggcugggcccaagguguggucagaagaggugcuccugccugugguauuauauguguguguuuauguguguguuuauguucaccuguacagggggcacuacacucaauguaagauacccuggagacaggacuccuggagguggcuggaucucagucucugucucucuccuuuuucuuuuacuguaucacacauuugauugacaaaguacgggccuuaauuaggaucaaauuucuaugucuguugcuauggccuuuaauuaaaguuacacaaaguggcccauucuugucacucuauacauaugggacauauguauaucuaggacauauguaauauauaaauauauaaauauauauaaagcauuaaccucugcccccuugguuuaggauggaggccuuucuguugaguggaaaugcaccuuaacuuggugcugccagcagccugcaggccccagcccuguugagaugaacacaguugacaauaaaggaaugaguaucauuguggagucgcuugccugcuucucucccuuugccucuauccugcauuccccuuuucaagcucgccuuucucuccagcuuuuucaaaaaguguuuggaggcugcccacagcgaucagaacaucggaggagaaauaacugcucagugaaaggaugucuguagagcugcuggauucgcuuggcuguuagggggcuuguguagcacguucaagacacugcuccauuccuggcacgggaagaaagaaaaggauaauaggcuagggcugguaacagagcacagugggcaaagugccugcugccaaggcuggcagccugauuggauccccagggcccacacauaguaagagagacaacugaugccuacaaguuauccucugaucuccauaucugugcuacagcaugggcacacccacccacgcauaugugcuguaacauaugauccaaauugaguauauuugaauugagggaggauaaagggaaaggguccaggcaggaaagucaugaguaguugcgacuggauccccaguccccacguaaaaagccagaugcaccagaaccagcccuggggaagcacggacagggggucccugaggcugacuaguuaguccaaccaaauaugugagcgccaggcuuagugagaaacucccucuuuuaaacugcacauuuaucuacgugccuauucauuuacuuauuuugcucagugucaaggcaugcauuggagaucagaggacagaguaaguucccucuuaccaucugagucucagguaauuaggcuugguggcaagcaccuuugccuagugagccauuucaccagccugagauucauucccaaaaaggaaacgguaagauuuaggaagacacuuuuuggccucuaaauacauacgcguaucacuccuccuauacacacaagauggagagacagagacaauauaaauaugaauuuaucuuccuaggagguggaaaugcucuuauggguggucugugccagggcugugguuggagcggcugcucauggucuaugauagcagccuucagucccuuaguucugaguuauggcucaccucagaauugguaggggauacucagauuagcugucagggauuagacagaaaaaaauucaugaaaagcacaugcaugcguccuaaucccaauacaaaccuuaguuucugaagggaacauacaagcaccaugccggaggcccuguguuccac

SEQ ID NO: 6551 - RNA, 80805 nt, Mus musculus
cuccuuuuuaaaaaauauuuauuuuauguaugaguacacuguagcugucuucacuguagcugacacaccggaagagggcaucggaucccaugguugugagccaccaugugguugcugagaauuaaacucagaaccuccggaauagucagugcacuuauccucugagccauaaacgugguuucuguuggccuaaaaaaggucuauuuacuuugcgagacaaggcuugguagcuaacaacuuaguuuuugguauauucacauccuauacuagagaguugguaaaucaaucuaaccugucucaucuauuaaucagauuaauaauagacaagaacugcacgcgguacgucuucaaaaagauaagcuuuguaaaaaaugaacuugaggacaagacgaugcaugccuguaauuaccaguaaugggagacagaaguucggaguuuaagguccgccuuaccugagccuguaccacaacaaaauaaaacaugcugauuaaaacgguaguuggcaagaucacuugaucgucgggcucuuuaaguuuccagagccacuccucaacacacgcugcacguaaccgcgcaaucagccuuucccgaaaggagcagauucuguuuccgccagaagaucuucccggcgggugugaccgccagacauccgacccacagaccaugggccgcccuccgucgugcgcaagggcucgaugcggagacaccggaagugcaggggcguggcuaacugcugcagccugccgguccgacgccgaggcugggggcgcgcgcaagugcgcgcucguucgcgcggccugcagcguacaguagugacggccgcgcggcaggggucacgugaccacagaagcugcuuguacaguaagaacccaauauggcagcggcgguagcaguggcagcggcagcaggaccggccaccccguagagcccccuacccccgccacugcgcgccuccgcggccgcuugcucgcugaguugcuucucggguccgacuuccccuuucucccaccuuuccuggcaccgcgggaaaagcagugcagggcgcagcaggcgagggaacgcagccggagccggggcacggaagccucccagucagucagaaccgacaugagggaaaagggccguaggaagaagggcaggaccugggcggaggccgccaagacgguaaggaggagggagcagagagaaaggcuggcaggaguucguuuucucgccggccacccgucgcaaggcaagggaggucacuuggccccgcgaccggguugaggaucaggaaagcgcgcgcagagagcggcaguuacgggcgcguuggagagccgugaggagaccgaggcgucggcgcgaggaauccgucgcgcgacugcgacuucucgcgguggcuacgacuggaccuccucgguguugugagguugccuuucggggucaugucgcugucgccccuacacuguuaccccuugucucggcccuguguguugugcuugcccaguaaccgguucuucucccuugugcgccucggagagccccgauuggaugcagacaggaggcgguuugugcgugcuuccagccccggaaaggagaggggagcgcuugagcucgguggcguucuccugucgaggcagaggugcugccagaccggggcccccgcuuaucuugcuccgggagccaaugugaggucacgaggcuuuuguguuugcugugagagcugaaagugcaggagguguuuagaaacgaaguaacaggugggacucagaauuuuuuuuucuguuuccguagagaccuacucugaguaaggcugcaaugcauggugggacguguaguuuauuggcuuucuuuuucuccuuuccuuuuuccuuuccuuuccuuuccuuuccuuuucucuccuccccuccccuccucuuuucuuuucuuuucuuuucuuuucuuuucuuuucuuuucuuuucuuuucuuuucuuuucuuuucauuucuuuucuucuuuuuuaaguuaaagugaaaguggaccggaccaaugaaguugugauuagugccccucacuccaauuuuguuauauggaauuuaaaagucauuuagcaaugaguauuugugagaaacauuguuuugaaaaauuuaaaacguguauuuacgaagaaaagaaaccuuaaggagaaauugaaguuucaucaagcauuaguagcauuucaaccucuuuaauaguggacaacauaguggguucuaauaacugaaccuuuaugaauuauacguuuuauuuucucuuuaaaaagaugugugugggggcuggagagauggcucagugguuaagagcauugacugcucuuccagaggucuugaguucaauucccagcaaccacaugguggcucacaaccaucuguaaugggaucggaugcccucuucuggugugucugaagauagcaacaguguauuugcauacauuaaauuaauuaauuuuaaaaagguguguauguguauguguauguauguauggaguguguacguggcuauggagcacgcauguagaggugauaggacaacuuguaggaguugauguagguucuuaggaucgaacucagguuaucaggcuugcuggccagcgcaguuacccacugaguaaucucgaaaauccuggauuguuuguuuauuaauuuauuuuuugaaaaaggguuucucugccuugaaacgcuauagaccaggcugggcuugaccucagagaucccccugccucugccucccaaguccugggauuaaaaguaugaaccaccacugacugacuccuuguuuauuuuuuaaaugagacuuacagaauucaaaaguaauguucaucauggagaaauuuagaaaaguaugaagaaaauaacucaguccguucauucuuuuaucgccuagucuuguuuccccaaauuugaauuauauuguuuauucaaccuguauuuuguuuuuauaagccacguacuuuuuuuguugaauguuuucccuauauacauuuguuuguuuguuugaggauagcaucucacauaauaaaugauggccuaaaguuugcagcaaucuuccugccuuugcccccuugggugcugggauuguagacauguaccaccaugcccaguuuuaugggauucugaggauagagccuagagcauuaugcacucuaggcaaaauacucuaccacuugaacuacacccccagcccacuuagaauaugucuuugugacuguacugguaguuuccucuaagggacaacucuauaaauuuuuuugcuggugaggaguuucucuucuacagaaguuuacuuucuacauuagggacaucucaugauugcuuacuguuaauaaaagaaagagauuugauuuuaguuaaaauaugcaaaaccccaaacuaauuaugugaauuaauuuuaaguguccaugaugucauuauuuauuuauuaggcuuuaauuuuugagaccagguuucacuuugcagccuaggcaggccuuagcauucaaaguauuaagauuacaggcaucucagcagucucugucuuuguaagauggacuccuucuguaacccuuacuaguuaagaacccuuuauguagaccagacuggccuuaaacuggauuauaaguauguacuacaaucucuacaguaccuugugaauuauucuuuuuggauuaaauaguuuaaugguuaggaaauugugacaaauaggaagaauaauuuugcaccaguuagaguucuuacaaugauaauauuugcuuauuuugugccccagcuaccuuugugaaaaauaguguuuaaaagacagaaaguaggcuggggagcuggcuuagugguuaagagcacuuguacagaaagauacuuuaucucaccaagggccccacuuccccauuuauaaaaacucauuuguuuuacuuuuaugccucuuuuugugaguagggaugucuaugugugucuacaucugugugugggagucagaggaugacauuaggugcuuuucucaguugcucuuuauuuacugaggcaagaucugucacuaaaauggaaacuugccaguugcuuugcaugaguagcuggccagcuugcccccaucucaacuuuccaaguacugguauuauaagauggugccacuaugaacaccuguacuuaaaauguuuuuaaaaauuguauuauguguauggguauuuuguuugcaugugucuuugcaccauauguauaccuggggucagaagaguguuucuggccccuuagaacuacaguuacagaugguugugagcugaaccuugaccuucuggaagcgugccuuuguccacugagcuaucuuuggagcccccacacggugacuuuucugugucuuuugccaucugcacucuaggccuuauguuuguucucuaagugcuuuauccauugagccaauuucccacuccuccccccuguuuuuauauguuuguccugaaagucuacacaccuccuaccuuguggaaggcaaaacagaaaauaacuuauuuuggagucaggcaguaauggcaacacaucuuuaguuccagcacuugggaggcagagucuggcagaguucuugaguucaaggucuacagagacaguuccagaauggccagggcuacacagagaaacccugacuugaaaagucuccugucuucaggggaauaacuauauuggauauuaaguuaaaaauuucuacagggccauguugggacaggguugcaaucuagcaucuugugggagaggcaaaaauaucuucauaucaaggccaguuuggccuagguagguagauucuauuuccaaaaauuuuaaaaaguguuugcuacaaaaagagauacaggaguagcuccuagauuaugaaacuugagaaagcaaucucaaauuugcagagcagacuacugcuuuuuccccuuuuuaaaaaaaauuuauuuauuuauuuauuuauuuauuuauuauguauacagcuuccugucugcauguaugucugcaggccagaagagagcuccaggucucauuauagaugguugugagccacuauguaguugcuggcauugaauuuaggacuucugaagcucaagugugcacucccuauacauauauauuuaagauuuacuuuugugugugucugucuaugucuauaaaugccugugcaguacccauagagaucagaagagggcauuugacuucaauggaaccagaguuacaggugauugugagcuaucugacuuggguguugggaacugaacuugguuccucuguaagaguuggaaaugcucuuaacugcugagccaucucucuauccccuccuguacauucaauguuaauguaaucaagaugaucagccuuuaccuuuauucuuagguuuugggaucuuaagaaauauuuuuuucuauuaagagauuaaaaguuguaggguggggauguagcacagccugaagagugcuugccuaacauaaaugaauugguucuguccugagcacugcauucauggcauaaacugguguguugacauacucuuguaaucaaaggguucagagucauucucugcuucauaaugaauuugaggcuagucugggcuugagacccuguagagagugggcugggaggaaguguauguguaggagggacuaagugauuuuauuuacucauguagccugcacuagccucuugcacugcccacuugcuguaugaggauaaccggauaccagugaauucucccucagcuccccacacucuccgagacaggguuucucuguauaguccuagcuguccuggaacuagcucuguagaccaggcugcacuugaacucagacauccaccuaccucugccucccaagugcuaugacuuaaggcacgcaaggcaugcgucacugcaccuggcuuaaccuugaacucuugauucuccugagugcuggaauuacaagugggugccaccaugacagccuuacgugguguugggauacaugcagugcuaggaaugaaauccagggcuucuugcaucccaggcaagcugaguaccagcugagccauauccccaagccuccaucuggagccuaagucacugauguuugaauuauucaauagcugguucagugauacucaauuucaaauuguuccuguggacaguuuuguuuggugcuuuccccucuuucucuuccuuccuaguuuuuguauuugguuuugagauaaagucuuuguaacccauuuggaauuuacauauuuaauuaccaacccaacagucaguaugaaccaccaagcaaaacacaaaccacuaauauuuagaaggaaauuaauaaaaggaagaaauguugauaaauuagaaacacaaaaacaacuagaaaaauuuauaagaaaaauuucaaauggaaguuuucuuuuguauacauuuuguaucuuuauauaaaaagauaaagcagcgaaauaauuuuuauccuagugggugugggguuaacaucagagaggaugaggcagauuugccaggaguuuggagccggucaccaugguaaguuuuugguuauauugugagaacuugucucaaaaaacaaacagaacagaagaagcaaaaaguccauguugugaacuguaugaaagaagacagguggcaaggaaugggaggcagccuuuaggauugaauauuuucuaaguuucuacagagauuagaaguggcuuugggaugaggaccauaaggcucagauaaguucauacucuuagguggcuuuuugauuuuucacagcuuggucugauuuuaggaggaccaauuaaugugcuuggaauccagacauacagaaauugugagauaaauguguacuguuuaaccuaaauuggauaauaaaauguauagucauuaauaagaauaaauacauuguugaagcuguauagugguaaauuaauaauauuugauaguuuuccaagaagcaaagucaaauuuaguagaccucaguacuuaaaacagugaguaagggcuggagagaugacuuaguggcaugaaauacucuuguggagaacccagauuccuagccaaaacuucaggggguuccaauuccaagacaccugcauucauguguauguauacacaccuacacacaaaaauaaaaaucuuaaagaugauggauaaaagauuuacagguuaauauguaaagucauugucaaacaaggcacaaauugagaagaaaggcuaaaaauacuuuauugcuaauuuaccuuugaguauugugaaauauauuugaagagaaaggcugaaaaggugguguguugaggaacuugaucugacauguguuuguauucuaggaguuauauaaaucuuuuuuuuuuuuuuuuuuugguuuuucgagacaagguuucucuguauagcccuggcuauccuggaacucacuucguagaccaggcuggccucgaacucagaaauccaccugccucugccucccgagugcugagauuaaaggcgugcgccaccacgcccgacauguaaaucuuuaugcaggagauaacaucuauuuuaggucaguuggguuaugugggauuuauuucagaggucugggaccuaugugugacugacuggcuauuucuuucugugaccuucaccuuguuuucacuucauauuccuucuacccauaugucuuacacauugaguucuccgauuguaucuuucucagguucugcuggucuccugaaguguaaggggguguuguguuaguuuggguuauacugcugugaacagauacaugaccaaggcaacucuuauaaaggacaacauuuaaaugaggcugauuaugauuccagagguucaguucauuauuaucaaggagggaagcauguagcauccaggcaggcauggugcuggagaaugaucuuaaaguuguacaucuuguuccagaggcaaacagaagacuggcucccacguggcuagaagggucuaaaagcccauccucacugugacacacuuccuccaacaaagccacacccacucugacaaggccauaccucccauuaaugccacucuguaggucaagcauguuuaaaguacuuaaaggguuuaaugcagcucuuucacacaauuaaauuguaccauuucuuuauugcuauuagucauuuuguuuguuugguggggucaagucuugcaauauaacccuuaccguccuggaaccugugaaguguucagauuggccuugagugcugggcuuauaguugugagccgccaugccuggcuuuuucuuuaauguuuucuauuaauguauauuaaguauacauaguaaugagauuuucauacucuguuauccuuguugaucuucugcugacaccuuccucuucguagcuaguuccccuucuacuuucuugucaacaguuugguggcccagugauuuuucauuuggguugauaacaggugcauggaugagggguuauuuacaggcuugugguuagucaccuuuccaguguagccacugaagaaaaugccucuuaacuacuuccuagcaaccauugacuuccagacucuuaggaaugguggggucuuaggaaucacuuuccacuuacuuguuucuuugagauagagccucuaacucuaguccaaacugaacucaaauuucaguugaucuuccucccucagucaccuagccucagcuaugaugauuggugugugacaccuucuucaauucuuucacuguguuuguuguccccaucccuccauugcucuagagaauacaguauauacuuacuucucuucucaagaguauguuuagaaucacuauuuuacuuaccacuauguagcucccuuuacuaucacuuguauauauugucauugucuuaugacacugcaaauuggaaagcccaugaggaaguauaauucuugaguuuuuuuuuuuuuaaagauuuauuuauuuauuauauguaaauacacuguagcugucuucagacgcaccagaagagggcaucagaucucuguuacaggugguugugagccaccaugugguggcugggauuugaacuucggaccuuuggaagagcagucgggugcucuuacccccugagccaucucaccagcccccaauucuugaguuuuuuuaaaaaagauuuauuuauuuauuauuuguaaauacacuguagcugucuucagacaucccagaagagggcaucagaucuuauuauggaugguugugagccaccaugugguugcugggauuugaacucgggaccuuuggaagaacagucaaugcucuuaacagcugagccaucuuuccagcccugauuguugcuucuuaauauuuuuguugcuagagguggaguuauguuuguguggcuaucuucuuuuggguuuuuuggaagauuacuuucuuguuuuuucuaggguguaguuucccuccuuguguuuaccaucuauuacccuuuguaggacuggauuuauggagaaauauuguguaaauuugguuuugucacggaauaucuugguuucuccaucuaugguaauugagaguuuugcugggaauaguagccugggcugacauuuguguucuuuuagggucuguaugacauuugcccaagaucuuuguuuugugcauuugauguuuugacuauuauguaaugggaggaauuucuuuucugguccaaucuauuuggaguucuauaggcuucuuguauguucuugggcaucucuuucuuuagguuagggagauuuucuucuauaauuuuguugaagauauuuacuggcccuuuaaguugggaaucuucacucucuucuauaccuauuuuccuuagguuuguguccuggauuuccuggguuaggagcuuuuugcauuuugcuuuuucuuugacuguuguguuaauguuuucuaugguaucuucugcccuugagauucucucuucuaucuuuuauauauacacacacacacauacacacacacuguagcugucuucagacacuccagaagagggcaucagauuucauuacagaugguugugagccacuaugugguugcugggauuugaacucaggacuuuuggaagagcagucagcgcuccuaaccgcugagccaucucaccagccccccucuucuaucuuuuguauucugugggugaugcuugagucuaugacuccugaucuuuccuagguuuucuaucucccuuugugauuuccauuuuagauccuggaugguuuuguucaauuccuucaccuguuugguuguguuuuccuguaauucuuuaagggauuuuuguguuuccucuuuaaggguuucuacuuuuuuaccuguguucuccuauauuucuuuaagggauuuauuuauguccuucuuuaaaguccucuaucaucauuaugagauaugauuuuaaaucagagucuugcuuuucuaguguguuuucuaguggguauccagggcuugcuguggugggagaacuagguucugaugaugccaaguagccuugcuuucuguuuuugcacuugccucucaccagaugguuaucugugguguuagcuggucuugcugucucugacuguggcuugucccuccuguaagccugugugucagcauucuugggaaacuaguuuucucccggauggauuugggucuggagagcuguggcacagggucaacuccaggguccagauggaaacuggaaagauccuguuucgggcuguuccuuaguuccuguguccagaugguucugggcaggucccucuugggccaggaauuuaagcagaaguuguggucucaccugugcucucgggugugucagcacuccugggagaccagcucucucccaacaguauuuggguauggagagcuguggcacuaggucaacuccagggcacagacagaaaccggaagcuguacgaagacuuaaaugguaguuguuguccuggauuccaauucacugcuaaaccugcugaaucugaugcccuuccucuugauuaaauggaguuaaaacaauuuuguugcuuaaaaagaauguuucuauuaaucuugcaguucagacauuguugaccacuacaacuucaaaauaaaguuggcuuuuuaaaaauguuauaaauguguuuugacauuugccugcacaccuggugcuguggaggccagaagaggguguuggauuccuuugaacuggaguuauagaugguugugaacugaaugaaccuucauauggguacuggaaauugaacucagauccccuggaacaacauccaugguuuucgcuuuccagccgagccccauuguuguucaagauaggguuccucuguuuggagcuggcuauccuagaacucuucuuuguagaucagguugaccugaucuugccucugccucccagguguugggauuaaaggcguguuccaugacaccugacucaaauuugauauuuuuucuucauagauuuucguuacuguaucuuguguagcacagauuucuuuuucuuaaccuuucucacucugcaugagugagucaucuuaaagauuacagaaguacuggucaccuuauuauguauacagugcucugccuuuguguaugccugcaagccagaugaaggcaccagaucccauuacagaugguuaugagccacugugugguugcugggauuugaccacaggaccucuggaagaacagucagugcuccuagccugcugauccaucucuccaugcccuaggugucacugauaacuuaaauauucuuuuuauuuuguuugugacagcauuuuauuguguagcccuggccuacuuggaacuugcuauguagaccaugcuggcccauaacucaacagagauccauuaucugccucugccucccuaccuuuugggugcuagaaauaaaaaccugcccugcuacuucugcuaaggaguaguauuaguaaguacuuuaagaaccuuguccauuauccuugacuuuuuuauacuuuugauauuuaacuuuuuuccauguuuaguuauauuguuuuaagaacaguuuguaaaaaauguguuuuguaguuuaaacaguuucaguagaguuuuuuugugagacaaacacugcccucuugugguuagaauaagguaacuguuuuggaaaacugcuagccuagcugugguaaaacaauaugguaucccuccuuuggaauccuuuccacuuucaagggguuuccucacuuuccuuuaguaaaucuacacuugcuuuaucguaguaguaguaguaguaguaguagugguagugguaguaguagggaugaauguaauaguuuauauaguauuuuugcuuagaaauauuugauauuuuucuucucagauuuuucuaguguauguauauauuuuucucauccuucuguauauuuucuuagugggauuaggacaauuaaauauaaacaaaaauuaaguuaucaaaaagauaaauugcccagucacugagccaccgccgaggacucagcugucucccccucgagcccccucgcuucccgacgcuccgugggcccccaccccucgcccaccuucuccugcagcugccgccuuccgcaggccguuuccaccgaggaaaaggaaucaucguaucguauguccgcuauccagaaccuccacucuuucgaccccuuugcugaugcaaguaaggguggugaccugcuuccugcuggcaccgaggauuauauccauguaaaaauucaacagagaaacgucagaaagacccuuacaacuguccaagggaucgcuuaugaguacgauaaaaagaaacuagugaaggcguuuaagaagaaauuugccugcaaugguacuguaauugagcauccagaauauggagaaguaauucagcuacagggugaccagcgcaagaacauaugccaguuccugauagagacugggcuggcuaaggacgaucagcugaaggcucaugggguuuuuuguuuguuuguuuguuuuuguuuuuguuuuuuugagacaggguuucuuuguguagcccuggcuguccuggaacucacuuuguagaccaggcuggccucgaacucagaaauccgccugccucugccucccgaguguugggauuaaaggugugcacuaccacacacggugguucauggguuuuaagagcuuguggcucucugaagcuuccuugcaaugaguagaauuucccuucuguuccuugccacaaguuuuaaaaccucacagcuuguauaauguaaucauuuggggucugcuuuuaacuuggacuaguguaacuccuucaugcaauaaacugaaaagaggcaugaaaaaaaagauaaauuguucuuuuuuguuauuauuuauuugugaguucaugugcacacagcugaaaaaacaucuuguaaaugguacuucucuuccuugaucgaacagguuauuagacuugguggcagccuugcugcugauccaucucacaguucuaggcccuguuuuuguuuuguuaucuuuuuauuuuaauauugucucuuucuuuuuccuuuccuccauccccuccuccuuccccccucccucccucccuccuuccuucuccuucuucauuacugucuucuuaguugucgacuucuguuuaacuggauuucucuguguacucugacuguccuggagcccuucuagaccuggcucgccuugaacuugagaucugccugccucugcuucccagaguacuggaaauaaaggcuacaucgccacccgcuuucccaugucuuguuuuuguuuugugcccaggcuguagcccagacugaccuagaauuuguugcagucuuccugucucucuuaagugcuguaauuauaggcacaagccacuuugagggggagacagaaucuauauguguagucuaagcugguuuauaacccuuugucuuccugccucacccucuauaagugcuggaauuacaguuauauacuauucuguccaacuuaaucaaaguacuguugcaugaaaacacaaauguuuuaugcuugauauuuuacucuuaguuuuucuugcaguauaguguaguuucacagaggaaugauuuuuuuucuuuucuuuuuuaagaauuauucauuuauuuucuauguauaugaguacaccauagcugucuucagacacaccagaagagggcauccgaucuccauuacagaugguugugagccaccaugugguugcugggaauugaacucaggaccucugaaagagcagucagucucuuaacgacugagccaucucuccagccccgauuuuauguguguguguguauguauguauguuucgguacuuauaauuuucuauuucugugugcuuuuuuauuuacuaggagaaauuaauauaucauuaguuauuuguugugaaaauuguagaaaagaacaaagggcuaauagccugagaaaaacauggucuuuuguuuacuucauuuucuuuuguuuacuucauuuucauuuacuaacauuuuugaugaagcugacaucagaaacaggaugugacacagauuuuuggucaucaggggcaauccuguuuuuggcauccugaagugguggcacaagccuuaaaucccagcacuugggagucagaggcagguggauuucugaguuggaguuuacagagugaguuccaagacaggcagggcuacacagagaaacccugucuugaaaaacaaaagaaagaaagaaagaaagaaaggaaggaaggaaggaaggaaggaagaaagaaagaaagaaagaaagaaagaaagaaagaaagaaagaaagaaagaaagaaagaaagaaagaaagaaagaaagggaaaggaaaggaaaaaggaaaggaaaggaaagaaugaacaaauaaacaaacaaaacaaccacaauaaaaacaugcaucucugcuucuugaagcauagcugcuuauccaaguuucauaauccugagaguugccauuuuggguguguuguuuguagaccuguuuugugaacucuguagagugauuucagauuauguauuugacauuguugcuuuuaggauuacguagccaugaggguccagagaaaggucuuauuugguagagugcuucauugcauauaagaaguccuggaauccauccccagcacaaacuggguagauguaguuugucugaagcccuuacacugaggauguggaaacaggagggucagaaguucaaggccauucuuggcucuguagggagcuacgggccugggcuggagaaucuguccucaaaccaaacuaaaagaacccaucaaaugcuuauuuaaauccuauggagaaauuuuguuuguuuuggcaacagggucuuacuauguaaccuugaacuaacaaagauuaccucuagugcaggcauuaaaggauugugccuggcauuagcuuuaguucccaaaucuauguacuagaauucaaaaugucuuaauuuuuagaacuuauucaguuaucugcaucuauuuugcauuuaugucagcuaguuucaaaaugugauauugguuuacggcuauugcuauguugccugagcagguguagaaagagagggacaguauggugacauacuccaaagucuaaaaacgggagaauugccuuccuuugugacauuagacaagucuucuuuacugugcuugauauaagaauggcauuuguauuggaacgcuuucugucuguaucagugugcucuugaguuuggguugcaguugagcccaagccaggagguucuagagaaaacagagcaggaaguccgcuucugacugcgccuuguuuuuucuaauugugguuuccuuuuaucugcuaccauuuuugaagccuucagauaauuacuuuauucauucuguucagacuuuuaguuccauuuaauggugaacaaacuaugcuuaaacuauguuuacugucuuuauugcauccaaaauacugauauugauuuuuuuuuaaagaaucauggauuuaauuuaacuacaguuugaggcuauauuucaucaugauggggaacacauggcaggggugugaggucauauuacugacugcaaacaaagucagaaagcagggagauaaguguuccacagaugcaauuuuaauauguucauuuauaugauugagaauuuacuguaugcccauucaguaguaguuacugauagaaauguaaacagaugauuaaaaaaaaaaaaagacaggguuuccuguguaucccuggaugcccaggaacuuacucuagaccaggcuggucucaaauucagggauucauauguauguuucccgagugcuagaauuaaaguggugggccagcacaccuuguuaaaauagagaaucuucuaugcacagucacagauagggauaggacuugggaguggagacuaaaauuaagcaauuucauauucauugaguaauuaaaauguuaauuuuaaccuuuuuggucuguuucugcuuuagaauuugacuuacuguuuguggcugaggaaaaaguccggaagaaaucucuagauauuuauguuuuagaucuaauuauugccauaguauaauauacaauuacaagaaugagaauguaaaauaaaauaagaauugauucauuauuauuuccuuguuuuucaggucuuagaaaaauacccuaauacacccaugagucauaaagaaauucuucagguuauccagagagaaggacugaaagaaaucaggcaaguuauuaaacuauuacuaguaaugauuguguaugguuagaguauuuaauaguacuuaguauucuuugucuuacacauugauuaguauaauaugcuuucugaacuucagguuuauucauugucagucuuugcaguuuuuaagucauuauauauaaaaucaaaaauaaguaaagcaaacucuucaugaaaagguaaaguauuuaucuuuuaaaaccuaugcacauuaauucuucagaaggucuggaauuaucuuuaugccuucaccuaucacuuuguacuuuugauauauugagguugguaauuauuggauaaaaaugacuaaaugucaacuucuagaaguaagcaguguaagaagaaauaagauuugcuaacaagaaugaaaugggaaaauuuuacuauaugugucaagagaaagucuuugucaggcaucaugacacugucuauaguucaagaugcauuagagagacuaagucuuggaagaucacuugagucuaugaguucuagaccaacuugggccacauagcaaaaaauaagguguuucaaggaguuaaagcccaugcccaugauaaucuaaugaucugaguuuaaucuccacagugggaauagggagacagauaacuucuggagguuguccuuuggucuccacaugcauuuuguggcacgugcacacaagugcauacacacacaugcacauuuaaaaaugaauauauaaacaaauauuuaauuuucaaauguaguagauguauuaauagggucaaagauaauacacuccaauuucuaagugucuuguuauaauaguaguauauaauauuuauugcauaauuaaaacuuucuguuaucaagaaauguuaaaauuaugucauucauuuuguauauugagauaaauuuggccauuuacauuggaguuacuuuggaaaagauaagaaacuugaaccaaaccaggcagugguauugcacgccuuuaagacagagaaacccugucucgaaaaaaaaaaaaagaaagaaaaaagaaacuugaacaaaaaaauagaaacaagaaaaguuagguguggcgggcacauuuguaauuucaguguucuggaagcugagacaagugcuguaaguucaaggcuaaccuugguuacauauugaauaccaggcuggcagagcuauauauuaguuacuuuuucuguugcugggauaaaacaugcugaccaaggaaucuuauaaaaagauucucuguguagcccuggcuguccuggaacucacucuguaggccaggcuggccuccaacucagaaaucugccugcuucugccucccaagugcuggaauuaaaggcgugugccccaaacaccugucugaggaccauucuuuuuuuuuuuuuugagauuuauuuauuauuauaaguaaguacacuguagcugucaggugcaccagaugagggcauugaaucucauuacagaugguugugagccaccaugugguugcuggaauuugaacucaggaccauaggaaguuagugcucuuacccacugagccaucucaccagcccuaaggggaccauucuuguuuaaacuaccacacucuuuuagaacaccaaaucaaaauaaaaauacauuuguggugcuuuuauaacaaacagaauaaaaaguucauugucacuacuuuauggcagaaaucauuaauuuuuuuuuaauuagguauuuuccucauuuacauuuccaaugcuaucccaaaagucccccauacccccccccacuccccuacccacccacucccacuuuuuggcccuggcguuccccuguacuggggcauauaaaguuugcaaguccaaugggccucucuggcagaaaucauuauuaaguagaucuuuuuuggcuauuuaccaagcuaaauuuccccaaagugauuucauuagaaaaagccuaauuuaagaaugaagaauauuuugugucugaagaugacuaauagauaaaaguguuuguuugcuacacacaccuauguuugaccuuuggaucucaugguggaaggaguggaaggggagaaacaacucccaaaaguacacauguacauuuucuuauuaaguuaauaacaugauuuucuaagauuagcuccuguauuaaaccuaucucuuuucauacacuggcuguagucuguugucaagccugcaaaguugguaggauugucaagaaguuaaacagaaacaaacccuuagguauugauagacaaagcuuuuguuuucuuuuuuugggagagggauagacaggaucuauaaaaaacucaggguggucugaaaauugaaccuuguaaauaaugagauuacagguauauaccaccuuucccagcuugcuguuuuguuuuguuuucuucagccaggauuuacuaaauagccuauguuggccuagaauucauaaaucugagaguacaaacaagugccuguauacccagcaacagcaacaauagaaucuaauaaauuugcaucagauucauuguagaucacugagaagcaaauaaccugcaaggccauuguugauggcuuuaugacuccuuguaauaaaaaugcaugggaaaacgaauacuauuacaaaauucucacuuuaacucuaagcugcucugauaguuacacuuuuucauagaauucaaguauuugaauuauuuuccuauaguagcuuaggcuauauagcugaauuuaaaugugcaauuuuagacaacaauguuuuggauuaauuuaugcauuuaaaaaauguaauguuuuauguaguaaggugaugacgauuacuaauuugaggauuguuaguauugcuggaagaucaugguauaaauuauuugggggagcuuauuguuacuuguaaagaaaaauuaaaaccuuuuuuuuucccuccuuauuuucuuggggugcauuccaacuccagaagguaagaaguauuacuuuauucuaaaggagcauuaagcaauuauaaagcacucuuuuacaaguuuuauugagugugccuuuguaugcaugaucuuuacuuuaucaaacuaacuagcuuagaaaugaaauaacugugauaguguauaaauauuagucacuaagugugcucuuuuuuauuguuuauuuuuauaguuuguaaccauuacauggccauaauuuuagaaauuguugacauuaagguuuaucaaaacuuaaauuugccuuauaccacugaaguauaauuuagcauguugaugaaaacacuuacaagauagagaugugcauguugccuguugccuaugagauuaaaaauauuuuugcuugacuuauauagagaaaauauggucaauugucuauaaucaagugauacuuaccugaaaccaggcagaacagauuaaaauucauagucugaauccuuuaccaaauuggcaguuuugucuguguuugcaugcuacuucagauaaccuuagucugcagcaauucccuuauuuauagaauagguuuuuuuuguuuuuauuucaguuauaugacuucuaugugaggcuugagaacaggaaauauauauguucauguauaugucauguuugcuuauagauugagauuaaucucuuguaacuuuaguuaguacuuuaaguucauuuaaguaacaggucaugaaugaagcuuaauaagauuuaaauuuuuauauuuguuuuuucucuguguauguguaagugugcuugccuguguuuugugaugcucugaugacaggaucuuugauuuuggccuauuggauacuuuguaggugguagugguggucucaggucuuugaggacaaagugacuuaggcuggacuacuuuuguucuggucugguuuugauaguuuuguuuuuaagcagggccuuacuaagaucugucuccaaaaugcugggcuuagagaugugugccacuaugcccaguuuuaugugguuuuaccccauaugcacaauaccaccuaauaacucacuccuauuuuaguauuuguuuuugaggcuuaaagucaaagccauuuaauauggucuaagauuuaccauaacucuuaaguuacuucucugagaaagaauuccugauaaaaauauuaggaacugguuaaauaacucaagacaacuguuuaaaaacucagaaguucaacaucuguuuccauaucaucuagcauuauugcucugagacaaaagcagaaagcaaagcuaggcuggagacaaaacucagcaguuaagagcauuugcuacucuugaagaggacccaguucaguuuucaaaaaguauuuuuuuuuuaaagaaacagaaagcaguuauaacaacacuagcuauuaauauacaaaauuacauuguuaaaugaacaauaaccacccaauagggcagcaauauaaaguuuuagauaauuuuuuguguuuuuauuguuuccaguucaguucuuguuuuuuuuuuccgaaaaguuucuguguuucaaucucuguguucauucacauugacacuucuuuuaccuggaaucuuaagauccuauauguaacuuuuuguucuucuuauuuuagaggcaaaaacugugauuggaauuugguccagcuguuaagaacuuugagcaugauaauuugggcaguagugauggcacaugacuuuaaucccaguacucauugggggggggggggcagaaguagcuagaguucaaggccagcuuggauuacagaaugaguccaggacagcuaggccuauacagaaacaccccccccccaaaaaaaaaagaacuuuaaguauccuaauuaucuguaauaagauaauaaauaaauaguuaggcagugcucuuaucacaaauagagaagcaaucuguuucucucaaagcuacuuuuuuuugagacagaguuucuccagcccuggcuguccuggaacucacucuguagaccaggcugaccucaaacucagcaauccaccugucucugccuccuaagugcugggauugauuaaaaggugugcuccaccaccaccccgcucaaagcugcuuuuuauuaccaguuuaccauaagauucaaaaguuagguguuauaaugaaccaguauuugaaacgaccuuguuuaaaugggaguuagguauuucauguguauuuugucucauaaagacguuguaacaggaaacauuguauagcuaguuagugauagaacuuaaacucacauuuguagucuguguguaaaagggaggcaguagauuggguaaggauuuuauuucgccuccuugagaauggggauugaacccauggccuuuacaaggcauggcaggcagcacucuaccaaaccuugggcaaggaagugggguuuguuguuguuuggccccuggguguguguguuuuauuuuuaacaauuucagcugggcuucauggcacaugccauuaaucauagcacccuuguggccuucacuggguuaauauaccacuuuaucauaguugagaaaaagaacggauguccauuagagacaagcuccuuuguuuauuguguguguauuuuuguuuuuuauuuuauucuuuguguauguuauauguccaugcuuaugugguuguaagacagggguggacaucaagcguuuucuugcccaccccuuccaccaggaacccccucccccuuuaacuuuuuuguugggcuagacuguugaauagugagcuccaaucaauagccuaccuuuuuaaaugucaguucuucagaucuguccaaguuguuaugaucucuguugcuuugagugucaccagcagagaacugaaaggaagaugaauugagaguguacaguuaaggguugaggauuuagcucagugguagagugcuugucuagcaagcgcaaggcccuggguucgguccucagaugggggagggggagagagaaugugcaguuaaguuguuuuuccuaggccuguagagacggcucggcaguuaaggguacugacugcucuuccugaggucuggguuuuaauucccagcauccacauggcagcucucaacugucuauaacuccagaaucugacauuuucucauagacauaugugcaggcaaaacaccaauacacauaaaauaaaaaucgauagaccuuuuuuuaaaaauguaaaaguuguuuuugucucuuaguaauuguaagaaaccaaaagaaccaaacaagaacagcaaaaauugggcccccaauguaggaucuagagaaaguacccaagagcugaaggggucugcaacccuauagguggaacaacaauaugaacuaaccaguacccccagagcucaugucucuagcugcauauguagcagaagaugaccuagucagcuaccauugggaagagagaccccuuggucuagcaaacuuuauaugccccaguacaggggaaugccagggccaagaagugggaguggauagguaggggagcagggcggggagaggguauaggggacuuuugggauagcauuugaaauguaaaugaagaaaauuuccaauuaaaaaaugugaaaaaaaacccagcaaaaauuacuuaaggagucuccagucagacuucagaccauccccugacucucuauauaugcuuuuuuuaaaaacuuauuuauuuauuucauauauaugaguugaguucucuaucugcacauacaccugcaugucagaagagggcaucagcucacauuacagauaguugugagccaccauguuguugcugggaguugaacucaggaccucuggaagagcagcuaaugcucuuaaccauugagccaucucuccagccucuuauaugcuccucuccccuccccucccuccuccuucccuuccuuucuuuucccuuuucuuucuuucucuuucuuucuuuuuuuuuuuuaaagauuuauuuauuuauuauauguaaguacacuguagcugucuucagacacuccagaagagggagucagaucucguuacggaugguugugagccaccaugugguugcugggauuugaacuucggaccuuuggaagagcagucgggugcucuuacccacugagccaucucaccagcccuucucuuucuuccuuccuucuuuccuuccuuccuuccuuucuuccuuccuuccuuccuuccuuucuccccuccccucucccuuuucuuuucccuuuucuuucuuccuuccuuccuuucuuuuugagguagaauuucuuguuuacccuugauuuuguaugugagucaccaugcucagggauauucuuuaaugcacguggcuuuaugcuuaaaacugcauagcuuucuuuccuguuucauuuauuuucuuucuuccucuuuccucuccccuuccccacuaccccccccccuuuuguuuuuuuuuuucccagacaggguucuuuuguauaucccuagcuauccugaaacuugcucuauuuauugaugaggcuggccuugaacucagaaaucugucugucucugucucccauguucugggauuaaaagcaugugacaccauacccaguuuuccuguuucuuuuucuuucuuguucacauguguuugaguuuauugcagagaaaaguaacagaaauuguaguuggauaaagagaagagucagacauagaauuaaugugagccucuauucccaagccuuagcagcucagccauaggucuauaugguucuuuaguaucaagaagccaaucuuuccagccauuuccauguuguaggaccucugccauauuuccuagcucucauuggcaguggcagcgaggcuuuucauaguagcauagucacuuuaugauuucaguagcucauagguggugaggauucuguuuagaccuguauguuucuucuacauucuccuccugaaccaucauaguccuggcagugagcaauguuuagccauggccuuguauuuaaaucuucauucuucaggacuauagacuaggaccuaagcacuuguacuccaggucgauucacuccccccccucccccccacccccgccaacccccauuccuuauauauaaguccguaacaaaagaagccaacauuagaguuuugguaaaacagucccauuuccuuaaugcaaugacaaaucaagauaaggaaguauuuuagugaauuuuauuagacuuuuuaaaagaaauacaauacgaucugaugacaggugaaaaaaaugcaaguuuuuuuccccuaaggaaugugguuuauaauagaggguagcauugaacuugugauucuuuugucucagucuccuacauucuggaauuacaguugugugccaccaugccagguccagaaaaguuuuguuuuguuuuguuuuguuuuuuuaaaugaaaaacauuuuuuaaagauuuauuuauuuuauguauaugaguauacuguagcuguacuaacgguuguaagccuucaugugguuguuggaaauugaauuuuaggaccucuguucgcucagucccugcucccuccagcccaaagauuuauuuaucauuauacauaagaacacuguagcugucuucagacacaccagaagagggcgucagaucucauuucgggugguugugagccaccaugugauugcugggauuugaacucaggaccuuuggaagagcagucaguguucuuacccgcugagccaucucgccagccccccagaaaaguuuuuuugcaucuaacgcuuuaaaauggggggaaaaaaacccuacuaaaugcaauauaagaagucuauuaaaccucuuuuaagguguuuaaagugaucuucugauagguguaaguacaagaaaccauggcaguuuguuuuacugaucagauuuaguuuagugcagcaguguacaagagaauaaauacuuauuugaaucuaugugugugugugcaagcauguucucucaugcaugugugcaugcuuuccacuuucaugucuacuuguaaaguuucaugcauaaauaaaguagguuugcaaaauaaguuucauauugcuauaugaaauuuuuguuuugcuucuauuuaaguguuaaguuaaaauuuucccccuuuauauauucaaagaugaauuguccauucauuuuuuuuuuuguggcaaucucuuucuguacugauccgguuuguaguuaguaaaaaauuauauaaaggaauauugaucaacuaaaaauuagguuagaauuauaaaaaauauuuagaucaugauuagauaaacuaaucacuaaguucuucacuuuauuugcuuuuagugggacuuccccucuugcaugcuugaaugcaaugcugcacacaaacucccgaggagaagaaggcaucuucuauaaaguuccagguagaaugggcguguauacuuugaagguaaguugcuggggagacaagcaauaguaaggguuggcagcauauaacuacugaguuacauagacagaauucuguucuugaggaacuuauuuccagaaagaaauaaaauuucaacccuaaaguaaguaaauaaauuuuggggaguugaacucagagccucaugaauacuaaauaaauuuuuugagcauuauuugaucuuaaguguauggaugccuugccugcauguauaauuuauguaccacauucuugugguacucauggaugccagaagaggguauuggauccucuggagcuagaguuccaguugauuguuaccuucugugugggugauggauugaacccauguccucuggaggaacagcaguucauguuccuaacugcugagcccccucucuagccccuacuucuuauuuuaaagaggccaaaaauauuuacauauuuacaaauuggguauugcuuuagauggcuuugcuuuacucaucuuccccacuaaaaccuacaguuaugguuauuauuccuguuuuuauaagggagaaaacuaaguucaaaaguugugauuucuuuaccagugguggcuguauuauaucagcacaauaauaggaacuguggucaaacuuaacgcccacauuucuuccuuccuuccuuccuuccuuccuuccuuccuuccuuccuuccuuuaaauauuuauuauuauauguaaguacacuguagcugucuucagaugcaccagaagaaggcgucagaugucauuacagaugguugugagccaccaugugguugcugguauuugaauucaggacaucuggaagagcagucggagcucuuaaccacugagccaucucuccagcccccacauuucuucuuucauaacaaguuggcuaauauguaauucauacacugaaauggugaccuuuucuuaucaauauccuuucacucgcaagcaggaaaaccaauuuauaugagcuuaguaagaaggcuagagaauuuaacucauacagcuaaacauuccuugggaaauccaagcuggaucaaaaagaugucaucuagucuuggucucuguucuuucuuuuagcuuuauucucagucagcuucucaucguauaugaauucauucugagucuccauucugcaaacuguaagucuagagagacgaguccaguaacuaaagcaaaaggcacccaccucauuuagauuuaacuuacuuuggcccagcccaugugacacuauacaugaauuaugguuauuacuaaauguauagaaucauuuuuacucuugauguaaggauauuaagcuuguguuaaucugauaauuaaaauaauaaugaaggaaguuuaucagcaagccagaaugaauguuuggcagacaguuauauccaaagggacaaauccauagacaccucugucccauuaccucuuuucuccuagcuacacaccacaaugcucaguagugguauggagucuauuaacauuaagcacaucuaaucugggaugcugagacggaucaucuuguaaagguacagacaacucauuuuguccccugggcacguauaaaugaggagaaccaacucccacaagcuguccuuuuaacuuucauaugugugcuaugucacauuggugcccauacuuacguacuaaauaauguaaaacuaaacaaauggacaucuuccaggugagccugugcauggcuuuagcccuagcacucaggcugcagaucuagguaccuccgaguccuaaccaggcaagccugugaagcacagugggaucccaucuuaaacaauacagaacaaaagaggaacaaaccccauaucuaggagcugaauguggugcuguaugguuauugauccuaagacucaggaggcaaagcaaaaggaccguguccaguccuagaaccaauuugcgccacauacaaaauccuuucacacguuuuaaucuuacuuccucugacuuugucugcaguguuuaacauuuguauauuaugggauugaauucuaaaugaagcuuucacuuucucuuuugauuacuuuagcuauucuagaucuucuauaauuuucuuuguauucauuaaaaugcuuacuguguuguagagaugaggaggaaaaaccucaaaauauauuuucuauucuuaauaccacuuaggucaguucuuugguaucaguuguuuuggggguuucuuucauacaucaagcaauucucccacugaaaucagcuaggcacucuuuaauuuaacucagguuuugcacugucuguccauugugucaggcuaagggcccgauuccauagauuacccuucacuucagcugccauuacgagucuuugguugugaccuaaccucugauagaccagcuguaauuauuguuucguguccuucuuggguuucauuaacuuucuaggacugcuuaccaaaaaaaaaugccagagaaaaccuuuuaaguuuuccauuuauuguaauucagauaaaagacaugcaaaaaaugagguggucauugaauauggaagcuggcuugucauaucagcucuaagcacaaaugugauuuuagccuuauccaaagcccuaggcuagccuugaauggaagguuugugauugaagcaucauucuguccuugcuaucaacucagccuucauccuugagaucuuggcuaaacuuggcaauuuucuaaccacguaauugucucuuaguacucaggucuauucugaggaacaggucauuagaaacacacucacagucacucaucaacacagguauuaucacucuuaucauuuaggagguucuaaaucgguuaggugccuguuuuaggagcuagagucaaagaccaaacagcagaacaauguuuuccuaaucccacuauuaauuaggaaaguacaaaagucagugcugugucaagaguucagaguuuaaagcuggagagaugagauggcucagcaguuaagagcacuuguugauauugcagaggaauggagcucaguuucuagcaugauguucucagacacuguacauacauguacauaugcaugcaugcaaaacacauaaauauuuaaagauaaaagaaaaaguucaaauaauguaugucuuguaucacauugucaagucuaugccagaaauaaaaguuggauaaacuauaguuuuugaacccauuaaugcuuauauuuucauuauuaaaauauuucauauuuauaaaauauacugugaacucugccauuauaaugaagcaaaguaggauaaguuuugaauaaagggaucuagaaaguuucuguuacuuaccaguaagauuugagcuguacuugaacuuaagagaagugaaggccuucagggaacaauagguuuuccuauugcuucccauuuauuaugaguagcucaaaugaagagacagauaaaauucugaaugaauuuuuaaguagaaaaaaaaauagauaaagugauaaucucgggagucaagauaauuaauaaagauuagcuaaccauuaaguuugacucugacugaguuuuguguguuuggguggugugucgaguaagcagaagucagaggucaucaggaagaaccauuggaucaaacccguguuuaagaagauuuucauguaaaggugauuauaguuugaaggaggaacucagaauaguagaagagagauagaccuaagagucauugaagaaauagaacacauugcauuugggauguguaaaauugugggugagaaaagauccuaagauuuggggcaugagccauugaucccagagggaucacaagauuuuugcaaaaagaagauaauuauauuuguauuucagauacuuguugaaccuacaggucaagaugucuggcuggcaacuaacucuauaaaagcuguccugcauuuugaaggaaggaauauaaaaauauggggucuguauuaagaaaguguauaacauaagagauggauuagcgggaaauuuaauuggaaaauaacuguucuuacucaauuggacuuauuggucuugggacugugucauguggugucaguuagauguaggauuaauuuuuugugccugucaguucauuuuuuuaaugugaguguuaaaaauaauuaugugggaccagaaaguacugauagaaagaaaauccuuaugagaaauaacauucacuaauucauuuauuucuauauuuuuuaugugaacacacaguagcuaauauugagcucucauaaagacauuauucuaaacauaauuuaauuuaauuugcucauuuaauuucuaugugaccuuuuaagguagguacuguuaccucaccuuagaaauuaaaauuaaagcaugacaaauuaacuuagacuaagacuguauaguuacuucucuagcuuuucauaugcagcuaccugguuauguuuuuucacacuaaguagacaguuauucuuucugguuaaaagucucauuagucagaacuaacaccaaagugauuaacauguuuuuuauuucuuuauuuguuuguuuauuuauuuauuuaauguguaugaguacacuguagcuguacaggugguugugagccuucuugugguuguugggaauugaauuuaggaccacuugccugguaggcccugcugugguuggcccugcuugcucugguugagcccacacgcucagucucuacucgcuccagcccaaagauuuauuuauuaauauaaauagguacaguguagcugacuucagacacaccagaagagggugucagaucucauuauggaugguugugagccaccauaugguugcugggaauugaacucgggaccuucagaagugcaaucagugcucuuaaccauggagccaucucuccagcacccaacaugauuuuuaaaaacaacagaacaaacaauaguucuuuucuugcugcuacuuauuagccaauguugaggaccuaguuagaugaaaauaauaugauaaucuuauucuccugacuugaauuauguaauugaauucagaauauaugagaugcuacccuauacaaacacagcuaugucuaagaaaauuaugugauuuuuaaaccuuagcguuucaucuuuuaccuggauuuauauauaccaguuaucauguaauuuaaauauauguuguaccugcauauaaauguuuuguguaauuuuuaucuuuggauauagaucgaaaauuaacuuauuugauccccaaaaagggaaguauaaggauuucggcaaguauuuaugguuuuacuauauuaauacuaaaaauuaaucagcuaauuaucugcugcauuacguauuagacauuuaguuucgauuugcuaaaauggugacaguccuaacaggaugccuacauuuucagaaagaugugccagauggagugaaagagcugucagaagguucagaagaaagcagugauggucagucagauucucagagcucugagaacagcagcagcagugaugguggcagcaacaaagaagggagaaagagcagguggaaaaggaaagguaaucuccgacugcugcagcagugccuugucacuuuccucagaccaucagcuuccucuuucucuaguaguuuaguguucugcaauagucucuugcagggguccaaguguuuguauuuaaccuuucaggcagcagccacuagcaucaugaaccugucugacugcguaacugaggagcuuuuaaaaaauaauauuuuucuuuuagggacugagagauugcucuguggcuaauaugcuguguaagccuaaacauuugaguuuggauccccagcacccauccauauauaacaaugaagggggaaaggggccaugcuccaggaucaaugagagaggggcgugggggaagggggggggggagagagagaaacagcgacagaggcagacagacagagacugacuggacuuugaauuaucagcaaaaccaaaacaugauguugaaagggguacauuggggggaugaugaugggaauauauaaaguuuaagcauaaggauuacaguuuaaauuaccagaauguaaaaguuggacagguauuacagcugucuggggucucagcuagcacuuaagcaaagacagaauuacuagguagcuagauuagcucaaguuugacaagcucuugccugguucagugagagaucagccucuacacacacauacauacacuacacauacauaugcaaaggggaaaaaaaaggaagacccuuaaugugaacuguggccuacauguacaugugagcacauaguacacagacacucagccgccgccgccccccccccccccccggucauuuuggagaauuauuuagguuccaguugaguagaaaguucagaauuagcguuugcuuuccacucugagguguccagacuuguucacauggguucucuuuguugugcuuguuuguuuacauauauuuuguucuuggcuuuuugguacagggucuugacauggauagccuaggguggcauucaguuggcuaaucauccugccucugccucuuuagugcucauauuacaggcugaaaccacguuuugguaaauauuguauuuuagcagucuuauuuguccuguaucccuucuuucuauguuuguuaguuguacuugguaaccuagaccagcacuuuuuuuuuguuuaagauuuuauuuauuuuauguauaugaguacacuguugcugucuucggacacaccagaagagggcaucagaucccauuacagaugguugugagccaccaugugguugcugggaauugaacucaggaccucugggaaagcagucagugcucuuaaccacuaagucaucucuccagccgacuagcacauuuuuauugcuguucacauuggaauucacucuugguaguauacuuucugagaauugggacagcugucuaauuuauaaagauauguauacacauguacaucauacagaauauauuuucacugcccuaaguauccucucugauguccucuacacuuuucuggcuaacuuuugcagaggacccagaaucuuuucuacugucuucauaguuuuacuuuuuccaagacuaucaugaaguuagaaucuuuucaaauggacauuguuuuuaaaauuacauuaaacauuuuuuguguaugugcauucacaugcauaugcauguauacacaugcauucacauaugcacuguugccauggcgcuuauuuagaugucaggacaacuuacaggaauugauugucuccuauacuuguggucaagguugguggcagggucuuuacccaccaaaccaccuuacuggcuccagauuggcauauuuauuuaguaauuuguauuggugauuacuccaugucuuuucaugacuuacuggguacauuuccuuguagagguaaauuguauggcauaauuugcaaaaagccauucaccaccugaaauacguaauugcuuuggcaaugcagagugaaaaauaugaugaacuuugugugcauauguugucucuguguaaauucacagaaguaugacugcuauaguguaagaagaauauguuaaauuuuguaagaagcugccacagugacugccggacgcuuuguauuuccaccaacagugaauggcagaugauauggcuuuauauccuuaccagcaauuuguguuaucuuucagccuucugaauuuuggccacucuaauagauguguaucaguauaucacugucauuguaauuuauauuuccaugauuacaugugauguagaagucuuuuugcauaguuauuuuucauuugaauaugaucuuuggucagaaaugugcccagguccuuguuccauuuuuguuaagguugggauguuaauuuuuuuauuauuggccuugguacauucuuuguucauuuuugaagaguagucuuuuuuucuuuucuucuuuaagauuuauuuuuauuuuauguguauguaaguuuugccuguguguauguuuguaucaugugcguaccuggugcccacagaugccagaagagggcacuggaauccuugggacugcauuuauggaugguuaugagccaccaugugggugcugggaauugauucuggguccucugcaagaguagccaguucucuuuucugcugagccagcucuguagccuuggauuauagucuuuuauucgguaaguuucuucuauguauuuucuccaaaacuauagcugugggguuuuuuuggggggguggugguggugaauuguuuguuugcuuugcucuguuuauuuuuaauucucuuggcaguuuucccaccuccaaauaugugugugccuguauaucugacuaaucaguacaugcugccacaguguggaggucgggucucaccacuugcacccuuguuuugagggagaauuucuuuuauuucugcuacuaccccuaagcuuggcaguuucucccauuuugccuuaggaacacuagaggggguguggaggggaggaggagaggaagaggaggagaagagaagagaagagaagagaguguguguguggggggggggggugguagagggauacaaacagaacuuggcuggcauggagucuuagcuuauggcccuuguggaaguugcuuauuugcaacucuucucuauaucugucuucuaaacuuggagugcuuacuguucauagcucucguccuuacuagcaaacaacagaugcagucuaccugucuuuccucucauaccuaacccaagacacuuaaggaauaauggcugcauugaagccauuucccuggaagguauuuuccuguuaaagauaacauuuugucaucuauucguacuaauuauucugucuguagcuuuuuauuagcuucugcuugaacagggaaaaauauuuuucauccucauuuaauaagcuauauguggcaguagaaguuuuggacuaacuucugaguacuuuauggagguauugauguucaugucuaaaguaggcauauauucucaaguuuuguuuuuguuuuuguucuuucgagacaggguuucucuguauagcccuggcuguccuggaacucacuuuguagaccagauuggccucaaacucagaaaucugccuaucucugccucccgagugcugggauuaaaggauauucucaaguuuuaauaucuucuaaauuuaagugauaaguaaagugccuuagaucuuaagauaauucuucauauaauaacagacuuauuaauuuuaacugcauuaagaacuguugaugugucauauuauaaaaauaggucuuuuuuuucucuuauccccaugguaaugauuguucuauucuuggaaagcaucaaacuaauucaacucauauucuaugauauagcuacuauacacgaucaguucaagaaaacaaauccuguaaucuucguuuuaaguuugcaagcucauugaaaauacacccaaaugagggaaacaugaaguagggugcccuguuuucaaucuuggacgaauacuuugagagugauuccugauaguauuaaaaggcaccuuccgcccaggguauuuuguuccacccagauuuuuuuaaagcaccugauuugggaagaauaaagugaaaugggcuugggggcuagagagauggguuagcaguuaaggcuacugaguucuuccaaaggucaugaguucaauucccagcaacugcauggcggcugcccucgucugguguaucuuaagacagugacacauacauaaaauaaaauaaauaaauaauuuuuuuuuuaaaguggaaagggcuuugucuuuuucccacuucucuccagcuuagacuuuuuuuuuguaaguuagaaaauuguaggcaagaaaaauaacuagcaagagucauguuuucuugcuggcaccauaaacagagaucaacauuaaauauggccagacuaaauugaacaaaagucacugucuggaauauauuugagcuuguuuguugggggaugaacugcucacagaguuucauauaguucagucuggaaugacuauuucaauggagcuggcugugaauucuuuuugccucugccucccaaauacugggguaauaagcaugguaucaccucuggcuuuguucuuuuguuguuguuguuguuuuuguuuguuuuuguuuuuagagguaagggcucaauguguagcccuagcugaccuggaaauaaguguguguguguguguguguguguguguguguguguauuucuaccuuuuaaggcugaccugcugggcagugguggcacacgccuuuaaucccagcacuugggaggcagagucagggggauuucugaguucgaggccagccuggucuaaagagugaguuccaggacagccagggcuacacagagaaaccuugucucaaacaaaacaaaacaaaagagugacccagugagaggcauuuaaaaguacuuguugcuuuugcaaaauauccaagaucauuuuccagcagccgugugguagcuaauaauuaucuguaaguucaguaacaacuccugugccccuuuuugaccucugugggcauuacagaccacacaauguacauguacccauccauguaaaauaaagguauaguuuuguuuauguguuuuauuuuuuaaaaugcuacacaggcuucagcagccuugugaguagugucccuugcugauacuuuuuugcucagaaguaaugucuguuaguggccaugucaaagaauuugaguaaaugcauuuuaugaugcagaaauaucuuaaaauuccuuguuaguagcuccguugcuaaauuugaacaggauagccuuacucuacauuuugcauaauaguagaggauauuaaaaauuagguaauaacaaauucaauauuguuuuugaucugccuuugauucauuuguagaaauaaguaaaauuccaacuauuucuccaugaauuguaccauggagaaguuaauaucuaauuguagguaaucuauaaagcugggagacuaguuuggaaagugaaaugagaaguauacaugcaauucauauuuacuugagcaacucuuauucccaagaugauggguaaacgcugagauaccaguaguaaaggguaacucagucucccuuauaaucuaaacuuguuauuuuuacaucauccauaggauagcauccuauaaaauaucagguauauauuacauauuuaugaaguuuuauauuccugugaaauuaaugcgggaggccuguagccaaaauaaaaucaaaaggacuggacugcauauggcuuggcagguacacuuguggcugagccucaugccuugaguuugaccuugggacccacuuguuggaaagagugugcugacuccugacuucuuuccagacuuccacagacaugcugcuacacacauauaaauaaaggugguuucacgugccacucagguuggcacacaccugaaauucuagcauuuagcaagcugaagcaggaggauugcagcaaguucaaggucagucuggucgacaaagugaguuccaggccugcugggacuuuauacugagacgcugucucaauagauuuuaacaaacaaaauacuaaacacacaguucuacuuaucaguaaagcacacuaauuguggcuguucaguuuucuuauuuagggcuuuuacuuuugaucugacaucacuauuucaaauguauuauaagacaggaagaacagugagauauuaucgaaacccacuuccuuuuuaugugcaaaaauaaagagcuuugacagcagaacugauacuuuuaguugaaaauugauagaaacucuugauacauguauaaccuuucagcuaaauaggaacagacuaaaaguuagaaacucaguccaauauuaaaucuagcuuauugauuuuuaaauuagagaaaguuacuaguucguaguuuugauucuuagcucucaaacaggaaacauguccaaagaagagcuuuaugggauuucaagucaagguaagguggaauaaugucagaaaaauuauuaguaaaaccaauuaucucacuuacuguuuuguagucauaacuaagggaugugucugucuuuuccccaaaauauguucuaaguauuauuauauaagacagcuuugugaauaguuguuguuuugaagauuggcuuuuuauguagaccuggcuauccugaaacucacuauguagaccaggcugguuuugaauucuucuugccugugcacucccaagugcugugauuaaaggcacuacaugaguauaguguuuauaucgucauaagaagaaauggugagaugauuugcuuuccuccuguuuucaagagaauaucacuguuaacacauucagacuuuuuucuuuuaaucaaggucuggaguuagagaacaguguggaucccucuagcauauaugugcuaagugaaaggcgaggauuaggcucacuuucaaaugcauccuagaaacgaaacuuuugacagagugaucucaaauugaaagagauguucuuguugguagugguggaggugaagagaagugaugggcaccuugcguguuaaaggagguagcacuguuaggacugagacucuaaggauaaccaaaagcaggaaaguaugcaggcaugauauuuucuauuucaauuagggagucuuuaagaaauaauaaaaaacauggccagauugcaguagauggucauuguaugaaaagugacuuagaaccuaaauuggugauacaguuuaaagauuuuuauuuauauuuuuuguaggagcauuuugccuccauauaugugaguguaucugccaaggucagcugaggccauugcauucccugaaacugaaguugcaaaugguuguaagcugccuuguggucaucugaaagagcagcaagugcucuuaacugcugagccuucuuuucuagccucgggucauacaaauuguaacuauucucaaaacuccaguacaucauuaaucucccagaugccaaagggaacacauaaaggaaguaagguucguuuuuuauuauaaaguauuauaccagugaagacuuuuucauaugcuuuccuaguucauuuccuauguugccacaaucuuuuuuguuaagauuuucauuauuuuacucauggaggaauuggugccauuuauuuucccuuggguuuauaacuuguuacuuuuccuuuguuuuuaaaauuauucagucauuuaacauaaggaaguuggaauggauaaaaagccaauccuuccauauccaucauguuucucuuuuuguauuugagacacuggauuuucuuggacuguuauuuacuagugaaggagcuaauguauaugcauucauguuuuauauuuuauauacuuugcagcacaaauuuaguuguauuaaaaguauuuucuggggcuggagagauggcucagugguucuuccagagguccggguucaauucccagcaaccacauggugucucacuaucaucugcaaucagauuauauacccuauucuggcaugucugaagauagcaacaguguacucauauaaauaaaauaaaucuuuuuuuuuuuuaaaguaucuucuaucauuagucaucaucucguugcacuguaacagagaaucugaggccuuugacaauugaggaauggguucauaauauuacucucagagcuuggaugagaacaacaugcauaucucaucucuggcaucuaugguuucuccacuucuguaaucuuaacauugaaaaccauccaguuccuacaagccauaagcuguuuuuugaaaauagcuuuaacauugacuuuaagacaccuguccuccuguagucguugugcgcacacacaaaagcauacuauuacuuacaugguaauuaguaucagagaaggaaucuuagacuuacguaaggcauaacuuuauggcuuuuugaaauuacuuuaaaauuuuaaauucucuagaaauaugaaauaaagcaagcagcuaauuagcuuuuuuuuaaauuuuuauuuauuuauuuuauguaugugagugcacugugacugucuucagacacaccagaagaggcaucagaucucauuaugauugguugugagccaccauguuguugcugggauuugaacucagaaccuuuggaagagcagucagugcucuuaaccgcugagccaucucuccagcccagcuuuuuuaaaauauauuacuguuuuaucuuaggaaugagguccuuaaucuauauguaguagucuugauuuuaauaauaaugauaauaugugcuuugaaagcaggucugaaauagaaagcuagggauagaacuuaguauuaagcacuugguuuuggcaugcuuaaggcccugaguuuaucccccaggugggaggagggggaaacuaauuaggaaugaggaugaucaugagaauaaauauaauaaaaauauaaaaacauauuaauuaauagcacuucauacuuuggguuguugugggaugguuuuuuguuuguauuuuuuuguuuguuuuccuuugagaaaguuucucuucuuagcccuagcuguccaggaacucauucuguagacugcgcuggucucuaacucagagauccaccugucugugccuucugagugcuaggauuaaaggugugugcuacugccugcucauauauaguuuuaauuuauaucaaaaugugauuuuagauuuaguuuuacagaaguuuaagacagagucacacaguguacagguguuccuagaacucuccaaguaucccaggcugguuucuuauuucuagucauacuauuuaagucauacugugcuaugcuuuauuuccuuguucacagagaccaguaguagcaacaaacaaaauguuucucuaguacugaauguuguuuuuaaguaccaucucuuuuuaacaaaauaauugauuuuuauuuuauguucguagguguuuugccagcauguaugucugugugaggguguuggauccucugaaguugaaguuagaggcaguugugagacuuucucaaaaaauaagaugcuagggcuggagagauggcucagagguugguaagaguacuggcuauucuuccagaggaccaggauuuaguucccagcauugacaugucagcucacaacuaucuugaaaaaugcuuuguuguuuaagauugacuugcauauacuauauaaucuaauuaguuaacucuuucaccaauaaagcaacauucacaggcucugagaauuaggacaugagcacguuuucagugaucaccacugucauccuacuccagguacauaaucauuauacugauaauaaaauuuaauucuuuaaaauuuauuauauguaaguacagcuacaguguacuuacauauaauaaauaaaucuuuaaaaagacuguugaagguuaaaaaaaaaaggcagggagacccuuaccuugaagguauacauacauaaacaaggaaaauguuuucaaaauguuuuuccucccuuccccucccccccuuucucucuuaguuaaauuuccauugguguuuuacuagcauguaaucccuauguaagggauuuggauuucauggaacaggaguuagacaauugugaacuuuuguggagguacugugaauugaacguggguccucuugaagagcaagcaguaaucuuaaccauuaagccaucucucaagcccccacaacuuuguucuuaauugauaaaauguguauaauucgccaguugguaaacauaaacaaaaugugacaugaacauacaauaaaaaauuauucaauaacaaaaauaacuauuccuaugucauagcauagacgaaccuucaaagauugcauuaguugaaaaaauuuacucacaaaacguucuuuauuauuuuaucauaucaaauauagagauuugauagaacuauagagacgaaguagcuaaauaguuagcuaggauuacaggcaagguuagaagaguggccaguucucagcugugcucuuuauggugggauguugaaaauggauguuggugaugguuccacaguuuuuacagauauguugaacauaaugcaauacuuugaccucuuauguuauaguuugucaacaucuaauacuacauugaggauacauuuucuuuuacugcucaaucaucucuagauuuaucuuagcucauuuuucuuaaaucauguauguguauguguaaaugcucauauuuguuuauguauaccacagaggccaauaaaggauauagauggucuggaacuagaauucuauauagacaguuucgagccaccuuauguggggcuugggaaacaaaucugaauucucuuuuaagaacaguaagcuuucuuaacugcugagccaucccucaguauuuagcucaccuuuuuuuguguguaugugggaauuuucccccuuuguuuuaacaucaagcugauauacguaacuaugacauuuaugaagaugaggauacagacccaaaguuaaauugucuuaauaucaggacauuuaagaguaaagugguauguuguacuccauguucacauuucacuguguauauucauucacuuuuuuuuuucucuguauagcccuggcuguccuggaacucacuuuguagaccaggcugaccuugaacucagaaauccgccugucucugccccccaagugcugggauuaaaggcaugcgccacuacgcccggcuuauucacucuuauuuuugugucaaauggauaccuagcagcacauacuucauauaucuugaagcuuugugauuuuaacuagucaauacccuuugcuauaaaugcuuucaggucaaguauuuaaaaagaagacauuagccaauucgucaggagucaucaguaggaugcucuucucucaaacugguaccuccucacuccuacaugagaugucugaaucaaccguuuucgucuuucuccuuaacuaacauaaaauauauucauuauacuaguagaagauacgauuuugguucccagcacccacauugggcaguuugcaauaccugugauucuagcaccagagggccucaaauguguucguucguguucucucucucucuuucucucucucucucucucucucucucucucucuuucucucucucucucucucucucucucucucucucuuucucucucucucucucucucucucucuuuuucucucucucucucucucucucccucccucucucucucucucucucccucucacaaaaaaacaaaaaacaaacaaacaaacaaaaaacuaggcuggagagauaccuccacggaguacagccugcuguuccagaggacccaggcuugauucucagcaaucccauggcaccucacaacuuucuguaaccucauuccaggcuuccauccucuucuggccucuuucagcaccaggcauugcaaaugguacacaaacauacacaaaacacccauacuuguauaguaaaaauguauuuacauaguguuacacuuuguagaacauagauaggaaugccgugaauucaguauagucugucaggcuauacagaacagauaauaaugaaauagaagguggugguuuccagccaagaaaucuucaaaaauccccuuuaccuuggaaacauagauacuacucauaaucuuaggaccuuauucuaaguucuaacuugauaacaugauuuauacaugacuuccugcuuuuuaaaucacuucuaauauauuaaacaaugagaaguaauauauacuaauacacaccccuuccccauccuaucauccuacacuagaacuuucugaggaaauaaacugaaaagggagacuguuugcaguacaacuccaaaaagaagauccucccuaaaguguuuggucccaguucuuaacagguagcagcauaugaucuggggaaggaauggugcuugauaucuacucugauaauacaacuuuuccuugucaauuuuucucuaguaucaucuagacugucacauccacccucucccccgucaggcugcccaucacccaccauuccagcaaguaaagucauuucuccaucacagaagcacagcaaaaaggcauuaaaacagguaagaagugagucugcauuuaucagaauaaucucuccaauuaaaaauaauuaugagggggccggugagauggcucagugguuaaguacugacugcucuuccaaagaucccaaccacaugguggcucacaaccauccguaacaagaacugacgcccucuucuugugugucugaagacaacuacaguguacuuacauauaauaaauaaguaaaucuuuaaaaauaauuaugagagccucaugguguuugaggcuuuacuuuuguuguauaauggacagucauguacuaagaccauguuucaagaaaauccugcaucaacucuucuguuaguaaaauuucuugaaagauuguagauuucucucuuuacagaguaaaugucagcagucuacaaauuuaccgcugauaauuuguguacacuguguguaacacccauuguaggguuugguaauucuuuuuaacaugauuuugaagacccagaccuuuuccuacuuugcuaaauuguccaugaaugugcugaaucaugaauagguguuuaaguuuucagauguuuuuauauuugucugguuguuguuugggaugcuggggaugaaacccaauguuucucacacugagccaucuucccaauccucagguuuguuuucuuucaaauuuauuguaauaaucagguagauuuuuuuuuauacuguuaaucuaauacauugaaucacauugcuagauuuuccaauauugcacuaauuguaaguauggaauauacccuauauguucauucuuuacauacauuguaaagcaaucuccucuccucuccucuccucuccccuccccuccccuccccuccccuccccucuccucuccucuccucuccucuccucuccucuccucuccucuccucuccucuccucuccucguaaaauuuuaguuuguagucaaauauuuuagcacacaccuguaauccugucaccuuggaggccaggguggugagaggagaguuugaagccaaucuggacuauacagugguacccugucuguauuauuuuaguuuaaaucuuguaauauucuucuugugaaguuuugaaaugaagacacacauuaacauuguuuauuuuauuuuagacuuggugagaaagguguagaaauuaucuuuauuaccagcguugaauaauaauacuuuuuaaaaaaucauuuuccuuucauuauauuguucuuuguuauauuuuucuauuuuugaacuaguuuuggauauuuuuucuagaauacuccacuaguccauuucugggccaguaagauugcucagcagguaaaggcaccuucccucaaaccugaaaaccugcauucauuccuggaaguuccauguugggaagggaaacugccucccucgaguuguuccugaccucgauacacaugccuccccggcuucauaauguauacauacaauaaauaaauguuucaaaagacguaaaacacucugauuuaccuagcuauuauaaaugcugcuguaaacuuauauaguguuuccuuauuugucuuuuccuuguauucauuuauuuguucacuguaguaauugccaguuggguuuucugcuuuauuggaauuaucaaagagcuagcugucuuuggauuucccuccuucccucccucccucccucccucccucccucccucccucccuccaucucaauacuuagucuggcugcaugguaacauagucugaguaauuaggaggcugaggcaaggggauucuaauugcaagacagccuggguuauauaguguacaaccuucuccaagaaaaaagcaaaugauuaauuaauacaaacugacaaauaggacuggagagauggcucacuggucaugaguacugacuaccucuccagaggaccuguguuugauucucagcaccuauauggcacucacaacugucuguaacuccagaggauccaacacccucaaaaagacauauuggcaaaacaccaaugcacauaaaauuaaaaaauaauuuaaaaauaacaccuaacaaguaauuaggaaaacauugacauuauuuuuuucucauaauuuaguauuuuuauaucaaaaauugccaguuauagugaaguuggcagcucauguacugauguaguauaauaaaaagcacugaaucauuaaguaggaugauugaacacaggacccuaugccugauagucaaguucucugccacugauauauccaaagcaagccacuauaacuuuguuaggaagaaauuuuauauuaucuauuaaauuuuaaauguacauguaccaugaacauggaauuaagcauuuuaggacuuagguuaaaauauauauauacagaaaaauauuugcauaaaagcuuguuaauaagcugggcgugguggcacacacgccuuuaaucccagcacuugggaggcagaggcaggcggauuucugaguuggaggccagccuggucuacagagugaguuccaggacagccagggcuacacagagaaacccugucucaaaaaaaacaaaaaacaaaaaaaaaaccacaacaacaaaaaaagcuuguuaauaguaagaaguagcaaacagccuaacuuaauauaaauuuuaucauauauuguguauuuuguauguauuuauuauucauaugccuaagauaaaucaauuaggggauuauauagacauuucuauuuauaagauguaugauuauaaaggauuaaaaguuuaugcugcagaacuuugcacuauguaguuuagauaugacacaauuaccaaaacaugccucucaugcagaagacccacauugggcugugagagugcuuccucuucuuagagaagacuuggguuucauuucuagcaccuaccucaggucacucacaauucagcuccaaggccagagccugauaccuuuuuugccucuauagaaaccuggccacacuuagcauauacuuagacacagacacacuugaaauuaagucuuaaaaucuuuuaagggucuggagagauggcucagggguuaagaacaauggcugauuuucuagaggguccuggcuugauuuccagcacccacauagauuccuuauguccuuauguaacauacuucugaauucaaugaauauucacaauaaaaauauuuuuaaauucuaaggcccaaugagauaacucacuggauaaaggugucuguacugccaagcucaguucccugacuucugucuuggguagucacgagauaaaggagagcaccaccucagauacagcacccucugacauccacgcacaugagugcucccaugagugcucuuaaauaaguaguuaauagugcuacuuacaaaauguacaguaagaguuuuaauauauuuaguagagauaugaauguaugauaaagaauaaacuuuaauaaagauaauugcccauaauuauccuugaggauuguaaaagaacacuucagugauagucaaaaaaaagaauuuaccuuuaaguuugaauuaaauuuuuaaaauuuauuucuuguuuuuuauuuauaauuagaacccauaaucuuuauaucuugagaguggguuuuacugugugaccugaaacucaaauccuccugcuucuaccuccuaaaaacuacgcugaaagaugugugccaccacuccuggccuggagcccauaaacauuuuaaaucaugugaguuuuaaaguauuuaaacuaaaaguuauuuuaagaguuauuuacaggaucagacaugauggucacacacaauuaugagcugucaugagauuugggaguuaaaccuuuguccucugaaagagcagcacauccuuucaacugcugagccucuucccagcccuugauugcaugugugucugcauggagguauggccacuaugcggcauguguguguauacaugcuuuaaugucuaugggaauauaaagauggauguauguucaugucuucauacuuuauauccgaaaguuucauagguuaaucacagccacaacuuucucagauuugaagaagagaacuuuugguuguugaacuuuuuuuuggggggggggucuguuugugugugcaugucucucuguauauauauguaugagucuuugaacacaccuagaggucagauaacaacuuuugugagucauugcucuucuuccagugcguggguccuagggaucaaacucugggagcuagguuugaagagggauuccuuuacccacugagccaucucacaggccuucuuucuuuuuaaauauuuauucuaaauaauauaucaaguuaacucuauuaagaaauuaaaugguauaaaauaaccagaagauaaguuacugagacuuagacaaauguugcucuuguccaagguaauuuaacacaaauauuuaccucugaccguauauucaggucagacuaagcuguuacuggugcaugacuuacaauucuuuuuucagaugugauaaaaguacgugugcaguucucucauuagaagauuguaaauuccuugccuuucccccccccccccaaguuuuuaaguuugggaaaaauucuaaugauuuuuuccuuguaucuauauauaaaagacuaaucuuggccuccccucaaagugucugaacucuaaaggucauuuaggccuugccaguuuuguuuaauuuaagcuuuuguuugcacugaguagauuucagaguagguucucaccaguuugcuuggugguuguuguuguuguuguuguuguucuuuuuuuuaagauuuacuuuacuauauguaaguacacuguagcugucuucagacacaccagaagaucucauuacauaugguugugagucaccaugugguugaugggauuugaacucaggaccuuuggaagagcagucacugcucuuaacugcugagccaucuugcgagcccaguuugcuuaguucuuacugucggguuuuuucuuuauaggccuugaagcagcaacaacagaagaagaagcagcagcaaugcagaccaagcauguccaucuccaaucaacaccucucucucaagacugucaaagcagccagugacucuguaccugccaaaccugguaggcaaacugagcauucacccuguccaauggaauuuuucccccagcauauuuguacuuuugauauuauaaauuuuuuuacugaauuuuucauuuuuaaauugcuauauuuauuagcauaaucuuucugcugccacagaauccuagaaaaaaaaaaaagaaaauacuuuuauauguaaaauuaccaugcacuuaauucaaaauauaacagugaaauuuggguauuucauuauuucaaauuaaugagaaaccccuggaagcuuaaauucauuauacgcacgaacgcacgcgugcacccguuuuguuuccaaggucaaagugaauucuuugucucuguguguacaugcagguuggggguucagaggauggccucagaugucauuccccugcaccauucugcuucgggugguuuuguuuuguacagggucucucauuggccuggagcgugugguuuacucuaaacuggcugacuaaauaaccucgggaauucuccuaucucccuuucucaguccugggauuacacgugugcuguaaugugguucuuugugugguuucugaggaucagacuuagguccuuauuuaauaagaacuuucugcauuuaaucaucuauacagaucuaaagugaacuccuuaucaaugcucucauuuaaaauaugaagaugaagcuggagaaaugguucagucauuaagaauguguacugcucuugcagagggcuugguauuagugcccaccaucuacaugguggcucucaaacacuuaacucuaguucaaggggaucggauuccauccucuaguaucugugggcacugcacauacaggugaggcaauaagauaagauacaugcaggcaaaacauuuauucacaucaagucaaaauaaacguaaaacuaagacguggaaaauuguguaggcuuucuaaaauauacacuuuauuuuccaucagacauguuucuugggcuuuggguauuauuguugcuuguuuuguuauuaguuguauugccacacacagacuuuguuuugcauuauauaauugaaugaaaacauucuauggacugccacaaaaaugaaacgucugaguguuacagaacuuuucguuuuugccagagcagauacucacaauuggauaaauaauguaagagaagaugaaugauuguacaaaucauuuagaaggccuauguuuugucaaucauaacuccuguaauuaccauggaauaauaguuugauuaaauuuauugggcccugggagcaaauguauguggcagucugaggcaaacuugucaguucucuucuaccauggagggcccacaggugaacucagguuguuggguugguagccaccugucuugcucagccucaaugggcuuuuguguaugcgccucugucaccagucuucaccuauuuuucccccuagcccuaugggaaggaaagcaaucugauggacagucaagcaguccccagaacucaaauuccagcuuuucuuccucagugaaaguggaaaguucucugcuaggcuuggggaagaagucuuuccagaggucugacagacuccacacaaguaaguuaguuuacaaggacuucuuuuuucagugcaacaguguguucacagcauauuugaaaucauuagccacuggcuugaguuauuguauaauuuuaauuuuaauuuuaaaaagucagacaugauuucuuuccuuuuuuguuuugaaacaaggucucacuauaaaacccuggcuguccuggaauuuguucuauagaugaggcuggccuugaacucauagagauccucgggccuuuaccucccaacgugcugggacuaaaguugugugcuagacauacuuucuuuguuuuacauuaucucgauguuuuuaaaacuguuucugauacaauuucuuugggguuucauuugguuuuguugguuuguuucauaugagcaauaacugccacagcuuggaugugcuagggacuuggucuacacugagcuguacagccugaacccuagcugucagguuuacuuguugccuuuuacgacgguuucucauuaacgcugucuaaaauacccuagggcucuccugcuucagccucacaaacgaugauauaauaggaaacaccaccgcauuggcauuuaauaauugcuuuucagagauaaaaagaaacauggauagaauuuauuuaaugcccuuucuuauucguuucauccuuuuaucuuaguugucuucguauucuucuguccaucccuuaucaaacuguuucacagaaagaucuguuaucagccuuuuuucuuuuuuugguuuaccucucuuuguaccaauagguccuacuucguucuuguuuuuauagauaaaaagauagaagggacuauaauuaaauauuguaaacugaacucccuuggaaaucccacuaaaaagagaauacggacaaaaaaaaaaucaguuugauugaagaaaacaaggagacagccaaaugggcaggugucagcaaagguugaaagaugaaaaauggaugaagcugaaaaggaauugucauaaauaagccaacuauggcuacagaccacgaaaagggcucaagaacuggaaaaauggaugacagaaaagaaaggugaggcauaggguugauaaagaauuaaaaaugaaugaaagcauuuugaugcuuuacucuaaguagaagacaguuuauuauuuguugaaguugaaugcauuaccuucaaauuuaggaauaucacauugagcugcagaccagugauuuggcauuguguaguuuguucauugcuguaacaaaacacacgaacaacuucaggauguugagagguuuguuuugguucacagacuggaggcaacaagaagugcagcaguggcaccaggucuugugauaguaggaguaggcuggucaugucacuuauuuguggucgagcaguaucagacaauaccucaugggucugucccagucauccuccuuugccugccaugccaucuccccaagcaaugccaguagcugaaccaagguggcagagcuugucaucagcuuuucacguuuauaucuucauaggcacuauucugaaauuuagggaauuagucaaauacagauaccuaaauacuguucuccugcuuggcuuuacuuaguagagcguauuuuaaccaccacuagcagaucaguuaauuaguaaaguauaggaaagcucagaagauaauugugcaggcacacuuacaaguucccagaucuuuugaaacuuuuagauucuuuugacuacccauauaauccuaguuuuagaggcuuagguagaaguguuacacgauauaguuacacacugcgauccugccuaaaaguaucuucuaccaccaccccccaccuccccuugacaaucuugaccucuuuggugcuguuuauuaucauuuggcuugaaaagauauuuuuaaaauuuuuuacucucauuuccuugucugaaaaaauauuuugcacuuauuuuuauuuccacauuuauaaggauuuuuguucugaacuuuuagcugaaguaucuauuggccaaauguccugaguucugauacuuguaccuauguggcauagugacaagaaacagacagaaaauggucuuucuggcuuuaguuuguuacauuuuacuuaaucguguaauuugagcauguuucuguuucugugcagugauauacuaauaauuacugaguucuaucugcacagcaguaugugccugugaucccagcuauguagaaguaaauacauauacauuaaauaauaauaguaagcauuauuugcuucauggagcuaugugaaaaguaagcaaguuacuauaaauguucagaaauaagucugcugcuaguguuaacugucguuauuguugcuauugguauuauuugaaauagcacagacagucuuuuuggcuuaacaauauugaaguccuacuuguucagugaauucugaguugauugaaucaagauuauuaauguaaaauaaugacucuuguggcuggagugccaggucaggaguuagagccugcacuguucuuugagagguugguccccagcacauuuccaggcucucaaccugaaacugcagcuccuggggacauaguucccuucucaagccccucacgaaaaagcacacacucauagauaaucacauacauagauauaauuuaacauuguuuuauaagcguccuuuuuugguaagcuuaguuacugauuauauaagaugugcuaaaauguuuuauaugggcauuucucugucucacaguacaugauuucuuuguuaagagaagcucuuuauaugugucuaaggcuagcagugggugaguucuccccuucuuacauauccucaccagcaugaacuguuacuugcuuuauuaaucuuaguuauucugacaggucuaagaaggaguuucaaagguuugaauuacauuucccugauggcuaggauggauguugaacauagaaguguuucucagccauuugaauuuucucuuuuaagaauucuuuguuuagauuugugccccauuuuuuaacugggauauuuguauuuuugaaaugaaguuuuaugaguauauuuuggauguuaguccucuaugagauauauacuuggugaaaaacuuccuguuugguaggcugcugcuuuguuggaaugacggugcccucugccauacagaagcuuuuuaguuuuuuuuuuuuuucuguuuuuuuaaguuguuuauuuuuauuauuguuguuguuauuaauuauugauuuccugccugugcucuugguguucuguuuagggagucuuuuuguaugccaauuaguucaacgcuauucuacuuuuucuucucuuagguucaauguaccugguuuuauguugaggucuuugauccauuuggaguugaguuuugugcagagugauagauaugggccuauuuguagucuucuacaugcagacauucaguuugaccaacaacauuuguuguagaugcugucuuuguuucaguguuuauuucuggcuucuuuaucaagaaucagguguauguggaucuauguacuggucuucaagucuauuccauugauuaucuugucuguuuuuauaccgauacuaugcugguuuuauuacuauaccuuugucguaauagcuugaaaucagaacccaugagacuuucugaaguucuuuuauuguucaggauuguuuuaacaauucuagguuuuuguguuuccauaugaaguuaagaauugcuuuuucaagaucuaugaagaauuguguugaagucuugacgagaauugcacugagucuguagauugcuuuuggugagaucuuuauuauguugguuuaaccaauccaugagcaugggagauuuuugucaucuucugguauauuuuauuuuuugauucaaagccuugaccuuuuuaaucauacaacucuuuuuauugcuauuugauauuagauacauuuauuuuauugauuuaggugcuuguauuuuuuaauauacacuccugcuuuagaucuuuauguuuguuguuuuuguaguuagccuuguucuaaauucacugcuauuaucaucucucuuuucuguauauuucuuuuuuuauuagauauuuucuuuauauacauuucaaaugcuauccugaaaguccccuauacccuucccccacucugcuccucuacccgcccacucccucuucuuggcccuggcauuccccuguacuggggcauauaaaauuugcaagaccaaggggccucucuucccagugauggcugacuaggccaucuucugcuacaaaugcagcuagagacaggagcuccggggguacugguuaguucauauuguuguuccaccuauaggguugcagauuucuuuagcuccuugaguacuuucucuugcuccuccauuaggggcccuguguuccauccaauagcugauugugagcauccacuucuguauuugccaggcaccagcauagccucacaagagacagcuauauaagggucccuucagcaaaaucuuucuggcauuaguaguagugucuagguuugguggcugauuaugggaugaauccccaguugggggagucucugaauaaauaguccauuugucuuucccuaucacugucugucuuauucuuuuaagaugguauuuuaccaagucuggaguucacaauuuuuguuuuuuguuuuuuguuuuuguuuuucgagacagggucucucuguauagcccuggcuguccuggaacucacuuuguagaccaagcugaccucgaacucagaaauccaccugccucuugccucccgagugcugggauuaaaggcguggccaccaugccgagcgaguucacaguuuuuagcuagacugucugacuagcagaccuggaaauccuccuguuucuaucucugucucuccugucuaacguuccccacccccaagacacacacaacaaucugggauuacaugcauauguguauacacaugacuuuucauguggaugcuauagaucugaacuuggcucaucauguuugcacaaguccuuuacacagugauccaucucucuccagccccaaauguccaauucuugaccuguacuuaggcacauguuaaacauucucauucugucuguguguguguguguguguguguguguguguguguguguguguguguuguuuuuggguuuuuuuuuucucucguuuccucaaacuucucaaaaugaucugcccucuucuuuuuacucugguuaauuuugugauuauauauuuuauacccugauuaccuguuuaauaugcuaauuuguaccacuuaauaucauuugugguaucauuuuaaguauaaauuuuuugagcacuuaauucauucauaaauaccacuucacugaguccaaaucauacugccugugugugugugugugugugugugugugugugugugugugugugugagcgcgcgcgcacgcgcgcgugcacagauaaguguauaugaacauuucccuaaaggaaacugacucuuuuuccuuuacaacucuucaauuguaaauagcucuucagcuaaagaugaggaccccuuuguuccuucccucuucauaccagcaaacauagcaacuacgagauaaaaacugaaauuuuugucaugugcauaugagaguguuuuaccucuuguccuuacaacuuuucugccuguucucucaccuugaacagugugagagccuuuucaagagguggacuuguugauggugucucuuuaaagacaggguuuuuugaagcucagcuagcuuugaguucauuauguagucgaggaugaccuuacugauucuucucccuuugcuuuccaagugcugggauuacauguguuagcuacgauaguaguccuaguccuucuuugucuguucuuaaucguuguuuacauuugcaguuucuuacccauuuuccucauagcaacucuguauucuguuucauagcuguagucucuuaaauauaaaucuguuacuucgggauuuuagugacacucauaggggcaugcuguauauuuauuagauacuuguugagauucuguuguauuuuaauuucuaagauuuccaagggccugauuugagguaaucccuuuccuguagcauagaaugacuuuaauuguacuucagccaggagcugguggguauuuauacugagaauugcauagcuuuguucuauaacucuuuauauguaaucgugucaggcgccagcuaaacaacucagcgggucagaacacuugcuuccaagccugaaaaccuaaauuucaccccugggacccaaaugauggaaggagagaauuaacuucugaaaguuuuccccugaccuucauauaugcuccguggcuuaaacccuucaacacacaaauguacauaaaauaaauaaauguaaaacaguguuguuguuguuguuguuguuuuaagauuuauucauuuauuuauuuuaugaguacguuguagcggucuucagacacaccagaagaggauaucagaucccauuacaagccgggugugguggcgcaccccuuuaauccuagcacucgggaggcagaggcaggcugauuucugaguucgaggcuagccuggucuacaaagugaguuccaggacagccagggcuauacaaagaaacccugucuuggggaaaaaaaaaaaaacagaucguauuacagaugguuguaagccaccaugugguugcugggaauugaacucaggacuucuggaagagcagucagugcucuuaauugccgagccaucucuccagccaguaaaacaauauguuuauuacaaguuuucuuuaagacuaugcuauaaauuucaguucagaaauacuuaaaaggguuuggguuuuuuuuuuuuuuuucgguuuuugguugguuuuuuuuuguuuguuuguuuuguuuuguuuugcuguuuccugcauauuuugcacucaauuguugcuguguuugcaguuuucauagaaacuauuuuuuuauauuaagaugccuuuuaauuuuuucuuaaaauuuuauuguaagauuuaaauuuacauaaugagaacuaaugaaagauggaagguauaaaaugagauuaaauggaaauaguaaaaauuauaaaaauguguaaaaacaaagcagcacaauuuuuaaguuaguuuuacuaaucuuuguguacucaaaucuguuuaucuuguugcuguuuuaaagcagacaugcagcucaugcuagccuggagcucaaacccauggcagcuuugaacucuaguucuaucugccucugccuccaauaaauuauagauacauaccaacacaucuggguuggauuuucuauuuuuaaaaguuuagggggaagaggacagagggaggaagguagagagaaggagagagcgagaacacagauuguguuuguauacauagaugggcauguuuguaucacagugccugcauggaagucagaggaauguuucaaguguuaauccuugucuucugcauuguucaaagcagagcaccccuccucccuuauuuauucauuugagaauuauauaucuaaaugcaauauauuuuaauccugucuguccccacugauucacaacuuucccuugauuuaacacuuuuuccuccccaauuuauagcaccuuauauauguuuuuaacauauauaaccugcccugucuaauuggugcugaggcaggucucugcuguuugccauuauaaauaccagguuagcuggccuaugagcuuccugucuuuacugcucaucuugcucuaggaccuuuugaauggguuguggagauuccaacucagauucuuaugcuugcaacucagguguuuuaccuacugcacuaucuccuuggccauguuuucuuuucaaaagaauuuuuuaucuguauaugugugcuuguauggguuuaugugcaucucuuacacacuggugccuguagaugcccuucgaaguggaauucuaggcaauugugagccaugugaugcuggggaccaaaccuagacccuuuccaugaguaguuuguguucuaaacccccgaaccaucugucuagcuccaauuucuauuuaaaaagaaaaaaaaaaucauccuauagauaugcaguuuugccauuucucacaaacuuguuuaauggagggagaaagcuaucuguuagguaucugauaaacaauuuuacuuuuagagaucuauuucuguagauuuuuuuguuuauuccuuauaaaugauuagaguuuuauuucuuugccuuggacauuucuaagaucuuuuuaacugucaguauaguauuuaauuuugauuuuuuuuuucauuuuuacuuuuacuacacggcaaacuaugauuagauagaaaacugugaaaggaagccaagugauaaaauauuauuuucugaauuuuguaggacagaugaaaaggacuaaaugugcugacauugauguugagacuccugauuccauucugguuaauacuaaucuucgagcacugaucaacaagcacaccuuuucaguucuuccuggagacugccagcagcgccugcuuuuguugcuuccagagguggaucgacaggugugucacuuuaagcauaaacaauccuauaacugaaagagucuucuguuuuuaucauuauccucauauauucuaagcuguacucagacuaugcagcugaggaugucuuauauguacucuuagauuuacuuccugaggggauuacaggucugucgccauguuaagugugugagugugcgugcguacaaaaacccaggacuuuaugugugauggucaaguauuccauuaacugaguuacaugccuaguucucaagacuugaguuggaagccagccuggucuacagagaguauuucaguacagccaggacuacauagagccucuucaaaaacaaacaaauaaaaaauauaucguuuuauguauuccuauaaaaguaugauauuaauaguacuguuguguuacuuuccuuggaaauaucugaacaagguacaaccaaugaucagggaaugguuccacccaaguuuaguuuagugaguuuauuaacuaacauuacuuuacaggacuuuggagcuggauugcaagaaaaucuccccugguauuguugaugacucaaaaacuguaucccuagagcuccuuauccaaugagcagucagcucguccagcuggggagugugcugcuucagauaugggcacaccaccaucucucucucucucucucucucucucucucacacacacacacacacacacacacacacuuguaaguuuuaugagccucuagacaguuggcauucaaccuuccuaauguuaugaccuuuuaauaguucuucauguuauaugagcauaaaauuauuuucauugcuacuucauagcuguaauuuugaguauauagauuauaauguaaauaaauauauuuggagauagagguuugccaaaggggucaugacccacagguugagacccccaaguugugucuccuuugaagugucuuagcaguugaguuuuauaaaauaaaccuuauaagggaguugaacucucuuacuuuauuuugauuagaaaauaaggcuggagauaagagacugguuguaagaugcuugucuaacaugcaagggucguaguuucaguuccuagugcugugaugaaaaaagaaagggagggaggaaaaacguaaugaaaggccauuuucuccacugggaaaaauggaguuggggggaaggagaugaguggaaaaagaaaauugaaugguuuuccuuuugagauacauacaucaauagagucuagcucgagagcuuaguugucuuguuuuauuauuaacaggauaguaccucaguuaaggcagaaagcuaaaaaugugaagucagauaaauauaggcaaccagaagcauguagaacauaaaauacuagugaugauuaaguauguuacuuuuucuuuguuaaaagaaaugcuuucaucaaagaaaauggcuaguuaaaguuuucuucucugugaagaggaaaugagaucauuauucuuuuuuucuuucuuucuuuuuugguuuuucgagacuggcuuucucuguguaggcuguccuggaacucacucuguagaccaggcuggccucgaacucagaaauccaccugccucugccucccgaguacugggauuaaaggcgugcaccaccaugcccagcuccauuaugguuuuucuaagcuuguucucucaaauuuauuuuuauuuaugccuauguauauaucugugugcauauaugcuguguuuacaaguacccacagagaccagaugacggugucaaaaguuucaaaagcuggaguuggaaggaauuguaguuccuugcuaugggugcuaggaacuacaaacucagguccuuuggaacugcucuuaacugugucacuccagccccuauucacuuucauagauucauuuuuauauacuuauauauuuguuugaguucugccaggccugguaguaaggccugaaauuucauuuaacuugaagaggaagauaaugggauuccaaaagaacaaaaaauuaaauuggguuagguuauauauacuuccugguaacuagaagucaaggcaggaggauugggauuucaagaccugagcuacaugggauccugucucaaaacaacaacaauaaaaagaggcaagagagaacuugagugaaggacucauucaguaagcugguugccaugcaagcauggggcacaucguucagauccagagcacuuacaagccaggcagggugauagaccuguaaucccaauacuggacagaaagagacagcaguauuucugggacuugagagucacccaugcaggacaaacugaggaacucagacuuagugaggaaccccaucuuaaaaauaaaaugaagaguguucgaggaagauaugauaccccccgccaccccccccccagacacacacuguacacaugcacauacacaaaagcagcaaacagacugccaaggaugcaguugagcagaacacuugcuuaccaugugugugagcucauagguuuagucucuuuccuuuuucauccuuauuaagacagcaugaaagguguccaugcuugauacuauuaaucccagcacucugggagcagaagcagcagaucucugugaguuuaagccuagcuugguuuacaguguuccaggauagucagggcuguucuccacccacccacacacacauuuucccuaguguauaauaauggacuauauuguuuaguuuauaguaagauucacaagguaggcugcacaaaucauuauaauuaauugacuacaaagucacaguaaaguguuucucauucugaaaucuguuuucuuauuuuguuuaugagacaggguuucucuguggagccuguaauuuucuaugaagacuagguuggccuggaacccagagaucucccugccucugcuuugagaguccugggauuaaaggugugcacuaucacaccugcuugaagucuguaugcuauaagacuugcuuugaugccaguuccuuaaugcuuagugcuauaaucagcacaugugaaaguggauaauucagauaauuagguauuuuuccagcaguagggacuaaaggagaaguuuuccuacugacuucauucucuaccuuaucucuucaaaauaguuacuuuagagguuacccaucuaguuaauuauugguagcagaaauaggagauuaaaguuucggcaugauuuuuaaaggacuuggcugauuugaugggguacucucauuugcauguguucuuauguccuauuuuuuuguguuguuccaccccuaaauacaaguguuggggaguaguaguauaugaaacaacucagccgcagcaggcuaaugcugcuuucucagaagcacucauggccuucugauagaaguuuggaguaggugguuguuuaaagauaaauauuuuuaaauguguaugaguguuuagcuauauauaugugugugugcugugcgugugugccuggugacuuaaguggccacaagagugcucugcauccccuggaacuauauggugguuauaagcugucaugugcuaggauccaaaccugggucgucuacaagagcugaacaugcucuuaaccacuacccaucucuguccaucucuugccaugcgcaguuuuaaugaaagggauguuaagaguuuucuaguucaauuucccauaaaggccaauccuacggggguuuaaaauuuguuuguguguguuuuuuuuuuuaauaggaagcuaguugaccaguauugauaagauaaagugaaugauacugggaagaauuuuauuuagguuuccggaaaaugugucaauguggauaauguuuguaauguuuaaguugaaaauauuguaaacaaauauuuuuacaugauuugaguggaccuuuccccauguauuuuaaagaagaauuaauguuuuuuuaaaaaaugaagagagaaaauucaaauuuagauguguguguggguuuuuuuuuuuuuuucauuuaaaauuuuucgcauggccugugaggugauuuaguggguaaacagauuuuuagguaagccugacaaccugaauucaacccuaggauucaacaugaccuccacacaaaugucauugcacauacacaaacaaauacaauagcccagugccacgaacuacucccgggacacacacacacacacacaccccaucacuguggacucuauccuggagauacaucucuaggcacaagaaaaugaguuaaacccuuugucaaagcauuaaaaaaaaaacuuacuagacaauggacaggaauggggggugggcagggaagggauaauaucugagaguaugccucacagucugauaaaaauaaguagccuaaaagaaaacuaagaaagugacacuucacaagaccacugcagaguuacauguuuaacaaccauggaacaacagcuaacaacacagaggcucuaggaaaucaucuaccguuucaagguugacacaaaauuaaauuacagguugauacuugguggcaaggaaaagaguauuguauguaaacauauugcuugugguuuuagcacacuaauuauguuuuauacuuggaaugcaguccuuagaaauaaaaucacuaguacagcuggacaaggugacacaccucuuuaaucccagcucucaggaggcagaccuuuaaauccaaggacagucuggaguacauagucauacccuaugucaaacagagaaauaaaacaaaaaagcacuaguacauucaucucugccugaauguuuguugaaacuuuauuaauuauggggaaguauugguaacaaaguacguaauuaccacuaggaaacuaguaaauuaauuguaacacauucauaaaaugauauaaaaaugcagcaauuucaaagaagcuaaauacauuuuaaaauggaguuggaaggugagaaaggaaaauugguacacaugaaaagauuuuuuuaaaggagaaaauguuauuacaucuuuuuaaagcaauaaagaaggaguuaacuauguuuuuauggauagauuguacauacauucuguuaacaugaagugaacauuguugcaucuuuccuuuuaacgguuuucccuggcuugcucuuugauauagguugguccagauggccugaugaaguugaauggcucagcccuuaacaaugaguucuucacuucugcagcccagggcuggaaggaaaggcucucagaagguaaguguucugcccuguggcucccagggucuuagugccucucacugcaugagauacuggaauagauuucaaaggucaggauucucuuagagaaugaauauguauacauacacacacacacacacacauggaauuuauuagaauggcuuacuguguuaagucuggcaauagcugucuacuaacagaagcuccaagaaucuaguaguucagucuaguagucucagcuggucaucaguauaugcuagaauccaaaagaagucggcugcaaugccaguggauuaguggacuugccagcaagaguaagcagcaucuauaccacuccugguuguauacccagagugugcucuaacauguaauaaggauacaugcuccacuauguuuaucuaaggcauauuuauaauagcuagaagcuggaaacagcccagauguccuucaacagaggaauggauauagaaaaugugguacauuuacacuauggaauacuauuuggcuauuaaaaacaaugauuuaaugaaauucuuaggcaaaugaauggaacuagaaaauaucauccuaagugagguaacccagucacaaaagaacauacaugauaugcaaucacugauaaauggauauuagcccaaaagccuggaauaaccaagauauaaaucauggagcacaugaauaucaagaaggaagacaaaaguguggaugcuuugguccuuagaagcgggaacaaugguugaacaaauauggagacaaacugugaagcagagguugaaggaaaggccauccagaaacugcccaccuggggauccaucccauauacagucaccaaacccaaacacuauuguggaugcuaacaagugcuugcuuaaaggagccugacauagcugucuccugagaggcucugccagaggcugacgaauacgaagguggaugcucucagccaaccguugcacugagcacagguuccacaguggaauaguuagagaaaagcugaaggagcuggagggguuugcaacccuauaugaagaauaacaaugucgaccaacccgccccccacagagcucccagggaugaaaccacuaaccaaagagugcauauggagggacccuugacuguagcagcauuuguacaggaggaagacuuuaugggggggggggggcaucagugggugaagaggccuuuugguccugugaaggcuugaugccccaauguagggaaugugagggcugggaggugggagugagugugugggugggggaacacccucauagaagcagguggagaggggauaggauaggggguuuccagucaggaaauugggaaagaggauagcauuugaaauguaaguaaauaaaaucuccagugguuuuuuuuuuuuuuaauuuuuuuuauuagauauuuucuuuauauacauuuaucccaaaaguccccuguacccuuuccccgcccugcuccucuacccacccacucccgcuucuuggcccuggcauuccccuguacugggguauauaaaguuugccauaacaaggggccucucuucccagugauggccgacaaggccaucuucugcuacauaugcagcuagauauacgagcuccugggaauacugguuaguucauacuguuguuccaccuauaggguuccggaacccuucagcuccuuggguacuuucucuagauucuccauugggggcccuguguuccauuuuauagaugacuguuggcauccacuucuguauuugccaggcacuggcauagccucauacgaggcagcuauaucagggcccuucagcgaaaucuuucuggcauugugcaauagugucuggguuugguggcugauuauaugauguauccccggguuggguaaucucuggauaguccauccuuucgucuuagcuccaaacuuugucucugaacuccuuucauggguauuuuguucccuauucuaaggaggaaugaaguauccacccauuggucuucccucuucuugauuuucuuguguuuugcaaauuguaucuuggguauucuaaguuucuggguuaauauccacuuaucagugagugcauaucuaacgacuucuuuugugauuggguuaccucacuaaggaugauauucuccagauacauccauuuguccaagaauuucauauccauuguuuuuaauagcugaguaguacuccauuguguaaauguaccacauuuucuguauccauucuucuauuggaggacaucuggguucuuuccagcuucugccuauuauaaauaaggcuucuaugaacuuacuggagcauguguucuuacuaccaguuggaacuucuucuggguauaugcccaguaguacuauggcauaguaguacuauguccaaguuucugaggaaccuccagacugauuuccggagugguuguaaaagcuugcaaucccaccagcaguggaggaguguuccucuuucuccacauccucgccagcaucugcugucaccugaauuuuugaucuuagccauucugacuggugugagguagaaucucaagguuguuuugauuugcauuucccugaugauuaaggauguugaacauuuuuuaggugcuucucagccauucaguauuccucaguugagaauucuuuguuuagcucugaaacccauuuuuuuuuuuuaaagauuuauuuauuuauuauauguaaguacacuguagcugucuucagacacaccagaagagggagucauaucuuuuuacggaugguugugagccaccaugugguugcugggauuugaacucaggaccuuccgaagagcagucagugcucuuaaccacugagccaucucaccagccccugaaacccauuuuuuaaugggguuauuugaauuucuggaguccagcuucuugagcucuuuguauaaauuggauauuaguccccuaucagcuuuagguuugguaaaaauccuuucccaaucugucgguggccuuuuugucuuauugacggugucuuuugccuuacagaagcuuugcaguuuuaugaggucccauuugucaauucuugaucuuauagcacaagccauugcuguuuuguuuaggaaauuuuccuguguacccauaucuucgaggcuuuucuccacuuucuccucuacuaauuucagugucucuggucuuauguggaggucuuugauccacuuagacuugagcuuuguacaaggagauaagaaugaaucaauucgcauuuuucuacaugauaacugccuguugugccagcaccauuuguugaaaaugcugucuuuuuucccacuggaugguuuuagcucucuugucaaagaucaagugaccauagguguguggguucauucugggucuucaauucuauuccauugaucuaccugucugucacuguaccaguaccaugcaguuuuuaucacaauugcucuguaguacagcuugaugucaggcaaugugauucuaccagagguucucuuauuguugagaauaguuuuugcuauccuagguuuuuuauuuuuccagaugaauuugcaaauugcccuuucuaucucagugaagaauugaguuggaauuuugauggggauugcauugaauguguagauugcuuccagcaggauagccauuuuuacuauauuaauccugccaauccaugagcaugggagaucuuuccaucuucugagaucuucuucaaaaauauccaguuuuuaaaaaggaaauaaauuugaaaugcaguguuauaggugagaagaaaucugcaugauauauguugucuguaacuggaagaagacacuuugggaaaccgcuggagcauaaguacuguggcccuugcugcauauugaaaauuacaagguaguuugugacagugucuguacuucaccuacugacugguauuuccuucuuuuuucuggcuugcuucuuugguaaguuguugcuuuaacauaauauucuguucuucuaggaaucauucaugauaagaaucuaugaauaaugcuuuucuguuggugccauuucguugauacguugcaggugaauuuacuccugaaaugcaggugagaauucgacaagagauugagaaggagaagaaaguagagcuguggaaggaacaauucuuugaaaauuacuauggucagagguaagcuaaggcagacucuguauccagcugucaaugucacaugucaugugacaccucuauguuuuuaccuuauuggaaacucuagugccuacauaccuguaauuuuuuauaucaugaauucuuuuucauuaauaauagccuuagcugggcguggcggcgcacuccuuuaaucccagcacucgggaggcagaggcaggcagauuucugaguuugaggccagccugguuuacaaagucaguuccaggacagccacgauuacauacauagggaaaccccaucuugaaaaacccauacaaaagagccgcuuuuuguuuuguuuuuaaggaaucaugaguauacagaauuguuucucucauaauccuugguccuuaacuuacauuguacuuaaaguggguuccacuuacuuuaaaaaaaaaaaaaaaaaacacuugaacuucuuucuuugaucuuacauuagaguccuuccuuggaaaauacuggcuucuuguaauuucaugagauagaauuauacuugagaguucugugcauuuuuauagugauuuuccaaaauaucauugaucuacaccagucaggaauccaaacaaucaugugauggugggcuauuaugccaagccuguaauuaaaauccuuuccuaugugacuuggagaugaacaucacugaaucaagacacgcacuuuauuuuuaaagggcugcacucuuuuuauuuuuuuuaauguauuuugaucauuucacccuacuguuccuaacuccucucagauucacuccucccucccucauaguguucccaguuuugugucauuuguuuguuuguuuguuuguuuuguuuguuuguuuauuuuauguguguacacuguagcugucuucagacacuccagaagagagcaucagauuuuugauacggaugguugugagccaccaugugguugcugggauuugaacucgggaccuuugggagagcaguaggugcucuuaaccgcugagccaucucaccagccccagggcugcagucuuaaacaacuuuuuuuuuuuuuaauuuuuuuggacacacacacaaaaacaaaaucaaaaugaaauucuacuggguaaauuuaauagauaauagaucuguuugguucgcauaggauuacauauuccagcuccuauuugcuagucuccuuacuacauagugguaaaugccagugagaauacuuuauugaccacagagaaaguaaaggcuuuuucuuuuuaaagcuccaaguguaaguguucaucuccuuuaaagucacuuaaguaagauaccuacuaaaauuaagauucucaaaugcugauuuuucuauaaauuuauuuagagagagauaaaauugauggugaguauaaucuuauaaaucacauugcacgccgggcgugguggcgcacgccuuugaucccagcacucgggaggcagaggaaggcggaucucuaaguucgaggccagccauggcuaaacagagaaacccugucuugaaaaacaaaaaaaaaucacauugcacaugccucaauguggaguugguucucucuagcauauuaguuccuugguucaaaucuagguggacaucucaguggcacuaaauagacucuuuuuuauuacuaauuccuuuaagcugcuagagacagcuuaauugauuguugcugguuaaguaacaauguaaaacauuuaaaaagagucacuggugacucauaaaaauuagcuucacuuuuuccaagccacacugugcaagucccagcugacuuucacccucagauagcucagcagcacacaaccuccgaacuuuagaguuagucuaaguagaauuuaagcaggcucucuacaaacucaguucuaauucuuagcuuauggagaaaauuaauaacuauuuuuucaggugccccccccccagucuugggccaaccuuccuacaaacacuagugaacaaaacugaugacaguuccaaccuaagucucaggguagaagcauuugaccuuucuuuagguucuucuagcuagccugugaauuucuagacauuaugacuccuauaauaauaagaggaaagaaguaacaguaacaaucaccacuauagaacuuuuauuauguaccaaauguguacuucacaugaaguucacuuuaucaguagcaauaucgauguuguuaauuccaguguugaaguaaaagaacuaagaugcagaagccuaccuagccagucaguaucuugucaacauuugguaucagagacaggauuugaauuuaauuacuuuggcucaagaguucuacucacuuagaaaaauacuugcugugugucagggguuucuaguuauugacauagucuacuuuucucguguuuucaguaacaugggcuauuucccaacuaacagcuccuucuguuuuuuaguucuggccuaagccuugaagauucacagaaacugacagcuuccucaagugaucccaaagcaaagaaaaccccagcugagcaaccaaaauccauacuuccuucagaggccucuccugucagaauugucccaguaguuccucaguccgaguguaaagaagaagcagugcagauaccaucaccaucccaaaaggaagaaaaucaagacgaggcgaggccagacuccaaauccccagaaccuguucuugcaucagcuagcaauacaaaugagcuuaucaccaugaaacccaucaagagcccuaaggaugagggucucuuagagcagaagccuguugccugugcugaacaagaaucugagaaagaaaaucauguaaccacaacuucucguaauaacaaaagugagaaccaagaagcguuagcuauauccccaagcaaaucuaaaaaugcuggguuacaaaaacccauaauaaagccuguugcagaagccaguccacugaacccugauaugaagaugccaccagcaacuguuacugaucagauccaagaaagucucaagaggaaaucuucucuuacugaugaagaggccaccaguagcugggagaaaagaccacguaucacugagaaucgccagcaccagcagccauuucaggucuccccacagccuuuucuuaauagaggggacaggguccaagugcgaaaagucccaccucucaaggugagaaagugcuuguuguaccugcuaaguuucauaauuggugguauuaaccuagaaccaguaguguacguuuaauacacauaacugugguguuauguaaauaaaauuaguaauaaucaggcuuuagaacugcuuuccuauauuuauuucuugauauuugaguaagggaucugaauaaacaaccccagcccacuuaacuauucacaucuuagaggcaaauucuugcuauguaacucaggcuggcaucaaagucuuagucuuucuguugcugguuauugaguguugaaauuauugaccaaaaaccuuucuuuagugaaugucaaaucagaaacaaauuguagaccuaggaacuguauuaaaguuuaguuuacuauagauugguccccacugaagacuuucuccacucugaccagauuuauaaaauuucuccuuucauagauuuagucagaagcuguuuuacucucuuaucuuacauucuaucuagcuuccauaauuuauaccagaacaaaauguuuuagccaguuuguuucuacauaccuaugaccacagcucuggaaaaauagcaaaugaagaaaugaauugccaaaaccacugaggccuccucucaaaacaaaacauauaaaaguaacagaaucuagcugggcuauggugggacacagcuuuaaucucaggaaccagagacugguugguuuuuuguuguuuguuguuucuuuugguuggguuuuuuuuuuuuuuuuuuuuuuuuuaauuauuauuugggggagugguguugguagguuguuuugguuuuuuuuugagacaggguuucucgguauaagaacucuggcuguccuagaacuuuauuuguagaccagguuggccuggaauuuacagagaucugccuaccucucugccuaugccuaagccuaagccuaagccuaagccuaagccuaugccuaugccuuucagaguugggauuccgggcaugccacaccacugcccagcucguuuauauucuuaaaagcaaaauauuacauuucauuacugcuucaugaagacagaaaguaauugaaacuuaaacauauaaaaacaucuaacugcuuuguccuuuuuuaauuucaauauguuuauacuggugacuuuuaagucaucuuguauuauccuggguagggugaaaacccucaaguaguauuuuuaugagccuggcauggugauauaacugaaaucccugcacuugggagggucacaaguuugaggaccaccuugguguauauaagcaugaucuuuguucacacauaaaagagagagggaguauguuuguguguuucaugugcauacauauauacacacuccuaacauucccacucgggaggccaaggccagcacaucucuaaauuugaggccagccugcucuacaaaaagaauaccauuccagccaaagcuaaaacagaaauccucucuaaaaagaacaaaacaaccgaaaccaaacaaacaaaaaaauacaagcauucugugguggguggcauaacaauaaaacuuacuaagugguuauaggauaaacaaacaguuauuagguccuuuuacuuuuuuguuuuguuucuaucuuguuuuuuuuuuuguuuguuuguuuuugguuuauuuuuguuuuguuuuguuuuucaagacaggguuucucuguauagcccuggauguccugggacucacucuguaaaccaagcuggccucaaacucagaaauccgccugccucugccucccaagugcugggauuaaaggcgugcaccaccaccaccagacuuuuuguuuuguuucuuaagucagaguuucucuguguagcuuugguuguccuggaacucacucuguagaccaggccagccuugaacuaacacauagguuggaccucugaauggccuuauacuuggauauuuggcuuguaucauuauaagguuguuuuucuccaaacaaauuuccuguguuuuauuuaacaguuuuaucuauuuugucuuauagucucuucucucuauuaacaagaaguagcaguugcuacuuucuuucuucuucuucuucuucuuuuuuuuuuuuuuuuuuuuuuuuuuuuugguuuuugguuuuucgagacuggguuucucuguguccuggaacucacucuguagaccaggcuggccuugaacucagaaaucugccugccucugccucccaagugcugggauuaaaggcauggccaccacgcccggccaguugcugcuuuucuuauccccacagcuucuaaccauuaugugcugaguaaauaaugcuaccuaugauuuuagaacggauuucucagguauagggaguugauuucuuaauacuuuuugaauuaugaaaaauagcaauauuaaaauuuauaauugaggaauuuauagaaagaugacaugcuuuucuuauaauugaucacuuaauuuuuuuaauuaaauacucuauaauauuaacgauuuuuugcuucuuuugauuccaccaaauacugaaaggcaucguaucuggaugcauauuccuuaacuuaagacaacaaucuguuuuuuuuuuuuuaauguuauaaaaauaagugauuucagaguagauguaguggcacaugcuuuugucuuuaauagaggaggcagagggaucugugacuuaaaagccagucugaucuacauugugaguuccaagacagccaaaacuacauaaugagacccugucucaaaaaaagaaaaaaaaauuuuuugaaauuuaguagguuuucacaauuuuuucuuuaguauaauacauauuuuucuagccguucugaucuguaagcuagaggcuggaacccaaaaccacauacauuuuuaaaaucgaguauagaauucaccaggguugaaaaugacuggcagacaauauaugcauggaccuugauauggguggauagauuaagguugaaccuuagacacaauguguguuguuaguuguagagcagccauaugugccaugggugcuuuguguuaguuaucugcucuagucuuacagcugaaaauugaccucugccuucccccaucccuuacuuuuuuuagaucccugucuccagaaucuccccgaugcuguuuucuacaucacaggucucucccagggcucguuuuccaaucuccaucacuaguccuuacagaacaggagccagaacucuggcagacaucaaagcaaaagcccaguuggucaaagcacaaaaggcagcagccgcagcagcugcugcagcugcugcagccgccucaguuggagggaccauuccgggaccuggcccuggggguggacaaaguccaagagaggguggugaaaggaaaauugcuggaggaggaagugcaggcucagacccagucaguacaaauggaaaaggucccacacuggaacuggccggaacuggaagcaggggagguacgagagaacuuuuacccugugguccucaaccugagaccaauaugccaggccaagcacagccuccugguaucucuggagcacaacuacagcaaaccuccucagugccuacgggacuugccagcaguggagcaugcacaagugucccauuaccagcccacauagaaauaucaaacagugaaaaaccaaaccuccacaaggcaacagccacagcagccucuccuugccacuugcaagacccuaggaguugcagacuugaaaaagcucugucuccaacagggccuccucugaucucaggagccucaacuguuuauuuuguagcugauggcacaguugagcccaaagcagguucuaauaagaaugcaccaaagccuucagccuuagcaaagacaacugcuccugcuccacuagauaugacuuccucuccugugacaacagccaguuuagaaaaacucccuguaccccagaucaguggaacugcaacaucuacuggaucagcuccauccucaagcacuuugccagcagcuucuagccuuaaaaccccaggaacuucugcaaauaugaauggacccauuucaagaacaaguucuaguaucccugcuaauaauccuuuaguuacucagcugcuccagggcaaagauguucccuuggagcaaauucugccuaagccucucaccaaaauugaaaugaaaacaguuccacugacuacaaaagaggaaaaaggcauagggauauucccugguaucaguguaauggaaaguagcagcagagaggaaguuaauggcaggcaggcccaucuggcuaucccgcaguuggggaaacccuugcaaaguaaacagcuuucccagguuccaaggccaguuuucacugcuaaggaccggaaggaccccugcauugacacucaccaguaccgagaaggucuaaguaaaacaacgcaagaucagcucuuucagacucuuauccagagggcucagagacagaguguucuuucauuuguaccgcccucucaguucaacuuugcucacucagguuuccacuuggaagacaucuccacaagucagaaguucaugcuggguuuugcuggcagaaggacauccaagccugcaauggcaggucacuauuuacuuaauauuuccaccuauggcagggguacagagaacauuaaaaggacccauucuguaaauccugaugaucgauuuugucuaaguagccccacugaggcguugagaauggggcaugcagauuauaaaaacacaacuggagaaaucagcagcaaagaagaugaaagugaugaagaucgcguaggugaugaacaggagccuauuucagugaaggaggagccaugggcuucccagaguucuggcaggcauccgcaccauggggaagcuucaucuaccaaugauuguuuagcuagcaagaaugguaagacugaggcaccagugagugagcaaaccacuuuaggccaggagaauuacauauucucuagaggccaagcaucugaugaaaagagccugccuagagauuuuauuccggcagcacauaaacagaugacucaugcugugagagguaagacaguguguagcagcccugagcuuuucaauucuacugcucuuucucuucccgcagacagucccacacaucagccucuacuccuuccaccacugcaaacccccaaauuguauggaagccccacacagauagggccaagcuauagaggcaugaucaaugucuccaccucaucagacauggaccauaacucugcuauaccaggcagccagguaucuagcaauguaggggacgucaugucguuuucagugacugucacuaccaucccugccagucaagcaaugaaucccagcagccauggccagacaauuccuguucagacuuuuccugaugacaauaguaucgaggacacaccaucaaaauguuacugccgguugaaagccaugaucaugugcaaaggauguggagcuuucugccaugaugauugcauuggccccuccaaacucugugucuccugccuuguuguucgguaauaagacuguagcguauguaaaggagggaagggaaggcuuaaaaagucauguucuugcacccuuuuuaaaucacagaaauaaaguuucaguugucucaagagacauuaaucaggaauacagaaugcaggucuucacauuuacaggaagagcaccuuguauaguaggucugagucaaauaggacugaauuggugacaaaguuugcacuuacaaaaucauguaaauaugucacauuuuguuuuaacauuuuuuucaaaguauuuagguaaugauguauuaacuucacauucagauuuauguuccauuucuuuugacugagaaaaguugaacgguaugcauggugaaaggaagcugucugccucugaccuuuccccaggcuaugaaaaggaaagugagggagcgaucauagugcugauuaugucuucacagacuggcucagguucuucacgaagaagauggccuuugugggauuuaauucgggguuugcucaucccuuuacuuuagguggaacuauuuucagugaaauuuucaaaagguauuaacagcacagacaguguuuuugacccugacagcccuggcuuagcuuuuggcuuccaugaaucaguacuguuguuaaaagcagagcucugcuguuaagagguucuguuucuaagggacugcugaguuagauuaguauauacguggcaguaguucagcaauaauacaucacaacauugcaucaaucaugggcucccaccaauaaacacuuuacgggugggugugugugugugugcgcgcgcgcgcaugugcgcauacuguguaauguuggaaaagggaugaaauugaagaaacugaaacuucacggaauuuggaagagugguuuuaacaugggacagaaaauagucuuuuccuauucucucaauccauuuuuagguagaaagggucuuaagugauacuuaugcuuuggcauccagagcauaagagaugaaugcagcuacccugugccauccuacuauaauaaauuuugcacccacacacaaguacacaguuugcuguuuuagaaagugauucuacaaucucggcugucaggacagcugggaugcuuacugugaaagggucuugugagugacuaauggaauauauggcugugagauuuugcuguuuuucuuuccuuuugauuuuuuuuuaauccucccaguacuccagagacagagacagaccagucucugaguucaaggccagccugaucuucauaaugagcuccagacaaccagggcuaucuaagaagccuugucucaaaacaaaaauaaucacaaaaacccuaaauaaauaaaagaaguaaaaaaaaaccacacacacacaaggagcuggagagauggcucagugguuacgagcacugacugcucuucuagagauccugaguucaauucccagcaaccgcaugguggcucacaaccaucuguaaugggaucugaugcccucuucuagugugucugaagacagugacaguguacucauauacauaaagaaaucuuuuuuuaaaaaagagagaaaagaaaaacuaguugguggacauggugggugacacgccuuuaaucucagcacuugggaggaagaggcaggugaaucucuggguuaggaccaguaugguuugcauagcaaguuccagaguacacagugaaacacuugucuuuuuuaaaaaacaaaagcuagcuacgaauuuuuaaagaaauacuguuuaaguuagagaugguuuaaagaaaaauaguucaccaaaauuuaguauuauauagucuguauuguuugguuucaagucuccuaauuugaaguaugugguguaauauugcaacccaguauagguguauuucaaaagcuauuuauaaaacucagaacaauuuaacuugcuaauuauaucaccuuccagauuggagaaaggagacaguaagguauuuugccugccuugugaugcccuccccugaccacccuaccuuuuugcaucaaacacugggaaugcuuccucagucccugcuccaaacuaugaagcucacccuucauuuuuccucccugcuauuguggaccuaagcaauuacaguuuaaauucuguauacagcacuagucaagacaaugugauauccuuccaccuucccccuuuauuucaagaaaugcauagauaagggagaagaaaggcuucaaggauucaugguuaagaaguguguauguucugaagugaaggaccaguaagaaauacaagccaggccgggcggugguggcgcacaccuuugaucccagcacuugggaggcagaggcaggcggauuuuugaguuugagaccagccugauccauagagugaguuccaggacagccagguuuauacagagaaacccugucuugaaagagccaaaaaaaaaaaaaaaaaauacaagccaggauucugcucccaaaccuucaggacaauggguaguccccaugggaccuuaaaagacccauagcugaguagucucccuugucuacccugcuuuaagagggugaaugacggaauagacuuuauggugucagugaguaguuuguauuagaauaauuuuccuauuuccuaccuugcuuucuagaaaggcuuuugcuccauacuucccuuaaucucagaauggauggaaaagaggaagacauuagggacugucagguccauuuaaagaggaaauuacauuguuacucuucuugaucuccucaggcuauguaagucugaaguacuguucuucuccacuaaguaauacccaacuaauuuccauuuaaaaguauuccaaaagcagcauuuaccaacaauuuuuuuagauugaaaauauauuaaauaagaauccaucuagucuauuuguguuaaaacaugcuuucagauggaagacgaacauucaucuuauaaaugaacagaaaauaaacuagucuggcccuuugaguuugucacuccaguaacuauuaacacagauuuugucauggccuaucauuucuuuuaccuuuaacucaacucugaacugauugaauaagugcuaagcuuauucuuugggcuuuggguggcaauuuucagugagguauuaaauauaucugauaccugauggggcugugccccauccagcccucaaaguagucucuguaaaucgcugggauaguauucauauugugucaucucaguguuauuuuuaaguguucugaguugccuaaguagaacacucucugaaucauaaggacuuuuuguuuugcuuuuugaauaaucaccauucuuuagcucaguaauaugggggugggggagcagcacaaauaaccuggaguuguuuggccuugguuccuuaaguccuguguucaagacacugaagcuaucucccauguucugugugagauuucugaguaagaucuggcaagugagggagcuuuucuugagaggggaaggcuacauuucuauggguauagaaaugggaauauuugcgagccuaucucagauguacauuaauagaccucacugccuuccgggugaagguguguuguccuacauagaacggucccuucaguuaccauucugauugcucuaugcugcuuuccuccucuuaaaguuucaugagcucuuggguuaaaugguuuguuaugagcaggcuuuccauuacucauuguucugcgauuuauuuuagagauuguccaugagcacugaacaaggagaagaaguuucuuguugcuuuacaacagugugugcuaagugcuggacuuggccauggguagucugcagcucaauuuauagaacaguccaaagagacuuugcaaaacaugauaggcagggaccuuuuccucuguguuucaauaccuauauaccuauugaacaaagcaguagguagacauuuccuaaaguugaagcaguagcuucauagagucuugguuacuuuauuuuuuuuaaugcuuuacauuugauacaacuauugaagaucaauuuaaaaauaacuuuccaguaauauauuuuaaguaauauauauuuuaauaucuauguaaaaaagugacaguggaggacugaauuucucauguauacuauguuuaaugguagggucucacuguuaaggcacaaauuauuucaaaggaguugcucuaaaaacagauuauuucccggaaaaaaaaaaaugcaauaaugggaaugauuuggggcuuuuauuuuuuauuuuaaaagaauauugacuuauuuagcacaagcuauuuuucccucucuggugauaagguuuguacagacugguuugguaaaugcuaaauuuuugucuuuugccuuuuuaaaggaauuguuaccauuggaauugaggguauguacagagaaguuggugucaaugccauuuaauaagucauauuuuuucacaaauaaggaaaaaucauuuuaaugagaauuuuaaguauuugcaauaaauauguguauauagauuguauguauucauauauuauuuuucauuuuauuauuaaguaaaagauaauuaaaagugaaauuaaaaau

SEQ ID NO: 6552 - RNA, 756 nt, Mus musculus
auuugacuucugggucaaagccauggcaguggcaaauucaaguccaguuaauccaguggucuucuuugauguuagcauuggcggccaggaaguuggucgaaugaugaucaagcucuuugcagacguggugccuaagacggcagagaacuuuaggcaauucugcacccgagaucagaaaagaugguguuccgauaggauacaaaagaagcaccuuccacagggucauaaaggauuucaugauucaggguggagauuuuguuaauggcgauggcacuggagucgccaguauuuaccaggguccauuuguggaugaaaaauuuaaacuuagacacucugcuccaggccugcuuuccauggcaaacagugguuccaguacaaauggcugccaguucuuuaucacauguucuaagugugauuggcuggauggaaagcauguaguguuuggaaaaaucauugacggacuuguagugaugaggaagaucgagaauguucccacaggccccaacaauaagcccaaacugccaguggugaucucacagugugggaaauguaaucuagacaagacggaaccagguccucugcuguguugaugugacauucucccuugagucugacaagcuggacuggccucuguguuugcuucccugucuccacaguaugcgauccaggacccggaaguaucacaaaugagaaccaaucauccuguuuacauuuuggacuguaaauaaaggaauuuuuaaaaaagaaaaaagaaau

SEQ ID NO: 6553 - RNA, 760 nt, Mus musculus
ugaugccugacaugcggauccuguaaggaaaaaggcggaggcaugccugcacccugagcaucucuacagccaggagaggagcccaggucaaggucuagaggcuugagugcucucagaggcucggcgccugcuccuccuuguggguucccaguugguugggauacauuaauaaacaagauucuugcccuuguguaccuagugggcggagacagacggggaccagagacauaagagaggacagccaggcaggcaucauggacgggagcagagagcaaagccacggcagaggcgagcuaugagauccauggacugcaugaaaguucugggggcaggacuguccucuguguccuuggaggcagagugaguaggaggacccagagaauggagugagggagagccacugugaggacaugggcuguguugauggguguagauauugggagcagguucugagguguccaaaugcacguuuuaaaccaaggaguguguggcggguuugcguguucacgcacacuugcggguuuuguuucuggcuucaaguucaaucaggaguauauuauucuuugcccuguuuucugccccaccccaccccaguuuuucuuucagaaucaucugcugggagccccuucugauugacagccacccacucuggcagcagcagaccggaagaagagucuacagauugaccauccagugcugaagcccuucagcgccccuuggugagucuccugggagcgccacaggccccuggacuccuggu

SEQ ID NO: 6554 - RNA, 760 nt, Mus musculus
accaggaguccaggggccuguggcgcucccaggagacucaccaaggggcgcugaagggcuucagcacuggauggucaaucuguagacucuucuuccggucugcugcugccagaguggguggcugucaaucagaaggggcucccagcagaugauucugaaagaaaaacuggggugggguggggcagaaaacagggcaaagaauaauauacuccugauugaacuugaagccagaaacaaaacccgcaagugugcgugaacacgcaaacccgccacacacuccuugguuuaaaacgugcauuuggacaccucagaaccugcucccaauaucuacacccaucaacacagcccauguccucacaguggcucucccucacuccauucucuggguccuccuacucacucugccuccaaggacacagaggacaguccugcccccagaacuuucaugcaguccauggaucucauagcucgccucugccguggcuuugcucucugcucccguccaugaugccugccuggcuguccucucuuaugucucugguccccgucugucuccgcccacuagguacacaagggcaagaaucuuguuuauuaauguaucccaaccaacugggaacccacaaggaggagcaggcgccgagccucugagagcacucaagccucuagaccuugaccugggcuccucuccuggcuguagagaugcucagggugcaggcaugccuccgccuuuuuccuuacaggauccgcaugucaggcauca

SEQ ID NO: 6555 - RNA, 3724 nt, Mus musculus
gguucuuucccaugcugccacccuccccauggcuugcugcucaccaccugcaggucuccacuccacauuaccucaagaaagcuuucccuggcccaagauacugauaccaacuuccgucuaccuguggugccugguaaguuccuuucccugcucuguagcucauacggauguauuuucugccagccacccccacagaaucuaugcucagaaccauguccucguggaagguggcccuggauacuagugaucugaauuaaaauguaugcuuacucuguuugugugugugugugugugugugugugugugugugugugugucugucugucugucugucugucugucuaccugccaguauauguauaugcaugcagaagccugcagacaagaaggcauuagauuccccggaguuacaggcaguuguggguccccugacuggauggauggguguuaggaccaugaacucaggucaucugcaaugacgguagaugcucuuaaccacugagucaucucuccaggcucucauggacuucuuaaccauccuauucucuauuaccacuucacagagaagcuggggcucagagcacauaaguaacuucucagggccaagcgacaaaugguucaacuagaaugagaaucuaugucucacucugaaacccagcaugguggcucauucacaccugugaugcccaaucggaaggcuaaggcaggagugcuaugaguucaaggcuagccugggccacagaguaagacucgucucaaacaggaaaaauuuacagacacuuggcaagguaguaaaaagcccagguugccauagaggauguagacauuucuaauuauuaauuaugcauuuaauagacuaccuggauuacuagccacagccagacaggagaugcucccagcuguggccacagaccacaggauaugcugaaggauaugacgccagcagugguggucaagacuggaaagcugcugagccagcagaggcucagaagacagacuucagguagacagggcuugggaggcagggcucaguaggaggaguggcuuaaaagugcugacgucaucacugcugccuggaggagucacagcacaacagagcccuccucaccaggagcccccucgccccagcugccugaagcagggaugugccuugcuagguucugaaauacuggcaugaagaacacccuguaaaguccaagugguggaaacuaaagccacagagaaaccaguauucaucguacaacacguacaacaaggggaggcgccuucuggcuuuccucacaucaagggauuucaaagcuaaaacaaaagcuaaggauauuaacuguauucaagaguguuucuggcccgacaugguggcgcacaccuuuaaucccagcacucgggaggcagaggcaggcagaucucugaguucgaggccagccuggucuacagagugaguuccaggacagccagggcuacucagagaaacccugucucgaaaaacaacaacaaaaaauaacaaaacaaaaaaagaguguuucuguuuagaggcuaaaaugaaaguguauuuccaaauuaaaaugaaaguguauuuccaaauuaaugcucuguggcccuaucaggugacccacccaauuucaacacuggaauuucaacacuggggauacugagguccagugccaagaggaagaggccacaccccuguggagagaggaggugcgcugcucucugcccacaccaaccaucuuuccccacugagcugcuccccaaggaagcaggcccaucacccucaccucacuguugccaggacaacuuugggguugguacuagaaaccugauucuccccucccccauggccuccaagagaacaaggcucaagguuaaggggacucugugccacgcccuaacagccgaaggacuuggggcacgcaguaaaggucagaggacaaggauauucaggcacugagccuaugaagcagugcauucuccuagaguucucggcucucggagggagagaaacccaauccuguggcaaacagguaaaguccuggcucagaacagcagcagaccucacaugaaggaucaagacccaggcagaggcaggcugagagaagcagguuacagcaguguucaccugugugggcgccacagaaguagugucuccuaagccaugauucccagggcacacagcuagugacaguggacagcucucuuauaacccuguacagccagcaucuccacuggagccuggaugcagcuuccuaggugcuggggugugggggcugagaggagcccucccccccucgccccccccccccgccuucugaaggauagggugugcccugaggaggcuccccugucacuucuccaugccccucauuccuccuucuuuauuuuccgugccugcuaaguguuucugggggugauucagguacuucauaauucuaaaguuugugccuggcaacaggugugauguucugagugccucugcugccaggugccaguuggggugcuuagcaacucucaaggucccaaacgaauccccaaaguaggucacaugggagucacaacaaguaauggaaguucuucccucugggccucuggcuccgcacuaacaugcccauggagcugaggggagacuagagagagaccccaaguccacucggauaucuacuccauucagcuacuggaccacccacgaugccuggccugacuccccuuucaugccagaaucaugcucagaaagacacaucaauaagccuuuggaguuggcagacacagcucugcucugcagggaagcaggggccagggccaggcuaugaggccaaacuacuuuguuccucgccuuucuugccuacuuucuggcuccacccaucugucaccugaggcaugccucccuuguaugaaagagcugggccaccucaccccuuccuaggagcuauaacucuguccgccuucaucccaagcaaaaagcuggagaccuccacagagacaguacuaaagggacugcacccagagacauuugggcagggucccugcagugacagaggaggaagaugaggggaagaggagacuggcugggguggggggguaggaggggggucacgcaaccucagggacagggcacagcguuugccacaaaagcaguuauaucgacacugucacgugagaccugggccugagugaggcauucucgaaggaccucaucuggccuagaacugacauuuacacaaggaccacacaggugauauuuaguguggcagggacuucaaguggcuccuuaaaagggguccuguauccagacccgcuucugucugcuccuacagcccuuuguccccaguaucccugucugucaucuuguuuccguguguaccacgggcucugacauaggaaagcugacagagaccugcacuuggauccaagucgcccuggcugaggcuccuguguacagucagcccugauaccuggagagggagcaaccacugucaaccggaacagaggaaaaaggugcucucucaaccagcuaccagcuuccuccucaacucuccuucagccaguguguccccaggagcugaaaugcguccuuguaguuaacagcaucaaaggccgucacaguuuuuaagcucaccucuaccuucuuacuugaugugcuuaccaaacaaucuaagacaaugauuuuuuuuuauccuaguuuuucagaaggucaaaccaaagucaaagaggcgcagccccaaggucacac

SEQ ID NO: 6556 - RNA, 188 nt, Mus musculus
ccgguacuccugcugccuccuucaauuugccuucaguccuaggaaguggagggcccaucaauccagccacagcugcugccuacccaccugcccccuuuaugcauauucugaccccacaucagcaaccacacucucagauccuucaccaucaccugcagcaggauggccagaugggcagcgggcaacgu

SEQ ID NO: 6557 - RNA, 188 nt, Mus musculus
acguugcccgcugcccaucuggccauccugcugcaggugauggugaaggaucugagagugugguugcugauguggggucagaauaugcauaaagggggcagguggguaggcagcagcuguggcuggauugaugggcccuccacuuccuaggacugaaggcaaauugaaggaggcagcaggaguaccgg

SEQ ID NO: 6558 - RNA, 6083 nt, Mus musculus
gugaaguagcaauguaauaauuuuaugguugagggaucaccaaaacauaaggaacuauauuauagagucacagguaaacaggcuuccccuucccacgaggucuaacucaaagaagcugagauucuauaaggcuuugacuuauaaaaacugcaauaucuauuuuagguaaugaacuuuuuuuuugagaaaguaguaaagauuuuuauuugucaauacaagauaacacaaauaaauuaauuuuuacaacaaucuuagacuccagggcuucucucugagguuagcucauuauguaaacagacuacuuacuaucuaaagugaucgagcaaucguacguugaguguucacaacaggcuugugaacaaugaggagacacagaagggcacuuccuugccuccuucccucgguaagacguguuacugaacagaugaggcuaacuugguggaaaacggucucaauguuaucagaauacaguggcgccaaguucaugugaaccugaagacuauauaauccagucauaccuaucgucuucuuuacucuaacaaaagcuuaagcugguguggcugugcacaccuucaaucccagcacuggacggcagaggcaggcacaucuucucugggcaucuacugauugaguuucaggcuagccacagcuacagagugagacgcugucucaaaacaaaacacacaacuaaaaaagccuacuauccaggaaguaggggugacucggcuccgugguagagcacuugccuugaaugagcaagucccugccugggcuuaaucuucaguaauggaauuagaguggggaaaccagcaucauacugaauuagaaguuaaauuaauuucauguuaaaaugcgggggaaaaaggggccguauaagaccuaguguuuguccugugacacagcagauacggcccaagagaacaaaguggugugcuggaucaaccaagagaaagaacugugguggugacccccuuuaaccccagcacucgggaggcaggcaggugcaucucuguaaguucaaggccagccuggucuucagagcuaauucuaggacagccaaggcuacacguagaaucccugucuugaaagaaagaaaaagaaaaagaggggguggggggggggacaaucugugguuccacuuagaaagccaggguccugcaagccaugcccagcacucagagaaguccagacuaaugagugucaggaggccuccgcuguguaaacugguuggugggcaccucuaccaugauuugucagugcucauagugaucaagggaaaagaaucaagaggccuuaguauuggaagcacuccagcauaauuuaccuaggaaagcaaggaucagaguccuuuucuaggauaaaugauuuuaaaaaaagauagugagguccucaacgcuacaccacugacauuuuccaccaaccugaaagcaguguuuuuucucacucacccaaggacaaucugcacacucgcucaggccucaguuagccacaucacuccuaugucagagcccagggaaguugcagacccuggacagagcauucuagaagccagugcgugugagcacauucaggucacgggguuugagauuauggguucgaagugguugcuucuuuccuucuaccaaugggacauccaucuuugguggcuugaagguugcuggaucuucaccuacuuguguggccugggcaugcaucaccuccacaggagagggucuuggggcaccuuuguaaaccugaauagcaaaaccagaaucagauuucugcaggggucgugguccaaagaggcuccauuugucugccgaguuccuaucauuuccacucccaggauccaugguauucagaucaaguaaggcuguggaggagccagaugggaaccagccucuggacuuuugcuuaggggacgugugaggggugcugcucaggguggacugggcugaugcagggugcuucucuucuuuugcugucucuccacucugcagcuuuaguuuacggagugcuucugccacucgaagguacuuggucuccuccgugguaaggcccuuaugggguguguagccagcaucucucaguccugccuguuguucaaaaugcuggaugcucuccugggucugcucugugaucagggaacucaugaugacauggguagcuuuagccuucaccacaggggccuugucugaacugucaguggcuggugauggagucacagcaagggaagagacacuggccgcacccuccucuaucuugucaagaugcugauacuugcgcucuggaaucacuggcuuccaggggaugcugccaauuccgauggaggaggagucaugggcgcaggguccucuagggcaucaucauagcugaaugcccaacggcacaucccaaugggcagggacaucuugccuagaggccugcugggagcaagagcacagugaaaugaauccggacuaugcggacagacagauguuaaugaggagcauggcccagcuucugcaaauuaucgaagcuucugaggaaggauccauccagaggcucugcuugcccgccgccugcggcccgacuucccgcacuaaagaggcuccgaggcuccagauggcccaagaggcugcugggcuggacagaggugagccaucaugagagcgugacaaacgcucccugaccgguaaugaacugagagauggguuaacagguaaaaaaaaaaauugucacacuaaccugauaaccugaguuuaauccccaaaaccugugucaaaguauguaaaaugaauuauuuauccuagcuaguccccaauaaugacacagagaaaccaagauuuguuuccaaacuucaccuggggcagucaaaugaucugucugaacccccuaagcuaaucuggcuaccucacagccaacauagcaauaauacuucugguuuuugcugaacucucaagaacucacuucucuuuccccgugucagaucuacaacucgcuuccucucucccagucccuuggaugguagaagucccacccuuauucucucuucugcccagccacuggauggucagcauucauugagagagaauaaaugguaagaauuauuguacaaacuugucauguacagauguuuagggaggggaguaauucuuggcuggaagacuuugugaaggugauguguuaggugucaggaaagaggaagaaaagaagcauucuauuauggcaccagagacuggaggccagucaugggacaucaaggaaagaagagggaaauggggagcagagagagggaggggagguaaggaacucaaaggcaacauuuuaaaccugagugaccugaaguccauuauucccaacagaaaacauauugugugucagcgaugacccacagauaauagugaugcuuauccacucuccucacuugaacuuaguggcaaugaugauaaugaugauaguaguaggugcuuauuaaugagagcuuuaauuugaauuugugcugguucuuaagaaaccaccauaacuagaggggaagaguauaacaacauugaaaggaacccacaaugcuucaggaugguggccauuuggcuccccagacccagcugacuuucaguucucccagaacuacagucacuugaacaaucggaacuucuucaaauacuggcucacuucuuccuugggguauggccucagggcuaugcauguggcaauguucuccggcugcuccagccacagcguguggucaauguucuucugcugcagggucucagccagcuccuucaagguggucucaucagcagccuacaaguugcagaacacacaacacagacugaaugacccauuuaggaagugucagaaggucacaagaguggggacgggcucuguaacuggagcuguggcuccaccaaagaacuguagagcaacaguugugcccauugguuugcuauuuccuuuuuuuaggaucuuacagaaguggcuaggaaggggcugagaaggaggcucgauacccuguuaauaaaaugcaauucucuuuuuuguauugaauucugcuauauaguuucuaguucccuauggcuggcgccuacugcagcucaccuucacccuuaagcuaucugugacucagcugaccacugggaagacuucuaaaauuacauauacuuuccuucucccucucucauccccucaggcccaagccuaaguugaugcaggacacaucucucaacuauuugauauaagagggcucaguccacugugggcaguaccaucccuaggcaaauuggccuuaaguguauaaguaaaauaguugaaggucaggagagccaguaaacaguguuccucugugguuucugcuucaagauuucugccuuaaguuccugcuuuggcuucucuagaugauugauguaaccuguaagguguaauaaauccuuuccuucccaaguugauuuuuuuuuggccaugguauuuuucucagcaacaaaaagcaaacuagaauauuauauuaugcaugcacacugagaauaacuuguaagauuuguuuuuguuuuuuuuuucuucccaucaagugaguccagggauagaacuaggguugucagacuugguggcauaugccuuuacccaaugagccaucucaccaacccuuuucaucuacccuauuauaugcuuuuuggucagcagaauaggaucuaaggccaacaggaucuugaccuggauacaaauacaacuuuuuuaaauuccaggagaucuaggagaaggcuuucugguaaagaauaucauaugguccuaacccuuaagaguuaguccaggagcugaggagaugcuccguguccagaggaccagaguucaguuccuagaacccacagugggauguucucacugccuauaacugcagaagagccuacauccuacucuguccucccaugugcauacgucccacagacacacacaccuacacgucugcacccaugugcauacgucccacagacacacacaccuacacgucugcacccaugugcauaugucccacagacacacacaccuacacagaauuuaaguagaucuuuaaaaaaggguuaaucaaaugcguauguaaaucaccaagaugggaaaggaccccucagaaaguugaacacagauguagguuggcacguuggucccuuuggccauuguuccuccacucucaccccuuugccaguguuuuccuggauaaagauuucucuagagaagcaggugcuauguaaaugucaguuaggagacuugagacucagagcuucugaaaaacauacuccuuuuccccacucacugagcauuucuccuuuuaaauaaacagccucuauuucuuacuaacaauauuaaggcagugcuaauuuuaggcccagcuuuuuucuuuuucuuucuuuuuuuuuuuuuuuuuuuuuuuuuuuuugagacaggguuucucuguauagcccuggcuguucuggaacucacuuuguagcccaggcuggccucgaacucagaaaucugccugccucugccucccaagugcugggauuaaaggcgugcgccaccucgcccggcuaggcccaguuuuaaaaggcagauuggugcacaggcauaagcgccacgcuuuccccagcuucguucccagggaucuaagggacacuggaacaaccaauuucuggugaacgcugugauagcagggucugcgucgguucuucacagucaugcucugccaaagggaagguucacugcguagcgcagaccauucccaaacucuuagugaucccuccuacaaucaugccacacguacuuccggaagcuaaggguugggcccaagagcagaucuacuuccggccucggcaccccacccccguuuagggucccuccggauacuccccacgccucaccucgagaaccaccuugcgcaugcgccccagcucccggagauaagcugccgugugcggauggucucgaugaaggugcaaggcugcuguggcggcgugacaagccugcgcuaccagugcgccggugggccaggaaaagggagccugagauagauccuuucguaauacuaaguacuguacaaggaucuguggcuccaccccagagcaugccaucuuccugaucaucagacuggccggacg

SEQ ID NO: 6559 - RNA, 6543 nt, Mus musculus
cuucaggaaguucaccuuuaauuucagcauuccagaugaaguuuccugacgcggcgcuuuggcauaaggaccuagaaaagaacagcaguaaggaaaguuggagaugcuaaugcccuccccuauccccacugcaccuuaaaguaugcaugucaccuucaagguuuuauaauugcacuguuuguuuuauguauguacagauuaaaauuauugcuacauuugaggaaaauaaaauugcuugcuucuauguaauuccugucauuccacaggaaauugacuuuuccagcuacugaauagaauuuguuuaacaaccucaugggcugccucuucauuuaugcgcuauggaggggaggggaggggacauauagaaagauuaccaaaucacaaaugauuucaaauauuaaagguuaauaaaaagaaaugauccuauagcccaaaauccuuaaaguuacucuaauaugaaccagucuagaaaauguugaugagaccaaagccaagcugugccugggggccuugaggaaaugcugacuuagcuggccuuuggucugaugaguaaacucuguugucuggggcuaagauacuauccaggcaacacuaaagaaccgugaaaugucaugccccucucaauuacugauacaggaauucuacuugaagaugccguuucagugugauagugcauuuuauaaaagucaggcccuggccagugagauggcucagcaucuguaaaccuaacaacuuuaguucugcuccuagaacccagagagaggacuccucuggccuccacaggagugcagugcucugcuguucacacacacacacacacacacacacacacacacacacacacacaccaauaguaauuuuuguuuaaacuuauacccuaaguagaaccaauuccagagggccuguuucucacauauauucccacacauaacuacagaaucugcuguuuagaaucauauucuggagugaaauaauacauuuuccuauaguuuagaugagagaaacuucuuuuagauggagccucccacuggcgcaaaguuauccugaguggcaguggacagagaacagccaacagggacagugaggaaaacugagacgcuggaaugaggaaacugccugccuuguggccccgggaagaagaguucguuccuagagaaguuccuaaaggacaauugucugcuuacauagugcugacccuaugcugacaguaacugcucuugucagaagagcaccugcacuugaauguccugaauggucugugagcaucccccacugcucaaucucacugacucaguugagcccauacguucuuuuugcuggagguggagccuguucugccagcaacguuaccuuucuaugcguguuuuauuuccauugcuaccauacucuuaagaauguugaaaaaccacaugguggcucacaaccauccguaacaagaucugacucccucuucggugugucugaagacagcuacauauaauaauaaauaaaucuuaaaaaaaaaaaaagaauguuuaaaaacaaaaggcucuaucaucauuuaccuagugagcauauuuuauuucuuacccgaggcuccaggaacaaggaagggugaaaacgggauuggcccugcccugugcugaauuguggggagugguaagaaggagagagcucugggagcggccacgcccggaggugagggcgggcugccuugcacagagguggccuuggagguaagguacugagaguacagcagacagcaccgugaaggauggacccagggcagauuugaggagcaugggaaggggcuucugggacuauuggccaguguguggagcacugguaaacaggcccgcagagaucugucagcugguagggccgaagacgcugacucaguaggaaugugugguaggcuugggggccuugcuuggaagucauagcagcugagaagagcuaaggucucuuccauaacuagcccuacccaaccagaaacagagccuucuguuccuucuguccacccauccauagcuggugauauuaaagacauucaaagaaaguacauguaugcucuaacaauuucuaaagugguuaggaucaugaccucugccucugcagaucuuugagagagcuguagacgugaaucaaguuauacuaaauuaugacauaaaaaacaguuuaucaguguggggacaugaaauccagcuuuaaaauuguaucuuauguguuucaccugcauuuguguaugugugccacaugagcuccugguaccugcagaggucagcagaaggcacugagcccccuggaacuggacuuacagaugauugugagccaccaugggggugcagagaacggaaccuggcgcaccugcaaaggcaacagugcucuaaccccugaggcauuccuccagccguguguuuuaauugcagacucugcuuuauuguccuauccuggacuagaugauucaagaugguuaagagucuacagacuuuaaucucauguaugaacuuaagcccagcuuucuucugugaaguaugcuaaauacagcauugaaaagaagagcaagaggucaaagguggagaagagagaacccagaccccuuuucuggagacucugagaacuuguccuuuggguccucaaguuaauggggggagggauucuuuggcauguaguuagccaauauaguaugucuccgcacaucuaaacaggaagugaaggauggacugucugaaacaggaucagcgcuuuagcuuaaaaaaagauuguagagccgggcggugguggcgcacaccuuuaaucccagcacucgggaggcaaaggcaggcagauuucggaguucgaagccagccuggucuacaaaagugaguuccaggacagccagggcuacacagagaaacccugucucgaaaaaccaaaccaaaauaaaacaaaaaaacaaacaacaaaaaaaaaauuauagaaggugaggguuaaaggcagguuauaagagugucugaugggugcuggagaaauggcucagcgguuaagaguaccaacugcuuuuccaaagguccugaguucaaaucccaguaaccacaggguggcucagaaccauccauaacgaaaucugauggccucuucuggagugucugaagaccgcuacaguguacuuacauauaauaaauaaggaagaagaaggaggaggaaggagggaggaggaaggaggaggaagaagaggaagaggaagaagaagagaagaaugacaggauuugaggugcagcucagauacagagcacucaccuagcacgcaugggacccuggguggacuccagcucuguguguggcuaucaggguccuuuucaugaaacagggucauuguacagucuauaagucuaagacaauaggcuucguggaucacaguuagaagcguucucaucugugcuguuuauccuuuugauggugaagccuccccacaugcugugaauuuagcucugccauaaucauuuauccuuuguucagaauucuacaaccagaaaaaacaaguauccauagaaagcagaaaccaagaguaaaacauugaaaggaccaacuacuuuuucaucagacauuccucccacccccaugaccagagguccuacgauuuagaacaaaguuaaaaaaaaaaaaaaaacuagguuauaaaaauagcuucuauuucugaugagcugaugugugacagacauggacagcaccagagauaacuuucugagcugccuguuucccacgguggggacuccauagcucuuaaaccagugguucucaaccuuuguaaugcugaaacccuuuaauacacuuccucaugcugugaugacccccaaccauaaaauuauuuuguugcuaccucauaacuguaauuuugcaacuauuaugaauuguaauguaauuuuuuuaaaaaaaaaaaaaaaacaggguuucucugugcagccuuggcuguccuggaacucacucuguagaccaggcuggccuugaacucagaaaucugccugccucugccucccgagugcugggauuaaaggcgugugccaccacgcccggcauaauguaaauaucuuaccugcaggauaucugaucugugaccccuggaaaaggguugugacccacagguugagaacuacugucuuaaauguugcuaucccuuuccacucucccaagaagucccuguccauuguuuucaccuguguuugaucuuucagcaucccuguuccuccauguagagcagccuauucacagauguugaaacugaauccccgauucauggugaaggggcucagaacuuuuggccugugaguuagauguugggcuuuggggugaaaccguuuagugcugcauagaaccaccauuaaagaugagacgaucagauaccaacauaaaggcuggggaccacagggcucugcuguugucaugaugguuucugaugggcuuucacuucauggcauagacgaggcuggccucaaacucacagagaucugccuggcuccauuucucugccgauuuaaagguauguaccaccauaccugcuuaaggcugaugauucuuuuuaagaucuauuuuacuugugggggaguguucaccuggaggccaacagaaggcauuagauggcaucagauuccuggagcuggagucacacaaauguaugugccaugugcaaggaccgaaacucugguccucugaaagaggagcaagcacucuuaaccacucaaugcuuaccuguuuuuuuuuagcuccaacacugggaauccuaaugaauucagaauuauucuuuagaacuugaguccuauagaggcuucugaagguuuuuauuuugaaaauaaaacagccguuggaagcuguuaguggugacuguucaugccuagagcaaaucucacaucagcuugaguauggcaaccucugcucucuagaaaacaaaugcuccaugcacgcguguggccuuuauucucugucugcugcugaggcagggucucucuucacagaccaggcaggcuuugaacuugaaauucuccugccucagccuccagaaagcuagaaauacaugcaugaaccaccacacucaggcuacuacugauccucaugcuuaaauuaacuguugccauauucauuucugccuugucuauaaugauuuuucauccuucagggcccuguuccagaaccuucccugguugcagcacuugcuuugcacucacugcuggguuugccucauuagcacuuggcuguaugcacacuggugucuuuucuccacuaaaucguuaagucuccucagaaacuucuucgcagcagccucgugaaugcugacuggaguacuucaaccacuaagggacaagucaguacugaguugucccccugcaaucagcaucaccguguuuccaaaagguuacaaaugugugcacaacuugcacggcguaguucuguuuccauguuuucccuuuuucaugaaaugugaagaaaaucuucuuuacuaguuguugaaaguuuccaaaugcaggaccugaaccaggcugaagaucacagaaacacuugcagguuuccuucccaaaugagcagaaacuggauccuaucucuuucugaucugcaguauggaccucugaaaagcaacauuuaguguuaagauuaagcaaaaaggggauggcucugaaauuuccuagacucgccuuuaaggccggugccucugaaagcugcccgcucaaacugugugccggagggauccagucaguuagcagggagcucucagaacucagaggucuuacugggguuucuuuccuuaaagcagcccaguccugcucagcucugcuuugcucuugguucuaagaauucuuggaucuagaauuuagcguugaaaucauacuguggagaauggucccuauugcacauucucuacuuaaagacucaugugccucuauuuaggcuccaaauuguccuccaaucuccccuugaaagcuuuucauuaaggaaauccccaagcauauaugaaaguagaagcaauaauguaaagaucuaguucucaucugugaacuuauggcccuaggugaccugucuuaagugauuuuaugguccaauccuaacugaucuaccuaaugugaucuuacgauccuaagucaaugguucacaaccuguggaccccuuuggggaggaaggggucacauaucagagaucuugcauaucagauauuuacacuaaaauuauaauuagcaaaaguacaguuaugaaguguuguuggaaauauuuaaccggggguuucuaauccuccucagaccauucaguucccagagaaaagacacaaacccuuuauauuuaugauaagccuuuaaagcacucgagcuggacagauaccagccuucuaagcuauuaguagcuccuucccugucaauaaccccgaguuauaacuugccauguucugcgugggccacucucacucugacuggccagcccucauggccauguuuucaugauucaccuaccuaugacaucuucuccucccuccaccuucuccuccccuuucucaugguguccuaucucaguccccaaguguugggcagugggcuaugcaaagac

SEQ ID NO: 6560 - RNA, 2630 nt, Mus musculus
uguguguaguauaugcacagauauaaguauuagggcaugcccgugaagugggcaugccugugagugcauaagugggcaugccugugagugcguaugugggcaugccugugagugcauauguggauuccugaacgacagucagguguuuuccuauaucacugucucaaguugagacagggucucacugaaccagaaccccaccauuagaccagucagccagcaagcuccuggggucugcuggucccuguccccagugcugaaacuauaggcauacgcauauuuacauguuuuuguuauuguuuuuguuuugaauggguguuggggauucaaacucaggcuugcaaacucauacucgaaaagcuaauguucuuaccuacuaaacuuuuuuuucuccauccucuuuauuuuuuaaaaacuuuccuuauuguuuauauaugagccaguaucauuguuauaaaacaaaacuauuuaaaaaaaaccaacagcuaagucagcucuugauuuaaugacuaaagugcuugauguauaguagccauaaguuuuuuuggaacugggaauaauuaggcucuagagaguuccaauaggccauguuacagauccuauucacagaacuaguauuuuuuuuauauguccaaaggauuauuacugaugugugggguuaauagugccugaauuaacaucacaucuaucugggccauaaaguuuaaauacugcauuagauuuucauuuuucaaccucgccuucauuucauggggucaguucuacuugcugauugauagugcaauuuauaaauaaagacauuuucuuuuagauaacuagaguaacuggauuucagagaggcuacugugagguuccagaagugaauccuuggcucuggcguguggggauucugggggagugcaagguuagugggacuuacggaaguggcuuccuuagugaaagcagauggaccagagaaaaagcaaacauucaaaaaggacaagagaguggcaagacugugcuagcaagggacuaugagugggcaaggucaaaggguuuacuuaguaagauauuucacuccagagaaagaauuuucuuuagcacccaugaauagcuauagcaauauacauacuacuuaaguuacauucacaauucaguaaaaucuuagcaggguggcaaacaccuauauuuaugcaacuugggaggcagaggcaggaagacucagacuuggagaccaaucuguguuauguagcaagguacugaacaaauaaacaaacaaauaaguauaaaacaaacaaaaaaucucaguacugaguagucugagaauguuuuaagauguauauuuaaauuuuuaauuuauuuuaugaguaugggugcuuugccugcaucugugccugugcaccacaucugugccugaugcccagggaggccagagaguaugucauauaugcugggaauggaguuauaaacagcugucagccaucaugugggugcugggaauugaaccuggguccuuuggaagagcaaccagugcucuuaaccacugagucaucucugcagccugagaauggcuuaaaguuaagacagaaacuaauaguuaaagcuauggauacaaaccaaaucaacuuauaugagagaagaggaaggaaagacaauuaaacauacccccacgccucccaaacacacaaaggaaaagacaagaaaaguguuagugaaacaaaguucagagaacagguagaaagaaugaggcacaaaacaggaagaggggagaguaagaaaggaggggcuagaaacauccaguuagaaaaaccaagauaaaguugaugugcccaccacaguuacacaucagcaguuccugaagucuaguagagacaggaggacugccuauacuuggcucauuuguaagcaccagagggccggacaaugcacuuugcacaggguagaugguauuagaccaggaaacagacuccacaggaguaaacuaaguagagauagagaccuucaagcacuucagcuauuaauaaggcuguggauugugcaggugguacuguaaagaaggugaggacaggagcuaaucaaaugcacuaggguacugacuuugauaagaaucaacggaaugaacacagggauggaaggaugacugcauaaaggaaggcugaguauggucugcuggcugcuuuauaacuaugaccaagacaggaagaugaaggcagcacagggcacucagcaguaguagggugaagguaccugcuuugugaaagaagucacaggcugucucagagagggccagcgagaugucagguuugacuuagggaagggacauggaggacuuaaggauuuucacaggcugcuuuggggcauccaaugcaggaugggaaacagcagaaaacagcaucacaagucagcuaaaugaggacaagaacucagggaaacaaagaugaccgcacagcacuuccacggccagagagaacagugagugguacauugcaggucuugggauaagagcugcuuuccagauaaagugaucaaggcucaaggagcuguccuguggcugcuugauuccuccggugacaaggaacacuacuuuugaaaguagcauuuccauuauagaagaaaaaaaaggagguuaaaaaaaaaaaagaugugggucc

SEQ ID NO: 6561 - RNA, 60551 nt, Mus musculus
agaccgagaaauaauguauuuucauaacucuaagagugcaacguauuucauuugcaguguuuugagagguucaauuaaagggcaguuucacagccauaugaagacacuaaauaacguuguuauauacugucagccauaucaagacacugaauaaaacucuguuauuuacuguacagcuauucaacugugauuauggcggacaaucagggaguuacuaccagaugggagacacuuaauuuguuguauuuaaccaccuggcuuauguuuucugaauccuuuucauggucaaugcauauucauuugaggaaaggucugguuuaauaaaaauugaguacauguuuacaacucuguuggauaaaaguauaggcucucuaguuagaccuccuaccucagcucuaguuccaaauaguuguaugaccuuaagcaaguuucuuuaauucuccaauuucuguuucuucuucaucuuuaaaacagggauaaugauaguccccauuucauaguguuguauguaauauaaagugcuuaguugcugugccuagcauaagugcccaguaaguguuaccugcuaucaucccagccugcuuccuucagugagaaaucucaagcuaauuagucugucguccucucuguggugcugucucucuuagguuugugauuuauucuaauuacuguagaaaauagccuuuucuuuugguguucaguuuuuaaucaacaucaaaaugagccauaugagaaggcuaaaaaaugcauuacaagagucuuccucuguaguucccuucauuucuacuacuuuggaucaucacuucagugccuuuggacucagauaguuaaauucuuugcagcucgaaguggacuuaacuuggaagaggcuaguguugagagagaacaaacgugagagaucuaaauaggcaaggcuuuguacuugucauuaggacgggaacagccuuugcuuugccauuuucuuucuguguucucuguccuccuuucuuagucuuccaucuaauauguuuuugugcauuuguaaaaugacugcuuuaauauaagaaccagguagaacaaguuaauacauuuuguaauuuauguaacauuuggggcauugcuuuuuaguguucaugaaauaauccuuagggauuauagguaauuaccucaaagauuagugacaauuuccuguuaguuacuuuucuuguuucuaugacaaaauauuugacaagaagcaacuugaggaacauuuugacacacgguuugaggguacaguccaucacagugagagaaugagacagguagucacaacgcaucugcagucaggaagcagagauggauaccgucuccuagcuguugccuuugugugaaguccguggaauagcgguccgcauucagggugagucuucccacuucaguucaucuaaucuagacaauccugcauaggcauguccaaaggcuuuccuccuagguuguuguagauuuugucaaguuaacugucaguauuaaucauauuugccaagaaugguguggaccacuuaggaauacaaagcaguauuauuucuuuaaaccauuuuuauuagcaucugaacauccaagugguagaagggaaaauuucuccccuuuagguuuuccauugcugcggagccuaccuguauugagcuuuccucccccucccccuucaucccagugauucuggccuaagacucacuaacgccuuucaccguacugauuccuacaguguugcacagguucgcagacuggguaguguggggugcuggaggaguuaagaaccuuuggauuagauuugggcagcuguaagccuuuucugguagugcuccccugaaccugaucuuuggaguucauuuagcugaggaccugauagugcagcucacucuugcaucucucgcagaucgccucuucauuacugcagcuguucuuuauuuuugucuucuccacauuccacaucagccuucuuuucuuuauucugucuucugucuuugaaaauuaaggacaaaagaaguuacucauaauucauagcauagaguucauucuuucauuucauuucauaaauauugcaugauuucuugcaagaaauguccaauauauuacuuauauaaccugugaauaaaauacacaacccugucuugccauaggggcacuuaaauucaggaaaagagaauaaagacaauaaaauaucuugaacuuagaaauuaccaaguacuauggagaaaauuaagagaggaaauauggggguguaugugugugaaguaauuggaagaaguaaauuugcuaucuucaaaauuaucaagaaacuccaacacccuucccccccccaaaaaaaaauccauaguguacauuuacaaguaaauccauaguagccuuaauguaaguaaguuauucauaguuuaggguaccauauuuaagaugguuucauuguuauuguuauuauuauuguauauuuguuugguaccuagcaaaccucuugauauuucuuacuauugaaauuauuuaaaaaccuucccuaacacaguuuaugcuuaaagcagaaauuugccaaauuguuuagaaugggcacuuaauuugauuuucccuaaaaguacuauauuguuugguuuaagguuuuauugacuuuuuauguguacuauuuauuauaaugaauaauaaauguucuguguagaaaauugggacacuauacggaaauacaaagaacaugauacuuuuuugauauagccgcugcucauguuuugauagagcuccuccuaaaacauugucucuacagauaaugcaccuugcaucugcuauauuguuagaaguuaauuuuuuuguuguugcugugcuaccccaagcaugugaggcaagugcuuuuccauugaacugcaugcccaguuccuguucugugauuuuuuuucuucuuagcuuacuaauauuuaucaaaaccugacucuauuuuuacuauguacuuauucucaguacacuuuuauuggugaauaauaugccguuacuacugaauacuaguaauaaugucuaacauuuauagagcaguaguuuuaucuuaguuauuuugcagauacuuuacauaaauucauuuagucuuuagccucuuuaucagaacuuuauaguugaggaauuugagcaaguauaauaauuuccucagcgucacccaaccaguaagugagagaccuaggguauaaauuugacuuugaucaucugcuuauaaucacugucuuguauggcuucuguagauuaagguagucuguaaccguucuuugaugucaugcuguagcucgcaucccuguaccugugcuuguguucaugaugaugagcauuuccccaggauagauuucaaguggacaaaagggacauuggaucaaaagggauggacacgucuuuuuuuagguuauauuaaaggcgggcuuauugggaagcugcuuucuggugggacccaaggaccaagggcagagaagucaccuggggaaagugggguaggaagggagaaaggagcaugugcggagcauguggauggacccauccgucuuaaugcccauguaaacauaguaucagauuaccuuagggcaaaguucuuaguauccaugugggaaugaaaccugucuauuuccuaacacccuugaaagcacugccuuuuaaaaauaugcuaacuuacuaaaacuacuuuucuacuucuaaguguugguaucagaucauucuuuuuccauuuuucuugaaaaauguuaauuucugcuucuuuccuauuuuauuggcacauucacuuuguuuuguuuuguaguucuuuuguucuuuuguuccuuucuuuccugucuucucuucccuccuucccucuccuucccucccucccccaaucuguugacagaguuugauauagccccgacuggccucaaauguacuauguagccaaggauaaaagaggugaaggagacuucugcuguccgugccuccaccuccugaacacugggacugcaggcagaugcagcugccccugcucuaugggguguagggaacaagccugaagcuuugcgcauggugcagucauucuaccaacucaaccacauuaccagcccuuucgauuguucauaagaauucuuuguauguuaagcauagucuaucuucuguguaguuauacauuuuucuaaguuuguuuuuuagguuuguuuuuggauuuaagaaaaauaacaaugaugguaguuaaugucucuauaguguuucucaaguacauauauguuguauaugcuagaugucauucauuuaauaacucauuuaauuuuugcagcaucccguaggagguagugcuguuauuagcuccuuuggcagacauugucauuuuuuuuuuuuuuuuuuuuuuugaggcagggucucauguguagcccugcuggccuugaacuugcagagauccaccugccuuccaagugcugggcuuaaacgcgugugccuugacuucaucuuuuuaaagucuagauuuuuccucugugcuuuugccuauuucuguucucaguccccaguaaccugcugucugaaaccuauuguuuaguacucguuacucaauuuagaagucauuuccucugagauuacucaucuaauaacguucuaguuucucaaggcaaagugagcuacucaucuguuucucacucccacagcacuuacauggaaguccaaguuuuggugcauuuuucuacucuauucccuuuucuuauacauuuaaugacugggcaaaaacacugacuugaauuaaaagugcucauggugacucuggguggugucaagaagugaaaggccaagagguggccugguugaugaagggcuugcugcacaagcuugaauccccagugcgcacauaaacacacauguacaugccuccccuaucccccagucaaacacaaaagaagcccagcacuugggaggcagguggaucucuacaaguucaaggucagcagggccauacaccgaaauccugccuuuuaaaaaaaaggugaugugaauugaguuaauagcagagcacuccuagguaagaccuuccaaguccagcaagcagagaccuggacugggaaaggaacacugaagcuggucugagagguaguggggaaaacagcagaaggccagagacugguuuugcauauuacaaaccuugcuucugggagagcuuuaggaguaaggcccuguuugcccuaauauguguuuguggguaugggucuacguaggguuuguuuuuuuuuguuuguuuguuuguuuuguuuuguuuuguagggauuguuguuguuuguuuuucuuuuguucuguuugcuuuuagaaagggucuuacuguguugcucagguuuuuuuuuuuuuuuuuucaaacuccuagcuacaagcccccccccccccccccagccccacucuucuugacacauuccuaguagcugggaucgcaagcacacacugcuccagccaacugacccaguguacuccaguacacuuucuuauaguguucagaauauugagucuucgagaacaugggucuauuuaucuucugacuuagacuuuuuacuaacauagugaagaacuuggagaguccugacaucuugcuaagacucugaagggaaguuuggugaacucgaagccuuugucaaaagucccagggaagaucccugcacucuugucuuuggagccucuccuccacuuuccuaggucagcgcuuuugcauggaccucagcucuuucucaccggccuugguuaugcuucugauuucucuuuugcuaacuggaguaagagacauuuucagauauaccaauggcuggucucgaaagagggugguaaguacuaucuuuauauuaacaauauagcuuauaucauuugauagaaauacuuuuccaaguuuuuauauauauuuuuuuuuaauuagguauuuuccucauuuacauuccaaguuuuuaaacuucuuaaauuuaacuuuacuucucaguagguagcuuaauuuuguugucguuguugcugcugcugcuguuuucauuuuuguuuuuuugagacagaccaagaacuugccgaauagaccaggcuaaccuugaauugccuuucaaaugcuugcauuccaggccugcaccacaacaccuggacaauaucuuuuucuuuaugaaaguaguacaugccaaaugcagaaaguuaguaagauaaaaguuuauuccaagucaaucuccuaguaucagucauuuuuagaguucauuccaugggcaugugugcaugccugaauguguguguuagugugugugcccagcaguugaaauugagaacacagauuuuguauuuuaggauuuaagugguuagcuuuguaaguguaauagucucauuaagccugcguuuucuuuucuuuaaaaaguagagauuuucuggguauggugguacacaaguuuaaucccagcacuugggaagcagaggcagccagaucuuuauacauucgaggccagucuggucuacacagcaaguuccaggacagacagacagucaaggcuaaauaagaaaaccucuaucaccuucccaucccccagaagguagauuuuugguuuuucaagacagggcuucucuguguguagccuuggcucugcuggaacucuguagacuaggcuguccuugaacucacagagauccaucugccucugccucccuagugcugggauuaaaaccauucaccaccaucaccuggcuaaaagguagauauuuuauauaauauuuaugcuuauggcuauaaagacgaagagguaauuauaguuaauaucagccuuaucuuagugagggucuacugcucugaacugcuuagaaugagggagcagacuggagcaauugcauauucucuuuuaugaaauaaaauuuaaauuuaauuaaaauuuuuuuuuaacauuuauaaguggcuuuugaaacuguuuagugaacucuccuuuaaaauguaaucaaaacaaguccuaaaaguugauuuaucuugggcuagccucaaggauggugaguauaugugaaccugagacucuaguaucuugaaaugguggcaucauugauaacaagguaaccaugguaacauguaaaaacauguacuauaggguuuggcaccuucauuauauuucuaaaauuaauucuuaguugaaguacaaaguaauaaauucaucauaagaucuucauauuuguuauuauauaguuugucuuuguuuccuccuacucuccucuuguguauuccucccucccuccagcugauucucuuccuucccccaguuaguucccucuucugcuuuucuauugcccguguuccuucaccugcuuccaaaagugaguuuuugccccauguuaagucaccacauguaguauuaaagcauuuaaaauccugggcuaggguuucuaccccaccuuugguuacugaguuccuggaugaaagacacacacagcauuacauuuucaguaagccuuaaucugcaagauaauccuccacaggcaugcucagaggcuggugucucagaugauucuagacucugucaagcugacaacuuauauaacuugcugggaaagaaauaaggaaaaggaccuuauuuuguuccuuuuaaugcccaaauagucuuuuauuauauguguagauaaauuuguuuauccauucuuugauagacauuuggguuguuuguaccuuuuuggcuacugugaauagauguacuauaagaaguuguacagguuuuuguguggacauguuuguuucuuuuaagcucauccuuagaguugaauugcugauuuauaugauagccuauguuuaaccuuuuaaggagcuuccacauuguuuucuaaagcaguggaaauguacucccacaagcgguguaugaagguucuacuucaggagaguauauuuuguacuguuggugauccacuacacaauaucauaaugaaaauaauuacugaaaauuauuggguuauuuauuggccuccuuuaugguccaagauaccaagucaugagccuuuuccugauggauaaucaaccaaauaugccguucaucuugaauaguucucagggcuacucuucuuucauccccucccaaauagcuuugauauuuguguauuacuacuuauuaagaaucuaauuuacugccgggcgugguggugcaugccuuuaaucccagcacuugggaggcagaggcaggcggauuucugaguuugaggccagccuggucuacagagugaguuccaggacagccagggcuauacagagaaacccugucucgaaaacaaaacaaaacaaaacaaaaaacaaaacaacaacaacaaaaaagaaucuaauuuaccaagauguauugaaacuuagaguuuauaaacuaaaauuauguaugucuuacugaacacugauuuuuuaaaagaaucucaucuguccaauguuagccagcauugaggaauuccuacuauacacgcccacauguggauagacacugcaccauuggcauugucgugaguuggcugcuuucccacuaccccuggacuaauauaauuauaaaauaauacauacuagaaugugaagaugaucaaaaaauauaaaaggucuuauagcuuuuauacuaauuauauacugaaguuaucauuguagagaugaguuaaaauauuaacaccuggcuggagagauggcucagugguuaagagcacuguucugcucuuccugagggucugaguucagucccagcaaccacaugguggcucacaaccauccauaaugggaucugacgcccucuucuggugugccugaagacagcgacaguauacucauauauauauauaauaaauauuuuaaaaaacauuaacaccaguuucugaugucucuuuuaugaaaaggauagcaaaaagaaaagauauuuuaaaaauuucccauagaauaauacaagaugaauauaugaaagaugcccaguuuagggcacauuggagcaggccuauaaucuuagcucucaggagggagaucaugaaccaaaguaaacccuuucuuaaguugccuuugucaggguauuuuauaaccacaguaaaauaaaccaugacaaaggucuucaggucagcccauugucugcuuaauaaauuuuuaugucuuagauuagguacaccuuacgugugucacacacaguaguaucuuucuguguuccaccuuaguuguuuuuuuguuuuguuuuauuuuuuauuuuuuauuuuuaacaagcuuuuggaacacagcuuacucuguguugggaugacugauaugauuucacagguuuuuuuuguuuuguuuuuguuuuugguaaggucauuuuuuuauuagauauuuucuucauuuacauuucaaaugcuauccugaaagucccuuauacccuucuccugcccugcuccccaacccacccacucccgauuccuggcccuggcauuccccuguacuggggcacccagggauccaucccauaaacaaccaccaaacccaggcacuauugcauaugccagcaagauuuugcugacagggcccugauauagcugucucuugugaggcuaugccagugccuggcaaauacagaaguggaugcucacagucacuuggauggaacacaagucccccaauggaggagcuagagaaaguacccaaggaacugaaggggucuucaacccuguaggaggaacaacaauaugaacuaaccaguaccccgagagcuugugucucuaguugaauauguagcagaggaugaccuaguuggccaucaaugggaugagaggcccuugguguagcaaagauuauaugcuccaccuuaguuuuugagacagggucucccauugaaccuggauggugucauuucagaugcccaggauguauuuccuuauuuccagcucugcccccacguaugcaccaggcuacacugccaugccugguguguacauggguacuggauguuuaaacucauguccucaugcuugugcugcaagcauuuuacccacugacuuaucccuucagaccugcgcaugcucuugucauuacacuuuguuaggugagaaagguaagagacaagaguuuagagauuccaaaugucuucccgaauuaaaccagaguuagggauuugugcuuaagccccucuuauuggaauuaugccaucaggcuauagugagagacuucauagaugaaguccaauuuaggguauuugguaauacccuauuaaauacccuaucuguuaaaacugcaauguccauacacacuaaaccacuauguguacuauuuaucuuuggaaaagucacauaaguacacauuuauauuuaauacauauauucagaauguuuauuguuggacuggagaggugccucagcagucgagaguacauacugcucuuccagagguccuaguuuguuucucaggcagcucacagucacuuguaacuccagcuuugggggaucugaugccucuguccucugagugcauuuacaucaugugcacauacccacauauaggcacagacacauacacguaauuaaaaauaaaaguuaaaaaacauuuuagaaaaagaugugugcuacaguguuauuugugaugguaaaaaguuaguagcaugaaacaaggcaaagccaugaagugugacaagucugcuccuuucagcccgccuuccccagcccuuucaaggguuccagacauagucacguuagauuacgcaggcuagucuucaacucacucuguaguccaggaaaucuuugaauucuuauacuccugcuucaucuuccacaguagcuuggauuauaauugugguccacuaggcucagcuugcuugccugccugcuugcuuuuuuauuuuuaaaauuuuuuaaauuaaaaaaaaauuuuuuuugguaaaacuaguuuccuaguauauaaacaagaaaauaucuggaaaaauauagugaaaccuauuaaugguuguuaucuugauaauagacuuucauuugugugaggagaugugugguuuuuaaacuuuuuaaaaaauacaguguucauuuacauuuguaucacucggucuuuggguuccucaaguuacuaucaagugagaauaaguuauuuauuuucccagcccacaggaaucaucuguacugcuuaccuuccuuuauauuaucuucccauguuuauucauuuaacaaaugucugagaguauagggccaagguugcuuugaauguauauauacuugcuggauucuuguaacuuauuugugugugaccuccccuuuuucugucucagagaagguugcacuuagacccuagagaggccaagaaauuagucuucagcccuccccuuugaagagagggaaagaacaaaagaguggcagaagucugucuuuucucugauccugcuugugaauuuccagucuugugaauaucugcauuuaucccuguugccauaucugaacuguauucccagagccagaaacgucugucccaugguguaacuugaugcccaagagcuaucuaaguccacucucauagauaauguuucuuuucacucccuuuggagauuuuuuuuuucuagaaaaauaguuuuguuucucuuucuaaaaguaaauacuguacuccuacuuccccuucuuaaagccucuccucccaccaguucaucuuccuuuagcaacuuauuucuuuucauugcuguuuuguuuuguuuuuuuuuaacgaucucuuucuccucaaacccacagagauccccccuaccucugccuccugaaugguaggauuaaaagacgugcaccacuaugcccaguaacuccauguuugagucacaaacauuccccuuacugcauacuccagaucaguuugauuuuugagcugugcuugcauugcaacugaacuugacagguugcuaagacuaauagcguagccuuuauuugcguaucauuugacagugguaacuucuccuugguacucuuuuucucuuugcuuuugaaacucacuaugggucucacuauguagaccuggcuggcccugaaacuacuauauaaaccaggcuggccccuaauucacagugaucaugucugccuucugaguacugguauuaaaggcaugugccagcaugccuggauucuuuuguuucagauacauucuuuuccagacaagauuguaacuauacccagucuccaacagagcuccuucuguuuccuggucacucucaccaauaugucuuuuaaagaugucaagggaaggucccaaggccugacacuguuacugaggcuauggagugcucacaaaaagggaccuagcacugggaggugguggcacacgccuuuaaucccagcacuugggaggcaggcggauuucugaguucgaggccagccuggucuacaaagugaauuccaggacagccagggcuacacagagaaacccugucucgaaaaccccccaaaaaagggaccuagcaugaccgcacuccagaagacccaacaagcagcugaguuagaggcaaauaguugcgcccaaccaauggacagaagcagcugacccccuguuguugaauuagggaagauggaaagaaguugaggaggaaggccauccuguaggaggaccagcagucucaauuaauaugggcccccgagauuuuucaaacacuggaucaccaaacaggcagcauacaccagcugauaugaggccaccaacacacauauagcagaagacuguaggucuguguucguucagagaugaugcaucuaacccucaagagacuagaggccccagggaguuuagaggucagguggcauggggaguggggacauccacguggagacaaggggguggggaggagguaugggauggggagcaguaggaggguugaugguaggggugggagggguggauaaaauauggaaugcuuuagcagcaaauuuacaguugugaagcauggggucaccacaacaugaggagcuguuuuaaagggccgcagcauuaggaaggcugagaaccacugcucuaaagggucaugaguuccaguucaaccugaguuacauaucaaaaccucaaaccaaaaaccaaaaacaccuuggcuggcaaauuggcuuaguggaugaaggaaccuacuuccaagccugacagccuaaguuuguuccccuggacccacauaguggaagaaagaacugacuccacuugucugcauuguguaugcacgcauguccacauacaaacacaugugcacaagcuaaacgguaauggaauaacaaacuuaaaauauguaccuucaggaacugugcuaucaugcuuuugaauaccaguccuuuagucaaaucuauuuaaacuauuuaacuauuaugauucaaaguagagcugaaaaauccaaaauuuaaaaagucucagaauuuauuaagaaauauauaaacuuuuaucucuaaaaguauacuuaaaagaaaaacaguccccaacaaguuauagaagagccauguugcagggggcagaaugguugauagccauauuccuaaggccccugcucuccuuucccaacagaucuccucuauucaaucuuuaaaaauucuacuuuauuauuagugugugugcaugcaagcacauguguauuaugauguuugcauguguguggaugugugaugugggugcaugugucccagggcacacuuauugaagucagaugacagcuuuuugagaguugauucucucccaugaugcauucuggggauugaacauacaugucuuccggcauccauggcaaaugcuuucccugucugagccccuucuccagucugauaugucaaguugacauugccuccucugcaucccuuuguuucuuuguuguuguuacuguucauuuguuucuaugugagccauauuauuuauuugccaaauuaacuuuuucagcacauauuuaaaaguacuuacuaugaaacauuugguuuaagaacuaggaauaccaagcuacgugaaaaugaacuguagccagggcauguggccuaggcgaacaaggacaaugugaaguugaagugcaguaugguaaagauuguugugguugagcacugcuauaggcauacguaagagagaguaucuaaugccagggaggacaggcuucuuuuauagaaaagaugucauuugaauugggaauuaaaggaugagaagucuuaugaugacugugacagggccaacacuucuuugugaaaacaauaagggagaggaaaaagugucccuguuuuaagaaagguugcugugcguacccaucaaggagaaaugauagguaaaggaggcuggagggaaugucugaaaguacuuuucauccaaguuucauccaagaacuugaggcugacuuguaaguacugggagaguuuaagcaggaguggcgcacuagugagguuaggggaagaaaacgaaaucugugugaaaacauuuuagaggagaaaacuauuggagaaguuuguauaugcuaaugcauauaaugacuugcuacugacacagucucaagugaugauccugggugucuagugauuguuaaacagugaugugauuggccagauuggggaacuauuuuaugaacaggacuagagauguaugauuuucuagguccaguuuugcuuacgggcuugugggcuuauacaacuuuuuuuaguuugccuaucuugaaaauuguggccuuuggacugaauggcuauaauuuuucuauaauugugugcuucucaacaaacaaaaccuuuaaccuuuacugagccacuuuuaauuuuaaauggcucuaauuuuuccugagucuuaaagacccauuuauagaagagccucugacuguuggucuggcagauccacuuuugucucucuuuaggaucauauauuccaaucccaaauucauauuugguguugucuccagauuacauuuagaauaaauucaaccaagugcgucuuugccuuuuaccuguuauccaccaaguaggguuucuucaaagguagcuugccaguucuccacaggaguaauuaauaguucgcaucaugacugcaagcugcccaucguuacacauuauccucuucacacagagaacgcggcguuuguaggacacccaugagccguguaauggaggcggugcugguuaguuacccuguagaguguuaugguuaguuauccuguagaguguuaguuacccuguagaguguuaguuacccuguagaguguuaugcaggaggccauaaacagccagcacuccuaguuuauuugauacagccuuggggauugcgcagcugggcagacuuuuccucuccacuaaaaugugucaacaucaaguucacccacugcuuguauaaacauaugaccuuuucaccauuauuauauucaucuaggagaggaaaagauccauaagggcaaagagaaguucacagguuuuagaaggagagaggcuuggaaucaccucauuguuccaugauacugaauuugggcaagucauuuaagcucucuguuucuucauugugaagugagaaugauaucugccugguaaggauuuugcaggaguauauuacagguaccuagguauauaccuaggaguguauuacagguaccuagguauauaccuaggaguauauuacagguaccuagguauauaccuaggaguauauuacagguaccuagguauauaccuaggaguauauuacagguacagguaugugacgcucugugugcagaacuggaaugcuggauucuuauugaacaugagacauguuaggugauuaguagaaguguauugaauuaauaggaaacauuaagcaaauguuagcaauuauuuaaaauguaaaacagacuuauaugaucuguuacauuuuccaaaauuucaauuauaauuauuucuuaugcaacacuggggauugagccaaggccgugugcauucucagcaagugcuucauuccugagcuccaucuccagccccaguuauuaguauuucucuccaauucugcugguaaacuaggaaaacauaagcauggugcaauuagugacucuuaagguggggcagaaaguuaauggaacuaaaacagauguagugguaagccuuaagagcauauugauaacaaauuauguuauaauagaugcuaccagaaucaaccaaaugcuacauacauguauaaauguugcaauaugguacuugcaugcaugaauagguaaauucuauguaugagguagaaaagcccaggaagcuugcccucccuguccauuauauuauuuuguuaugucuuaauuuuauuucaggauuauaacugugauaauugaguaucuaccacauggcauuuuguuauucucacagaauacaugauacccagcuaaaaguucuagacagaguguuuguacauuagaccuuaauugauuaaaggcuuucugucuaugggauucuguucuccaucagucuuucuguuaucucagccaucauugacaguguauuuauugcuuuagagguuacauaguauauuauauauaaugauuuagaugacuacauagugggcuauauauaauguuuuggacaagcuuucacccauguuuaaaaauugucuguuagguaaguagauagguuacuuucagacauacaucuuauuuuucuuuuaaauugcuaugguuauuuacauggcggaaguaaaauguguuuguagaacuguucuguguuuaaggaaauuauuguuaaguaguugaugagaccuccuuuuguuaccuuuucuaucuggcuaugccaccguuuuucuaccucacauccuauaauucugagagccauuuuuuguucuuuuuauuacauagucacucauuucaagagaaucagggaguucuguuucuuuugaacccuguguucuuccucuagcuauugcaucucuuccaacuggcucugcucuagagcuggugccagguucuguuugcagcuugccuugcuuaguauccuugcuuuugucuuuucuucauaauuggcugucuuucuuaaaugaaauguauguuccucucucuaaaacccuuuaaaacaccugucugccacacucaagauuuauaacuaaucauaauuauauaauuauaacuaauucuuauucaucuuauaaggcucaacaccauauguucuauaggggcgccaguuauccuaccagaguuuggucauuuucagucaccaacuucaguacuuggaacaaauuuugaauuuugcauuuauauacagcuaaauaaugcaugggggagugcucaaaaugauacuucucucucucuggaugguuacagaaaagcacucauuuacugaauacagacuauaugucaggcaguguauuacguuucguaauacuuaaaaaaaagugauuggaaguauuguagacaaggaaucuaagacuugaaaaaagugaaauaacuuuucugcagucacaguuaggaguagagccaggcagaucuguuaucuacagggagcuuguaguagugcacuuauucaaacaagcauguacuuuaauaauuacgcuguuuuugauaauuauguuuaagcucugugugucucugugcuuugcuauacacuccacuccuuuaagauuauuuuuuuaaaaccuauagagcuuaauuaaaagacacuauuacauuuauuuuggacauauuucuugcugaggauuuaaaauguuauggauuuucauacuauuuuuuauauacuuacuuuaugcaguugauuuccuuaaaccaguucuugccuagucauaacagcuuucucucucuugaauugauuucugcagaaauguugguuaaugccaaggguuucuucauucugcauuugcuauuacauauaacguuucucuuaaauggccuuguacugaaggcagcccuguugccaacagaauccccuccucguccccaagcacggauucugcucagcagcaacaggagcucugcguuguuuuccuuguuggaugugugugcuaaaggugacagacaguccuacagcuuagagugugcgcuaaacugugcucagccuuugcugugugaauggcaccguguucucauguugcagauggcugagagcugcaagaagaagucaggaucaugauggcucaguuucccacagcgaugaaugguauguaacuuugugcaugguaggaugggcuuuguuguggugggaagccuauuugaaauauuuuguagauaaauuugauguuuuaaauauaaaacuugaaguauucugauugaaaacacagagcauuuuagaguauuacaugaaucuucuuauuaauauuaugcaguaaauuccauguuuuuguugaagcauuuuuugguaguaucuggcauguauguuucccaucaaacaggugagaguaacuuaaagauauauucugcuuaaugcaugaaacugaaggacaaaaagcugagugccuuuaggugaauaauaaauguauuuuaguuguacagaugguugcaaauaggugaggccaacaagauucauuuagcaauauaaacguaagauuaaauuucucuuucugaauauuuauauuauuuaauguuuauaaugucuaauuauuugauccgacaaccugcaguugaccugguagaaggagagaagugacuccuauaaguuguuuucugccugugcuccuucuaguaaauaaauaaauguuauuuaagacuauguaagauuaaaauaaauauuguuuuuauuguggaaaugguguagaauuauagagauuuauacuacagguaccuuuuaaauuaaauaauuauuauuuuuccuuaauaaaugauauauaaguuuaagacagcaauacucuauccagguuugaggauuucugggccucaugaaaaagcuuuuacuaagcuuaguuuacuuacaaacuucaacaugcauauuaaugagguuuacaauucaaaaaaacauacaaguaguaugaucucauucuuucuuucauuccauaaauauuuaugucuauuauguagcucauugcauuauaaauaaaaaucauuugaaacaaauaaaauguucacugacaaauaugcuuaugugaauaagguacaaauuauuaacuagaaagugguuuguaggcauaaagacaaucauuuuuuaauaaacuucugaaaauugauagcagagagacuguuaucuuuguacuuagccuauuaaaaauaguuaaguaacuuguguauaucuaauucauguccaauucaacauuuaaaauguuaauuagcugggcagugguguuguacaccuuuaaucccagcacuugggaggcagaggcagguggauuucugaguuugaggccagccuggucuacagagugaguuccaggacagccagggcuacacagagaaaccuugucucaaaaaacaaaaguguuauugaaagucacauccauguauaauauaaaacuucaagagcgguuucugccccucuaguuguugaugcuugaggcuacugagacuuaaccuguuagcauaccuagaugcugugcuuuguguuaaugcugggaccugucaucuaauuuugccaugucuauuuuaucauucugagguuaacuacaaaccuuguaggcucagugugacaucuguccagcauaguagccacaccaucuauuucaguuuagauuuaaacuaauaaaaauuauguugcugcauuucaugugcuaaaagccacagguaacugaggcugccuuauuggacagugcagauaaagacuauuuauaucaugucacaugguucuaguaaacaagguuuuucuccuugucguugguacuucacuuccuuuuccuuauucuuuuaacaagacuagagaguugguugucagugccuuguguuuuugcaacuguagcuuugcuccuaaucauuuggacugcagaacuguccuuccaaagccuucugaaucacucgcuuugccuucugcuuuucaaagacugaauacauuugcagauugagagaacaugauagauaggccuucaagugcuaggcaagggguuagugcagaugcguguugcuacugguugauauugcaaugugauauagcuucuuucagccucaggauuauggggugcugaagacugaagaagaguucugaaauccaucauagugacuuuauccauaaucuaguaaggagcggaagugauacagaauaaagaaacaaaacaaacaaacaaacaagcagcuuuaagaauaacaccucccuuccauuuucuuggagcuuuauuacuagagcuuuagggcguagcacuauuccaaccauauggcuaggaagcugcugagcuagguguugagugugugcagucacauacagcacugcacuguacuugaaaaaaaacagguuuuuauuuuauuuuuuauuggauuuuuuuuuaucaauuuauuucaaguguuaucccuuuucccgguccccccccccaaaaaaaaaaaaaaaaccucuauucuauucccccuuccccugcuucugugaggauguucccuuaccaacccaccuacuccugauucucugcccuggcauucuccuaauacuggggcauccagccuucacaaaaccaagggccucuccucccauugaugccugacaaggccauccucugcuacuuaugcagcuguagccugggucccuccauguguacucuuugguuggugguuuagucccugggaacucugggggguuugguugauugauauuguugcaaaccccuucagcuccuucaguccuuucucuaauuccuccauugaggaccccaugcucaguccaaugguuggcugugagcaucugccucuguauuugucaggcucuggcagagccucuuaggagacaguuauaucaggcuccugucaaaacccggguuuuauaagugaaguucccacaacuuagacuacagguugguuuagaacaguauaacuagggcuggcaaaauggcucaguggguaagagcacugacuguucuuccaaagguccugaguucaagucccaucaaccacauaguggcugacaaccaccuguaaugagaucugaugcccucuucuggugugucugaagacagcuacaauguuauaauauuaguuauaauaauaaauaaaucuuuaaaaaaaaagaacaguauaacuguuauuuuagagauuuaaauuaguguuagaccaguauacauuauuuauccuaaguguucuuuguuuaaauuuguuuuaaauauuauuuuaaauuggagacaaauaucaaugcagacuauuuauaauauuuaguuuuuauguauauaaguauagcauguuuggauuauuuacauuuagaauuguaauauugaugugguaccuagcuguguucuuuauuuauguuuguauauuuauagauauguauguguagcuacacaugugaaaauagggaugauagauauuacugacuaguugauccuuuauaauugagaacuuuccauuuucauugguuuugugagugugcuuaagagagccaguagcaagaagagaaugaggaacaaaggguauauaaaugcuagggcccuagaggagcgguuggauuguuuguugguugcuguugguagcagcuucuuaaaguagucauguucaaagaggaaacaacaagaauuaaauacucuaauagcaaagaucaaauuugcccgaggaacuugaugucccuagucaacaagaaguacucuaacaauaauaucacccccccuuccuacccuugacuuuaugucaggaucucuuucuuuuauauccuuuucucucucccaccuaguguuaggagguugaaaggguagaagaaauggugugaaagaaagaagagguagggaaagacaguuccagaaacagaauuugauuaucagacaauggagaggucauuaucuuuuaguggaaauauuggauaccaaccuccccccgccaccuuguuauacugucuuuccauaaagcuuacaaaaccagacuaagauagggaaguuuucuccacuucaggugaggaauaccaaauaacucuuuugaaagauucuuuuagugcuacauuauaaguaagaaaguuagaauugaaucuuguauccuggaucucucagagaccaguccaugcaggagagcaugugggucgcagaagcaacauagcuucuuggacagggucccuucaggccuucaucuucagccaggaggcagagcugagcuccagaccucugugcaccuucccugccauaggagagcuugccugcagagagugcucugaccacugggacucaggagagaguuggacucccaggagugcugacagaggcuaacaaaaucacaggaggaauaagcuccagccagagacagcuagaacaucuaacaccagagauugccagauggugaaaggcaaauguaagaaucuuaauaacagaaaccacaugaucaucucauuagaugcugagaauuaugcugaaaaaucauuugacaaaauccaacaccuauucaugguaaaagucuuggaaagaucaggaauucaaggcccauaccuaaacauaauaaaagcaaucuacagcaaacuaguugccaacauccaacuaaauggagagaagcuggaagcaauccaacuaaaaucagggauuagacaaggcuguccacuuucucccuaccuacccaaaguccuagccagagcaauuagacaacaaaaggagaucaaggggauacaaguuggaaaggaagaagucaaaauaucacuuuuugcagaugauaugauaguauauauaagugacccuaaaaauuccaccagagaacuccuaaaccugauaaaaagcuucagugcaguagcuggacauaaaauuaacucaaacaaaucaguagccuuucucuacacaaagaauaaacaacacccuucacaauagucauaaauaauauaaaauaccuuggugugaaucuaacuaaggaagugaaagaucuguaugauaagaacuucaagucucugaagaaagaaaucaaagaucucagaagauggaaagaucucccaugcucauggauuggcaggauuaauauaguaaaaauggcuaucuugcugaaagcaaucuacagauucacugcaauucccaucaaaauuucaacucaauucuucacccaguuagaaaaggcaauuugcaaauucaucuggaauaacaaaaauccuaggauagcaaaaacuauucucaacaauaaaagaaccucugguggaaucaccaucccugaccucaagcuguacuacagagcaauugugauaaaaacugcaugguacugguacagugacagacagguagguagaucaguggaauagacuugaagacccagaaaagaacccacacaccuauggucacuugaucuuugauaaagaagcuaaaaccauccagugaaaaaaaagacagcauuuucaacaaaaggugcuggcucaacuggcaguuaucauguagaagaaugugaauugauccauucucaucuccuuguacaaagcucaugucuaaguggaucaaagaccuccacguaaaaccagagacacugaaauuuauagaggagaaaaugaggaaaagccucaaagauaugggcacaggggaaaaauuccugaacaaaacagcaguggcuuaugcuguaagauugagaauggacaaaugaaccucauaaaauugcaaagcuucuguaaagcaaaggauacugucaauaagccacaaagaccaccagcagauugggaaaggaucuuuaccaauccuaaaucaaauagggaacuaauauccaauauguacaaagaacucaagaagcuggacuccaagaaaucaaauaacccucuuaaaaaugggguacagagaguacauauugugugaguuccuuugugauuggguuaccucacucaggaugaugcccuccagguccauccauuugccuaggaauuucauacauuaauucuuuuuaauagcugaguaguacuccauuguguaaauguaccacauuuucuguauccauuccucuguugaggggcaucuggguucuuuccagcuucuggcuauuauaaauaagggugcuaugaauauaguggagcauguguccuuccuaccgguuggaacaucuucuggauauaugcccaggagagguauugcgggauccucuguuaguacuauguccaauuuucugaggaaccgccagacugauuuccagagugguuguacaagcuugcaaucccaccaacaauggaggaaugucccucuuucuccacauccucgccagcaucugcugucaccugaauuuuugaucuuagccauucugacuauuaugagguggaaucucagguuuguuuugauuugcauuucccugaugauuaaggauguugaacaucuuuucaggugcuucucugccauucaguauuccucaggugagaauucuuuguucagcucugagccccauuuuuuaaugggguuauuugauuuucuggaguccaccuucuugaguucuuuuuauauauuggauauuaguccccuaucugauuuaggauagguaaagauccuuucccaaucuguugguggucuuuuugucuuauugacggugucuuuugccuugcagaagcuuugcaacuuuaugagguuccauuuaucgauucucagucuuaggauacccaagauauaagauacaauuugcuaaacgcaugaagcucaagaagaacaaagaccaaaguguggacacuuugccccuucuuagaauugggaacaaaacacccauggaaggaguuacagagacaaaguuuggagcugugacgaaaggauggaccaucuagagacugccauauccggggauccaucccaugaucagcuucgaaacgcugacaccauugcauacacuaacaagauuuugcugaaaggacccagauauagcugucucuugugagacuaugccggggccuagcaaacacagaaguggaugcucacagucagcuauuggauggaucacagggcccccgauggaggagcuagauaaaguacccaaggagcuaaagggaucugcaacccuauagguagaacaacauuaugaacuaaccaguacuccggagcucuugacucuagcugcauauguaucaaaagguggccuagucagccaucacuggaaagagagguccauuggacuuacaaacuuuauaugccccaguacaggggaacgccagggccaaaaagugggaguggguggguaggggaguaggggguggguaugggggaccuuugggauagcauuggaaauguaaaugaggaaaauaccuaauaaaauauuuuuuaaaaugggguacagagcuaaacaaagaauucucaacugaggaauaccaaaugguugagaagcaccugaaaaaauguucaauauccuuaaucaucagggaaauacaaaucaaaacaacccugagauuccaccucacuccagucagaauggcugagaucaaaaauucaggugauagcagaugcugaugaggauguggacaaagagaaacacuccuccauugcuggugggauuccaaacugauauaacaacucuggaaaucagucuagagguuccucagaaaauuggacauaguacuaccggaagauccagcaauuccucuccugggcauauacccagaagauauuccaacuuguaagaaggacacaugcuccacuauguucauaacagccuuauuuacaauagccggaagcuggaaaggacccagaugucucucaacagaggaauggauacagaaaaugugguacauuuacacaauggaguacuacucagcuauuaaaaacaaugaguuuuggcccuggcguuccccuguacuaaggcauauaaaguuugcaagaccaaugggcuucucuuuccacugauggccgacuaggccaucuugugauaaauugggggacuuuugggguagcauuggaaauguaaaugaaaauaccuaauuaaaguaaaaaaaaaaaggaaaaaaaagaaaaggggaaaaaagcuaauaaacuuaaggaugaauagaaaaaaaaccaaugaauuuaugaaauucuuaugcaaauggauguaucuggaagauaucauccugagugaggcaacccaaucacaaaagaacucacaugauaugcacucacugauaagcagauauuggcccagaauacccaagacacaauuugcaaaacucaagaagaaggaagaccaaaguguggauacuucguuccuccuuagaauggggaacaaaauacccguggaaagaguuacagagacaaaguuuggagcugagacagaaggaaggaccauccagagacugcuccacccgaagauccaucccauaaacaaccaccaaacccaggcacuauugcauaugccagcaagauuuugcugaaaggacccuaauauagcuaucucuugugaggcuaugcuggggccuggcaaauacagaaguggaugcucacagucaucuauuggauggaacacagggcccccaaugaaggagcuagagaaaguacccaaggagcuaaaggggucugcaacccuauaggagaaacaacaauaugaacuaaccaauacccccagagcuugugucucuaguugccuauguagcagaggauggccuaguuagucaucaaugggaggagaggcccuuggucuugcgaagauuauaugcccuaguauaggggaaugccagggccaggaagugggaguggguggguuggggagcaggguguggggaguguauugggaacuuucaggauagcauuugaaaagcaaaugaagaaaauaucuaauaaaaaauuuugaaaaaauagaaagaauuguaucaaguauuuaaaaauuggcuuugaaucacauuuauuucugauuuuuuuuauuuugaauuuaucucauugccagaaaauucuugguguauuaguuaaauuuuaaaggguuuuuuuuuucuaaaguuauuugaacaugauuuaaguuacuuuguguccuaacuuauugagcauuucuauuuacacauaauguuaauaauaauaaaaguggcuguugcuugugauuuucuaggugcuggagucuuaaauauuaagacugugaacaccuuuaaaagggguucauggauucauuuuuguuucccuugcauguuuauugaaugagugaauaugcaguagucacgaucacuacuuggagucauaaagaauuaaacaaauauuaacaggcuuguugaguuugcuacucucaagacaaguacccaagaagaguugaaaagauaauguauauaaaagaacacuauaaccaggcaugauggugcacaccuuucaucucaggcagagacacguggaucucugcugaguuugaugcugugugguuuauauaggaaguuccaggccaaccagggcuacacagugaaaccauuuuuuuguccauuuuuaauuauuuuuucagguuaccauacaaaguagugauguuuuuaaaaauggaauuuucauacauuuauuucauuacccuuuguuuugucguucucaagccauuauuuuauuguagguauauuguuuauucuauauggucuuugaggaacccuuugaguuagguggcauucccaggcuacagaguuagugccuacagugcagagagcuugaacaucuuuuacauguaugcugagaugauauaguuuagggaguucaggcuaccccaguucuaaccucauuucccauguggucaaaguuuuguuuuguuuuucuucaugccagggacccaacccaugacuuugugcuuguuaagccacacacuaccacugaguuaauccucaacugcccaaguucuaaucucagcucugcuacuuacuguauuaucuuaagccaguuacuuuuccaccacugcuuuuaguuccuucgccauaguagucuccugguuuauugcguggcccugggguuaaggaggcagcacauaaguaccugacaucauugggcucacagcuguuuucaucccuguugucauuuucaucuuuuuaaucaacauuuucccaaagucauacauaguaaauaaguuccaauacacaugacuguccugcucagcacaggacuucuuacagauuuuuauggaauuuucaaaugaauacaugauuauauguuauucuuagccauuccuccccacacacuggucguuccacuauguaccugguuuauuucuauaaucuuaguaggugaaagaugauggcuaauguuauuuuauuguagguauauucuucauugcauggauaauaugcucagucuugcgauaauaagcugauaagacaaggaaaguuuuauugcacauguguuuauaucagaaguguauaguuuagcuauuuuuagaucuuuaguuuaucaacauaucuguuuauuuuuaacuuuaacuuuuaaaacuuuuuauaguuuuuuuuuaauucacucacuugggcuaaggaaaaguguuuuaucaaauuaguuuuaacaucugaaauuugaguaggccuuuucagugauaaauuuuuuugaaaauuacuuucuaauaccgauuuuuuuacucaguguggacagcagauauauaugaguuuauauguguaaauaccuaugguuccuuguugagagauguugaguaaaccaaaaguguaggcagaagugagguauagaugauuacuacccaagugauugauaaagcgucccaaggguuccuucagaaagcugcuccugauucagugugaaagacaggucgcaccccugaccuggguaguaaggcacucuuuauuguccccuuguuccuucuuuuauugauucagacaucuauucagaaaucauuuuuaaauguuugcucuuuccuggguacucaacugguuccuggaaaagaaaggucucaaaaucugguagugcagagggacaugagacagcaccuucuuaagugcucugcagaagugugaccugugucuugagaaucuagaagaggaagcaauuacugucauuuagaucccaggguccucuggauggaagugacaucugcccugaccuugagagauaaagcuugaaaggaagggucaggguuaagcuuggugguagacaucuuaccuagugcagagaggccuuaucaauccccuguggugaaggaaaaagaaaaaugccccuuugcagcaaauucagacuaguuauucccugcuacuuucuguacuuaaauugguaccuuagcugguaguaagccucuuuguuugguuuaccaagagaggcuuugguuuacuuagagcaucuugcauaucccagccucucaaaccacauccuuuuugugugagauaaaugcucuucuaccaccuuggcacauggcaagaugccaaagcuuccagccucugcuuaggucuuaaucuuucuugcuauuucacgucacuucugauguuuugaacuuaggauuccacaucuuuugccaugguucugcugggguccuucacaguuaacacaguagauggugguccuuucuagguauuucuuugagaaugagaaugauacuguaaacuuuuuauugccacuauuuaccucauccuugugagugguguacagugauuauucaauagauguuaacugaguagaugacuggaaagccuuaggguugcuguauguaguugauagaauucuacuuuauguccuucaaacauuaaauagucucaucaaaugaauguuuacgauucauguuuacaaguuaaaauuuuguguucuugugaaugacauaguuuugagcaggcucauguaccuccuauaauaucuuggccuuucauauauguuuuaggagggccaaauaugugggcuauuacaucugaagaacguacuaagcaugauaaacaguuugauaaccucaaaccuucaggagguuacauaacagguuuguauuuaaucuuuguuauauuauuuauuauaaauauguaccuguuuauauaucuuagaguuaaguuuaauaacugcuaucaaaauuguauuaaguaauaaaauucauaucuaccaaaacucuagaauuuaaagauacuuuauuuuucccacaacugucuuaauuuguugauucauuuuggcauaugggaguuuuuuucuuaaauucuaaguggugguccagaauccauuuuauuacauauuaauacuauuucaagaaguuuuuuuauuuauaucuuauaccagauauuuuucccagaguuucccccucaaaaaaaaacuuuaaaaauuuuuuauuuauuuaggauuugcuuguuguuguuuugagagagggucuugcuguauagcucagacuggccucuaaccuguuacauccuccuaccuuagcuucuucugacugcuuagauuacagggauguggcaucccaaagucuguuuccauaaugcuagcuccccuuugagagauagcauuaauuaaguauuaauuauugguguuaacaacuugucuuguagaaagaccacuagaauaaaagaagugauccguuugaguuaucuuucuuuucuuuuucaagaaaugaaacuuuccauuuucguuccacugcaucuuaaugcuuuuauguauaacaguugucacagaaaugacaccuauaccauuuuuuggcuuuguaguaugcguuacuguguuucaccuucacaguaccucugugaggcagauacuguguucaucuguauucacaggguaaagccuaguccaagaaaugauguggauuugccuaaggcuaucaugaugacuacugauaccuuucaggccuucuucagaauccauccccguauuuauuauaguccgaugucauuuguauuccugcuguaccaucccugcugucagaguuugacuuguuuccugacgagcuaauaauaguuauccauggcuacuagaagaucugagauuccugagucaggaccuuaccacuaguagugcccauguuucuguugguuuccuuuguucccugauucucagcaggaugauaacagugucagaaagauacguguuacaggagaacccgagcucgggaacgccaucauucuguagcaaagucguuccuuguuccagugggagacauuauuacuucagucuucaagaguuuucauuuauaagucaaauucugaaaacccaagcagaggaauuggguuuuguucuugguguguucagcaaguauacauacacguaucgggaaacucgugagcgauguuucccuagcccuugguaguuauaauuauagaacuuguuuagggugaagaaucaaagaugaguagcacacucuuucuucacugauuaauagaauguuuguggugacauauuucucuagacuguaaacaccuucauguguacacuuauaacuuugcuggaguuaagucagcaccaugugccagcuguuaggauuuguaggcauuggaauaauucugcuuacuaaugcacccuuuggcucuugugcuuauuccuuuuaggugaucaagcccguacuuuuuuccuacagucaggucugccggccccgguuuuagcugaaauaugguaaaacacuuucuuuuguaaaugcauuuagauuucuaaucggcuauuguuguuuuuuaaauaguaugguguugacauccaguuauuuccauuuguacucugcuguuaaauaagaauauuuuguuagcuuuuugagaaauaaauuauacuaaguaaaugauugaaaauaauuugaagugcucuauagaaaaaaauucuaauuuaauuugaauucaagacagaauguaagaguuaacauugaaaaauauuucugucuaacuugacaaaaauuucaaauuccuuucuauuauuuuguuguagcuuuauugguuuucaucauuuguaaaccccaaagugcuaucccuuuccuugcucuuacuuuaaaaauauucuagagggguagcagagauucuuguggcuaguggcagagggccuggguucaguucccagcacccacauggcagcuaacaaccaucuauaacucuauuuccaggguaucuuucacccucuucugaccuccguggguaccaggcacgcacauguuguaccuauacauguaaacaaaacacucauaaacauaaagaauuuuaaaaaaucucuuaaaauguucuagaauaucuggggucauguuuuuuaaaaauguauuacaguaaauaagaucuucuacuccauuccuuuuccuuauagaacaucugugugcuugacagaaugcuaguagcaaacauauuuuugauuauuugaacaagugaauaaauuaaauuuagaaauuaugagccuauauaaaauauacacacuauguaaccuuagauguccuaaaacucacuguguagaccaggcuggccucaagcuuggaacaauccuuuucucucugccucccugauggcugggauuugagaggugugcuauuguuccugguuuaggacuacguuauucuggaaugauuguuuucuaucuucacugcuagaaauccucuccgaacuaucuagauucuguauagccuaugaacauuuugcuagauacuauuucuggcuaguauuucucacuguucagguuuucuguuauucauacacacacacacacacacacacacacacacacaccacacacacacacacacacacacacacacacacacaauauuaagugacagucuacaugugaaugcuuugccauuguuuucuuuuucucaaccucaauagucauuuauauuuccucauuaccaccccauauacugaucuacuuaccucauucuccuuuuagggccuuaucagaucugaacaaggaugggaagauggaccagcaagaguucucuauagcuaugaaacucaucaaguuaaaguugcagggccaacagcugccuguaguccucccuccuaucaugaaacaacccccuauguucucuccacuaaucucugcucguuuugguauguacuuaguaauuuagcugcccuauuugauuguuaagauugauuccuuggggaucaggaaaggauuuauuagcacaaaaugacaaucccuagacuuccaaguuacuuuucaugccuuuaagagaaaagauuauaaauuacuaucauagcuaagugucccugucuggucuugccugaaucuccugucacaguuacuagucgugaagugaauuaucugccucuucaguuacaacugacucuaaauacaguuccuuaucgucucuucugucuuucauggauggagaagcaggaugcuaauuacuagaagcuacagaagggagaugaugguguugggggucaaggacaaauggucaguugguacaaaguuacuguuagagaggagaaauaaauucuagauucuguuguaugguagggggacugugguuaacaauuuuguauuguauauuccaaagaaacuaggagagaagauuuuaaauguuuuuagcacagagaaaugauaaaugcuugggaugacagaugugcuaaacauccugguuugguuaucauauauguauacauguaucagaacacuacacuguaacucuuaaauagguacaguauuaauauuaaacaauaaaacaagaagguugaaaauuuaaacacgccuagugggguuuaaucugcaugguaauuuaaaaucauagauaaguaagauuuucuuuaauuuaaagguuaauuagccagcuaaauugaggccuaaaaauuguauacuuuguccuaauuaauuuauauacucaucagauauuaccaauugauauguuuuuauauaauuuugauuggucaguuucuuaugaauuauaugugaaaagcaguaauuuugaauggaacauucaauaagaugucucuauauugagaaaugcauuuguuuacaccagauguuagguuuuaaaacaccuuauucuuccacuguuguacucagcuguagaaauaaacaccaaaucaccugguggccauauucuuauguuauaguuaguguucagcaguuaagaaaauagaaguuaucacuaauuuuaaagacuuguuuuugaauuuuauaacuuagaagaaaagugaaaugaguggugcauuugccaauaauacauauacguaagcaaguccaccauaucaucugcuaauuagagccuguuuguuugaagaauaaggaugcauauuagccuaguaacguagcagcucuggaucuguuuuccuuacucagaaaaccauguagucagguaagacauuuuaucuuugagacacuauauguaguugacaaagauugcuuagucuuaguggccauaagagaaggaaaagagaaggucugcuuguaguucauacaugaaagacaauauucgggcaauagcuuaccccaucacuucagaugcagggcugcuuuauggaauauuuuaaggauaauuuaccauggcaauuuugcaaaauugagggugcuuuuuauacuguagcuuguuuuuugagauguauuuuauaguugaaaguaccauuggaaaauguguucucuuauuucuuuagggaugggaagcaugcccaaucuguccauucaucagccauugccuccaguugcaccuauagcaacacccuugucuucugcuacuucagggaccaguauuccuccccuaaugaugccugcuccccuagugccuucuguuaguacauccucauuaccaaauggaacugccagucucauucagccuuuauccauuccuuauucuucuucaaguaagugucuaauaagucaagaugugaggaagaaacugugguuuguuguucacagaguuccuucuuuguggaauugccuaguaccaaucuuuucccuuuuaucauuuucccuccagcauugccucaugcaucaucuuacagccugaugaugggaggauuugguggugcuaguauccagaaggcccagucucugauugauuuaggaucuaguagguaugaauacuuaucacagacaacucugucugcuuucaguguggauuuuuauuuaauaagcccugggcuuaucuagguuguucuuuguaauggacaaguauaaauauuuaacacaagcuuucuuuuguuguuguuguuauuguuggagggguuucuuuguauagcccaggcuauccuagaacuugcucuguagacuagacugacuuugccucugccuccccaagugcugggauuaaagaaaugcaccaccacaucuggauaaagugguauuuuuuaauuuuacagaacacaaaaguaucacuuauuaccugccauagaaaucauuauaguucuucaaaaacuguuuacaaagaguuaccuuucacuuagaaaaguauuauauuguagcuuaaauaaccuuugguuuuugugacuuuuuuuuucuuaacaacccugaacuaugguuugacaaauuaagaaauauagacaaugucauuuaaguguacuuggaagauaagaaaugucaucuauaaauucccuggccaguaaaaugccuggaauuguagguucuuaguagauggaauuguaugugucuauugccauuauaguguauauugauucuuaauguuuuugucuuauaaaguuuaauuguauuuuauuuaguaacaaaguuuuaaauacauuuccuuauagcucaacuuccucaacugcuucccucucagggaacucaccuaagacagggaccucagagugggcaguuccucagccuucaagauuaaaguaucggcaaaaauuuaauagucuagacaaaggcaugagcggauaccucucagguaacuaacguauggugguugugaaagagcauugguccucuauguaaacaucuuuugaaaaauuacuugaauuuguacuuuguguuuuaucuaaaguucuaacauugaaggcauuguauacauaagaauauuguaaguauauaauuauugaaagauggauucacuugauugcuuucuucaaauucuuaugccaaguuaagugcaagagguauacaccccacuuuucagaaaagcaucucucagaaagauuagacuuaaucuuguaagcuuugaagugaaugaaaaccccaaaccacaugugugguaaugguagcaauuagccuugacucuccuugagagaaagcacauuuucucugcuugccuuuuucaugacucacuaauuuuuuucuuauaaaggacaacauuuaauuggggcuggcuuacagguucagagauucaguccauugacaucaaggagggagcauggcagcauccaggcaggcauggugcaggagaagcugagaguucuacaucuccauccaaaggcagcucuuggaagauugacuuccaggcaguuaguauagggucuuaaagcccacaccuacagugacacaccuacucaaacaagaccacaacuccaaauagugccauuccuugggccaagcauauacaaaccaucacauucuauucccuggcuccuauaggcguguucaaacauaugaguguuugguggccauacuuaaacauagcauaaugcaaaauaaauuuaguccaacucccaaaguccccaccauggcucacucuuuaugcuuuaacucacaugucuauaggacauuucaguucaguuuagaauauuauauaaacuuacagaggaggauaauguguuauauggucauauacaagauguauauuuguaauaggcaaguauguugcaucuccuaacuuucacauucccacagcauacauagggcaaagugauugauggauaaaggaaaaggggucaggaaagacuuggagauuucugucuggagucaugcugaggacagugaugcaaguuauagagaagagagagcaauuuggagugaaaauuggagagaggaacacgauagacacaggauucuuuucuuuugagaugcccgugaaacauaguuugguuggacauaggaguaugaauauggaggugcgguuugggcugcaggcgcagggcaucaggcuuuagaugcuuguugaaaacagagagaaagcauguucaggagucacaggaggaacugcagccucuauagaucacguaggaagagagaagugaagagugugagggaagggguguuggggggaggucacggcuggagagccuuucuucuccaugccuggccugagacuugcccuugcucucagagcugaguggagcuuuccugcuggaggaccguggagcaacacucccuccucacuagcucuaggcucugcugucuggagcaggacugugaucacugcagaaagcccacuaccuggccccugguacaaacaaugauggcaaauguuccgagaaagcugcaacauugucugcaugacuuaacagagacuaaagucguuucuuuuuaugccuuucucacuccaucagguuuucaagcuagaaaugcccuucuucagucaaaucucucucaaacucagcuagcuacuauuuggugagugugcucaucagugacuucaaacuauacaucgucucuuauaagaaaucuuuguggaagauuguuucugaaagaucaaacauaaaaucauuguuucuguaaaaauuuguuacuugagaauauuccaugaaaguguuugaaaguuacauuaacuagggaaguguccauuuuugagagcuuaaccuugauuuuauaagcaacaguguagcuuucuucuuuauugacuuacuuugcaauccagagauuaucucauuuauuccagugaauugaacaugaacuaugauagccaaccuucccagaauaggcauuugcuaugaugagucacucucuucuguuuguuuugggcuauggagauuaaggguaaaaauugacucuuuuuuggguauguguuuacauuuuccuaaaauauauuaaccuagaauuuauccucucauuacucauaaaaauaaaagucaguaaaaacucugacuuugugaacggucacauugccuuuaggacucuggcugacaucgauggugacggacaguugaaagcugaagaauuuauucuggcgaugcaccucacugacauggccaaagcuggacagccacuaccacugacguugccucccgagcuugucccuccaucuuucaggucugugucugcagagccauggcccgcaucaccccgguguuguuccugccucacuggagcccaugcaucgguuuagaggagagcuacauacuugcucuguccuuuaguuaaugagucacgaugggaaguagauaacagaaaggguuuuuucaccaugcuauaaaagaggaaaaguuuaacugagaagauuaaguaaggcuugcccaggaacagcaguuagcugagucugggucucugguuaacauccaagagcuuugugcuuuguaacugagggccaugcugcaguguaaauagccuuaaugcuguaccuuaaauacgaacuuguuuuaauugcugauaaucuguauuuuuuagucugaaaauucucagacugugauggcucuuuguuguuuguucuucuuagagggggaaagcaaguugauucuguuaauggaacucugccuucauaucagaaaacacaagaagaagagccucagaagaaacugccagguauuaauuuuacacuuuuaauuaauuuauuuuaaaaucaaaaucaguuguauuuucuuuaaauuuuauuuuugaaauacaaacacauauuuagaguauuuauagauuuaaaaauuagaugccacaugaaaauagggaaugaauaagauuugugugcaugugugucuauguguguauuacuggggauugaacccauagaccuauguaacaucaccagcucacugggauaucuuaacugauuuauacauuuuaaugaagaguaaaacugaaaaugaugaaggaagagggagcauguauauguuuggaaaauuagcauuucuuccacacuagggagaggcagaucaagcuuuguaaugaaaucuuuagcuugaaaaaaguuuuaaauauucacuuaaagaaugcacacaugauuauuuuauuuagaaguuagugcaaagacuaggguuauagcucaacaguagaauguuuagccaguacuaaguuugcucuccagcacugcaaaccaaaccaaaccaaaccaaaccccaccuucuucagagcuaaugacauguaacagauggcacacaaccucugagaaaaguaagucaggguuuguauuggcuuggauagucaguguuugaauagaaucaaauguagaaaauugcaggguuuuaagugaauacuuuuacuuuccuauuuacauuugaguauagaaguauccgcaggggaaauagccagagagcaagagcagaagccgucgcaagugacuacuaagcagaguguauugaacuagaugagaggcucuguaggcuugagagaaagcauagucucucucucucucucucucucccucccucucucccucucucuccuucucucccucucucccucuccuccucucucucucuccucccucccucccucccucccucccucccucccucccucccucccucccucccucccucccucccuccuuuugucuccuuuuaguuacuuuugaggacaaacggaaagccaacuaugaacgaggaaacauggagcuggagaagcgacgccaaguguugauggagcagcagcagagggaggcugaacgcaaagcccagaaagagaaggaagagugggagcggaaacagagagaacugcaagagcaagaauggaagaagcagcuggaguuggagaaacgcuuggagaaacagagagagcuggagagacagcgggaggaagagaggagaaaggagauagaaagacgagagguaaguuucuaaaugaguacacgguguuuaauaagaauaugcggacuuguugcugugcuuuuccaucugaaucaugucacuauucuuuaucccaaacagaacugccucuccuuucucuugaugggggaaagaggaucucuguguguaagaucaguaagggcuucauggcagaguuguggaaaccuguaucauaugcaagugaggcccagucagaggaggacugaucgcacagcugagcuaagugaggagcuacaguuaauuggacaucggaagucaggcagacgaggucacgggcagaaggcaagcuuagaauucagagucaaagugugaagaauugaaggcccagacucgaaguuuagggaggugaagacacaaaggugaaucaagaagucagccuagaauuauacacgguuccaagaaacacuguguuuuuaagggccaagaauggaacacaguaaauugcauuuuucugaaaaguuguaaaugaaauugucucuccugauuccagaaugaagguauaauuauuccuucugccuuuuauaccugugaggccuugcuuugacucuuuuaacagaagagugacuacagcagaaagauggcucugugaagcaacggccaagugauggcugaaaaccgccucuguggcuccucagccccguugggaacucuccaccuacccuuaggcacugcggccacucgcuccuaagugcugucaucccacaagcuguugaauaauguacaauuuuguaaauuuaaacauuaacaggaauuuguuaucuuuaggcagcaaaacaggagcuugagagacaacgccguuuagaaugggaaagacuccgucggcaggagcugcucagucagaagaccagggaacaagaagacauugucaggcugagcuccagaaagaaaagucuccaccuggaacuggaagcagugguaagcuagagcucugugaacuuuaucugccgaugccgcauuuccugugcaggccgugcuugagucaaacaagcaaccaaacaaccaagccgcucaccuaaaugaucucuugccguuucuuucagcuugaaacaccaauuuuaaacuaauauuagucacucugcuuaacugauucuaacacaucaaauguuagagggucaaauucuuugaggucaaaugagaagauaaacaagcuagacucucuuaagccuagccuuacuugaauggcaggauucugccugguggaugcuuaccuagguacuagaaccaaacuuagaucuuguguagugaaagccuaauuuuuuuguuguuguugucuugaauugcauugaaauuauuuuuauagauaaagcaucauaauaacuuuagucagaaagaugccguuuuauggcuuuaaauuaauuuguacaugccaugauuauuaaccacgucgcagugcuacaccagaggucuaaaaccuuuagcuuccguguacuauaggggcgucucagagccaucauuuugaugcuauauuuuuuucuuaaaaaugggagaagguagacugguugggcagcuccgcaggugaaugccauaccuggcaagcugagguuagucuugaagacccauggugcacgggaaaacugacucccgcaagcucuucuuugaccuucuucucagacugacuuugaauuauaaauguaaagugaaacuuaacuaaauaaaaauacuuuuuuuucugaggggacccugucuuguuagcacuuauuuauuguauauaugcauuuaaucuucugauagaauggaaaacaucagcagaucucaggcagacuacaagauguccaaaucagaaagcaaacacaaaagacugagcuagaaguuuuggauaaacagugugaccuggaaauuauggaaaucaaacaacuucaacaagagcuuaagguaggucuuuugcugcugucagucauccacucaguucuuccuacagacucugugccccugaggcaccuaugauacaaaagauuagaaaguccacaggccucuuaaaccugagcuggguucugcauaaacaugcaccacguugaacuuuaaugaaaauaucuuuacacacuguuuuuguccauugcacaugaaggcacuaauacugccugacagguugacuaccacagaagcgcugucucuuccaugugcccucacaugccaagugggcagggcaggaaggaauccccauagugagggaaaguccucagggcuuaaucacuuccuguacccuacccaaaccuacagugcuggagucauguaucaguguggaauuguggcgggacacauggauucuuaccauagcuuauauugcaauaaagccuuugcuauuaauuuuaggaaaguuugauuagaaguuacucuucuuggcgcuguagugagagaacaucaagugucccucucagaggccuggcacuuauuuacuuguagagucugguucaguuauugcuguuuuaaagacagcaucuuagaaguauuguccaccuggagagcugccccacauaacuucucucuccacgaagauggacaucaguuuuccucuugucccagcaaagguauuucuuacaugguuugaaaugcuucccuauuucucccuaagagcugagucccucuuugauguauacauauucauuauggagugcuguggccuguuuacacaugcugucuaguacauagacacacuucucauuccuugccaacugucagccaaagugcagaaaguuucugucucuagacccucauuaugaaggcauuuuuaauuaucuuuaaauuucagccaggcauuccuaaguauuugauuaaauauuuucuuuuuauauccuauauaauucuauacugcaaccauguaguguuucuauucuauguaaaaaagauuaaaucauguuuuaaaguuuucaaaaaauucuuggaaauuauauugguuuuaaucagauucuaacuuucuuuugaaaaggaauaucaaaauaagcuuaucuaucuggucccugagaagcagcuauuaaacgaaagaauuaaaaacaugcagcucaguaacacaccugguaagacgcuacaguugguuuuauuucuuuucuaaaucauuuuuaauauacuauuauuuuuaaaauggcauuauuguauuaaaauaauauuuuucccauaaguuaacaauuuuaaaauaaugugaaaaaucucacauuaacaaucagugggaagcgugaccucaugugugaagacuguaggaaaagugggacagccacaugcagaagagggaagcuagcccugccuuaccccagaccugaaaaccagcugaaagcgaauucaagaccgaagcuuggguguaguaaugcuugucguaacacuugguagacugaggcaagaggacuguuaggaaucugaggucaaucugggcuguuuagcaaauaccuggucagccuaggcuaaaguguaagacccuuucucaaacccagcaacagcaaagauagauucaaaccuaaauguaagguauaaguuuuaaaacucucccaaaagagaacagacaaaaguaccaugacaucuuuugcaagcauuuuaauaaaauauguuuaugaauucuuugaggauuucauacacuguauuugguucauauuuacccccacuccucccucuaacuccucuaagauccaccccuaccauaccaucucaccuucaacucauguccucuuguuggguuuagcagguuuuuaaaaauguauuuuauguguuugucuguauauaugucugggcacuauacuuaaagaacaauuagaugcucuugaaaaagaaacugcaucuaagcucucagaaauggauucauuuaacaaucaacugaaggugccugagguggccagaagagggcauugaaucugcuacaauuaggguuacauacagcucugagccaccauggggaugcuaggaauuaaaccucaguugucuuaaccaaucagccaucucuucagcccgauuaacaguuuuuaaaacucacaaaacauauaaaaauagaaacaguaaguugccauagaaaucagacaagaaauaugaaacaaaucauuuuauaucaaaccaaaagguuucuguacuaccaagaugaaaggugacccacagauugagagaaaaacugugucagccauauauccguuagagguuugauagccaaaaauauauaaggaauauacccccaccccaaaucugcagaauaaacagaagguuacaggaggacuuuacuuuuuccaccauauguuuaauuuuauucaaauucuauacuugauuuuuauacccuaaaaauacaaaauuuuagguuaugaauuuagauagaaauuuuacuauuucauuuuaauagaaaauaauagaaaauacucuuuuuauaccuaguuucucuauccucuauccuguauauguuuuuuaaaaaucauguacagugaaacccucucucuuuaccucauaaaaugugucauuaaauaacccuguuauuaaugcuuauugggucccugcuaugaguaguucucuguucuuagaucauugucaguaugcaggaagguaccugaggagcacaugcuguuagcugagcgcuuacccacgauaggccguggcuucagagucaccucacguaaugagguagaugguagcaugcuccuuguguuugcucaaacaccuuuucugcuuuggaguuuuucaagaccugaucuuucaguacagaacuaaucuuuguauccauuuccuuugagaaucuuuacaagguauuauuuggaaauaaaaaggauugucucuguauuauauaccuucuguaucucuuuaguuacaucauuuugaccagacaggaaaugacaugaguauuugccaaaugugaccugacuugauauuuuuguacuucagauucagggaucaguuuacuucauaaaaagucaucagaaaaggaagaauuaugccaaagacuuaaagaacaauuagaugcucuugaaaaagaaacugcaucuaagcucucagaaauggauucauuuaacaaucagcugaagguauuucucuccuuuuaucuucaugcuuuauagcugcugcuugcuaaaaaaaaaaaagcuacuguuaacauaauguuacauguuacauuuucauuauugcuuauaccaugccaacuacuagaaucauaguacuauuuuugauguucucugaaguuuaguaacuauuuugucaugagccgagauauuuucccuagcauuuccaggguuugaugacuauaugaaucuuuuuauuggcaucugugcaucucaaaagcagcuucauugccagcccuucagaaguaaugucagcaacacccuaagguacaaacagacuggcaugguggugcacacuguaaauccuagaaguugggaggcugacacaaaaggaucagaauucaaggccauuccucagcaaccuacagaguuuaagaccggccugggccacuugagagcuaucucagagugggaaggagggaugagcauggaaauuuccagacugucugaugguggucuucuaacacuaaguucuucuugcugguuugucucugugaucuaauauaauuaauaagaaauaauacaaugcuuagugaaaucuaaagugaaucugagaccauaaauuuuaucugaaaaguaaaguucaugauucauugaguuacuguuugccacugcggcagagcagaugcccaagggacagugguaaucagauacugaagccauaugaauggagauaauaaaauguuaguuggauauugaaguuucauucaaauuugggaguagucucaguuugccauuugcuaacuauucauaaaguuaucagagcauacaguuuuguguaguaauucuuuaagaaagauauuuuucauauguuuuuuuuuaucuuacugacuuacuagaguaacuaacauuagcaacaacuauggaauaaacaguaugauuuuaaaaaacacaucaugauagcuucaguuaaggacagaaaauugaggugaauaauucugauaauguacuuuacacaaagauauauucucuagaaaaauuaaagcauggccauuggucaaacaagccagucuaguuaucuuccuugaauuccuuuuaaaaucuguacauaguuuaacuggccuuuugucugccuuaucuuacagugugggaguauggaugacuguguccuucagugccuuuugucucugcugagcugucucaacaaccucuuccucuuacuuaagguuauuuucuaauaucuagcuuccucuuuuuaaguuacuuuacuguuuucuuuuuuuaaacugaacuauucuuugccuuuaucugauuauauuuguuuggaauaacguauacaauaaaaccuuuuuuuccuucuguuugcucuaauaugcuucugcugucuaaaugccuguuugagucuaaugccagacaucaggaaggcuguccacaggcccuccuucaugaagacuccugcuggucccuugcacucucccuguggacuggccacauaacgggguggcucaggagaaaacuaagggaaucugaaggggaaaacgcucagucccuuaaagccaucacucagguuucuacuuccuucagucuaggguagggucauggcuugugugcaccaggcuguguccuaauuugaauguaaagaaaaaacguaaagaaucaguaauacaagguaucauuacuugccaggccuuguauuuugacauacguacacuugagauaaaaauuaauauguauaaaucacauuuugcuguguucuuaaauauacagacuauucaaaaauauucaaugaaguucuccuuuaauguagcuuaaagauaggggaauuauauuaaguacuugccuacccaacuauucagugcuaaaaugaaugaaauaggcaguuccuuuuauaucccacaauaauuacaccuccacucuuucgaaagguauggcagauugcaaaagauaguagcagcaaggucccaaauguucaagcgugacugaucagguuaucuggucuuagaauuuugcuacagaucauauaaagacuuaaagugugagugucuucauuguaaaauguguccaguacagauuuguggacugugcucauuccuagaagaguccgauucuuucaguuagcauugauucuauacaggccagcagacuacucuguccugcuuuccuuucuucuuucugcuuccugccugcuaguuuuucacugcuuguugauacuuucauagaggcgauugagaacacuaaaggggugugagaucugucaaucaguggcugcgaaacuugacugugguuacagagucauggcuguaaggugauacagagggaucuauuaacacacugcuggaaacuugcguugacuccuacagcaggguccucguaccaucgcaguugcagaguaagcagaagcugggugcaguggucagcaguggguaggcaugaagacuaucggcugcuccugaggcacucugacgagaauagaaggcuugaggcugagagaugcuaaaugaagggacaaagaacaccagaggcugugagaggaaggaugggggcugauuauacuaaguaugauaauuauagaucacaggcucugcuuacauguucaccaugcaaagugccuaugugaagaagccagauguggcacacccaccugaagucccagugcuagggagacuagagggucagggaccuugucucaaaaaauaaagugggagcuaugucagccauacuccagggcacagggcaggccucacaggaguagucagccaacacagaccugacuccauaggguuguuuguuuucuuuguucuuaaaaaagaaagagaacuuaguuggguagggaguuaggggagcaaggaugaauaugaucacaacacauugaaauucucaaagaauaaauuaaaaacauuauugaaaaauaagguagaagacaucugauguugaacucuggucuacacauacauauaccugugaacacacagacaaaagaagaaaaaauuaaaaaagaaagaaaagaaaagaaaaaagagaaaucuggagcauagauuaagaaagaaacagagcuggguggugguggugcacgccuuuaaucccagcacuugggaggcagaggcaggugggucucugaguuagaggccagccuggucuacagagugaguuccaggacagccacggguauacagagaaacccugucucagaaaaccaaaaaaaaaaaaaaaaaaaaaaaaaaaaaagaaagaaagagaaaggaaagaaggaaagaaagaaggaaggaaggaagaaaagagaaaucuggagcauagauuaaagaauuuuuuuaaaaaguauauuuucacaggcuggagggauagaucagugggaguucuaggaaaaagaaugugugggggaauuaggaaguuucaggacagagagagagagagagagagugugugugugugugugugugugugugugugagagagagagagagagagagagagagagagagagagcucagccugaaguagaugccuugguaggugggguggaugaguauaagcaugagagaagaaaacaauguguugagcaauguuaaaugucuauuuuauuccaggucaugaauuuaaauugaagacuacaugccuaauuauaugauuuuccuuuccuuauuuacagcugcuuagacacaagcacagacauggcaagugaaauugguucauggcuucaaauugauuugggauuuuagcagacauuggcuaagauggaagggaaggggaguuagagaucuuaacgugagaauuaugacaaagauaaacucugguaguaacugcauguaaaaggaucguagaugaagaggugcugauguagaaaggaaauguuaaagccaacagagugggggucuccgugaagcugagacacccuugaaguggcaaaggcucagacuccaagaaccuaauguaugaagaauaggguauuuucccaguggguguucucuuuuugauguuacuagaacucaaggcauacuagcaggaacagucuacuaagaagcaccuaaaaggucugaccucagaguuaggcuuugaucggaucaucuauauagaggucaaagacaugaauaaaugagacucagugcccgggugaucaguaggugaugaugaaauagcaugcacacgugcacagacacuggguggggugcuccgugaacccacauguacuauacaaacacuuuugcuguucuuaucaaagaguuucgcaaaaucucuaaaauguauagugugauuaaaaagaacucaaacagcuuaacacuauugacuccgaggauuaacugaggaagugcuuuuccauggaaggaaagcagaaucugccaacaccggaaguuuuagugguacccuccagcuggcaagggguaauuugugugucagguauacaucuccuuuccaagaugaggaacaauagcaggaaauguggaccugaagaccugcuuugaggcaugggauaggaacuuugguuucugaagcaaagcaucuuacccauguuuaugcuguggacuucucucuagaccucaucucauguuuuaagugaggggcuagcaguguaacccagugcuagagcacccaccuagcaugcacuuagcccuaggcccaauccccagcaccaccguauauauucagauguagaaguuggagaauaugggagucuacguuuaugaauuaaagaagaucuagugacagguauaccacuuuuaaguuaagauaccaaguaaucuauaacuauaagaacagcuucaguuucuacuuuugaaaaugucauaaauaugaguaauaucauggagguuuauugcuuacauuugauauugaugggaaugcuggauuucagauagcaguuaguaaaaauaaaaaucaauuuuguuuuuagccacauucaugaacuucugaauucuccuaaacauaauuuuaaaacuuuagaaguacauuggcccuuggauuacaaacuguugccguagaguaaaggcagagugcuuuggcgugcucauuuucuuaccugcuuuucucucagcuagagauuugagaagacgagucuccccuuuaauuauguauuugucucuuuuaauuuugcuucuuuuuaggcucugcugcuagugugaguagcuuucaaacuguuguaguuuacugguggauaggcccaucugucaugcugucuccucuagagaugcuucuugccuauaaucccagcacugggagacuaaggcaggaggucugcaaguucuaggauacccugagcuacaagugacuuugaguauaguuugggcuacauaguaaaaaccuguccaaaaaaaaccccccaaacaaacaaacaaaaaaaaguggacuaggagaccuggggagauagcucacuuggcaaagugcugucuguguaagugugcaagcaugaaaaccugaguuuaaucccaguuuauccacagagauggugggaugcuuauaagccccguguaggaaguaauagauacagcgugcgaggggaggcagaggcaguguuauccuaaccaaggcuuucuggcuagccagccuauacugauugguaagcccgaggucccagugagagguccugucucaaaaacaagguagagagcccugaggaaagauaacaaugcaagguugacuucuggccuacaagcauguguuaauacauaugcacacacacacacacacacacacacacacacacacacacacacuucuuucaaggauaauguuuccugauauauuagucuaacugcccugccuuucuuuugcccuguuggcauggaauacauuuucuaccuuauuuauaaacuauuauauauuucauuuauauuuuaucauuuaagugacauaguuacaguuuauaacuucaguuuuauauuuaacuggaguaguuagucuguuuaacauacugacaaauuuggacuauaaaauuuuuuucuucuguuauuuauuuugucucaucuauuuuguuucuuuuucuuaccuugcucuuuuuuaaugcauuauuuauuuguuuacaguuuuaugcacauauaugauauacuuugagcauagucccccaccauuauucuucuuguacuuucuaaaaagucuuucuccucuuugcauuuuuuaaaagccuacuucauuuaaucaggauucugucugagcaugggugggaguuauuuacuuaagcuauggcaguuuaaccuugguuacacaccccucccccagcaaccauuaacugucugucuguaguuccuucagggagggauaagaacugacugucauuuuguguuaacucuaucucuuccuucucugugaccuaguuaugccuuccuuuauuugucuaguacuagguauccuggagacuacaguuugcauccuuaauuuacuuaguaucaauauucugcugauuugugucuguauaccaugugcaugcccagugccuacagaggcuagaagaggaugucagauccucugaaagugacgugcagauguuugugagcugcuaagugggugcugggaauccagagucuucuggaucagcagccuuaacugcugagcccucucucuagcccuuuuucuuaguucauugacuucuaguauauauauauuuuuuuguuaaauuccuuucaagcuuuuuaugaaaaaaauucacagaaauaauugggauauuaauuugugauuugauaaacaaagucaucuuuccagaagucauuuucuuuugcuuuuggcaaacaaaauggaacaaaucaccuuaauucaguggcuaacuaagcugauucaaagcaggacugauauacuucugcggugauuugaaugagaauggcucucauagguucauuaugucuaaacauuuggucauucauugguugguagaacugucuuggaaggaucaggagguguggccauguuggaggaggugugucucugggaguggacuuugagguuucaaaagccuagaccauucauucccaguagcuagugcucucuccucucuucucuccuucccuccccucucccuuuuucuuccccuuucccuccucuccccucccccuuccuucucuccuccacuccccucuuucuuuacucucucuccccucuccucaccucucucccucucuucucuccccucuccuguuuccuuuucccucuucucucucuccucuccucuccucuccucuccucuccucuccucuccucuccucuccucuccucuccucuccucuccucuccucuccucuccucucucuucucuccccucuaaucacacuuguagaucagauagauguauauucucagcuacugcuccaaaauaugucugcuugccugauccauguuccagaccacagugggaaccaaauguagcucucuggagcucagagccucuuacuuacucccuaauccugagggguccaugguagacaaucaaaaugugcacuccuagggggaauucuguagugugagguuuuuuagcuguacaacugugagcuccugaagagucccagguguacacucacccaggagguaucugggauccgcaaauggaaaacacacauaccaguuaaucuuaaaaugccuuuuggcuaacucaaugacugcacacuucuaaaccuucccuugcuacccuaggcccgaaaacucacauggcugguuggcuuuaucuccugccauuacuaugugcccuugaguccuucugauucuuucugcaugcuuaccugggcaacucucagugucccaccccugugcucgaccauuugccacuggcaucuuuauugauagaucaaaaccuaacuggggacaaggaccuucagccucuggacauacagauucaaagcauuagcacuaauguccaaaagaauuccagcuugucuacccaagcccuucccugagguggaugcccugcugagcuccuuagccauugcuuucucucagcuucucagauagguggaugccuggaaggaagaagcacuagguguuggguaccugucuccuuucucugcuuucuucucuccaggaucuuaauccuccugggugagcaugcaccuaggacucaucaggaguucacaguuguacagccaaaaaaacccccccacuagagaaucccccugagagugcacauuuugauugucuaucguggaccccucgggauuagggaguaaguaagaggcucugggugcccuuacaguacuccaguuccugcaaaugagugucuuuuauaucuuauucaacuuccuaguucuuggcagaacuugaaacuauaagaauuccucaguuuuugcugggagaggucccgauuauuagacuuuuuguccuaagucagccauuggaagaaggcccauuucaaggacucaaggcuuaaaauaaaaccuccuuggaaagcuacugcagcucucagucuuaaagaauacguuggaggcuaauguuacacagauuaagaucaugcauuaauuuggauucucuuuauacucccucaaaauauagaauucucuuuaguccuggcuucuaucacuaauugcuaguauuuauugagaaucuaaguaugaaaccugcaauacuauaagcacuuuaccuggauuaauucauuuuaucugaacagcagcucugugagacauguucaaauuaggaaacuaaaacuuucaugcgcuaauacaaguauaguugacagaaccugacucagacuuuuguggacgucuccuagaggcauucucucuaacauuaaacaacccauaaccacuguccucuuuuguuucucaguagaacuuagagacaaaaacaacaaauaaaaucacagaagcuaagagcugugugagacuuaaccugaacacagcauuuguguaagucccagacauuuggacagucucagucaccacacuaccccuaggccagguauacagcucagcugguuuaccucuggcuuagcgugguucuggaaauauacagguuuuccugauuuggguuuggaguucugucacuaggagggugaggggacaccauacauuugaaaaaaaaaaaaaaaaagcaacuaaaacacauucagauauugucuagcucuauuauuuaccauuaaauuucuuuuaauuauuuuaggaauuauuaauaauuccccuccuuucucuucucuucucuucucuucucuucucuucucuucucuucucuucucuucucuuuuucuguuggugggugguuguuugguuguuguuaguuuucuucagccucuuuuucuuucuuccuuuuucuauuacuguuaaguauuuguagauucacaauagugacuauugaaagacagccaggaugagugggugggaggucagcuucugggaagggccauuccuaccacacugcgcauggaauugaagaccagccccggguccucaucgacaccuucuucucuagucuuuaccucuguguuuuauguuggccucguuccugucaguccugacucaugguugguaagggacucagauuuaguuuaucucagacaaguuucuccuuacaauaccuaaucaagguauuuguauccuggaaaaaaauucugacccaauuuggaucauauucauguccuuuugagcauucauucucagcagggaaaugaagugcugugaucuuuuagaccaaguguagugauugcuucugaauagacagacagaggacacugagaccugccaaaaccacaugucaaaaagucauugugucuacuugugauccuagcacugagacagugaagacggaucccugaggcuuguuagccagccagcccaaaguacuaggcaaguuucaggccagugagaggcucugucucaaaacaaggaguuuggugccuaagaaaugacacccaaguuugaccuugaccucuggccuacaacacacacacacacacacacacacacacacacacacauaucacaaaauuuuucuuuaaauguuauuaccagcaaauuuuccauauuuuaaugaauuguauuuucuaucaaaaguaauacuucaaacaacugguuuauuaaauauuuuauguucuuuauaugugaacugauguggaaauagauaugccuuaguagaugcaugaaguacuuacuauaguuaaaacuuuuauauccugugaauagguuuuuuuuaaccuuuaaaucucuuuuaaauuuaauuauacaugucuuaguaauuuguuuuuuaaugcaaaugcuauauuauuaaauaugauuaaaauauuuaaguauugacuuacuuuuauuuuauccuuaggaacucagagaaagcuauaauacacagcaguuagcccuugaacaacuucauaaaaucaaacgugacaaauugaaggaaaucgaaagaaaaagauuagagcaaauucaaaaaaagaaacuagaagaugaggcugcaagguaauuguauuguacuauacuauuaagugaaugugucaugaauguauuguaguauuuuacuauugaaauucugcucagcagugguggugugcgccuuuaaucccagcacucaggggcagaagcaggcagaucacugugaguuccagcauagccuggucuacugagugaguuccaggacagccaaggcuacauagagaaacccugucucaaacaaaacaaaauaaaaugcuagcuuuuguugcacauugcuuuuguuuaugaaauuuaaagggaauaaaaguauuauuuuuaaauaccacucagauuccaauucuauaaauucaauucuccuuuuaggcauuaaguuuucauuaaccaauuauauggucuaguagugaaagagaagaacaugggagucagaucuggauuaggauuuuuagucuucccuuuacuaucugagggacccuagcaaacagaccguuuaucuuucuaaagccugguuuuucuauuugaaaacagagaauaccauuuaccacauagguaauuguaggcuuuaaauaaauaauguaguuggaaucuuguaaauuacacauaaugaacuucauuaguucucuggcucucccauaaaucugucuguucccuagaagaucauuaaaaaaaaaaaaaugaaccaguuucuuggugccacuaagacguaucgaucaaucauuuccauuuagagcagagagauggacagggacaucugaagcacagaccuccccuuuagcagcuguguggggcuuguguguggcucuuuguuuuugucuuuugucaguaaaauccuuugauucuccagugccagaaaugaguauaauugguaaacaaauuauuuguaagccaguaauucuuuuccauaauaagaagcagaugaguaacaucugugaaagagcuaacagacacugggggauaagaaguccauucccaccucgugagccucuguccuuaguggcuuaaaaugaccagugccaacacacguggagugacagcuuugcaugugaugaggggcugaccuggauuccucauuuauguagccguggguucagacaguuaaagacuuuacugucugucacuccagauacacucuacccauggccuccuagccagagauacuagaauaauauaggagggaggggcucagccaguaaauggcuugccuugcaaguaugaugaccuaaguuugauccuuauaauccagguaaaaaugugguguuacauaguuccaauucacugagcagccagucuagccaaaguggugaauuccaagccagugaaagacacuugccuaaaggagcuggacaggguucuuaaggaugacaccuaaaguuguguucuggcuccuaccugcaaacguauaggcaugagcacaggcauaugcauguaugagcaccuauacacauaaauauacuagcacauguauagccaugagagcacacacacauacaggcaucaacacauauaggcaugaacauacauauaugucaucucuaaaagaauaaugcagaaauaaagacgugaaguucuucacuuggcacuugccuugugccauuuaccauugcacaaagggucuaugcggugcucacccagucuuggauaagaacuuucuguggauaccuacaucucacaguuuuucucaggcuuagaauuaauaguaauacauauuuucuuuuuauuuaucucucuacauuuugucuucuguaguaaaccaaagaaguuaaagagaauacaaguaauguagaccuuaugaguccagagcuucauguuaguacuguagcucgauucugauauguagaucucacucagaguugugcaaagcuucuagaggaagugugcuaugcugggcuagagguugaagggugaguccugggguccaucuggccacagucucugcuacucugcuaaagcugaggcuuagggaaucaaagccacaggcaggacugacucgugaggaguccaggcaggaagaagccccacacuugcuccgugcaucccuuccugcaguguucuccuuugugcucuccagcucaccccacccugcgucugagucugagucucuccucuuuggcucucuuuccccauccccaccccucagcauuuccauguuaguucuccagccagcgggaaccagaucuuccaguaugccugucagcuuguuugagguuuggugucccacauauuaggauauuauguaaacucuucacuucucuuauuuaaaggaaagcaaagcaaggaaaagaaaacuuguggagagaaaguauuagaaaggaagaagaggaaaagcaaaaacgacuccaggaagaaaagucacaggacaaaacucaagaagaggaacgaaaagcugaggcaaaacaaaguaaggaugaaguagaccugcuaagagcaaacaaaauaaaaauaauaaacugaaagaugcucaccuuuaaguuaaaaaaaaccuuuuaaauuaaaugugugugaaaaauguauauacaugugggaacugacugaggaggguagcauccucaacacaacaugacagucagugugguuuuacugacuuccacaaaagauugccuacaguuuucagaauugcugcaaucuuaaauguuuacauuguuuaccaauguagcugagccacuuauuuaacugaaacaguaauaaaauuuaagucuuuuuuucacauggaacuuuucuuagaaggcgugucuccucauacaguuggaguccaaucuaacauacuucuguagugcaucuacuuuuagaugaguaagcuuuuggguccaugaucgugaugcagugcauucauauuuuuuaacaaacuauuuuuaaauguaucaagucugguaugguugugaguccuucuauuuuccccuuagaacaaacggguaaaugugcagauguaucuucauccaguccuguuuacucauuagucuccuguggcuucccuugugugcacucuuccucuguuguggucucuccuccauugaucugaccaugucucucccugcuuaggugccuugcaccauggauagcuuggccugcgacucccacccucccuuagauccgugcgcaugccucagucugugagguaucacuuuguucagcugccucccacaucacuugagauaagcauucgucuuugguuuauagugacuccccgaguagucacaauaucuggauccuuauaagucuaacucaagcagggcuuuguuauacuguuugaugcuuacuuuuuuuguuuguuuguuuuagauuuuuaagagcucuuuauagucauaauaaugauguauauacucuaaaguagcaaauuaugggaauuaucuuuucuucaggugagacagccagugcuuuggugaauuacagagcacuguacccuuuugaagcaagaaaccaugaugagaugaguuuuaguucuggggauauaauucagguaagaaaugaaagccuuucuacucaugaguaagcuaaucacaaaucauuguaccauguuuucuacaagguuaacuuugauuuuuauguauugcuaaaaauauuuuaaaacauuaucucacuuagcccuugcaagcaucucucagagcuguacagggcaguaauuacuaccauaauauuaccaaaaacgaaaacuuaagcucagacacauuguaacugucagcauuguggugacagagugcagagaaaguaugucuuuugguucugagucuaguguucuuuccacugugccauaucagcucaccaaaucauaagagauggcaccacuugugguguuuuaauaaaugaacaguaaaauuuggaggguugauuauuuucuaccaacuguuaagaauguaaaguuaaguucugcaguccugacugaauuuuggccauuuguucuuuggaacaaauggucuuugcuguauuaucauaacucaugugaaguagauuaauaagaaaauacauagagaaucacauugauaaagguauuauaauaugcuggaaaagcauaggcuuuaaaagucauccauuagggcggagcugagacccagaccucucugcaccuucccugccagaagagagucggccuccagggagggcucugaccccaggacucaucuuguaucccaggucucuuagagaccagaccgcucaggagagcguguggguugcagaagcaagauggcuucuuggacagggucccuucaggccuucaucuucagccaggaagcagagcugagcuccagaccucugugcaccuucccugccagaggagagcuugccugcagagagugcucugaccacugggacucaggagagaguuggacucccaggagugcugacagaggcuaauagaaucacaggaggaacaagcuccagccagagaaagcuagaacaucuaacaccagagauuaccagauggcaaaagguaagaaucuuacuaacagaaacuaagaccaguuggcaucaucagaacccagaacucccaccacagugagucuuggauacccccaacacacccgaaaagcaagauucagauuuaaaaucauaucucaugaugcugauagaggauuuuaagaagggcauuaauaacucacuuaaagaaauacaggagaacacuucuaaauagguagaaguacuuaaagaagaagcacaaaaaucccuuaaagaauuacaggaaaacacugcuaaacagguagaaguccuuaaagaagaaacacaaaaaaaucccuuaaagaauuauaggaaaacacaaccaaacaggugauggaauuaaacaaaaccauccaagauauaaaaauggaaguagaaacaauaaagaaaacucaaagugaggcaacacuggagauagaaacccuaggaaagagaucuggaaccauagaugcaagcaucagcaacagaauacaagagauggaagagagaaucucagguggagaagauuccauaggaaacauggacacaacagucaaagaaaauggaaaaugcaaaaagauccuaacucaaaacauccaggaaauccaggacacaaugaaaagaccaaaccuaagaauaagagguauagaugagaaugaagauuuucaacuuaaagggccaguaaauaucuucaacaaaauuauagaagaaaacuucccaaaccuaaagaaugacaugcccaugaacauacaagaagccuacagaacuccaaauagacuggaccagaaaagaaauuccucccgacacauaauaaucagaacaacaaaugcacuaaauaaagauagaauauuaaaagcaguaagggaaaaagguuaaauaacauauaaaggcaggccuaucagaauuacaccagauuuuucaccaaagacuaugaaagccagaagauccuggacagauguuauauagacccuaagagaacacaaaugccagcccaggcuacuauacccagcauaacucucaauuaccauagauggagaaaccaaaguauuccaaugauaaaaccaaauucacacaauaucuuuccaugaauccagcccuucagaggauaauaaagggaaaacuccaacacaaggagggaaaccacacccuagaaaaagcaagaaagugauccuucaacaaacauaaaagaagauagccacaagaacagaaucccaacuugucuuagucaggguuucuguuccugcacaaacaucaugaccaagaagcagauggggaggaaaggguuuauucagcuuacacuuuccaaaucgcuguugaucaccaaaggaugcaggacuagaagucaagcaggucaggaagcaggagcugaugcagaggccauggagggauauua

SEQ ID NO: 6562 - RNA, 13674 nt, Mus musculus
cgugacgcacucaauagccaauagucuagaggcaucuccgagguccaaaggccgaggcuuccguuaggugcccgggacuucugauucccgguccugugacgugagcggccccgggauuuuacgugugggacggggaggcagaagacuaagguauuucguugugugugugugugugaaguggguggcacuucaggcccagggauguaggcguggggagaaguugagggagaguuggaagaggaccaggcugcaguagaagcaagcucacgguguggguuuuaacaagugcccuugggauacacgagugauacuucugguaauagagcuuaaggaauauagccuuguuuguaguaaguuaaagucgccuacgaacuuugagauguuugaacaaaccgaacuaagaacuugguuuaaauuacaaaugauaauagccgagcuuuugguuaauuccaggaggcucuaacgggaugaucaguuaagcuguugccaguaucucugucucacgucucucauccuucugggaagcuagauggggaguuuugguuuugguuugguuuuuaucugguuuggucuuuuugagacugggugucauuuugcaaucagugcuagccuagaccuagcuggacucgaggcagugugugugugugugugugugugugugugccugcgcccgcgcgcccgccucagcguuugcgcacgcacgugcacuugcuuuggugcauagcuggaagucauaggacaacuuuugugaguugguucucuccugccacuuugugggguccagggguuggacucagguauaaauaaggcuuguguacaagccccugauaacugcugggcuauguugacuggcuuucagguuuuguuuuguuaaaugauaagauccuuacuugcuuuggcuuuacuaaccuuacaucagugacucccaaauccuucccugugacugccuaagguacaucuacugcuaccuuacaggcaccuucaugaaacacguuuaauaccacuacauaaaacucaucuaauacuaaauuuugucacagcuugcaguaucucagucgguggaguguuugccuagcauacagaggguucuggguuccauccccugcaccgcauaaacuggaccgguauuauucucaauacucaggaagugcaggcaggagaacaggaagcucuaggccugucugggcuacgugagggucuguaugaaaaauaaauaccuuacauacuacacaccuuucucaucuucaaagcaugccugccuucugcaucucugacuaaugguucaacucuuucucaagcuaaaauuuugcaugcugucccucaaguauuuuucagucuucacauucugugagcgcagucuuucugucuuagagaagcgccucuggcauccagcaccucgucuuccucugggaaaacagcugcacacuuuguuuccucucucuuuuuuauuuuauccuuuuucuuuuuccauuugguuugggguuuuuguuuaucuguccaaccucccccccgaccccaccccaccccacacacacacgggguuucucuguguaaucuuggcugucuuggaacucacucuauagaucagguuggccuugagaucugucugccucugccuuuccgguacagggauuaaaagaaugcaccaucaccgccuggcuccuuuuuuuccccuucuugcucuggccugguuugcuuugucccaaagauugauugauugcuggccugguuugcuuugucccaaagauugauugauugauugauuuaauuaauuaauuuaaguacagcugucuucagacacaccagaagagggcaucagaucucauuacagaugguuaugagggcaucagaucccauuacagaugguugcgagccaccauguggaugcuggaauuugaauucaggaccucgggaagagcagucagcgcucuuaacugcugagccaucucuccagcccuugccuuuuuuuuuuuguuuuucgagacaggguuucucuguguagcccuggcuguccuggaacucacucuguagaccaggcuggccucgaacucagaaauccgccugccucugccucccgugugcugggauuaaaggugugcgccaccacaccgggcuugguuuguuuuuucugagguggggcacacauacuacagcagaucuguggaagucgcaggacagcuuuugugaguuuguucuuucccuuaacuuugugggauucugagacugaccucagguuuuauggcaaacacuauuuauuuauuuauuuauuuauuuauuuauuacaugugaguacacuguaacugucuucagacacuccagaagagggagucagaucucauuacgggugguugugagccaccaugugguugcugggauuugaacuugggaccuucagaaaagcagucgggugcucuuacccacugagccaucucaccaguccuauggcaaacacuuuuaugggcuaagucaacccacugacucuuugugcaccuuaugguugugguguucagacucuucccccuccccccaugugacucuggucggccuguaucucccucccacccccaagauagauagauagauagauagauagauagauagauagauagguagauagguaguagauagguagguagguagauagguaguagauagguagauagguagguagauagguagguagguagauagguagguagguagauagguagguagauagauagguagguagguagguagguagguagguagguagaggcuuaugcugcccuuuacucucagagauccugcuaccucugccuccuuuaggaccaaaacagaucaaguuagaaaguuguaucuguagcaaauaacacaggcccuuaaugucuugaugcuuuuugaaagaacuucacuccuuuuacuuugggugcuagggauuggaccuaggguuuugagcaucugaggcuggaaucuaccaaugacccacauccucagauucagaaggacuuuuuuauaugcugaagguauauguucgguaguuggguuugggaauagaaaagugauuuaaaaaaaaacaaacaaaaaaacagcaaaauaacccaggugguuauuaaagggugcacgccuuuaaucccagcacuugggaaggaaacgggucucugugaggucgaggccagucugcuccacagagugaguuccaggacagccagggcuacagagagaaacccugccucaccucccucccagaucagaacaacaaaauaaaaagccaaaaugagggucaucagggugacccagcaggucaggaugacugcugccaagccuaacaucuaaguucacauccaggacccauaugguggaaggcaagaaccaacucccaaagguuguuugcugaccuccauguguguguguguguauguguguguguguguguguguguguguguguguguguuuguguguguauguguguuuguguguguauguauguauguauguauuuggguuguugagacaggguuucucuguguagcccuggcuguccuggaacucacucuguagaccaggcuggccucgaacucagaaaucagccugccucugccucccaagugcugggauuaaaggcgugugccaccacugcccaccuuagcccuuugauccuucagagacauuucaggauacauuuuuuucuaaacauugcaaaagaauuuuagagaucuaucugucuuuguuaaacacagacaauaagcuaguuggguggaacccugcucaaaauuacaccucccaccgugccugagccuacccuugcucuguucuagauggauccugaacucaggaaaccaucugccuuuguaagcaugaacagaacacucagcugguugggguccugugaccaccacucccuaagucucuuuaucuccauccuuaguaauuuucuaacaaaucggcucacggcucagcugcuuuuguuccuuuagaguugugaaaccccucauaauucauuuugcauacuuuuuuuuuuugcauguuugagaauauguuuucaaacucaaguauuuagagcucuuuccuguauccuuaagggcuguccugaaggucccaguacuuaccauucugcugagacagagcuauacuccugguguuucuaauuaucauggagucauaaacaaggagggcauuccucaggagaaaagaggccuccacugcuguggacccagagaguauguucauuauuacacaagcaagccugacacccacggcagccauugacauuccuggaagcucacacuggagcccuguccuaggggcaggaaccaugucagucugucucgauuagggccaugcuggccuuggcacccagccuuuacacauucacugauccguguuggggaaacugccugcugauaggcauggggucuaguucacagauggagcaguugccuagcauguccagguccuggauccaacccucaggggugaacaaaaaaugauuaauauucuuugacuguuuaaaagcuacgauuuuuuuaagucuuaaaacucuuuaugaacuaaguauauuuuuauauauuaauauuuuacuauaagaagauaauuuggauauaugauuauuaaaaagaauucccuccaaauacagaaauugaaaagaccacuuugucucucucucuuuuuuuuuuaaagauuuauuuuauuuauuauauguaaguacacuguaguugucuucagacacaccagaagagggcaucagaucucauuaugggugguuaugagccaccaugugguugcugggauuugaacucccaaccuucagaagaacagucggugcucuuacccacugagccaucucacuagcccccccccuuuuuuuuaaagauuuaucuauuuauuacauguaagcacaccagacacaccagaagagggcaucagaucucacucauuacagaugguugugagccaccaugugguugcugggauuugaacucaggaccuuuggaagagcagucagugcucuuacccgcugagccaucucuccagcccccauuuugucucuuaugccaccuuaguuuacuauccacugugaacaguuuacacgcugcaugugcauguuaucccugaccuuucccucaguguuuauaaacacacacacacaugaguagacacauaauggugcauguuuuuccuaaguagcgcauauuuaggguuaucauaugaguuccagucuuccuugagguuucucacuuacggaaguuaccuuuucacugucugagcucuuacccaggcuggccucagagagcuuuaggugauggccugccucagcuucuugagaaccugggccuagaguggguaccugccugccuccgaaugcucugaaacaguuccucaugucguggugacucccaaccauagaaucauuuuuguugcuacuucauaacuaauuuugcuacuguugugagucaugauauguggguuuucuaauggucuuagguucaaccccacaccaaagguugaggucgacagguucagaaucaucggucuaauuucuucuguagugacauaacucauuuuuauuuauugcuuuagauaucgcacaugcuaagcaauccgucucuugaggaacaucgcuucaaguucugaacuuccugucagggucuccugcagugcaagcuggccucgcacucgcuguagagcuaaugcuggccuagaauuccugacccuccugccuuuuacuuacuccaaggaacugagaauauggaccugaaccuggauuuacguuugcucuaugagugguugaacccggcaccagaacaugccaggcagugcuccaccacugaguuacgugcuuacacuaggcuuuuacccuugcaaagaugguugcuauggacauuuauauaugugauuggcuuacgugguaugguaaaauagucuuauauuuugcagauuugguuauucguuguuuauucauuuaggucuuuaaccaucuggaguuuauuuuguuguaauuuuuuuuuuaacauuuuggagcuuuugguuuuauuaucuaaaauaaaaguuauucauucaugcaacaugguggugugugccuuuaaucccaacacucaggaggcagaggcaaaggcaagcagaucucuaugaguucaaggccagcuuggucuacaaaacaaguucuaggacauucagagccaccuaauaggaggaccuugucuuaggcuggagagguggcucacaaccaucuguaaugggauccaaugcccucuucugguguggcugaagacagcuacagugcacucacauacauuaaauaaauaaauaaauaaauaaauaaauaaauaaauaaauaaaucuaaaaacaaccacaaaaaaaccccuauauggcucaggcuacccuuggaccuccaguccacucuugaauaccugccuacuuuccuucauuguacagcucauagaaagacuacucacaacauuuuaguaucaaacuuguuguuaauaaaguucuaaugcaggaagcugcagggaucggggaguuaagcacuugucuagcaugcacaaggcccuggguuugauacccagagccacacaaaaagauaaaauuaaaacuccuguacugaugacucauaggaauguaaggauuauguuugcuuucccuucacucuaacauagagcuuagaugugaaucugaaagccuuaggcaagauugccuguggugaucaacuagcuggccuagaacucacuuuguagaccaggcuggucucagacucacugagauucuccugccuuagucucuugaguggcauuaaaggugugccccaccacgccccuuuguaacuuuccucccuaaucauuucagauagccuuuguccgaaaggauggagcugggaaacggaaaacugccuaggacaggacugaacucacugaaccaagcaguccauccaaccuggggccuggccuggacugaugggaaucguguaguccugacugacuuacagcuucauaguggagaggccaaguucggggacucccgugucauuggaagguuugaaucugucugugggguuugcugggcaccagucagaacagugcgcucgccggcucugcuugccauccagcacaggaagcuugucuccguguggcagcugugucccagcacugcaggagcaagcaaauggcaggcgucucagaccucugaggucagggagucacucccuauccuuccucggggcugcguguggcacccaaaggaugcuguccugaccguguugacugcgcagggugucuccauuuuuccuaacguccaccaagaugguuccaggguaaaaguggacgucaacaccaagggccgcguuuacugugcuuguuggacccuggauggccagcggcuggugguggcaauagacagcaaccuucauucguauaucugggacaguucucagaagucccuucacagcugcuccuucugcccaguguuuccugugaauugcuccauccgcuccaucgaagccaccgggaacucgcagguugcuauagccaccgaacuuccacuccauaagcuuuguagcuuaaaugcaucugaagccuuggacgguccacccaacggugacgauggcucuguucauacucgcccuguagaugagcagguagccacuauggacaugaauucuggagugacaguuucucccuucucagugccucuggaucugacucacauacauuucaacccaucacaagcugaacagaguucucuuauuuguuuaagaaaaaaggacuacuugacaggaacuggccaagauucuucacauuugauccugguaaccuuuaagaaagcaauuaccauaacaaaaaaggucgcuauuccuggcauccugguuccugauuuaauagcauuuaaccugacagcagagcuaguggccguggcuuccaauacguguaacguaauuuugaucuauucggccgcuccaucuucuaugccaaauauccagcaaauucaguuagagaguaaugaaagaccaaagggcauauguuucuugacagacagacuauuauuaauugcuguagggaaacaaaagcccagugaagcagccuuucuuccuucuucagaauacggucaguauacuguucgucugauaguuagagaaauggcccagggaagcgaaucuucuggaacaucugcugagagucagggcgcuuacuccgacuucacugcuuuguuaaguaaagcagauagagaaaaguucacugacagccuuuccccagggucgaguccccugagccaggggcucuugcuaacaccuaacuccaguacucagagugggaggucuggaagagcccuuauucaagaaauuaaaagucccuuguccccucuguccagugauuccguuguccaugaaacccuucacaggccccccuggcuuugcccagcauugccuagacccagcaggaccccagagcacaccagcaccccagaacugaauucaccucaaagggagaacuuacaaaaagaaaaggaaacgugcccacuuuccagagagcuggaaauccucucucgacaccugguugcgaugcagcaguaucuuucugaacucacggguuuucuacacaaggagaagcgcgucgcccccgcauauccacccucgcaggaugcuccauauguucaccucauuuaccagguacagucuuucuugaggaacuuccacuauacaggaagcucuggaauccagucuguccugccagcaacgcuguggggacgguggggagggcgggagagugaagcccagugaccuguuagagcaguuuggcauuccuuugcacaguuagauggaugguagccuaccaaaaguucucacacagguuuuugccugacuuuaucauauccuuggugugaagauuaaugacuacacuuuguugacuuauauuuagggaagaaaaauaggguuaguugugucuguucauugugaaaaccgugugugugugugugugugugugugugugugugugugugugugugaggggggggcggggagagagauagagagauaucacuuaaaauguuuuaagagaauugguucuaagaagugaagugcaaauuugaagagcuuauuucuacaaguuuuuguuuguuuguuugagaucggaucucaugcagcucaggcuggccuuucaaggaugacaguaaacuucuugggcaguguaugugugugcucaugggagucacaugcaugugacauugggucugucuggagggaaggcuuccagucgaccagcuuucucaaggaaccuggaucucauugauuuggccagugaguucaaggucaccuguccccaucucugccagcaccuauccugcuuucuuuuuuuuuuuuccauguaacucuggcucuaaugcuaagacaccaagguacuuauccuucugccuucaccucugaaguacuggugcuauaggugugugccucaacaccuggguuuaugcugugcuggggaccaacuaagagucuugugugugcuaaacuaaccucuaccauuugaggagaacugcucauuuaauaccguuuucuacuuguauuuaaaaagcuauuaggaggaauagcugaagagagcaauggugcuauauucauaugcauaaaauaaauaaauaaaucuuuaaaaaaaaaaaacuauuaggagcuggagagguggugguuaagaacaugaacuagucugacuccuuuaaucccagcacuugagaggcagaggcaggaggauaucugugaguuagaggcuagcguggucuacauggugaguuccaggccaaccaggccuauguagugagauccuuucucucucaaaaaagaaaagaaaagaaaaaucucuugaaaggaagaagggagggagagaagaggggagggagggagggagggagggagggagggagggagggagggagggagggagggagggagggaggauggacggacggacgaccaugcacugcuuuccucgaggaccagaguuugguuccuagcacucagaacuucagcuccaggggaugccagcccucuucugaccucuucuggugcacaugugguguacagacacacguacagcaaaauacucgcgcacacaauuaaucugacucauuucacugagccagaccuccaguuccacuguaacacuguuugccaaacacuuuuuuuuaaagauuuauuuauuuauuucauguaugugaguacacuguugcugucucagauacaccagaagaggccaucagaucccauuacagaugguugugagccaccaugugguuugguugcugggauuugaacuucggaccucuggaagagcagucagugcucucaaccgcugagccaucucuccagcccuguucgucaaauaauacuuaaugaagaucauguuuaaauaauaauuaagaguaauguaagccgggcgugguggcacacgccuuuaaucccagcacucgggaggcagaggcaagcugauuucugaguucgaggccagccuggucuacagagugaguuccaggauagccaggucuacacagaaaaacccugucucgaaaaaccaaaaaaaaaaaaaaaaaaguauaauguaaacguaacuuuucuuuaucauuccuuguauguguguuuguauuuaacauguauguguggggugggcaugcauguagagguuagaggacagcugucaacgaucagaagcuggguaugguagcgcacaccuauggugugaguauugaagaggcagagacugaugaagcucuugaguuugaggccagacuggguuacagagccaauugcagaccagccaggacuauacagugagacugucuuaaaaccaaaaaagucaguucucuccuuccuuccaccuugagucuagggauugaaccuggguuaucguaaccuaaguggccagugcuuuuucccacugagccaucucacuggccuaguaccuuagcaauggaacuuuugcugugaugaaacaccaugacaaaaaacagccugcggagaagaggguuuauuucacacaucguuccauagaacagcucaucagaagaagaauugagcucaucggccugauagucaggaaccuggaggcagaagcugaugcagaagccauggaggggugcugcuuacuggcuugcuccccauggcuugcucagccugcuuucucacagaccuaggacuaccaaugcaggaauggccccacccacaaugggcugggcccuccccaucagucacuaacuaagaaaaugcccuacugucuugcacacagcccaaucuuuuuauuuauuuuauauauauauauauauauauauauauauauauguauauauguauauguauauguauauauguauauauacacacacacacacacacacacauauacacuguagcugucuucagacacaccagaagagggcaucggaucccauuacagaugguuaugagccaccaugugguugcuaggauuugaacucaggaccucuggaagagcagucagugcucuuaaccgcugagccaucucuccagcccacacagcccaaucuuaugccagcauuuucucaguugaagugccuuccucucgaguaacuauaccuugugccaaguugacauaaaacuagccagcauaccuggcccuagaaguaauauuuuuauuauguguucauaauuaugcuuuuaagcucauaaugagucuuguuagaacuguaacaauuuaaagauauuucccucuagguauauuuuaaaucacuucuaaaaaugacuucacucuuucgugacuucaaagaguguguguuuugagauagggucucacuguguaagccugggcuggccucagcuugccuuguagaucaggcuggccuuaaacucccagagcucugccugccucugcuccccagcccccagugcuggcuuggaggugugucccagcucccucuacauuguucugaagagaugucguuuuauugcuuuaacagucagcuaaccauguucccuuuuacuuggagaacccuuguucuguaggucccacugagagaagagcugugcuucucugcgauggcaagcugaggcucaguaccguucaacagauguuuggccuccaccuuguugaaaugcugcauggugggugaaagccagagcacccucuccaucccuucuguucugaagcuucaggaauggaaauggaacuguccagccguucaaggaguucacuaaauaguuaaaaaauaugauuaguugccuacuagauacucaggccuacuaaaaugcacaccuuauaaaaagggaaacugagcugcaaggcaguguguagcugcaguguaccuguugcaaucuagugcaccagucacggaaacacuacaguguugguggaguugacauucucacguggaggaaauggggggcgggggggaagcugugaaagacagaaugacacagugaggccauguuagcaaggccuaccugaugcccuacucacacgaggaauauggcugcuugcuugcuugcuugcuuuuuuuuuuuuuuuuguagccucugcugucccgguuggaacucauucuguagaucaggcuggucucaaacuuacagaauucccaagugcugugacuaaaagcgugcaccaccacauugaacauaagacauuuuauuuuucccuuuagcauucuaacauuuuucuguuuugacagauacauuuauaguuuggcuuuacaauugccauuuuugacagauagguuaguauuaauucuaagguauaccauuuuuauuuccuaauauauccuuguuauauauuuuuuuaauuaauuaauuaauuaauuaacuuauuuauuuauuuauuuauuuauuuauuuuguuuuuugagacaggguuucucuguguagcccuggcuguccuggaacucacucuguagaccaggcuggccucgaacucagaaaucagccugccucugccucccaagugcugggauuaaaggcgugcaccaccacaccccgcuuuuguuuuauuuuuaaacauuuauuauuaucuuuuuauuuuauguguuucuccaggcauggauaugcauguaguacccauggaggccagaagagggcacuaaauccucugugacugguguuacugauguauguuccccucaugcauuugcuaggaacuuagcccagguccucuggaggaagagcuggugcucuuaccugccgagccaccucuccagcucuauuucuauuuucuauguacgaggguuuuaccucuacaccaugggcacacuggccuaggagaugaggguauuggacugucuucugucuguccuugaaaggcccugaaagcucgccaugcacacacacacacacacacacacagaggcaggucacuuagacuuguaaaguaaaauaaaaauuacagauuuagccgggcagugguggcauacaccuuuaaccccagacacagaaacccugucucggaaaaaaaacaaaaacaaacaaauuacagauuuaagucauuuucuuuuuuaaaaagggauuuauucggggggggggggguugugagaugguucagugguuaagagcaccgcuugauuuuccagaggucuugaguucaauucccagcaaccacauggugacucacaaccuccauggaccugguggccucuucuggagugucugaagacagcuacaguauauucacauacauaaaauaaaucuuuaaaaaaaaag

SEQ ID NO: 6563 - RNA, 2043 nt, Mus musculus
ucguuuuuuuuguguuguuuuauuuuuguuuuguuuuguuuuauuuuguuuuguuuuuuggcuuauauccacuuauuagugaauauauaccaugcauguccuuuggggucugaauuaccucacucaggaugacauuuucuauuuccauccauuugccugcaaaacucaaaauguccucauuccuaauagcugaguaguguuccauugugugaaugaaccacauuuuuuguauucauucuucuguugugggacagcuggguuguuuccaagcuucugguuauuacaaacaaggcuacuaugaacauaguagaacacgugccccuguggcaugguggggcaucuuuuguguauauugccaagagugauauugcugggucuucagguagaucuauuucuaauuuuuugagaaaccuccagauugauuuccagagugauuguaccaguuugcaauuccaccagcaauggaggaguguuccucuuucuccauauucucucuaacauguauugucaccugagguuuugaucuuagccauuuugauugguguaaaguagaaucucaggguuguuuugauuuucauuucucuuaucacuaaggauuuugaacauuucuuuaugugcuucucagccauuugagauuccucuguugugauuaauucaaauuaguagcuucccuuuauacaaaugauaaacagguugagaaagaaauuaaaucacacgauuaucucauuagaugcagaaaaggcauuugacaaaauacaacaccacuucauguuaaaaguaauggggagaucaggaauucaaggccaaugccuagacauaauaaaaggaauauacagcaaaccaacagccaauaucaaauuaaguggagaaauaccugaagcaauuccacuaaaaucagggacaaaauaaagaugcccacucucccugaaucuauucaauauaguacucuaagugcuagcuagaacaaaaagagaucaaaaggauacaaauuggcaaagaagaaauaaaguuaucacuauuugcagaugauauaguauacauaagcaaccccaaaaacucuaucagaaaacuucuccagcuaaugaacaacuucagcaaaguggucagauauaaaauuaacucaaauaaaucaauagcuuuccuuuauacaaaugauaaacagguugagaaagaaauuagggaaacuacucccuucacaauagccacaaauaauauaaaauaucuugguguaacucuaaccaaacaagugaaagaucugcaugacaauaauuucgagucucucaagaaaaaaauggaagcucucagaaaauggagagaucucccauguucauggauaggcaaaguauauagagaaaauuucuuuugaguguaucacacauuuugaccauaacucaacacauuccagugugugugugugugugugugugucuguguguguguguguguguaugugugugugugugcacacuuuacauucuugaagguauuuauccauuguauauuugaucugauuugggcuagacuguggucuuuuaggagggaaagacaagaugauauuuugucuaauaccucacaggucaauacaaaaucaucagugagugagucuguaucacauaauugaaaguauacuuuaacauucuaauuaaaaugcuuaaaaauauuuaaguaaaauagucaauaucaaucucucacaaaccuauugugagccggccagcagcucacaaggacaggguacaccugaguggcagggcagagcugaaagagaggggaauuaggcagucgagagaaaaauggagcuaagucauuuuuuccugaucaaagcucaaauguuuaauggcaaaugcgcuuauaaagggggguggggggcauuccuaccaauucauccuuggagccuggaaccaguugcagguggugcaggauugcaggacagggcguagucuccagaauagcucaauugccucccagcagguagcaguaucuugaagaggaacagcagcaguggcugaacaauagagugaucuagggaggaaggcuccacccuag

SEQ ID NO: 6564 - RNA, 1928 nt, Mus musculus
ucuuuuuuuuuuuuuuuucaaguaccgaaaacaagauuuauugcauuucaugcagucuggaguccaugcagcaauggagaugagcacaaucuuuaauguauuuaaaaaauaaaacaguggccagagcagugcacaaaguccugguucucaaaguccugguucuccugggucuggagagaagggacgggaggaaaccagcucucuguggagaaugaguucauggcccacaggcaggaaauguuuccacaucuucuggauucagaagguucuggggaaggggcagagaagaaugcugguggaaagggucugccccuuucuuuuuuucugagggcagaacuggcagaguggaaauccuguacacccuuaggaaggaagagcacaggccgccccuuagcagugguggagagugcccaagccaggaaacacacaagagaauuauuucuucaaccacacguuucaagaaaaggccauaaauauguuauuuaauauucucguuucauagcauuggacacauagcucaaaauauugaaauauugauuccuuggagacaaaaauggaaaaaagaaaauaaaaaauauugcaucuuucuguuguagaaucucaguccccaggcguggaaaguagugcaccaguaucuuagccugcaggaggcaaugaagucccggguccucuggugagggaggguauguccccaucgccuggggcucuauggcaaauauuguguuggguguccuuggcuuugccagcucaggcccucagucuccagucaccuggggggucugcccaucagagggcugauuggcugacugaauaaacaugggcugggcgaggucuuggccugcaggcauggugacuugcuggaucugguacagcugcuguccaucugugaacuggcugaacugcugcuuuccuugcuggaccucugucugugugaucuguugggcguugguagcaagugucuggaucuguccuuggacaacuugggugccugauacaggcugggcuaaucggauauauugcagcuggccagcauucagcugcaccgggaucuguuggaucucuccuguguugguaaugaucugcugcaucaccugcauggucuguccagugccacucugggucugcugggccugacccugagguugggccuguacaaucugcaccugcugaccuucuccaaccugcauggucacgggugugaucugacccugcugaggcugugcaaugaugaucuguccaggcuggaugguggucguagaacugguggucugcuggccuugcugcugucccuggaccuggacagcagugggcugcugagccagcgugaaguaguacuggacaggcuucgcaggagucacagacuggcguaccuccuccuggcgcuuuggagguuucaguucaucucuuggaacaauaucgaugagaaagucgaacugaucaaauuuuguaauugccauggcaauaucauuccucugaagaguacgacgcuuguuauccucuguguggauccaggcucgaagagucagcucagugauaaaaaucugggcugccuuagcaaacagcacaggggcuucugcacugaucaucuucacaucuucauccaguuucauaaucuucuuaauaagagccagugggaguuccuguacucggaaaucuuucacuguuaaguuucggauuucuuccaugacucugggccagaaggacuggaggcuuugcugggcaucacugcugcugguaccgccaaacccuccuucuguggacauuuucacaaaggccucuacuccgucgucuagcgaagaaagcagccgcccccgcgcugcugcgccuucgggcaaugcagaggcccgggcgcggcggaggggagggggaagcgugcgucacgaaaaaccggagcgcguguggagcgggggcgcaaacaagauggcggc

SEQ ID NO: 6565 - RNA, 4039 nt, Mus musculus
ggccggccggcccaaggagcccauggaccugagcgcugccgccgcgcugugucucuggcugcugagcgcuugccguccccgcgacgggcuagaagcugccgcggugcuccgagcggcgggggcuggaccagccuggagccccgggggcggcggcggcgggcggacccucgcccgggcuccaggcccuucagcucuccaggccgcugcgguuccggguccccgagcugugcgccgcgcugcggguucuggcuucaggaacggcucgguggugccacaccacuucaugaugucgcuuuacaggagccuggcggggagggcuccggucgcggcagcuucagggcacgggcguguggacacaaucaccggcuucacagaccaagcaacucaagguacuuuacgcgucuucugcgcaccagcccaucccgucuacucuugacuggagacgagccgggggaggcaagccucugcccgauucgauccugaacuaugaucccuauaguuauccucaggugcuggagagaaaaaguugucuucgaagucauuguucacgaaccccuaagccagucaaggcuuggucuccgagggcuaagggagugggagccgcucuucagaacaggcuggcagguuccccucaagccaagcggagcucaagauccgcuucuuugggggaagggucuaguguagccuugggccuggagcccugggagaagaaagaagggcaggaguuguggccuuugaguucccgccaagagggacgagagcagugaugguagugccuuguguucagcgggggacuggggacuauacacaaauugaagcucaggggaauucaggguagagcagcugguauccaauuaaagucauggccucucgguaucagaaggaccccucucaggcaggccguuucggguggaugguggcuuguguaugggaagagaguuugggugccugccuuccuucugugacaguaggccccagcagccagaguccagggccucggcuuguguggggagaaaagggaugguuggagcucaaacaucacauuuuacccuguguagggcccuccaaagguaggaugugggugggguuguggggugguuguaguaugugugugucaucuggcuuuuauuaaucuccauugaagucauuaaagcagacagauagggaaaauuuaacuaauuucaggcggaaaugcaaguaauuuuggcuucaauucugcccagccaaagaucuagcuuggaaaucaggagggaaaggaaggcaaguagggcugaaaagugaggcuaggcagccuuuggcagucugcaggccuuugauaccagcgugggaaaacaggcuguggcuaccacgcaucagccaucucagaaacacacucagugcgcagcauguacgcacagacagcuuuguuuccauacauagaacucucuggcccugacgguccuaugggggcacuuaggaccagcaucuauuuuccaagggucugucauggcacgccacacugacuggugggauccuuacaggaaacuccaaucccagugugcagcagaaucaggaaaaacuccuaaccugucccugcauaggacgcucucaagcugccaacagugagaggggccuaaaguaacagaagcauccgacuuuguuagggcuggcuaaguguacaagguuauaaaaccagcuaauuccuuccggcguagcucugcuccaccagcaagacccagaggcgggccaccuuuucucccucccucccuggggagguagcaaggccgaggaagcggggugaggcggaggcugcagagaagggucuuugagaggaaaagcagggacggggaauauggcccagggccucugucuagcuugcucccaccagcuucaguuuagaacagagcuguggaggcagaacaguacacccagacuguagacuuagaacaccagggccuggcuccaugguugagaacaaauccccaaagguggggggaguuugcauggucucuccgauggggcaaaacgaaaccauaugacccccuucaaaggcaacgccuuaucugcucuuugguggaauuuaaacauuuuuuuuuugucugaguccaccccaaaagaaaaaggacccaugaccagaaauaaaaccccaagcccgaaauaaaucacaccggagcaaaagaaugagcaagucugcaccgcagaaacaucgccuccucuaaucucuccgugaagguucucugcgucucgcugucuuuuccauuccccuugguagccgcgggggcaccagaaggagccaagagcgggguugacgucgucgcuauccuggcugaacgggcagggugggcugaagcagagggugucgcgaugcuuaugcguuccguuucuggacaauuuucaagggcccaauuugcacgggaaaccguggucagugaaggugucuaggcuggguugggagaagaaaaggaaccaaagggaaaagugcuuuuagggaaugagaaguuuucguuuuccgcacauccaggagugcuugcagcucucuggggcgcucggcucagcaguaagggacaauugucacauaaagcaaguuauugggaaagugugugagcgcuuucuguuuggcccccuucaggacaccccugcucagaaaauugaccuaccuuucggcaaaagaaagaugccagugcaggcagcagaacuaaugguuaaguuuuugguccagagaugcgguggugagcucuugggucccgcagucuagcuauuagguguguguaucugucugucacgguggucgaagaaccaaagcuucagguguaggcgacaagaaagaaucccuuuauccgagggauugacaucauuccugcgggaacgcagaugcggggacgcuugcucgcucuuaugguccuuucugggucgcuuuaugugucugggguagccaagccaaacgaagccaagcugcccuccccauugcugcguguccuggcuuuacccucacacuguucuuucuguuucuguccuuccucgcagacgaaacggcggcggccgagccaggccagagcuuccuguucgacguauccagccucuccgaagccgaugagguggugaaugcggagcugcgcgugcugcgccggaggucuccggaaccagacagggacagugcgacccuccuuccgcggcugcugcuguccacgugcccggacgaggcuggcacagcucaccugcugcacucccgggccgccgagccccugggcggcgcgcgcugggaagcguucgacgugacggacgcggugcagagccaccgccgcuggccgcgagccucccgcaaguucugccuggugcugcgcgcggugacggccucggagagcagcccgcuggcccugagacgacugggcuucggcuggccgggcgguggcgacggcggcggcacugcggccgaggagcgcgcgcuguuggugaucuccucccguacgcaaaggaaagagagucuguuccgggagauccgagcccaggcccgugcucuccgggccgcugcagagccgccaccggauccaggaccaggcgcugggucacgcaaagccaaccugggcggucgcaggcggcggcggacugcgcuggcugggacucggggagcgcagggaagcggugguggcggcgguggcgguggcggcggcggcggcggcggcggcggcggcggcggcggcgcaggcaggggccacgggcgcagaggccggagccgcugcagucgcaagucacugcacguggacuuuaaggagcugggcugggacgacuggaucaucgcgccauuagacuacgaggcauaccacugcgagggcguuugcgacuuuccucugcgcucgcaccuggagccuaccaaccacgccaucauucagacgcugcucaacuccauggcgcccgacgcugcgccagccuccugcugcgugcccgcaaggcucagucccaucagcauucucuacaucgaugccgccaacaacguggucuacaagcaguacgaagacauggugguggaggccugcggcugcagguagcaugcggucuggggagg

SEQ ID NO: 6566 - RNA, 30395 nt, Mus musculus
cagaucccgugaccguccgcccgcccgcagccgacaugcaguccccggcggugcuccgcaccuccaggugagccagacccccaacaugcaugauccagacgucccagcagcugacgguuuaucccgcugcaccgcacacuauccugcuggcgugcuggcgcgccgucuagaguccccguuuuacagacaaggaaacugaggcccccuaaaggauccaagcacucacccacgucuccagaaaagccugggauuggcgagauagcgcuggcugggacagggcccagcuuccugucccugcguauggggggaggggggcauuucuuccggucccccaaacauuucugcgcuagcugugugaauagcucgaugcuaagcaccagggacgaggugaauaaaacaaggugucccuggaggugauacccgcaccaaaaugacuggugcugcgggagggggcguguuaaguucaguuggcagggcagcacacugcugcuguugaaccccaacuacgcagaacuaagacccuggcaguuauugcuggagagagcgcaggagcuuccucaaaggggucagagcagugcgcauccacccagggccauacucacagcuagggugaggcuuggaaaggcuugugggcaggguggauguccuacuccuuccucgauuuuuaaguaacucugaaaugaugaacuuuaaggauaaucguauacucugccuuuauuccccgaauacaaacucuagccaagaugggcaaacgggugcuuuacccaacacaaguucauuuguauucccagcucccugguuagaaaaguaugguuccggacguaagcccugaucuugaaagcugcuugcucuccuugguguggugaggccgcaggccacauccccauuaaaagagauguuccuaugacccugugagucguucccuuucacagagccucaguuucccuuccuguagagaaagguuccaucuagagagauaggaggacaggagcaguaaaugucccugugggccaccagacugugacugugaguuuggugcuggugccuagaaaggguagugguggcuucccuuggugcuagcaugcccccgaguguuagcaggcauagugugcugcugauggugaggguggacgagucgugcccuguccaccauucugauagucacagcagacccaaggagcuugccuuugaggagcacagccaccuaaguaagcauugaaguggcccugcacccaagaucagcuggaguuuccagccuccuccugcgcggcaucucugggcuucaugcaguauccauccagcagguguuuucucgggaucccuucgaugcuagacaccgguccagguucuaggauacaguagugaggcuuuggagggaaugggugggcagcgagaaaacguaagcuaugucgaggguaguaaaugcugagaaggaagcugaaugauggggagggaggucaggugacagacaugaguuuuauacgauguggucaagggauaucuuucggagagauggcaggcgaacaagcucuugagaagucucacaguggaaaggacuauaggaaggagagcuugcagugugugcucagcaggaaagacagaaaauccaaaggccgugugcugauguggagggagcguggagagagugagguggccugcaauggagaaaggccaugagguuucauucugagugcggugggaaacauaggcagccuggccaugggagcaaggggacagagaacccguggcugcugcacccauguccuucaggcaccggccggaguggcugcacggaggggugggaggaggggcugcagccuguuuagguucucuguguauucugaaugaugaacuuuggggucugcaggaugguaagguuggcugucagcugaagggcuauacuguccugagcgcacugcuuccugggauagggagcggguagaaccggggaaucagcauuuguucagauggguuuguuuuaaagcaugauugacggucaaauggagauucuagguaaguaagaggcgggaugguuuggagggaagagucuggaccacggguaggaauugggccacccuuggcucuggaugcuauggaaggccuugagucugggugaggucauuggagggcagugugagccagaucaggcugagccuugaggauaaaggaugcauaagagaucuguagccccaucacaacugaggcgcuugguguaggacacagguggguauacugugccugugagcauauccuaccaaccgcuugcuuuugugauuccaguuguacaagaacacacccagaccgggcagguguuggcuguagcugcuuuccuugugugucuaaaggccaaguugaacaguuguagcugaaauaagauagcaugcaaugcuugagauauugugcucucaggcuucugguugagugacccaaguguaucuuucuugcgcguuccagagugaugcuuauacugucuggggaccacuucuugcgaacucuaugucuggaugagguugugugccuaaaagucaggagucuaagggaaggacggggagcauaauugugccaauccaggagggauaaggaaauagaauugugucuaggcacaggagcaaaggagcugaugaacagggcguuuuaaaggaagcugagcccuaggcaugaagacaagggagccaagccggagauggagagauuccuguacaguacacuuagaugguagagccgauacagggacuguaaggacagggauaggguaugaguucaguuccuggugugguugucugugggaaaccuccuugggagguuccaaguggggcuugacaacccuuugccaucuucuaccacucagggugaaccauucagccuguguuaccugcccagcaccucagcuucauugcccugacaagccuaaagaaaaagggccucauuucccugucacagcuagcaaggcugccugggauugcucccugaaacucugacagcaaagauaagcuacuuccuguugaagccuucguuccuaucagauagguaggaccaccugcugggccugccagcugcuuucuccguaccugagccucucucccaugccccucuuguccuugugacagucuagcacuucagacccuggauacugaaaacuucagccucagagaacacucucauuugcccauugguuaagaaguggccuggcuuggggcucagggauuaagagcacuggcuguucuuccggaggacccgaguucaacucccaguacccacagggcagcucacugcugucuguaacuccaguuccugaguuccaaugcccucuucuggucucugaggagacugcacucaugcagacaaagcuccuauacacauaaaauuaaauguacaagagaaguggccugguguaaugucucucaucucacagcaugagucugcuguggaugccuugugaugcuucuccagaugcagccagcucaagccggcagagggauucgugcuuggaaugcgaguauuccuguguguacaaggcuguacagucacuggacacacacacacacacacacacacacacacacauugcauauuucaugcuuuuagcaugcugucccagugugacagccuuguucucaggccugugugugugucuguauguauguuguguugcauuaaaaacacucaaugggaaaaggggggugggggggggggacuggagagauggcucaaugguuaagaacacugacugcucuuccagaaguccugaguucaauucccagcaaccacaugguggcucacaaucaucuguaaugggauccgaugcccucuucugguaugcaugaagaggucggcaguguacucacacauaaaauaaguuuuuaaaaaaacaaaaaacaaaaaccuccacuccaugggcucugguagguccucacugcucucugggagcaaaaggauuggccagcacauccuugcagcccagagagaauucucugacuguacucaggcacggaugucuguccccuaaggguauccagaggaggaagccacuguuucccugcagccucggaugucauuccaagcugccacuguuaaaggcagaugggagcaucuggccuauugaaccuugcugccuucagaacugaggaaguacgucuguccagguucccuagagggcuucaguccugcucugucuucucagacucaggcuccucucuuggucuacauaccccuaaccccucagaauguaaggacagacugacaaggacacauagcugaaugacccagcaccuggagacugggccccacugaccaccucauuggcgaaggcugcuaauuugcacuugauccugaccugccuuccuuugcuuuacagacaaguucagaaugcacacacaggccucgaccugucugucccacagcaccaggaggugcgggguaagaugauguccggccauguggaguaccagauccuaguggugacccgguuggcuguguucaagucagccaagcaccggcccgaagaugucguccaguucuuggugagcaagggacccuagccauggugcucugagggugcccaggcagguaugucuguccccucagaggaaugacacuucucuauaccacaugggccaaggucuggagugcuagacugugugggaugacaggaacgccagaguagaccugugccuagaguccacagcaaggcagacuugcaaagaggcauagagggugacagagacaccugggagccugggaagguguagaagggacaaccuaaugcaccuugaagagaagaugcuggcaacaucuuggaagaggcgaagggaggacaaugguuuaaagaguauauguaugguagcgcuggguggugguggugcacaccuuuaauuacagcacucgggagucagagggaagcggagcucuugaguucagggcuagccuggucuacagaguaccaggaaagccagggcuacacagagaaacccugucucaagagaauagaugauguuaagcaacaggagaggugggaagacugucccagaaacaggacacggguugggauggcaugggaggagacaaggguagaugacuugcaggauucagguugaaccuggacgugucuugcggccauguaguuuuaagugacaguccuaccugccuuuaaccagagcaucuagugacagcaaagcacugggggccauaagacacuugguucugaggacaccauaguaagccuccaugcugggagccagcagaaacagcaggcuaagaggcaaggagagaaggaggugcuuacagugugcagaaggccgagaucagccacacccgccaggagcacguuagaggcuguggugagcgugcaguguucacccacugggcgggcacgggaagcccagcauaggagugguacuuagguaucagcuuugaggcccuguuaagagcugggagugggugaagcuacccagagagcagagguggagacgggagaaaugcugagaugauguccugaaacaccagccaggccaaugacgacagcuggggcggccaucaaggcagaagggaaggcuggcaggcugaaggcaaggaagcuaagggaacagagaacuucaacuaaaagucuaauggguucauacauuuuucuacccuuuggccucuuauggaagggauccagaccuggugagaaugaaaaacgggccucaggaucuuaggcuacgguaaaaugaaccaaaguccuugaguaccacaggggaguggcugcaacgguuugguuuggcaccuccaggcggcucagagaaaagaaaguaaagaauauaacaagccacucccccagugcuguuuuucaucugauugcuccuuagaccaacucuugauugaacccagguggaccgugagccacgguucugggucugcugcguucuaguguggaucuucugugaggggccaguugcagcuccugguggucugacgugagcucagguauacccagugauucugggcucugagggagagaggcagcacccuaggagcccuugggguccagcgcagccuguucugacccgcacagaaggcugggugaaugaaaggucaccugucacacugccacacgccacauuagugcugcaugauccuaaacagugaugcccacgcccuguggaaagcauguuggggcguguacagaguaugggugugcacauacauugcaggggccucacagaccugagagggcaaggggaaacucauuugcuuucacacacacacacacacacacacacacacacacacacacacacacacagugguaucuaaggguguaggccagaguuaugcuuccaggucugcagucccccuagaaugggaugaguuagcuaaaagaauuagugagcauuuugugucuaugccuuagaaggauauauacuuuuuaauagaagcaagcauuuaaguugcuagccaugaaaugaagccagcccccaggcaggagcacugugccugaggucuggcagacacccugcguaucucauuacacagaugugugugugcgcgugugugugugugugugugcgcgcgcgcguguguguguguacguacauacguaccuauuagaggcagcgucgugcuggcccagugcuccgcacuuccugccacgcagagccauuggguccuucuguguccccacuuagcucccuguuguccuugccguguuugcuguuggcugccugauguucugccuagcacacaaguggaugagagcccuggguggugccaggagccagggcuuaaagcucccacucuggcccucacagggcccggcuugugggucuuuggccugagccugcauggagcaguuaggccagcagggggugcucaucccucacuguggccaggcugccgcugccugauccucagaacaacucaggaacuccagccugagcaaccagcuggugcaccaggaauccuccuuacccuuucccugggaguucuucccaggaaaguuccagaaccaggcucuuguguucaacuauggacagcagcuaccuuucccaggggacccccccccacuuggagguuucugggguuccacccccacugccacuauccaaacaucuccuggggucuaagaccuuaacacugggugguguguugauuauugagauguggcuuucugagcccccaaaugauggggacauccagagucuggccacacacuagcauacacucaagguggugcagccaggccuggaggagugggcggggcauccaugccuucauccuuaacguugccacauauuuccuggggagaugggccuggccuccagggaaccaccaaggaguucaggacugagauaaauggaggguguuggugaaggcuguggcauaaggcaagugacuuuugucugagcucauacagauuguacagaucccagcaauggcacuaccaaacccgcggggauuguacagauccaggcaauggcacuaccaaacccgcggggcuauggcugcucaccgcacaggguccagagccagcuggggauuucugugucaacaaaugcaugcucacggagcuguggggagguagaggaggcagauucgauccaucggagcagcuauccugguauuuacaguaaaccaaguaccaccuucagagaugcaagggaccccugggaccacuuggcggcggcagcaggagcuguggccugcuucacccagaccccuaugcaccguugacuccugcuaaccuuacucaucucugucaggaaaggccccaccuguccugugcugggguaaggucacacagugcugucacaagauggccugacaccggccaggugccaagcucacucuacucagguucagaaagcccagaauaggcagaggccagguucaggucccuguguccuuuaccugagccugcagggguaccuuaaaucacuccauuguuguguccuuccuuugggacucugagaugucccuggggaagagauuggggcugggagggguauaaagggccagcaggcaggccugcuccaggcacauaucuggucagggugaggaaacuucucagccuuaguucuucucucaggaaaccccaugcuccucucauuccaggucucuaaaaaauacagcgagaucgaggaguuuuaccagaagcuguacaguuguuacccagcagccagccugcccccgcugccuaggaagguccuguuugucggggagucugacauccgggagaggcgagccauguuugaugagauccuacgcugugucuccaaggaugcccaguuggcaggcagcccagagcugcuagaauucuuagguacccaagguuuugucccaugucccugaggucucugcaucccagaacccaucucaccacugugacucagugggaggcccguugccacccuccauggccuucgagcuuuagcaaggauauuuagggaguugggccucgauaacccccugggcugaauggugagggggagacccagcccacagagugaccucaccauggccuuccuggccaucgucgauguauaucucccuucacgcagacacuugcuguguguccauaugucccucugccuccugccacccagaccugucagccugggaacacugugccucugcuggcuccaucccucgugggcuuuacgcucagcccacgccccacacagagacaaugggugugucugacuucccagcacuaaggaccucacgcucuucgguacagcaccagggagcucccacccccgcucucucuuacaccaguguucucucuaagagaagucguuuucugauggagacuguggggaucacaugaacuaacacaugaagugcuucagacagacguaucaucgggggaagugaucaaaagacccccccuucugucuaccgaaguuccccuagagaagagaagcgucugcccuucuggcccugaauggcagggccaggccacagcuauggauggagccuagcucccuccucaccuucuccgucuucuggccagucauuuaacuuugcucuuuucuacuccuauggaucuccaguucuaugggacagagcauaauucccauaaaccaaaugccaagguuuuaacuacugagugacauucauucacucacucauucauucauucauuuuuuaagacacgguuucuuauauagcccuggcuauuuuggaacucacuacacagaccaugcuggccucgaacucacagagaucugccugucucuaccucccaugcagggauuaaaggugugugccaccacaccuagcugagugauuuuuauuuuuuaaaggauaacuagcuaguccuucccagccuuucacagacagaugcacucacaauauugugugcucagaggcuguggugaugccaagccccuacggacaucucugggccuugcuuccccuuucugaacuuaacuuaucuugaauaccugucucucaaccaugcuuugagaagcacugauggaagcccaguuguccugggaucuuccacaugcucacugcacucauccgggugguaaucugauacugcaagcucuuggaguugucugucuaugguuaggucagcagaguucauggcuggacuuacuacuguaaaaacauucugaaagaaacagcccugguccagccugauuggaccuuggcuguugcacuucaccacugcguuagugggcaguuaucuguggcacagauaacucuggguauuguggcacacucuccucuggcaugacauagcccucuugaauucuuagcaucugugaccacuuaccuguuugugagcuauacaagauuggguccaguaaccuucccucguguggguaggaggggcucacaaggcccuacaccuccccaggggacacacagggcagauggaagaacagacaaauagagugguaugauggauagauagguagcuagucagguggguggauggauggauggauggauggauggauggauggauggaugaauggauggaaaggcagauaauuaagauagacggacagacagacacacaguuaacaguuguuaggagagaggcuuuucucacauaguguaacuguuauaagcaccccaugccccuguaaguagccccaguuaauucagcucguuaagcuacacauggguggaauccuacugcuguuaugcagauagcacccuaucaacauagaaugucucccuggaaaaaguuuauaaaacacuucugggaacuccugccuuaggcuucgucugacguuccccauggccaggcagcagcggggucccuugagcgucaugucacauagugggauagcacagcacuuggcgcucuccagacucuccacuuaggugucaggagguuaaugcaaucccucagccucagaaccuggcuuaggcuuaggcagguggguguggugaugucgccuugagaguagacagcaagcucuuguuuuccuuuucuuccacaggcaccagagccccaggggcuacgggccuugccacccgagaucccucugucuuggaugacacagccagccagccaggggacagugaugaggcuuuugacuucuuugagcagcaggaugaagugcagccacccacacugggccugagcagcaaggauguggagaaguccuuggugggagaagaggaggaggaggaggaggaggaggaggugcuggauccccuggguaucaugcgguaggucuccacuucuuccgaugucauuuguucaaggucugggccauggggcuuuaaccuggugugcucaagagaguuggcucagcuccgccgccucaguaucacccgccuuuguggcugggcucagaaucccccgcccuccccagugauaucccccaucuauggcuaacuccacagaguuaaccccacgauagcucgguagcacagacugcugggcccagucugcugccauugggacccggcuucuccuugcagaguggcaagugacuuguuugcccccagagcaugcuucaccaucuguaaggcaggacuuccuucagcuccugcgggacaauuggagaccuccaugaacauggguauaagcacccuuggcuuuacuccucuaggaggcaucccgccaauuagacggacgcuccugagcgcgggugggcggcauggaucucccugugcuggccauggggacagggcacaggcuggaggaggagaugcagaggcaggcaucuccugccauagccccuccaguggaagcaaugagcugagaacgcaauggcuucccuaauggaaaucggcuacucagucaucccagaauacuuuuguuccuucuuggcucaagcaacgagcaacugauauuuucugugcuaggcaugguauuguacuucccaugcugagccucaucuguuccuugccuguaagcaucaguuggaggcggggaacgguacuagauuggcacugaguuugagggcuuucugcugggaccugaguucuaguuccauccuuuggucgccaaggcuccuggcuaucugcaucuucaguuuucuucaguaaaugagcgggcucuuggaaguaccugcuuccuggagcaguccagggaggaucaucugaugugcauagauguuagcauuagcugucgucauagacucuacuuucagcagaaccugaccaccacgggccagggcacuguccucagcaccgugacaaaugggucuuaggaauuuacugcuguccccaguauacagacaggaaaggccugccugaaacuagagccgccgaagaaucggacagaggcguguucaguguaaugacauaccaaaugaagucccccaaaucggugcccgcucagcacgggucuucccccagugugauaugugagccaugggcugcagaaucuugaggucaccacagaggccucacacuggccaaagcugcccaggcaggcacagcggcugccgcaggcccacaggaauccguggccucccgguacucuccagccagugagggucugguccccaagggucaggcaguaagggucccagggugacauggggagacaccuauaaugcccaccccuuaucggccucgcccagcccuggggcccugccauaaggccuuguuugcacucaugccaucugugguucuaaguaaccaugaguagugacaaacugaaauggacuucugaggcugcaccagccuuuggcugaacaacagaguuagccaaguggcuccuuuuuuggguaggaaacugcuccuggcugccaagugcugccuugaauuucuuucucuaguggcagaguugcggguggggacggggcggaggucuuaggugccugacagccagccugggaccaccugcagcaagcucugugcucuuggggggccccuggcuccuggauuccgggaacacagcaccaagcggacuccccuuccugccagauuuuuuuuuuaaggacccaugugacacccaguugguauuaucggcucugucaggcauaauaaguaauguuuuucgagagcuuuuucagugccaggaacugagcuaacugguguuugcuugggagcucaugcuaccucugagacuugcacuucugaaaugggcugugacccgcaguaagugcgguaugcgucaggacauguguaugugcuucgugugggaccaggcgagguacgagagcacagggaagcucgcugagugcacuccgugcucauggcuccucucgggccucauuugugaaaagauucauaaugugccaaauggcuuucugggcccauugccggagccgcuugggaaagggagcccuggaggcugacacugggcauugcuuuuguuuucugugguaggacacuggagccucugagagucagauggcuugagcucguucauauaaccccaaguggcagcaccagggcuugaggccacugcaggcaucuuucagcaauguggcaagagguaggguggggcccuuacacauagggccaucaaaagauucgcccaagcggggacucggccaaagccugguggugugguuugcuuucuaccacugugauaaaggccacgggugaaagcaacucagggaagaaaggcugucuuuacuuggcuuacgcuucagguucaucccugagggaugagagacaagaacuaaagcacagagcagggaagaacgcuacucacugaauugcaccuccuggcuugcucgguuugcuuucuuacacaacccaggcccaccuacccaaagguggcaccgccccuguggcaccgccacugugggcugcgaucucccuccucagucauuaaucaagaaaaugccccacagacuucaugaaggcaaucugaaggaggcuuuuucucagcugagguucccuucucaggauacucuagcuugggucaagucaacauacauacauacauacauacauacauacauacauacauacauacaugaauaaacaaacaaacaaacaaacaaauccaucugguaugugacagagcaggucagguuucccacucagacacaagggcugcccaccucacccuuuggggcauucuucuuauccucgagagcuuuguagucuguauuuccucagcaacucuauacacacaucucauauucccugcuguggccacaagggggcgcucgggcuccauuucaggagugucugcaagggugggagcaguuggcacaaagcggagucugccgggccuggcuuuccuuugucucuucaaccugccucugacuagggaaaaguccgcuguguuauaccguuauggggcacagaaaagcccccacucuagcccauugaaacagcauugcuucuuauuuucuggguuuuuggguuuuuuuggguuuuuuugcugacccugucccagagccaucuggacucuagacauagcguucacuucaccauuccaauuaauguucugucucaggcgccuuucucugucauacauacuuaccguauuuaacucgauuuuagugucuguguggcucugagaaaaucgugccuugcacuagaaacauuuucaacacaacucaaaacuacccagguccuagggacugauuggcgagagucccuucccucccaggagcagggauauuuccugcagccuucgcuucucuacuucucccugaacaaagggauuguuucgugucugugccuccacaguuuggaauggucucucuccagacucugagccagucccucagcccagucacugcaaacugcacugugagccccggcuugugguaccuuucaugggcuuuuguuguggugggcuauaaugugaggaacuucacggguccggagucaucauuccauagaacuuuucaucuaaauaauagccucagaacaaggccccugaagguucugcaggggacaguaugauaaaagcucuuuggggcuacacauuuacccuguugaaggucccucuucucuuccaccccuccugcuacuucuccagccugcuugcuggugacagagaacacagcuggcucuuuucccugccugugagacugguuucucaggcucucaaagagaggggagagccuggcacccaaguggagaaggccuuuccuuggauacuguuuuaucauuaguuuuauauaaauuuaguuucauuuuuuccaugaagcagccacuucuguugaaccuaaaaauggcuuuuuguauuuagaugaaauuucugcucugggaugacccuccaguuuuugcccguagacacccacccacccaccacccgcuaguccuccuggauuugcaaacccagcaucuagaaucucuggggccuugcccccuccugccuccaagcaacuguggaaugccuuccuugggugccucuugcuaaguaaauaacaauauucucaacuccuguccuggauucugagccaggagaggaagccuuugcuggauacuccguugcagcagagagcaguuaggggcuguguuucagccuggaaccagguggggauacagauucccaggcccccucggcccugcguggaaccauggccucucagugagucugugugugcgagucaugcugauacuccaggcacuaaaguaugcagaagucugagagaugcccuacacagugcacaggugaacagggauccccaguccuccuagucuccccaccccugcuccccuugacacucucucucucucucucucucucucucucugcugucugucuuuacugcagugguucucugaggaccggauaccauaguggagcucccuaggagagucaccauggucccacgucauggcuagccccaaaguaggaagggagacugagucaaaacauucagccacacuuaccaagggguacaguuaucucugcuguguuucccauccagguaccuuugcuccuggcccagccucagugaagggacucuggggacuaugguuagcacggugguuucuguccuuuuuauuugauuagcaaaggcuucaagagguucacgaggaaagccucacacagaccccuaaugcaacgaccauacccaaguagaauugucuucauuugaacaggcauggaaacuagaucuuuguccucuaaaguggcccuagauaacuuuagaagagucuggggccucuuguagcaucgcucgaaagccaucggggaggcuggaacuccaggauguauggucacccccaaagggauucaaggguucagcauucccaucccagcucugaagugggccgagggcaguuugcugacuccaagcuguggcgucuucagguauggaacaguuaggguuuccgaagcaaagggaccuccagugggguggaggagugggggcugucuagcguuucagaacuuuuacacuucccaccaaagcccccaagggucuaggcccaagaguccaaaaggaagaaugcagaguucuugguaaaauguuguaacuaguuuguacucauccugaggccuucaugcgucuuucacuucagaugaacuauagagggcguuagcuccuauuguugagcaaaucccagcgccagauccuagcuucugggagucccuggauggcaccuccugccaaggacagcggggaggcuggcuucccucccacagcgcugccccuagaggaggcgguuugcuaggcugaggccuuaauggauacuuaccugacuccucagucaugggaggucaugucuaccacccuccugcuugaggcuguccccaacaucaaguguggcacuccguguucaguaggucagacuuggcauucuggguaacaguuggggaacauuaguaagacagcaggcgcaugcagagaguagguacuucagugaccagguggguggcucagacucuucaugcccagcugagaccacuaccuacgucaagucuggacuucuucaguguuuuguuucuuggcuugcuucucaagauaggguuucacuguguaaacuugacuguccuagaacucacucuguagaccaggcuagccucgaacucagagaucuuccugucucugcuucccgagcgcugggacuaaugauagcauguacagccaccacccccgacuuucuguuuuuauccgcuugcucucuguuuggaugccgugggugaugaugggcagcucuuccacaguggcagcaauuagaauacugugggaucuugauggggaccauagaaaagacaaugcaaauaagaguguacaaagacugcucgcucggucugcgguggccagggugaaaccggccaccagcaaccuucauugccagagacuccagagcagacaggcagggagugagaagccucagaguggacaaaagggaaggcaagguugcacugucacugggggaugucagcgugggcaccaagaagcaggacuucuggguccuagggaauuguuaaggagguguuggccugcuuucucugacugaucccacuaaauuggaagugaagaugacaguuaagcaucccagcagguauucaucacgcuuggccuuuggggacuaacagcugcauagguaguuugcugcaggcucuggucagaguguccauauaaccuggcccuuguccccuugugcauguuguaucucucggaauaauugcagccugagcaaggcuggauauucaccucaggccaaaggguugccccuuugcaagugagaccacuugcucuccuggugguaugucguagguagaagacagagaaaaugaaauggugugaccccaaaucuaagaagagggagucacuacugagguccuggucgcuguaguaggccuuggcucuggaaagcuuggacaggcuuaggcuguggccguugggauucacagcacugaggccuguccagggugguuccucacaccgggccuguuuuccuguuaggcccauuaucauaagccggacaucaugagacgaccucaagccucuggucuugcccacugcccucuguguacaggcugcagagagcuuucguagcuccucccccugagucccacuuaccaaauuaagagaaaggacuccgaggcaauguggugacccaggugugccaagcuguguucuugcccgugcuuccacagggcauggcuacuauacuccagcucuucuacccagucucucccugaaguuccagacuauuccaugaggcagccugacccuguccugacaguugcugcccuagguaaagcugugcagggauaagguucagaaaggauggaggagauugccuaaacaaacccagaguccacauauaaaaagccaggagugcuggcauacacuuacacacugggacuggagcacuggagacaagugaccccuggacugcacuggccaggugucuuagagacccugauucaaaaacccaagguggcacagucccaggggaaugacagcugagguugucuuugggcuugcacacacacaugcgcaggcaugcucacacaaaaaaagauugcuuuguggcacccuaagaauuuucuacaauugaaauaaacagguuaagaugugggaaacgcuucauuuuuaaaagcaagaaaguugucuugucggggaagaggucuguugccauauuuggugcagcauggcccuggcauugaagguggucugugugugcuguggacgcccagccuucuguccaggcccaggcgggcugcccgugucuguagacccucucuguuacucccuugcucucagguccagggcagcuggugcccgucacugguugcuacaggagguggaugagucuggaaugacuccacgaggccccuggguggccagagggaggcugcucucaggugucaaucacugucaccagaagugccugagccacagggagugagacacuucuuggccaggcagagcuuuggaacugucagcagcagcugccacaucuccccgaguuugcuacgcccggcucugaacguggcccggcugugcaucuggcuccugucagacacacaguaggagaacuggagucuguacaccagcaugaacaugcuuacacaugccugcggccacacagggaccacuaccuaucucacacagccugugcugggcaagaugccucuuuagguagcccucaggaucugcacagguuugccaggaagucaggggcugcagacccugcucugucccuggugucaggacauggcuuucucuccugucagcgcggagggugagcugcaugucuguggccagcuggguggaggcguuggccuuggggaguguaggagaagcaugcacagagccccggugacucaaauccacaugaagugauugacccaauccauccaacgcguagguuaccauucuuguaauggugcuguaauguccccucccaccagcauuaacccugagcuucccugucucccugcugcuuuguuccacaagucagacugucugugagcaaagcuccaugagggauggcuucccccucccucaucaccuagcgggguuuauguuccuugucaugccacagucgggcuccuucaaugugcggggugacuggcagcuggucugccagagacguuccucuccccucagcccacuagcuaagcugccguuaccuccuccaggagucccucccugugccuuccuugaguccucugugcuccagcugugacagccuggcuggcuggcaucucaggugggucugucugcaucaccuagagcaggcaccucuacaggggcacugcuuggggagugcugguuggaggaaggggaggaggaggaauggacaggcugcuugcugcugaaaggcuggcagggguuauuguuagaggagcagcgauggaauagagaaagggcuuuguaaacaugagcgcugacaacugcugcucugaccccucauucccugucuuauuacuuugucugucugucugucuggaugccugccugccugccugccuguuucuccuuccuuccuuccuuccuuccuuccuuccuuccuuccuuccuuccuuccuuccucccucccucccucccucccucccucccucccucccuuccucccuuccuuccuuccuuccuuccuuccuuccuuccagucagcuaaucugucuuccuucuaucugaugacuauccagcuacacaggacagaugccuaucugucggucugucugccugccugccuucuuccuuuuaguauuugcugaacaccuuucugcaguuuuaggaucaaucagacaagacccugggggcuuccagguccccugaugccccuuguguucucgugggugaucugagggauuugaggacaggaccgccagguagcuggggcaggguagucagugcugacugaacacuguugugcugagcaucugcuucaguucagugcagcagaaaucacagaugucaccaaggaggacaaagaugcgugucaagcuugugagggaagcucgcccagaacggucuagccuuaucuguguccguucaggaggacagacggauggucuagccuuaucugugucuguccuggacggacugagcagaacuggggaagugguuggaaccucccucaccuggcuucccgccuguucucucacgcacugugcuuccugcuguucuugauccguaggcggcuuugcuccccugcccucugggccuuuuaaguggguagcaugcgcauuggguccccaaagaaagugguuucugaguggagggcaaagcuaccagaauggcugaggaucagccucaagcccugaagugacuggccaggcacugccgauacagguguaaaugggguucucugccagucacugcugcugugcccacuggauccagggccaggggccaagcaaaggacauuaugauaggugaucaagagacggacauauuggugaugaaacagagccuacaguucucauagggcuggucuaagggccccccaaccccagucgauggucacauuccacagagccgugcucacagcuuccauccagggccuucuaggcauauugacacagggaguccagacucuggucacccuugcuagggccauggccucuguuagucaccaggacuguugauucugccugauagauaaaacuacaggggcgcccucccacaaggagcagcugaguccacccugcaggaucugagaggagcuagagccgaggcuuucugaagggugcgagcuagcgagcuagcgauccuucacccacccccagcaccacaggcaggccagagcucuguuggcacuucaccaugguggccccuguugacgugcacauacugcaguagggacacagaugccaucacuguugaacugugccacuuucaccccaguggacaacacagacaauucuguucaugggauauugagaguaacaagcaaagucauaaguauuguccuaguaugaucauaauuaguuacuacccuacucccaggcccaaaauguccagccugcuaggcgaucuccaccagacacgcuaugccucugaacuggggugggaggggggugguucugcaggaauagucaccucagagucccuggccuugcagcacccagggaccugguauuuuuaucugagacuggauagucuguguuacagcuuuuggcaauggccagccucugugcaguuugccacuguguugccaacaugagcucagaggugaccucagcccaguggaaccggcugccaggcgcuugggagaaugcaauccuggguuccaguaaaaaggaaaaacaaaacaaaacaaaaaacuuuugccguuuauaggaaucuuaaaaugccuaacguggguggcagccccagagcuugaggucagcuuguuaaaauaaaaccaaguuugugaucuggagacagugucacaaaggcagcccagaucaugugauccagcaaacaugaagcuugccuauccaccuggaucaagaaauaaaacuguggcacaccccaagaaaccucucuggugacccccaguuucccaccacaagcaucucagggcaggagcucuucagucagggaacagguguggcagagccaagcccaccugacuccagaggaacuucagaagggcuacccuacccagggggaaccacauuguugcuuagaagggcagcagguauacuacuuagagaagacugauguucaauguccggcaaagcagggcuuaggcuuugugaugguuaauauugcccgucuaacaggaucaaggauuaacuagaaagcuagccucugagcguaucugugaaggguuuuuggauuggacuaauugagguuggaaaccccucccuaaauaugggcagcaccaggguauggucugguguccuggacuuaauaaagggguaaagcaaaccaagcaccaacauuaacccccacccugggggggccgccaugguagacaaaccgugaaccuaugcaaucccugccuucuugaaguuguuuuguuauuguuguuguuguuguucauuguuuuguaccagacaaaagagaagucacuaacauaggcauccuccugcucuccuggacccuaucccuugaacuuugagccccagauuacaucaaccccaugucuaaguggcuguggggugcaggcuucugaccccaaggucucuguuagguagcuccacugucuuaguuaggguuucuuuccauugcuaugaagagacaccaugacuaaggcagcucucauaauggacaacauuuaauugggacuggcuuacagguucagaggcucaguccauuaucaucauagugggaagcauggcagcauccaggcaggcauggugguggaagaguugagaguucuacaucuuguuccaaaggcaaacaggaaaaaacugcugucuucugggcagcuaggaggagggccucaaagccaccccuacagugacacacuuccuccaacaaagccacaccaacaaggcucccugggucaagcguauugaaaccaccagucaccuucagaagaaaagcauguugucgggcccauggacaugugguggcaugauacucaagaagguuagcagcugucuggccaucagucuguaguccugauagcuccuugcuucuccugccuuucccaguccccaucacaccugagcacaguagugggggcucaucacuucaguagcgggugugggggucucuuugcucuaugucagaugauaacaaagcucauuccuagcacauggccaacccugccuccucccuucucccugcucuugccugcuugacccccuugggucaggaggaccugucagcugaagauuugacgacuacuaagguugcuucacaugccaagauggcucugguugggcuaccccugaccuuccuaugguccuccguugaacuucuucuauguuccuuggcauccagaaggcccagcugagcuggggaccuggaaaugaccaguaggcccccaguauacucaugagaauccuuaccuuguguuuuaucuccagcuccaagaagcccaagaaacgcccagaaguggccgugaggcccaagccugcaccucggcucaccaucuuugaugaggagguagacccugacgcggggcucuucagcucagacaagaaggugucugagacccggagaccccuggagaccacacaggacuguaaguacuaguguuguuccugguacuggcuuagagcuuggugaaugucuaugucccugagaaagugggucucauccuuguccuguuuagauagaauacagauuaggaauauagagacuuccuccuggugucucucacaccugguguucccacgggcugcaacauuuggggauuacacacucacucugaauguccuauagagaagagaagguccggcuucuuaguugccuggagaccugguuccuuaauuacaucugcagccacaggggcacagggaucccugcaacuguuuaauggaacauggauacugaccuagcuuugggcgugcaugugacucuguacagcuuuuaauuuuaaugaguguaugccacccacauagauucuacugcaaggcgugguacaagguucagagggaaugcuuagaggcuuugggacuuuuccacaugucucugaccuuuccucaugccugcccagggaaagaauugaugguaauuuauugauucacccagugcuuacugagcauccacugagggaagauccagcucaaauccccagccuuaggauuucagagcccauggaggauaaagauagauaauaucacccaaaaauucagcacagcccaagucucuuucagggcugagcagagagauaccgguucccauaggacagcaggcuuucugggagagagugcagugguggaucccaaaaggccaggaggcuuaaccgcguccacugggaaaagacgcuucaaguaaacacacgguugacacucccaaagagaggcucacgugggagagauugggaaggcccgggcuuccugaagauggguccuguggguaauuugugucuguugcuucugcucaucuuucacaaccuugacaagaucuguggcugguggcugccccucaguaccugcucauuaguaccugugggcaagcucagggacccuguccagccagagcucuggggauccuggugcuauguccugagaagccacuuccgccagcagugagaagcccugaaggacuggaacagagccaggccaaggcggacaggccgcucagacccguguauugcugcuauguucuugccuuccuucugcccuccugucucccuacacucugccuuccuugcucgcuaaccgggaugcaauaggaggcuuagcaggccugcucucucgcaucugaggauagauaagcacuuccuuucucaccugcuacgucuucucuccccacagcccugaagcuguuugaugacccugaccuuggcggggcugucucccugggugacccucuacugcugccugcugccagugagagcagagggcccacaucccgcccagaacacggggaugccuccaaggagcuguucagguacuccuguucccugggaagacuucauuagcuuguaagccaaguacaagagugucauaccagcuucagcccacaagggaggagggauccaggccuggccaagucucgcagccaugaguagcuaaaagaaugugaggauuuguaaggagaaggcugugggcaaccagggcagccccacuguuuccaugaacuacacucauuuucuucucacacuuucuguuuuaauagcuucuuuaaaggaauaaauuacauaauuuaugagcaaguauauuuggcauaggugaguucaggaacaaauaaaauugacccuagauauacuacagcauagucagagagaaaaaaagcacagagguacuuagcaacaauggcccagucugccaggaggggccugucagagggagaguaaagccaugguuaaucuguuaagugaagguugaugucagaagugguuaaaaaaaaaaaaaaaagacuguuuccuuagaguuuacugugugcuugucauuguaagaaguuugcuucacugcagguaaguuuaucuaucuaaccccuacaaugggugcuguucucugcaauuacagaaaauaguuuagaaaagaacacuugcccgaggcuaccacuccugccugccucucucaacacugcucuaucccagcagcagcccugagcccuuggagaagaggcugagagaccuguuuugcugucucuggcugccuuucucccugacuucuccuugugccagaacccaguuuccguuugcuuccaguauggugucucucucucccuggccaugccacacauguuuggugcaggaagcugagcugccucuuuccaggaauaguuuaaauggcaccgaggccugugguccuuagaggcugucaugagcaccccucauuagcagccccaagcuauuacacagcccucuaaguacccgccaagccugacucaccucgauggcagucuuguguuuacaucucccagaggccccuggcaucuguucacucucuccuccuguguccuugcuccugacauccugcuggcugggaggagccagaccaugguuauuccacuaggggagaaacugaggcacagggaagucugaaagcaggguauguaugcccaugggacggacaucacagggccucuccugcauggcauauuauaaacccuucccuuucaaucccaccuuccacagagcauuguucugugggugugucgaggcaauuuucacagaacuccauggccagcugacaccagcuuuuagcaggcuugucaugcacacgucaacgcugccaugccgcaauucaugacccuauuggucccugggaaccuuccuuuucauugcaccucccuaucuugcacagccccugggagucacagcucagagaaugugcacuucgcaucccugucuccauuaacagacaucuggcggugaagaacuggcuucuugagagagggagccaggauuuauuuuucuuuaugccuaccuuguuccuguuuaggcagugaguggccugcuucuugguagcaggcuuucgcuguuagccaccggccugagguggcagugucugaguugaugaguaagccaagcggacguuaagaagccucugucucaggccuuagguggaucuguagcugaguucuguccucugugggggcugaggaaggaggagaaugucauggcuucaggacacagaacucuucaggaugaccaccucaaggaacaacggcugccuggagaaagcucauacacaccagggcugagaccggcgggaacagucuucccauggaugacacccccagcaucucccuacaggggccagucuuucuagaagcuagcccacccauucccuccaugucuagacuuuuugcugguuucuuuaccacccaagcaggcucugaaagccccagucagcccagaaaucaggcaggacaauccagagcucccaagcagcuggguccuggcgggcagugcucugggaagcucugugcucagucaggccucuuucaggcuuuguagggccagagcauuguucagaccaaagcaccucuguccacgccuggccccucccccaccgcaguccugcugggguagugauguaagggcacacuguccagggcagagagccuccaucacaggccugaauccuuuuggcuuuucauucccaccgcccuuugcucuccgucauuucccucuccaggauccugccauucuguggcagggccaucuuucuucucccuuuccuuaagaacccguuccaaucuuuucuggccacacccuuccccggccaucaagugagugcuucuuagccccugucacucucagauccucucuguccagcuggguugggguuccccgcgggaggagcgaugcaucagcucugugacagccgaugccugcucucccuaacauuccucagcugucgguccaagucagcaugugcaagauccccucgaacuugagaagcaccucuuguguguugcuuucuuugguccuuacagggaucccugugagguuagaggagcaagagcaccccuucuuuacacaugggcagagacugagagagccagagaggcggcguggccugaggccacccacucgggagcugacaguagaagccaauccugcacacagcugcuggacuccccucccccuccccuuccuggagaugggggagcugagugguccccggguugucugcuuucuauggcuguguugugucuaccuggcauggcugaaggauggcuguggagauaaccgucaccacaagggacggucccauccugaaacuggagaaggggccuccauguagugguacccaggaaggugaugcgagccagccagugauauaggucaggugcuucauccucauccuagcuauggagcccaagacagggcccuucaucuugccacagcucaguuugcaccucuguaaaguaagguucaugucugcucccagacaguguuuaaagcaucaaauaaaacuaaagaaggcagaagcaccugcccuguaggagucgccacaguguugaguaggcugaugggcagaaugcguuaauggagacuuguuuuguccaucugguucugagauagcuccuccgcuggggacucccaauaugagcucucccaggcuaaagacaggugaacugugggccauuggucaggcucuucaguauccagacacguuccccuccuugccaaucacuacuaaagccucaucccgucagccugugggcagucuaggacuugcuaucuccuggacauuuuuaauuuuguuguuguuguuguuacuucgggugucuggacguauaugcacauguaccugugcauugugugcacagugcucucagaggccagaagagggguugcauucccuuggacuggaguuguugcagguggcugugaaccugcguccccuggaacagccggugcuauaacugcugagucauugcuccaagcucgcaugacccaaucuuggugagaacuggcugaguccggcagcucagaauccagcucuccaggcugcccuggccugugucuccuaggaguugauuuagcuucauguugcccagcucuccaggcugcucuggccugugucuccuaggaguugauuuagcuucauguugugucuccuaggucaagacuaugaucuagugccucucauugagccacccaggcucuuggacuguagcuuccugucugccaaauaagaaacauauauguccuucccugaaauaggaauuugagagacacagagaagauaaugauucuggggugcucuggcaaaggcugggagucuguaccaggcggcaggcagcuguuucuaaugggcugggaggcaaguccccugaagacaccagcagguuugaaguggugucaccaccaagggacuggcucuccucuggcugcuguggagauggagggucagagagcccugcccuuggguuucuccucagugcugguaggauaaggcaagcucagugcccauguggggaauggcgaggcuccgccccuugcuccuuuguggauauaguuaugcuaaggcuguucuccuugcuucucuagaguugaagaggaccuggaccugauucugaaccugggaucugaaccaaagcccaagccccagacuaagcccaagccucuagucccagcuaagccagcauugcccaggaaaccaacucugcccgcaucagugggcccgucagaaccugggucuggaccgcagaagcagcaacagauccaagcuauggaugaaauggacaucuugcaguauauccgggaccaugacacacuugcccaagacucccccagccucuucugacuuccccacaacccugccuuucacccuaugcugggccuggggaggaggccuguaugugacuauguggguucugcuuaccaggcagggacuccccagccccagucccacauccuucuuuucucuugggcuaugggauggacaaggacucucugcagacuguagagcugggaacaccacaggaauuaagccguaucauguccacccagcgggcuauggaaaggagggcauuugugagcaugucuugagaucagaggacagugcccccaccaagggaaaggacaucuucuucauacuuguacccacuggcucugccagcucagcaugggaaguggggcuuauccugagccuaggcugggcuaaaggagaacaugggacaggccacucugaacucucuacuuagcauggcugcucgggcccccaagguguguucugaggagaaagaccagcucuccaggcugcccugacccaagucccuucucaggcucuucuggcuuccaaugcuaagaagaaaacguagucccagccuugccuuucuagugcacggagggcuuccaggaccccaagccuucuacucccuuucccacgagagggccuggccagcccaugguccuuggauguggcuuucaacaaaguaggucuuagcaucucccagaguuuagcccaugggguuugaggcucugaggccucgucugcccucaggaucugaacuugcucgucagccuuucuccaguggagccaccagccaagcugugcccagagcaacccugugccuuccaguagaugguguuuuguggagcauagaauguuagaauguauucugugugucagggacuuuuuuuuuuuuaaugaaacacauuuuuuuuuaaaacaaaaugcagccacuuuguuccuugggucaguugugcuucacagaggcauuagaagggcccaguuggguccaagagucacuuucaggagccccugaguggcacaguucaauuguuuguugccuucaguaucuuggguccccagcuccuacucuguaguaagaccuacaggaucagacuaggaguaucaagucugacagccuuucaucucacuguguccccugucaccugccuaguucugagcagguguccaagcuguucuguguaaggaccggauacucugcucuccuagguuaagguccccagagcugaggacugacucuagacagccuccacccaacucugcuucccuuucaccagcaggccuucacccccuccaucucuuggugccuagaacucagcccagugcccagaagccccuuccucucugacugcggaggaagguucacguggcccaaucuuuuguagagccacccuacuguggucccugggcaucuuugaacccuagucccuuuauauccauuccugugugccuuggcuaccagcucucuaccucuuucauacacaccuugcaccuacuuugggugacagaugacauaggagccaauggguguguaggagcuuggaugaccauggacugauccccacguggggucccuaacaguaucugaccugaccuaccacucucuaguguggcuuugcccacuaguggggacuugucugcuguggagcuuuugggacacccuggcaugguuguuugccccacagauagcauuuuuccaaucaugacuucuuuugaucacuggucugugaccuacagccagucugucucccaguuauccaguaaagucugugugugauaaagccagaau

SEQ ID NO: 6567 - RNA, 572 nt, Mus musculus
cuagguuaagguccccagagcugaggacugacucuagacagccuccacccaacucugcuucccuuucaccagcaggccuucacccccuccaucucuuggugccuagaacucagcccagugcccagaagccccuuccucucugacugcggaggaagguucacguggcccaaucuuuuguagagccacccuacuguggucccugggcaucuuugaacccuagucccuuuauauccauuccugugugccuuggcuaccagcucucuaccucuuucauacacaccuugcaccuacuuugggugacagaugacauaggagccaauggguguguaggagcuuggaugaccauggacugauccccacguggggucccuaacaguaucugaccugaccuaccacucucuaguguggcuuugcccacuaguggggacuugucugcuguggagcuuuugggacacccuggcaugguuguuugccccacagauagcauuuuuccaaucaugacuucuuuugaucacuggucugugaccuacagccagucugucucccaguuauccaguaaagucuguguguga

SEQ ID NO: 6568 - RNA, 572 nt, Mus musculus
ucacacacagacuuuacuggauaacugggagacagacuggcuguaggucacagaccagugaucaaaagaagucaugauuggaaaaaugcuaucuguggggcaaacaaccaugccagggugucccaaaagcuccacagcagacaaguccccacuagugggcaaagccacacuagagagugguaggucaggucagauacuguuagggaccccacguggggaucaguccauggucauccaagcuccuacacacccauuggcuccuaugucaucugucacccaaaguaggugcaagguguguaugaaagagguagagagcugguagccaaggcacacaggaauggauauaaagggacuaggguucaaagaugcccagggaccacaguaggguggcucuacaaaagauugggccacgugaaccuuccuccgcagucagagaggaaggggcuucugggcacugggcugaguucuaggcaccaagagauggagggggugaaggccugcuggugaaagggaagcagaguuggguggaggcugucuagagucaguccucagcucuggggaccuuaaccuag

SEQ ID NO: 6569 - RNA, 2351 nt, Mus musculus
caucugccaccgcaguucgguugucgucgucugcgccccuguacccuaggucuagagugaacccgccccgggaaagaagcuaggccggguccgcagcaucagccaucacuucgcacaaagcagcgcagcuccgggaccgccgaggaccacagcggcgcggcagcggcgcggcgacacucagugcaccguaugccccugcgccccugccgaggcaaccggagcgccccgagagaccgcgccgccgcgggguccaggugcaguuagcgagccuagcccgcagcgcgcagucgcgggagagcggggagcggcaagcaacagggagcgggacggcggcgaggcgcucgcgggccccuccugcugcccgcgcccggcgagcucauggcggccauccgcaagaagcuggugguggugggcgacggcgcgugcggcaagacgugccugcugaucguguucaguaaagacgaauuccccgagguguacgugcccaccguguucgagaacuauguggcggacaucgagguggacggcaagcagguggagcuggcgcugugggacacggcaggccaggaggacuacgaucguuuacggccgcucuccuauccggacaccgacgucauccuuaugugcuucucgguggacagcccggacucucucgagaacauccccgagaagugggugcccgagguaaagcacuucugccccaaugugcccaucauccugguggccaacaaaaaagaccugcgcagcgacgagcauguccgcacggagcuggcccgcaugaagcaggagccagugcgcacggaugacggccgcgccauggcggugcgcauccaagccuaugacuaccucgagugcucggccaagaccaaggagggcgugcgcgagguuuuugagacggccacgcgcgccgcgcugcagaagcgcuacggaucccagaauggcugcaucaacugcugcaaggugcuaugagggacgcguccugccucacgcccuugccagcguggcucccccuccuuggcccggucgcccacgaaccgggagaaagggagacccaugcccccaaggacaccaccagacugccugacaucugcugguggcucuggcuggucacgcugagaauuagcgugggcaccgagcucccccuucccagugucuguguguguccagcuguguggcacaggccugggcacccugcugagugccaagggguuccugagcauccuuuucuaaagagccaggccucaaagugugguuguguguguguacgacucccuacaccccacccgacuccugccccacccccgccucugguuuccccaggggcacgcagagugguugcgcccccagcagguuugcuuguaaccagcaagccacuacuguugcuccaugucuguaacauagaccccuggaauggcgggaggggagggcuggggggaggauggggcuguuacauaaauacagauuuuauuuucggaggcagaaugguauuguuuagugguguguggggcgaccagggcccagagcagcuccuuucccaggcugggucaggcgcccacccauccaagcaugaacuggacuuggccaucuuuccacacccuggggaagacauuugcaacugacuuggggucgagaggaagcagcucagacagugucuccugggccaacccccagcgaaccuccggcagaggauccagggugugcaguggggucacuuuugccauaagcgaacuuugugccuguccuacaaaugaacauuguucagcucaagagacuauuguuacugaauuuauuuaaacgcugaagcuuuuuguuguugaugaaagaguucuuugcacaauugucccauuguuugacacccaguguacuugucauuugcauaagacagcauucugaccacacuuguaugcuguaaccucaucuacuucugaugguuuuuuuaaaacuaugaugacucuaagauuacaaaaacaacuaacuuuugcuuuguuuucuugaaaaaaaaaugucaacagugugaauuuuuucuuuaaauuuguguagcauacgcaguuuugguaaaggaaggcaacagguauuggggucuauuuaaacccccccucccacaagacaagucucuucugugugaaauuuucuguacguuccaugugcagagaaaagccuccccccucucccccccgccagcccagugguacuucuaaauugucuuguuuuguuuuuguuuuauuuuuuuuaaauaaacugacagaugacaaauggugaacuuaugauguuuacauaagaguucuauaagcuguguauacagauuuuuauguaaaauauuaaaagacuaugaucaugacauuuauaaacag

SEQ ID NO: 6570 - RNA, 4887 nt, Mus musculus
ugguuuuucgagacaggguuucucuguauagucuuggcuguccuggaacucacucuguagaccaggcuggcuuugaacucagaaauccaccugucucugccucccaagugcugggauuaaaggcgugcgccaccaccgcccggcuucaugcacugaauguuaauaacucuuggagaauuaaaucuagucauugccuugcagugacagugcacuuugaaggguguggggccugacaaggggauacuauaaaacucaucagcaaguuuggaaaaguuaaugcuauaagcagugagcuaggucuuugaggccgccaguccuguuuugagagaacgccguuucgauucuucuccuucuuuacuucggcauaacuugcccacuuuguauuuuuagcaauuacuucgauauagagauuugagcuuggaacaccccguaugauacgucuggaaaucaggaagccgguggccguaauccugcuuccugguucuuuguauuuaagucuuugaaagaagcacacgggacaaagcucugguuuauauuuucuuaauauuuaaagcugaaggacauagccaagauucccaagcuauauuaagaccacggagagcagagcuaauaacacagcaaucaaaagguuuaacuacgaggagaaaaauauguguagauaagauuuuuccccuaaaaggcauguguggggugugugugugcgugugugugugugugugugugugugugugcaaagugacuuccucaaccaaugacaaaccaaaccaugugacaguuccuuaggucugaaaaacuaaagcagagaaaaacagagacugggcccugcaguggggauaauccagaaugcagggaacacagcucucccccacugauggaacacuauggcuugaucauaucuguccagauacacagaaacuguaacauggggauuauaugugaaaacauuggcugcuuguguuuggucugauuauagcaggaucugauguuaagaacuaaaaaguuccacuuuugaaaaacuggguuagcucccaaagucauuuaccccuccccguuguuuucucucucugucucauuugguugcccagacugccuagacuuggaaggccaaccccugugcguccuguguggcugggucuacaggugggcaggccuaccacugcacggaccauuuuuacugcuucuuuagggcccagcauagugcuaggucuucaugaugcucaggugggaggaaauccuggcccucggacaacucacaguccagagagagagacaaagaaaugggucauaaggucaucaugacauggucacugagaaagcuuucucuuagcugguaccccuagccuagcccuccaugaggaccccacgcagcaauguuaagccauuuccccacuuucuuuccuccuuuuucuuuguucaguuucucuugggggcgggguaaggcccucuuugacgcccuuugcagcuuucugucuuuccuauuucuuacaguggacuggcuuaaauccuuuaagauaggaagaggugucaucuccugcaggaagugguaauucacgaguuaagaccugguguguaugaagaaacuccauccucuguacagaaaccgugugcccaccggcaaguucccugcgaggccgcaugccugcuuucccagcuugaagcuuuucaucugcuccaugagaguuguugggauagauggguuuccuugcacaguguacuucaagcaguucucuggcuuuagggcgagaaucagauguaaugugguaggacugggugaagguugccugcccaagcugggugcuuucuuuuucagcggagugcccugcaccucgcuuuccuuuguccuacagcugugugucuccuagauuccuccccuuaucuucuucacccggagaccuaagugugggccuugaagagaaagccgagaggggacucacccaggcccacacaauuuacuguuagccuuucucagugaaaaggcugcccuggguaagugucagaauucggcccagagcacacgagggguuaguuaucuaaacaaaguuaagaaagaacgaaacccuuggcuagguaacaaaaccgugcaccggugucuguuuaagugaaaacaaaaccacguuaaaggcgccgccccucccccaugcuugaucacccguaguucgcucggaagcuagauaaagcugaagcccugggagcagccaacgccccacaagaguguagcucgucucggaacugcccacccagacccggagggcuccaggcugccugcuccacgaugucgcacucagagaggcugcgacgaaggcggggacccggcggccacacaaccccacggggcgggucgccgcgcagacuccacagucaacgccucucccagccccgcggacagggcagucaaucaagcuaaggcgaacccgccuucggacugcagcgggcgaccaaucggagccaagcuccgcagcgaugagcucagcccuauggcuucccauuggguggcuauauuaagaaaguggccggacucuuuaaauagcgggcgcuagggccgcagcccgcaucugccaccgcaguucgguugucgucgucugcgccccuguacccuaggucuagagugaacccgccccgggaaagaagcuaggccggguccgcagcaucagccaucacuucgcacaaagcagcgcagcuccgggaccgccgaggaccacagcggcgcggcagcggcgcggcgacacucagugcaccguaugccccugcgccccugccgaggcaaccggagcgccccgagagaccgcgccgccgcgggguccaggugcaguuagcgagccuagcccgcagcgcgcagucgcgggagagcggggagcggcaagcaacagggagcgggacggcggcgaggcgcucgcgggccccuccugcugcccgcgcccggcgagcucauggcggccauccgcaagaagcuggugguggugggcgacggcgcgugcggcaagacgugccugcugaucguguucaguaaagacgaauuccccgagguguacgugcccaccguguucgagaacuauguggcggacaucgagguggacggcaagcagguggagcuggcgcugugggacacggcaggccaggaggacuacgaucguuuacggccgcucuccuauccggacaccgacgucauccuuaugugcuucucgguggacagcccggacucucucgagaacauccccgagaagugggugcccgagguaaagcacuucugccccaaugugcccaucauccugguggccaacaaaaaagaccugcgcagcgacgagcauguccgcacggagcuggcccgcaugaagcaggagccagugcgcacggaugacggccgcgccauggcggugcgcauccaagccuaugacuaccucgagugcucggccaagaccaaggagggcgugcgcgagguuuuugagacggccacgcgcgccgcgcugcagaagcgcuacggaucccagaauggcugcaucaacugcugcaaggugcuaugagggacgcguccugccucacgcccuugccagcguggcucccccuccuuggcccggucgcccacgaaccgggagaaagggagacccaugcccccaaggacaccaccagacugccugacaucugcugguggcucuggcuggucacgcugagaauuagcgugggcaccgagcucccccuucccagugucuguguguguccagcuguguggcacaggccugggcacccugcugagugccaagggguuccugagcauccuuuucuaaagagccaggccucaaagugugguuguguguguguacgacucccuacaccccacccgacuccugccccacccccgccucugguuuccccaggggcacgcagagugguugcgcccccagcagguuugcuuguaaccagcaagccacuacuguugcuccaugucuguaacauagaccccuggaauggcgggaggggagggcuggggggaggauggggcuguuacauaaauacagauuuuauuuucggaggcagaaugguauuguuuagugguguguggggcgaccagggcccagagcagcuccuuucccaggcugggucaggcgcccacccauccaagcaugaacuggacuuggccaucuuuccacacccuggggaagacauuugcaacugacuuggggucgagaggaagcagcucagacagugucuccugggccaacccccagcgaaccuccggcagaggauccagggugugcaguggggucacuuuugccauaagcgaacuuugugccuguccuacaaaugaacauuguucagcucaagagacuauuguuacugaauuuauuuaaacgcugaagcuuuuuguuguugaugaaagaguucuuugcacaauugucccauuguuugacacccaguguacuugucauuugcauaagacagcauucugaccacacuuguaugcuguaaccucaucuacuucugaugguuuuuuuaaaacuaugaugacucuaagauuacaaaaacaacuaacuuuugcuuuguuuucuugaaaaaaaaaugucaacagugugaauuuuuucuuuaaauuuguguagcauacgcaguuuugguaaaggaaggcaacagguauuggggucuauuuaaacccccccucccacaagacaagucucuucugugugaaauuuucuguacguuccaugugcagagaaaagccuccccccucucccccccgccagcccagugguacuucuaaauugucuuguuuuguuuuuguuuuauuuuuuuuaaauaaacugacagaugacaaauggugaacuuaugauguuuacauaagaguucuauaagcuguguauacagauuuuuauguaaaauauuaaaagacuaugaucauga

SEQ ID NO: 6571 - RNA, 22403 nt, Mus musculus
uugggacuacccaggcccgcggagcugggggugggcggcuaguuuugcaacugcagagccuuuggguuuauuauaaggcggagcuccgcgggagaggugcgggccagaggagacagagccuaacgcagaggaagggaccuggcagucgggagcugacuccagccggcgaaaccuacagcccucgcucgagagagcagcgagcugggcaggagccugggacagcaaagcgcagagcaaucagcagagccggcccggagcuccgugcaaccggcaacucggauccacgaagcccaccgagcucccgccgccggucugggcagcaugagacgcgcggcgcucuggcucuggcucugcgcgcuggcgcugcgccugcagccugcccucccggugaguguggcccggggcagggcugggaggcggcgggaagccgggacucgccacucgccgaugccaugcaggcggcagcacguggagggggaggggagcggggacuucuucccgcgcugccuggcggauccugggauggugagcccuuuaaugaggacuccugucccaauuccucuacgguccguggaugccaggaggcuaucccagcucgugguccgggcguccugcagaguggaaccuccauugguuccccgcucccaauuaaguaaaacgacuccacaugggucugaguccgccggccuuaggcgcuccgccggccuuaggcgccgcuuggaguugcucucucccguugcugucuugcuggccaucucagcggccuggccuccgccagugucccggagggaugcaguggccauggccacaacgccuuuuccauagacccuaauucaaaccagacugcaggcugcacccccagcgccgcggaguccgggcgcucggcccuuugcaccggggcaaguuugggcacagcagagccggcgcgggaacagggggaagcugacguucgggguggcgggagggacgggauuaaggcuguuugugggacacaagaggguggcucagggaccuucgguuuuucucuggcugccccaggugagccgggccgagcuggcagcgggagguuccgggaaguuggcuucagaacgcugaagacccuaagaacccaacuuuggggucgcugaaguugugcugcccccggagggccuccuccgcauggcccgcgcgggggacccuccccgcgaguggaccccgguacggcucuuccccucccccgacucggcuuugugcugaagccgcgcguagggaaggcgggucccuuggcccgcccaguagggccgcggggaaagagggacgaacguggagcuggcgacuggugggggaaagcuucuggguaggaugcagccauccaccuuuggugggggucggucucucuaaucagcggcuuggccgacaaagagcuuggucgaggguaccccagaaagugcucucccgccccagccgccguccgcuagcccgccuuccccaacgggggcgcuuuguucucggccccuguaacccuucccugggaaccgccccgcagcgcugguccuugacgugggccggguccugggucgccgccaggugucagcgcugcccuccggguguccacgccccuagcccccgcacccgcugugaagucccggguguccuuuccacuggcggcuuugcccaaccccuggaaggcagaggcgaggugcggagccucaggcuuuaucccucccggaaguggcagucucccaccgccacaucuggucugcuuaacuucgauaguccuggcaaaggcagacacgugcacagggaaggagaguugagcgcugguagauaccaaggucguguacaaauaaaguggcacacggacacguccccagucacuguuaauggcauugccuucgcuccuucccagguggcuggugcucuccaucacucuggagcccaagagagggccuccauaauuguauugcccaugaguugggguugugugggggcgccaaaucaggguucucugggagggcuaugaauuccgaacugagucuccugugcacuccuggcuuuaagguucaagaaauuguuugaggguugugguuuuugugggacucagauuaugccuggaaucauaguuaccacuguggagaagaaaguggagcuacuuagcaugccuccccggcccgccuggcauuaccuccggcucuguucucuaggcccaacgugaggccucacuggggcaguacagaugcaguacugaauuucuuuccagccaggaucuggagaggugguguucucuucccuggugucuuuagagaggcagauauuccugugaccuaagccccucaagcacccauuaauaaugcugaguagacaacuagagguggcguuuuccggaacuuccugugugcuggccugggagguugaacccucuagggaaacaggucuaggaaguagaauuaucucaauggaaggcuuccuggaggaagaagaugagcugagcccccaggucacugucugagcuuuaggaucagacucccacuuggaggcaagaguguucguuuuacuuuuuuuuuuuaaguuugguuuauuuucucucuaacagaaaacaaacaaacaaacaaaaaaaaaccccacauuuguuuaaaagugggugcauaagagugaggacauauucagagcuuccccuuuuccugaaaaaugaaggcagcugggauuuacuuaaaaugagagcacauauccacaaauugccagagagcuggucccuuucucagggcucccuaagcuccugugggaagcaggucagacagcccuggggaccagagagauagggagugcuuuugggugccugccuuugaauggggaagggggggggagcugcugggaucagaggcugcuagcaacuacuccccagagacugaagcagguuugucccucaguguccuguggucuucuguuucuccuauauagaauaggagaaaugguuauuugcucuggaauagugacuugcuauuuguucccuuucuuuccucucccuuacuguaaucauuuggacuaguagagacacuuuccccaggucuggcagaaugggagggagugggggaggccugugcuugcaugaugucacugcuggcuucagcucuccagggaggguggaguugguuguaaccuaccuguggcucuugaugggccacaauaaaaccucauuaacacacauugguagggagaagggacuggaaagaaugaugggaaagauugauguuuuuccuuuuuuuuuuuuuuuuuuuuuggcaguacuuucuagaucuccccucccccuugcugcagcaaaauuuuggauuccugaaguccuuugagaauguauaaugguagccagacuuuuuuuuuuucagucagcucaaaauugccuccuuauaaaguauccuugguuguuuuuuguuguuguuguuguuguuguuuuguuuuguuuuaagacaagguuucucuguauaguccuggcugcccuggaacucaauauguagaccaggcuggccucaaacucaaagaaauccaccuacuucuaacuuucagugcugggccuaaagguguaggccaccaaaagugcucaacuuuuacaaagcagucuuacuuugagcaggauucugaaacccuuauuuccuuucuguuaucuucaacaauacacugcuagguguauuuagucccucaugaugcugggccuccucaaguggcgccaggucaagcagucuccugguuuuugguggcucugaagaagacugugucccagugacuggcaguuugaauucggagcuucucuuuuccuucucagucuuuggcaggcagagugacacuggugugcccaagccuggagcuucucuguuuaauucuaguuuauuuucuuuaucagacugaaaaacaaaucagguugguuauaauucuuauaaacacgaaggucucaccuuugcguagcucuccggcugugugggucugaugucccucgggaaucucuguugaggcugcugcagugugugugcguguagaaagggcaagguagaauggacagaagcgugcugcccaccccacuguccuguuccuaaaugaugaagcacuggcccggugaagagccuagagaacucccucggugggagaugcacacaaugccaggaagcacacaggagcuugaguuccagcuuggcagugucuucucuuuggugacuuuaucagcuccagcugcccuggacuaacaaacaaggcuagcucacucucaguauugauaaucgaagguccuugguucuguuugagacugauccucacucgguagccuugaacucuuagcaauucuccugucucaacuuucaaagagcugaaauuacagacucgagccaccauaugcgacugaaaccuuguuccuaauccuugacugugaacgacucuuggguuugguucuuucuccauuucuuuaguguauguuuuaguucgcguccuacauaaucuauugcccauacuuagaaacaacagguuagagacagcauuggguccagcagagccucacacugaagcucagcucugccacugauuuaccgugucagcucaagugacucacuuccaacuccucuguccccaucuguagaguagacaucaccauaccugcucuuucugcccacauucugucauuaacauguucauuucauaagcgauggugcaaaagugcuuuguaaugaaagugcuggggaaauguuagcugucgauaaugguuaggguuaacuuuuuauugagugccuguugugugugggguugggugggguggggggagaggcuugguaguuuucuuacuucuuuccuacuuagcuuuucuuccuaagccuuuaugguauguaucauugccugauuguuugagugugugugcacaggcacgccugugcauguuugagaguaugcuugugcgugcucucgugcucacauauguauggugugaauacacuguagagugcaggccggcacacuggggcuggcugaauccugugaggcccugccuggaguuugcagaucuuccuuggacacuccugcuugugagcauuuuguguggagugacuguuuagcugggcuguagccuacauugugccuuuggguaaacccugaguauugggaaacacccugggcuguggcugugugugcccgacgguugcuuggguacagcuaagaacucuucauagaaaguugagcucagucgacagcagugggggcuuggcggugggcaccaggaccacauggagcucacaugcuauuaguauuaacugagugcuaaggaaccugucuugggugguaccugcuugcccucucaugcaguuuaucuugagcuuggcgaacacacuuacagauuuaguagagcuuuugucagcccugggagguggguuucguggccacaaguggguagcuuggaauccaagacuccuggcuucuagguugcauucuccugugguucuuuccaagggaaugcuaggggaacauuuuggacauuagauuauuucuagucccaaagcacacagaacauacuguuuccuaauugccuuuuuuuguuuuccucucaaucugguuuugaaguguuggguuugaaaauugcccccugagagccugcccuagugugugcagagggaagauaguggaacaggaagucuguagaaaguaucuuccuuuccaggaccuugugccccggagcagagucagcauggugucauaucgcuuuuggcuauuccagaagagaugagguuuuaggugagaaugaaccuuuuagaaccuucuagaaccuucuguugaguaugacaggaaugcccugaauagggcucgaagugcauggccacuuguuugucuuuuccauaagcaagcagcuucagguacagacaauaagacuagguucuuggagugagacccugcacuuggugccauuucagcuccagauggacacuggaggucccuacacagcaggcucugggauggcuggcuuugccuauguacuguugccugcucuacaagagcuucccagguuacuagccuuugucgacgcugggcucgccuggccaggcuugggcauuggagaagggacaacuugccaccuggcauaggcuguguguuuggagagucaggaggucuggugaagcccgcaaguggaggcaaguuuagugggacuugaggagagcucaguaggaaaucucugggcuagugacaggcaggugugguggugguggcgagguggcgggucuagaucuccuuuuagagauuugccuagggaucgucccugcugacucuggaacucagaggccuccagaggugucuccucugggagccucucaagggucucccaucuccuacuguuuauggcuuugugggcuaccuaauuacauagagaagauauguuccucuggccuccagcccugggaaaaguucugcccagugacucaccugaggccugcagccauguguguacacaggcgcucucaggggcuucuguccugcuggcuucagccuuucuagcccugguguucucggcagugguagcaucugggaaaccgggucaccucuuauuugcagcucccucccuuucuuggugucuucccccuuuuuaacuacuggucugauggccuuagacucaugcugaaauucuccuuucuuuuguccuagccuugucucugacuucuugugauccucugggccugugaaauccgcucaggggccuccauuucuaacagucacacacugguggagagaccgaguccugggauggugaagcuaacccugcugggcuucucaagcuucauuugguuucucuuuauuccuucuggagguacugccugccccaggggagucucagacuagaccacucuggaguuggagguggggcagguuuucagaucagugcccuuggcauucguugugggaaugggguggauggggccucugggcaaggucaggcuggggguggaggccaggugauguucuccgcacccacacccaggcagccuggcacccuccccaagguccgcucaucagcaggaaugaaagcagugccgggcagguuggggcagugggcaggugggcguguuuaucgcugugcucaucagcugagucacgaugccaggccccacaaguccucccuggaggcucaccccacccaccuugacccaccagcacccacuagcaggagguagggcagggcagugagacaagaccagccugggggucugagaggcaaaggggaguuguucaugaccuggcugugccauggggacuugugggugucucagauaucucugcugucccaggaggaagcugucuuaagugccaaccugccuagagccccugcuggggugcaggaaaugcaccaagggagagugcccauccauggaauaggcccauggagcuagaccagugacagugacagugaagucagcccccaccugugucuuccgagccagcuggaggguuuuuaucucagauucugcgaaaccauagaaucuagucaggagccuagacugcaaagcaggcuucguugaugcuuuaacuugcaggcuuccuggguaugagggauacuuagaaaggucccgcagguagggagggcaucaggaaguagaagagggccaggcacuucuaucuccugggcauugcccccuucucccaucuccaaggaugguaaaaagaacccuuccaguacacugacagagaggaaaacccuucaucucaccccauuuggaucugucguauccagcaugugcuggcccuuggcuuccauaccagagguggcuagagauguuccugggaauucacugguuggggacuugaguguaucagaggggcacaaaguaacauuaacucugguauccucugcagcaaaucggagauccccucuccuaggcgaguucucaguggauauggaggucagguuugggcuuguagggccccagcaagagucguugaugucacuccagcuucucccgaggaagaugagggugcuguguugggaucacaucucucccugaauggcauguuggggagggauggagcccuugcuucugaccccuaagcuuggucuuuagguggccacagucucuggguucuguccuaccucccugcccuugugugcuucaaaggcaugcuaaagggacucucggccauuccgaaugggcacaguguuccuucuguucucccacccccagaaggaggcaggccuggauuguagauuccuagaaguaaguggcccugagcaugcuguugaugaaccuggaaccaggcaggcugggcauccuaggaccugucuuuccauagaagucugaaucagucuaccuuugggacugaguaaggggcuccucacauaucagcuggcuaguccaucuuggcugaucuaaaccacauuaggcugaagagaagcaugguguacagucugguccacccgaaccacauacuggcuuuaucaguucucguauaauuuugcagguaacuuuuuagcucuaagccugucuccucaucugugaaaucgggucccucauauccugccuagaagggcuuuugaaaagauuaaugaaguaguaugccgagugguugggguucucuccuugacuggagcaagucucuaggaguacuaaggauagccugcugugugcagcacccccagggacugugccugaguaggaggguacagagucuucaugugaauggcccuucuggucuugccccgaaguuaguguugaugucauagagucuacaaacaugccuuuuguccuuccucagaaguccaagccuuuccuggcagaccagacauucaucuccacugagccucuaugugagacuggcuccuggccugagcugugugggcugagcuggcgaaugggaaaacuagacaccugggcaccugggugggggcucgggacagcaguguuucaguuguagggcacuguggccccugccuggagcuucugacugaagguuacccugagaggaagcagguucccuauagacacuaacauagcugggucagagugcaaggugggugugggccccugcccugacccauucagugccaaaggcugcucuucuggggagugagagcucuggacaggacugugauggccgagggggucucagagcaaaccugccuggccucuccccacucugauggauaugugcucuuaaacaagugacuguccacuuugccucaauuucaacaucuguaagauagauagggcguuauggucugaaaaugguuuuaaagauuaguuagcuaauacagggaaagugcucugacagguaccuggcaccuuacucaacaaguggcuggagugccugauuuccuaaggucucgaccugucccuaugcuucaagugccccuacagccuuggucaggcccuuagguucucccacccaccgcuggccccaggaccuagacugcuggacccugaccccauuuuuccuuuaagccaccucugcgucaacucuaaaggcgguggaguuguuuaucuaggcugugaggugucagagaaaggaccugggccgcuuuguuccugugugggcuggggccacuccaggaacugagaaacccacccaccuuuucaaaaacagccucuucucagagucuggcaccucaggcuagcccaccaugcugugggaccacucccagcaugcucugccuuugguuuguuucccaggggccucagugccuuuuaaagaugcacaggcaucuuuaguucaaggggaaagaggaaaugaaguguauuugcugguggugguauuccugucacuugcauucucacagaggcuaaagaaauuugcucuuuguaucuucuagucucuucuuuaugaucuuuucccaucuguuguaucccaacugcagggccccaguucuagaauuagccccucccccauaggaagccgacuuaugcuauaaugugaaugacaaguauccuuuagcccuucccacaggcauuuuaauuuucaaaagggcauugcacaaccgcagagacacuaagaagagagguuuggugaucagaguuacagccccagccucccagcugguggcccggcuggugcaggugugucgaaagcaguaguuucugcuucagugaaacuugaggauccuuuauuuagccaguucaggggcggaauggccaugcgaagucuaugugucacaggugucaggcccccauauccugcugagucuagaaucagcuacguagcaguuuuggggguauugccagacugggaguuuacaucccagaagcgagaauggugggguuccuauacugcuccagacaggaucuuucccccaaguuugucagccaccucucuucaagucccuuggcucugaccagcaagacguauccaaaagaaacugaggaggcccuucacuucuuuuuaggauaguguggggccagcaugguggggguugggaauggcuuucugucucuuccaucaucacaggcuacuucccagagacacuuugauucugggcaucuccagcagucaccuggcccacaaugcuuugcugcccuuugcuucagccacuguaucugguugucccuugaaggugagccagagcuccuaggcagagagcaugugcuauacaaagccguaggcugggcccugggaaccuucuugcugucauccuccugucaaaccccuaugguaugguagcccacauaaggcuugugccaaaaaacaggccaaaacauaaguuaucuuuucacucuaucgggucuucucauuuucccaugguacguucggcuggccaggcccaaaagauuugaagagagguggcuggcaagucuaggggaauagguccuaucugguucccuccaggagcagugccuagugagaggcugggccugggccagggccaggcgcccuugcuccacauugccugaagucccgcccugcccguccuggcugggaucuggcaggucuuccagcuccacacccggcucucagcugagccugcucagagacuaguccuggcauguggguugcagggcugguuccagcuccaccaggagguaugggcgucuggguacucaugggacauugaccuguaguggguauggagaguggaggaaugguacaggcaggugugcuggugcugacggacuugacuccggcauugaccuuggcuugcagucugguguuaaacuaacagggaaugcugacaaaaaagacaguuauuaaaaccaagacaggauacugcuuucccacucagcccauucccaagaauccccaagacguacaggaaaugugcaacagcagugggaauugcugaguugggggaugugggugagcugugugcucccagggaauuuugggaaauuccccuccguugaaaugcugucagggucugagccuuggagguguuuuuggggugcugugcuccccagcuaagcagcuaacaguccucuuuaccugccuuguccucaccuuggccccacccuggguugggccucucguucacucccugcugggucaccagucacuucagugcaggucucagcuugauucuugguggagagagagaaaguugauaaaucagggugccugucagccggaaauuuggguguugccugaaggcaccaaugggggcccucccuucuggagguggcuuuaggaagggguuucugggucuugaggccuccuuacaguuucuuagcuccaugggagagaagugaggaguuggguaucgucaccccagcaugaaucucuggucaccucucagcaugcacuguccagccugaucuuugagugccauaaaagaacagaauuauccucucagagcacuucauuucccgccagcacaguggguacagagacaagcugcccagacucccagcgagggacuaguugagccccagcaugggacuaguugagcuagaccugauacagucccagagagccucguugaggaagcuuugggaaaauucacccagcauuucagccaggacuggaggaaaaggugauuaugggaaagagagcagucaagaccccaggcuguaggacacaggauacaaacugagagcuaccggauaggaguagguuuuagucacaaucucuccuguccgcccuacccuccaggagacauugcaccuuguagaacagcugccccggagguccaccuuuggggcccccugggguagcucaguagugucagcauccucucauugacaucagucagguuacacaguggggcagcuaaugugaaggcgcuaggcugggaagccagcuacuugggaaaacuagguuguuccugguaggcccuagcaggaaggcaguuccuccuuuucuugguggcuuuaggggucuuuggaagcuuugaauguucccucagcucguuggugaagcaggcccuccugguacugugguguuugucuucgaagagugaaggcauuggaaguaaagacugauggggcgccuucccaggaugcuuugcuucuugcgcuggcuuacagagcucucuugcuaccuagugccuugacuuugaacaccagauucagucagggaacaggaguagaggucuugccuugcugagccccuggccacugcaggaaaagacuccucugaguggagccuuuccuccucaggugacugcuuucaaaguacagcagccucugagggggaagugucauuugacauugugguaguucuuggggucccuggauacagaugucaugcccagaucauaggucuguuuguacagagggaggcgaguucuguagcucagaguccucaguaccccagaguuguggcucuaggggugagaggagaagacuacagcccuucaauccacaggucugaccuguggguagggguagaucucuugcauacuaugaaccuguuugaaacccccuggguauuugcuguggaauagagucuugguuggguaagaaugguggauguuuaucuuggugugacucucggguggggugggggauaugucccugucuuucccaauguaguaugcugaguggacagagaccgugugacugaagccugggcuccuggaacagguguguguugguggggggugggggcgcaacuaucugggauccagacugcuugggaauggcugugacccagcuccuuugauaacagcagcucuuugucacuggauguugugacuaaugggacuuguugauucaguuacucggcucccacccacagacgccggggcuucuguuguggcaccaggcagcugcagacggcccacaaguuugccucgcuuucccacuccacgaagugaaguucccagcacugcccaaauuagagacuugugagugguccccucauaccccacucccugaggcuucuccuggaaggccuggaauggggcacuggguguguacgugcugugguuucuguuagggucaacaccaggcuguuucuuaccuggcucguaccuccaaguuuccaggugaugaguccugauuuuugaagugaaggaauccauuuaauaucaaaauucugugaccuuaaauuuuuuucuuuuauuaugugucauuucauauguacgcauauuuuuuugucuguguguggacaugcuuguggcgaucagaggacacuucagaaagucaguucucuccugccguguggguccuggggaaucaaauccaaguugucaggcuuuauccugaaaauaaaaaguagacagccccuugggauccgcaaagcuucuuagggcugugugucuuagacaccaccaguguugcacagcugguaacaugacaguguccuggagugcugauuggaagccacaggccucugugccagggcgguagacuuccaggguacggggcaggugggcguucucuacaaaaaccuuguaaucgcggagccucuuggagaugcccccuagguaucaugauuuuggugugugacacagcugaacugucuucauacucaggauaucaugaagugcuggggugcagaccacucucagccucaggcagccaggacccggggcuccaucagauugcggugacuaccacagaggguggccuuccuuccggucagugugggugugggagcuggcaggaaguggcuccaggcuuccuuuaagcauccucugcccacagccccaaacauguucuuuggcaauggcuugcaacuagaggugaacucucuccuguacuauguccugacccacgcugcugcaucuauuauaccuuucacacgcgugauggguacccagcggggcugcuaggcaggguuaagcacucaucuuguuuccuggugcugaagcugugguaaagaaacugaggccauuuucccuugagagagauggucucagccaggucuuucucggccuggggagcccggaagaaaggauguacuacagugaguggacacuuguuggcugauggccuugguagguccuucacccugggaagugcuguuucuuaucuguuagagaugcugaccucagcaggacuggaggaacugcaugggagguguaggaaugaaagugaguggggaaaauuaucuccagcccuagggaagucugaggccuguguccccuuuguccuggacugggccccugccuugggugucuguccagggucuuugcucuacagccccagcggaugcccaaaguagacgagucaacugguccuuucuuucacccuguguccacuucucauguaucuaccuucauaauccuucuagguaaaacaagccucuaacuuuggguuuucaaaucagccagcuuccaggcucgauaguacgaaccaugaaaaucuuucuuaccaugagguuguuuucuaguguguguguguguguguguguguguguguguguguguguguguguacguacacauauguaccucuaucugugugcugugcguguaccacagcagacucgugaggaggucaggcaaacuuuauaaaaaucuuuuuuuuuugcuucacuugagucccagggucacacaguggcaagugcugagcucuguucucuguucuugauuuguuuugugagcagcugauguucuuaaggcuugcggaggggaaagguagggcuggcuugccuucuuccccgaguggcggucaaucccuagacaucucuaagccguggccacacgguccuggaaggacccaggucagaagugauacugagauggcccugugagcccucucgaacacacaggguuguaaauaguaccugauuguuacauuggagacucgucagcuggguggaguccugguucagagggaguuauuccuccccccacauuucuucucuucuggggcugaagucucuuccuuccuuaccugugaugcugucaugauaggucccagcugagaguggaggcggggcagucagggagcugcuucucuuugcuuagcagggguuggagacuugggguguagggguuggcucccccuuucccugcccuggaccugguuucugguuucagcagagauucguucuagaagcuuguugcguaaacaagaucacaaagcgauaagcuugagcaaaacccaggggaacaaauugcuucccugugaagacccaaucuuagcucuuagagaagcccucccuuuugggaaauugcugacuuucagggcuucucuguggaggaaagaggcuagccgccguauguuugccuggauuccaauaaaucuuugcggccuuggcuaccccuuguugaacaaggucugcacuccuaaugcgugccucaggcuggucugagaccucuaccccaucuccagcuuuccuuccuauggagggagucaguggguuaggagagaauggaguugaguccuggaaugaggaggaagcuaugaacucggggccuguuccugucuggugggugcucuucuccgccgcugaaggaggcagccgcagggaagacuaccacaggaauccgaguaccaccuggagcaguguauacaggaugugggcugaugugugguaagggcaugaugggcugaugugugguaagggcaugggaucugauugcucuguggaugggccacagggaaauuuuugagugucuacugcaguaguucucaaccuguggguugugcgccccuugggugggaguuacauauuagauauuuacauuaugauucauaacuguagcaaaauuacaauugugaaagaaccaagaaaucaccgcagcaugagaaccuguauuaaagggucacgguguuaggaggguugagagccacucauccucugggucuaggccauggcgggcuguaacugcucucuggaguuaagccacagugaaccagcuguccuugcagauggacuuguggaggcuccaaaccuuugucccaggggagaagagcuugcuuuugcuuuguacuuuuaaaggaaguucagugguacuucgggccuuguggcugcuguguguggaagugccccuguacaauaagcuguauagaucguguacaacugcaguuuuccuccguggguccaccaaccacuccugacuccacggaugagugaggccaguagggcugugugugggucccuaggccaagcauccuggaccacgaugagccucagcuagaccacucuggaucuuuagcagaggcuccuagagagcuggcuggcuuccuccugccuucuuuucucuuaaaacuucgucucaaucggaagcuccucugugcacgugaccuccaggccugggggucgccacaaauccccucaucacaagacgagcagcucgcaugagggacacagacacuuguuaccuaccaggcugugggguuuuuguuugguugguuguuuuguuuuguuuuguuuuuuuacuuguacagaaguguugugacauucaguaguucagcuguuagugcuggcaccauuuuacagguagggaaacugaggcuguaagauguguagugacaucgcuaaggccacucaguuggugaggccuuaccaaggucaggucuuuggagccuuuugcugaaccauguacuucuaucucuguuuuguugaaacaaagucuauauggcucuggcuagccuauaacccauauguagacgaggcugaccucgaauacacugcagucuuuuaugucugccuucuggguggcaggauugaaggcaugugauuccuccuaacuguacacuuuaaaaaaaaaaucauucuuuguucuggucugugccagggccuuguaagauguucugugcugagcugggcuauuuggguuagucucauugcugagcagggccccuguaucuuccuucucugucacuugcuuaccugggucuuccuccugcacuagcuauccuagaaccaguacugagagcaacuaugggcccaacucugccccuugcccagccugcuuagcugggggcgguguuccacuucccugcccaaguccugugggacuguguuuguacuccaccaccuucaguuccuuggagcuggagcaggccaggcgggcugcauuccugcagcugcuguugccagggagagcccaucccauucacuucagucuccuuaauguagaagccuugucgaauuagcuuccacuguccccaacccaagaguacccuguccuuucuucacuaagaaggccaggauacaguccuuccuguggcugauaagacaggccuugggacaaggccugggaccacacugugugggcaaagcugcuucagcaccgauggcuccuccaugccaagcuuggcucugcuucucacaguugagacuucugugcgcacacccacugucuagcucagcuggacacugauuuucuuuaaauguauagauuuugggguggggugugcugaaagcucccacugauggccccaagccugagucucagaguaugaucaauugauggcuuucauggguaucacagcuucuguucccaggucagacucccugaccagucagagcauccugggguuaggacaauguccccgucacuugugccuccaccuggcaccaggcuaugauguuauggcauugaggguaugagaaggaccagggguuucccagaguuagccccagggccacaggcaauuguuuccuacauguguggcuggaaugguugggugagccuuuucagcugccuacaauaggaacccagggauacugggcauugaccaaggcauaucucauacccuuuucuuaucuuucugcagcaaauuguggcuguaaauguuccuccugaagaucaggauggcucuggggaugacucugacaacuucucuggcucuggcacagguaagacugacccagaacacugagauggcauagaucauggcuggaguggugagcaggcagucacccagcuuuuagugaacccccuucuucucccaucccauccuuagccauuggagucaggacagugccaaaaggaagaaugguauccagcugcaagccacucagcuaagagaaacucucagagaaaugaagggguuccaccaggccaugggcagccacuagagccaacccuuggaggaguuugacuccacugagccuuggugugguguuuccaucugugagaugggaauacuuugcccaagagccuguuagaagcuguaggaagcacagagucggcuagguauagauuugcucucaccuccaucucucgauaccaguucucugcagagcguggguuugugggaggggugggggggugaggggagaaggcugugagcugcagcuagccagaggggucucccagaagaauggggagagcuaagaaggaaaguugaggucacagugggaaggagaccagagcaaaggguuggaagguagguaaaaugcagccguguauucuugggagccuuaggccuuggggaagaggguagaagagguguuuguccugggcugcaguccuguaucagcucuggugucuuggcccacgcucacagcaggaucccuucccagauucccgagaauuucucacaguucagagagcacgcuacuuguaggcaggugaggcugcaaaggacagcuuuucuggccuaauuuucaaagugaguucagccuuugcuaggucaccuuuggggucucagaaggcuucagccuccugguagagcaugaaucacgucaggcgugaugccuggagaccucuccuacccugacaccccaaacccccaccucugacccugcaggugcuuugccagauacuuugucacggcagacaccuuccacuuggaaggacguguggcuguugacagccacgcccacagcuccagagcccaccagcagcaacaccgagacugcuuuuaccucuguccugccagccggagagaagcccgaggagggagagccugugcuccauguagaagcagagccuggcuucacugcucgggacaaggaaaaggaggucaccaccaggcccagggagaccgugcagcuccccaucacccaacgggccucaacagucagagucaccacagcccaggcagcugucacaucucauccgcacgggggcaugcaaccuggccuccaugagaccucggcucccacagcaccuggucaaccugaccaucagccuccacguguggaggguggcggcacuucugucaucaaagagguugucgaggauggaacugccaaucagcuucccgcaggagagggcucuggagaacaagugaguggcuuugcauuuccuggguggccacuagugccuggcaccuggccgccuaauguccucauuacagugacaggugacagggucccaccuuccuccugcccgaaacagacugauugcaagaucaggaggugggcgacuccuuagaugucauucaggagcuuacagcagggugaauuuuccgucuuagaccuucaugggaauuuucacacaacaauguguacguugugucacuggaggcgguaucugugucuuggccugccagggucccaggugugacugacugcauuccuugacagaugcugguauagguuggcuacgucugauggggguggcaggggaucccaucagguauggcacugccucagguugcuguugugucaguggcuccagccugaccugaucccaaccuacccuucuguaggacuucaccuuugaaacaucuggggagaacacagcuguggcugccguagagcccggccugcggaaucagcccccgguggacgaaggagccacaggugcuucucagagccuuuuggacaggaaggaagugcugggaggugagucuucuuucagguggagaggaggaggcaggugguggcucugagguagccuggguugcuggggugaagcaucuuuagcagcaggguggggaaggaggagggucaauucuacuccaggccaccuccuaggcuguccgucuagucugggagagacuaccacugaccccguggagcuacugaucugagccugccucuguucacucccuaggugucauugccggaggccuagugggccucaucuuugcugugugccugguggcuuucaugcuguaccggaugaagaagaaggacgaaggcagcuacuccuuggaggagcccaaacaagccaauggcggugccuaccagaaacccaccaagcaggaggaguucuacgccugauggggaaauaguucuuucuccccccacagccccugccacucacuaggcucccacuugccucuucugugaaaaacuucaagcccuggccuccccaccacugggucauguccucugcacccaggcccuuccagcuguuccugcccgagcggucccagggugugcugggaacugauuccccuccuuugacuucugccuagaagcuugggugcaaaggguuucuugcaucugaucuuucuaccacaaccacaccugucguccacucuucugacuugguuucuccaaaugggaggagacccagcucuggacagaaaggggacccgacugcuuuggaccuagauggccuauugcggcuggaggauccugaggacaggagaggggcuucggcugaccagccauagcacuuacccauagagaccgcuaggguuggccgugcuguggugggggauggaggccugagcuccuuggaauccacuuuucauuguggggaggucuacuuuagacaacuugguuuugcacauauuuucucuaauuucucuguucagagccccagcagaccuuauuacugggguaaggcaagucuguugacuggugucccucaccucgcuucccuaaucuacauucaggagaccgaaucggggguuaauaagacuuuuuuuguuuuuuguuuuuguuuuuaaccuagaagaaccaaaucuggacgccaaaacguaggcuuaguuuguguguugucucugaguuugucgcucaugcguacaacaggguauggacuaucuguauggugccccauuuuuggcggcccguaaguaggcuggcuaguccaggauacuguggaauagccaccucuugaccagucaugccugugugcauggacucagggccacggccuuggccugggccaccgugacauuggaagagccugugugagaacuuacucgaaguucacagucuaggaguggaggggaggagacuguagaguuuugggggagggguggcaagggugcccaagcgucucccaccuuugguaccaucucuagucauccuuccucccggaaguugacaagacacaucuugaguauggcuggcacugguuccuccaucaagaaccaaguucaccuucagcuccuguggccccgcccccaggcuggagucagaaauguuucccaaagagugagucuuuugcuuuuggcaaaacgcuacuuaauccaauggguucuguacaguagauuuugcagauguaauaaacuuuaauauaaaggaguccuaugaacucuacugcuucugcuucuucuucucuggacuggugguauagauauagccacccuuugcccaaacccugguagcucggggaagcuuggcuuaaggcugcacgccuccaaucccccaaaggguaggauccuggcuggguccaggguuccucugauuuauuugguuuuguuguguuguguuguguuuuucuuuuggcuaaacuucuuuuggaaguugguaaguucagccaagguuuuacaggcccugaugucuguucuucuaaaugguuuaaguaauugggacucuagcacaucuugaccuagggucacuagagcuaagcuugcuuugcagggcagacaccugggacagccuuccucccucauguuugcugggacacugcugagcaccccuugcuuacuuagcucagugauguuccagcuccuggcuaggcugcucagccacucagcuagacaaaagaucugugcccuguguuucaucccagagcuuguugccagaucacauggcuggaugugaugugggguggggguggggucauaucugagacagcccucagcugagggcuugugggacaguguccaagccucaggcugggcucauucauauaauugcaauaaaugguacguguccauuuggacagcagacac

SEQ ID NO: 6572 - RNA, 4272 nt, Mus musculus
ugcgauaugcuuugcuuuuuaauguaucuucauauuagcaaagggggagugacguuugaggagagagaagaaccguugagugaaaauaccaggcauggagggagggcaucccuucauagacucaguugagaugcaaucggucagcauguucugcauuucuuccccaaccaucuucagccccuggguuugcagguggcuaagagacaaggcccuuggggaaccagagcuugggcccgacuaauaggauggaucuucucuggagacauguagggacccagugcuuucugggccaaccaugguuaccaacaauugugguccuaacuagucuuggacucgccaacagagaagucuguuuaggccuuggcagacccucacuauguccaucccucaagcuauaagcugaggagcagaggggugacaucaugugcucagagucucggggggcacagccuuugucagcucucugcccugcaccccagaacugugaacacagucccacucagccauucucuucauggcuccccccagaaugacagaguaagcauuucuacauggcagaucaaggaacacauagaucucugugugacuggggcucuagccccaaccccccaaacaugcuugaaaaacaagcagacucucuuaggauacaggcuagccaaaacagacuccugagaaggcuguuuauuggggugugugugggggguuuaucucccucaucaucagguacccacuugcuuacagagaaaggaccuguucaucuucaucuuagucauccgucuaucccugcacaacagcugccuuuccgcagcuuacucacccuuccuccagcaagucuagcauggugcuuugcacaagcaggcacuucauucacucucauugaagaaacaaacaaagggauacagcaaggcagccguucacucgauagagagagccuccaccuccucuguaaccagguugucacagcucaguaacacaagcaggcccuggacccagagcugguuauuacgagcacaguaaggcuucugacuucuguguagcaagaugccugagggccugcugagcgaggucugcugaccagacauguagggaaaggcucacuacuuccaugaggcucccaguucugggguacauaaagagagcuaguaaggguuuucccacaaauuucugaccugguuguaaguauucaugugcacgugugugcaugauuacauauguacaugggaacuuauguguuugcauguguuuguguggacagcaaaugugcacacagccugcuucucaccugcuaggugcucucgccugagaagagaucagcuacccucccccauaccugcuccucuuucuggucugccccuggaagaagucugagaagccaauagagagcucucagugggccaugccauacuugcuguggucaggucuggagcuugcaguaagaggcuaaggcagccaaaggugcaggaugcagaccagggcaaagccaacaucucaggcugccgaacagagaggucuguagugcccuggugcuuacaagccccauggccugccugcaauuggccuaccuagaggagaguggggugagccugugccaaaagugaggacugagagaggagcuugcccuuggccaacagagcuauguucagggcauuggcuccugggaacucaaggacaagcaaggagccuaugacuaagccugguggcuucuugacuguuuaagucuccugggucuaccauaacaauagucuggguccuugaacacaagaacucucucugcccaaaauccuagaggcuggaggacugugaugaaggcaucaauggucaaucucuucuagauggccauggucacgcuguacccucauguggccucuucccuguuugcauggaggacagucaaauggaauuaaggccccacccuaaugcuauuauuuuaauguaaucaccucuuuauagauccugacuuagaauacagucauauuuccaggcacuagaggauuggggagucaacauacaaaauccugggggugacucuguuuaauaaauagcagugaugauggaaucguuguccuaacugugauugugaguuacauaagagagcugcuucgacauaggguaugagccccucccauauaugugugcuuauguaugcacggguaaguuuguuguaaugagucuguguucauauguauuuaguccauacuuacauacauauaugcucauacacauauaggaauuuguauguauauagagacgugugcauauauguaugcaugguacauaugcauagcaaccugcucuauggcugcuagguugaucugccugauucuucccuggagcuggagaggaggaugggccaggcugaugggcuagguauuuugugggugaacugaaggagcuguucagguccuuagcaggcuagaggcagcgccagaaggcuuacccuauguccucaguguccacgauuccucucucuacugucacacugcaggagucucacugcucagauguuagaguccccaggggccacccaucuucucuuccuguaucacgugggagggagaagaggcugcuccgggaaggcgaugugauucacugcugcugcugaggucugacgcucaucacgauaucuuacuugccaugauucacucaguuaccagacucugacaaguggacugauuugcccaaggucugauaggcccugguacuguggagggcagggcuuagucccuggaguaccugauccccuagagaucccguagacagugacuggaaaccgucccugagcucccccagucccgcagaccccuccagcuagaccuagacuaaaugcugacuccuuaugccagagaugcccuugucuccucacccugguuuuauuugcuuugcacuggcccugccugguuuuagcaggaggcgagucuugacugaggccuuauuucgguuuccaguuggaaugcuccaucuuucugucccuaagguggacagugugccuggccauauggccguggcagcauggaagcccugggcauggggugguggguccuuuucuucuggccguggcaagugaggaaaugcuucccuaaagaaagacuggggucuggagaaguuaucuugacugcuggguccuucaagaacagccacuaguacaggcacuguagagugcuuccaucuacaaacucggcucuccucaugagcugcuaucucgcuagccuggccacagaggacuaugaguggguagguggccauguugucccagccuccaggacagccaggugaccugggcugcuuuuuuuucucacauagcuucaacaucuaggccuguucuuaauccaaccuccagcagaggcuaagacauggggacuaagggacauacaugccagagccagacagucuccuccagaacccugcuguccuuucacuggcuguucauaaugguccugucacccugccaggagggugucugccauagcaccugggagaaggcagguacucuaaugcaccuguauuugaugaaugaauaaauagaucuucagacaauuuacauccuguuucucggaugugagguuaucuucaaaagacucaugauucaguuccugggugcaggugguggcgagggcucccaucucuguuaaucaagcgcccacaggagccuauggggaccagaaggagcuuugauucuguggguccgcugcuacgaguaugaguucuuucagugaauugaccuugagcccucccugcaggaaaguaaaauggauuauuuuuauuauuauugauuauuccccuuagacugaaccugaggcacuucaggcuuggggcuggcagcacagugaaagguugugguugaaccuggcuggccuccagcaggaguggcaugggaauguggccuuuggcccuugaaggcugucuaggggaguaggcgggacagcuacccagagccaaaccuuagaguggccucugacugacaccgcuggacaaacccagccuuggugguccccaaggagccauuucuucuucaucuucccucccuaccugggcuuucaguccguaucucucauugguugagggagcccucagaaagcccacagaauucccuugaucuugggaaaauacagacuagcaaagcggagcucccuaccuguguccacugcccugcucccaaguacagugcugcuugccuugguuggagaugucaucuuugcgcugcuucccauccgugcauccgauaauccccacguuucacugugcugcaucuuagggugguuaguugguuuccua

SEQ ID NO: 6573 - RNA, 17438 nt, Mus musculus
uuuuuugcuuguuuuucuggccuauuucaauguccuucacaaucuuucucuucaagaagaaaaaaaaaaucacuauuaucuguauaaacucaacagcuaagcgguuucuccacuuuaucaugcugucauuuuccuuaaucccuuggccuuuggcagaguccagugguauuuauuggcucccucuaaguaggcuucagagagaugggggaaggacagaaauccaauccuuuagccuacuugcgagcccuccuuucuggucugagccuagagggccacgccagaaugguagccacgccccuucccgcaggcacgccccgacaggcccaacaauagagcacgaauacgucacgugggccucgcagugacaaagacaacguggcgaaagacagcgccaaaaaucuccgugcccgcugucugccaccaacuccgucuuguuucacccuucuccuccuugcggagcucgucugggagacggugaauuaccgaguuacccucaauuccuacagcccccgacagcgagcccagccacgcgcaccgcggucaaacagcgccggagagaguugaacuuuugauugggcgugaucuguuucaaucuccacaucuucuccaaucagaagccagguagcccggccuuccgcucuucguuggucuguauguggcagaaggcggagggagagauuccgagccgacgucccgcgagagcggcgccgggcgcccagagcgcaggcgcacaggaguuggcaagggcccgggccgagggcgggccagaagacgcguccuuuggcuguggacaccgucguagagucgucuggguugaaccgcugggccgaaagcuuuugucaggggccugggcgagaacgaggcccgcgagguuccggaugguguccaugacuuucaaacggagccgcagcgaccgguucuacagcacccggugcugcggcuguugccauguccgcaccgggacgaucauccuggggaccugguacaugguaagggcuggcuggcagggccgcuccaccaggccagugcgccugcgcgacaagugggccuggugggcagggggcggggacgugaaaguuguuggggcgcuacuuuucggggugcuuuuaacugugaacugaggcuuuacgagauggggcuccccaggauuugggaggggaugggaauaggaucgucauuucggguucgggaagugcgcaacccucaucccgccccacccccccaucgaaacaauuauugucccgcaguuaugcagccaguucggacguuuuguccgaaucgaaagcgaaauccaguucgggugccuccugcaguuuuuguugaggcguucggugauguagccagaggucucuguuuugagucuagacguuagccagaauuuacagugggucagauuuuccucauuacacccccucccugccuugucagguggguuuucaucccaaggccgccuugguuuggaagagauguuuauugaaagccugcuauguccuuacugacauuuucugggcuccaggaucugugugauucugucacagcagauggacgggcuuguugguuccauauucggcagaaagucuugugacuuaaaaaaaaaauuaguucccaguaucuguucauaugaacuuauuuguugcgauuuccaaacccgugauuuuuuaaagauaguuuuaagcaauuaaacuuugccgaagcuuugaggaacauguuuugcuggcgugaccacuuggaugacuuuugaaauuucgucguggggguggggggugaggguaggaaguggaguuagugugcaguuucugauacuuacaugaagagcaaaggagggagaggcguaccccuguccucucuuccuucucuuuacucuuccccgcccaguaucuugaagucauuaguaacuuuggcagaacaccagaugaaaaucuuccucaggcagauggcuucccagcccaccccaggggacuaucagaccucugcaggauugcagcuuuuuccgucuuguauccuuauguacauuagagaagagccccaggaaagcuugaaugugguuugguaugcuugcgaugagguuauuuucacguuuucaguacuucuguacucagagagucacccuacugcuucuguagaauuaauuccaucacauuuucuuuaagaaacugccuccugcauacauuaccugagcuguaguucuggaccuggacuaguuacugacaaucaguuggguuguauaucucacuuucuguugcuuuccuuuuuguuaagaguauggguuuuucauuucuuuguccuucaccaucuuccauucucuuaaaugauuaauucuugucuuccccaucguccucuuaccucccugcuuucucccagaaaaugaccuucauugaacuuagcaaagcaaauaggauuggcaccugggauucuugccugaaaacuucaucuuccuguuucuucuuccaucccuccucuuacacagcuaacacccaucugcaacuccaguccaaggagaaucuagccucuuguggccucuauaaacauugcacacaaguuaccacaaacaugaagacaaaacacccacacagugaaauaaaaauaaacaaaaacuaaaauuaggaaaaaaguccuugcuauaguuuuucaaucugcauuuugaguucccucaaacaaaggccacagcaucaaaaacuccgacuaacaaagaguauagagaaaugcugccaauauaucugaaugacugaagagguguuuuuuuucaucuuaaaagguuugaagcccuuuauaagugcugggaauugcacccaggacagcaacuaguguuccuagcuacuccagcgugcccuccccccccccccagguuuuuguuuuguuuuuaacagagggauugagagaguucuaaaucuguagcacaacugaagcucuuggugugaaaagcacacacacacacacacacacacacacacacacacacacccgccuuugaaaagaugcugucuugaaucaacuuccagcuuagaauauuguaaacuguuucaguugguuuguuuuaauucauauaagagacuuauugccugucuucaguguaaagggcucugaggaacauaggaaggggaugauagauggcccauauuacaugccuucaguauucuuacuacuuguugcaugguagguucuagcucugcuuacuuuggucaugacaucaucccuugauggugaugguauuacagagaacuuaggagcacagccagggaaguggaacuuagagucacagaggagaaggggcacagugaugcagauucuuaucacauugaggaggagaacauuuguuuugcuuaguauguuauuguuggugacuuuaaaaaguguacaagccuuaguucuacaguagugugaaaacauacuuucugcuaguuggggugcacuuaggagaugaaaacaguaucauguauaaugccuccaaauaaagaggucucguccaaauucugcauuccauugccauagcagagacauaagcugacaacagcucgaaugaccuuuccucuuuauuuccgccuugccauuguucccuuccucaccacuuugucaugagcacugcuguuugauuccaggggacaguaugucuggaccugugugggagaauaaugagccgccagguugucuggaccaaggccugcauuuaugaugcuuucugugguguuugaaacguggaggcacagcccuuccuccugcuggucugggacacucugucagugacugauauugaaaccuuugaaaucuagaauuaacauugauuuuuuuuuuuuuuuuuacauaccaucauguaugucaaaggauuaauugaauggagccuauaauauaaguucuugggaggugguaucaggagaucagaaguucaaacucagccuuggugauaggccagccuaggcuacauaggaugauagcucuaaaaccaaaccaaacccuuaaguguuaaugguugguauugaauaauaguucugggggacauagaaccagagguaccaaaccugaagaguuugcaucuaauaguuuaaaugugaaagaagugcauaaguaauacgugacuuuagagugaguucaggcuuccauuucuacauuccucaaguuuacuucuuuaucauuugaagccagauuuuuuuuuuaauucuaaggagauaugaacucaaguacauaauaacucauaaauuaaaaaaccuguuucaagaaauagucuuuaugauauaaaugcauauuuuuguucuguucuuuguuuuuucgagacaggauuucucuguguagaauguccuggaacucacauuauagaccuaagguggacuuugucauggauguuuuaaccuuaaguaacauaguguuaggaagaagucaagacauccucaugccacagaggccuuucacccguuaguccuggccaguaucucugaugaacagugcagaaauucucgauaaaaccccgauacacagaauucaacaucacaucacaaaguaaauccucaggaucagguggguuuccuccuaagggugcaaggaugguucagcccaugcaagucaguaaaggcagacacagaauauacacagaauauauacacagaauagagauccaggggcugguaagagauggcucagugguuaagaacaauggcugcucuuccagagguccugaguucaauucccagcaacuacaugaugacucacaaccaucuauaggaggaacugaugcccucuucaugcaggccgauguauaugcagcagagcacucagacauuaaauaaaauuuuaaaaaugguauaaaaaaagagagagagagagugcgagggagagaaaaccaaaucccuaggacuauuucaguagcugcaguuacauaguuaauacauuuugccauccuuucacaugaaaaagguggagcugaagagaugacccaguggauaagagauuauucccaauacccacauggugacuuacaacuuuguaacugcaguuccagggaucagacagcaucuagcuucuuccaggcaucagguaugcaagugguacacuaacuagcaggcaugcaggcaaaauauccacauacauacugguugaaaguauucuuaaaguggauauacaacacaauaaaagccagccagauaauacugacagcuaacaucauaccaaauuagcucuucucuaagaucagaaaccaaaucagcauugcuuccuuucaacauuuauguucgacauaguauugaaaguccuagccaggggcuggcgagauggcucagugguuaagagugccgacugcucuuccaaagguccggaguucaaaucccagcaaccacaugguggcucacaaccaucuauaacgaaaucugaugcccucuuauggaguaucugaggacagcuacaguguacuuucauauaauaaauaaauaaaucuuuaaaaaaaaaaaagaaaagucauagccagagcaguuggcuaagagaaacagaugaagaacuuagagauaggaaaggagggaucaaggcucuguauuggcagaugacacaaucaaauauauagaaaauccugaaaacugaaaauaaucugagaauuaguaaauuuaaagaguaguaaaacaacuucaaauaucgcguguuuaugcaccagugaggacuaccugaacaagaaguuaggaaagcgcuugugucauagcuaaaaaagcaaagcaagcaaaacaaacacuucugcgaguaacuagccagaggugaaaaaaucuagucuaugaugagaauaaaacauccgugaaggcuuugaacaggucacaaauaaugaaaagaucccguaggcacgaaucagaacuacuaguauuguuagaugcuuuguacccaaagcgaucuguaagugugagguaguaccuguuauguuguccuucacuuacuaggagaaaacaguuccuaaaaggugaguggagccacucagggcugugccaaagaagucuugagcaaaaaaacccaaaccaaaccaaccaaccaaccaaccaaacaaacaaacaaacaaaaacccccaaagcuggaaguaucccacuguccaguuuuaaaauguaaagcuaucauaaccaacacagcuuaggccugguacagaaauacagaaauaguuagagaccaauggaaaagaauagaaaacccaaaaauagacccacacuccccacagccaggugauucucagcagaagugcuagauauacacauuugagcaagcgcauuuucuguagugaauacugcuaggaaaauggcauggacuagauccugcucucaauaaaagccaacuuaaauauuacaaaauaguugaguauaaagcugagacuaaccuacuaggagagaauauaggagaagcacugacaaaagucuguguuuuaggguuccuguugcugugaugaaacaccaugacuaaaagcaacuaaaagcauuagaccaaaagauggaaguaucacacuguccaguuucaaaauguaaaucugucauaagcaacacagccuaggccuggaacaaaaauagauauggacuguuuugcuuacaguugcacauaacaaguccauaauaaaggggaagucagggcaggaaccuaggcuggagcagaggcuguggaaaugcucugcuugcugcuuugcucauccugugcucgcucgcuagugcgcucucucucucucuuucucuuucucucucucucucaaagaauuauuuauuuuauguauaugaguacacuguagcuguuuucagacacaccagaauaggacaucagaucccauuacagaugguugugagucaccaugugguugcugggaauugaacucagacccucuggaaaagcagucagugcucuuaaccacugagccaucucuucagcccucagccugcuuucuuaugcacccaggaccaccuguccaguagcaccaugucuagugagcugggcccuccccucccacaccaaucauuaaucaagaaaaugaacuauaaacuugacggcaggaaaaucuaauuuaagcauuuucucaaaugagagucccucuucccaggugacuuguaggauugaccagaggaaacacacacacacacacacacacacccccgcaaccaggauagucugaacaagaaauuaauuuaagcauuuucucaaaugagagucccucuucccaggugacuuguaggauugaccagaggaaacacacacacacacacacacacacacacacacacacacacacacacacccgcaaccaggauagucugaacaagaaauuguuauuuaacaguguaaaggcauaggcaacaaaagaaacacccauacaggguuacaucaaacugaaaagcugcagagaaucucaacagugagcagacagccuagagaaauggcaggccucuucuaacuuuaucccaagacauuaauaccuaaaguauaucgagaacucaacagcaaaagcagauagucaaauuuaaaaggaggcagcugaguagacauuucucaaaagaagacaagcgggacugacacauaugaagagccucugagucaugagauagcaucucauccagugagggaaugccagucagccaguccaaacaaugacaugguggagaaaggaagaucuguccuguacggggcuguaguauagacacugggggaaaucgaguggaaguuccucggguuagaacugucauagauccuacuaguggguugccuguguuguacccacagaaaaugaaaucaguguaucagagaucaguugcagcccaugguuaaugaagugcuguucccagaagaugagguaggcagugagcugaaguguccauugauaacuguguucacaauugguacuguuagugguaaugaaucagauugacaugugcagcaacauggauagaacugaagauucaacugagagaaucaagcuacaggaaggcaagucagugaucuuacuuucagauuacaaaguagcuuaguuuaugaacaugauaguggucaccagagacuaaaagguaagagcaggggccaguaagcauccggguaggaguacaguuaguguucucuugcgcagagggugacuacagucgucaaaauuacauucaaaaagcugaaaguaccggcagggugaguauguuuucaccacaaacagugaaaugcuuaagguucuggaaugcugucuugauuugacgaguacaugcuguguaaguguacugaaauauaacacuacccauaaagauagacaaguauugucauuaaagaaaaagcaaggagaaauugcuuggcugggccugaauguuucccuggacuugaacuuguuccuuucuaccaaaucaaagacucuucauugucucugcuucuuuacucauaugcuguguacaguaggugcuuugccugugugguugacgugacaugugcugcucuaccugaccuugguacuagguuuaccagucuuauuuucagcuuccuuuccugaguagaguaggauaaaagucaugaguauuuuggaauaguuuguauguaguagaauaucuuaaagacuuuuuaaauuauaguuaacgugaauuuuaauuucuugaaaaauccaacgggcaguuuaguagcugaaauuuauauacgugcucagugguaagugcuuagaaucagaaguacugcuuuuuucagaacaguuacucucacauuuaaaguaccgacccacagugaaaugaacuuggaaauguugcuaauaauacuaggcaaggacaguggagaagucgaugauguuuuuauagaagaaaaaaauggcuuuuuaaagaguaauauaugugauacaaauauuuuagaccuguggaccuugcauguguacaaccacauauauacaccuguguuuaugugugguguguguauguauuuaacccccgcccaaguaguuuugguauuucauuuccuucauuugguaguuaguuuugcauguuuuucuuaacauaaauguuuuucugugccauucaaagcuuuuuuacuaggaugauaauuugcguagcaagaguuugcagaaugaauuucaaacuuaauuucccaacacaaaauaacaugccuaacaugaaaauaaaauaugguccguuucucuaccaaauguuugaagacuuggccugcuguaagagcauaccuuuguuggguguuaaucauuuaggguggacagaagagcguaguuucagauauuguugauagaacaucgggagugccaaauguuuggacuuccacaaggaggaggaugaauucuguggcguuuguuacgggguuaguauuagccucagaccuuacugaugugggcuguugucacacuugcaggccauaccuccugagaaacugcaaggaaccacagcuguagcucugcauaauggagcugcuuuuaaaauggaguuucuaucucugauaagacuaggggaauucaugguauuaugaugagauuucagcaacauguuuggcagugauucaagauaagccuuagcgugccugcaugcaugcauguaugugucuuaaauagagccuuauuucaugaugauuauacuucagaaugaagaaacuagagaaaauaaucuuuagaaugucaaaauccagaucuaggaaaucauggugggcagaaauauaaagaugaauuuaguuacagauauauugacuguaguuugcaaguagcuuauuggcucaaguauaggaaaaacaaauagguguuauauagaguuacuuuugugugauauugcaaaaauguacaauuaucuuuggaauugugagccagcuuggggaacuuguccuuuacacugaaacuuacacaaaggggaaaucagaggggagcuaaaauagcuagaaagguagaggggugguuugaggaccugaacggaugguugcuacagaguuuggaagaugcuuuuggguauuagaugaaccuacugacucaaaagguagaauuaagaccaacugcagggacagggaagggacuccaguaaacuugaacaaagcacauggggaugcuuuggaggaguggcaggcaucugcaugugggaaaucaacugauaagucgcuaaugggcgugugaggaaaugugcgccucugaacaugagcagacuauagugagucuccagucuuacuuucucugcauuucauucugguuuauuggcauuagcacaggguuaagcaucuuuauacaugcugugaauuuuaaacuguucucacagugguaauccagguguuaucugagugucuccuauuucauaaccuuguuacuguaguugagauaguauuaaauauaugcucauccagagagucugugaaggguccugcuaggaguuaaucuaaagguguuuucuccucagguggucaaccuguugauggccauuuugcugaccguggaggugacucauccaaauuccaugccagcugucaacauucaguaugaagucauugguaauuacuauucaucugagagaauggcugguaagucuuuacuuuaaaagauaccacugaacuuuauaugccccaguacaggggaacgccagggccaaaaagugggaguggguggguaguggggggaggguaugggggacuuuugggauagcauuggaaauguaaaugaggaaaagauaccacugccaaguucuauauauagccaauuguagacuauauaugaauguuagagggcgauugauagaauugugcuugaguuguucuucaaaugguuaaauucuuuguauaauaaauucaagcuagguguuacuuaaacucuuuguugagacuauugugaugacuuuucccaaagguguucagcaagagggacaguagagcauuucuggacaagaacaugcaauggacaguagacaguagguuguauguaugcuuucacuauagagaccggauagggaaaugggaaauaaaagugguuugagauuuuuugagagccuucugugauguauagccagggucagaaauugguguagaucagauggacuauuacaguagaauauaaaauauaguguacacuguagcaaccauccguucagguccucaaaccaccccuuuaccuuucuaguuauuuuagcuccccucugauuuccccuuuguguaaguuucagugcaaaggacaaguucccuaaucuagcucuuguuaaguggaaagagacuuaacaccacuauuaaaaauggaguaacccuagaacauucauagaaaugguccuuuuaaacugauuuauucccugauagcaauucguuuucauuacugguuuucucuuuaaaauacagguauaaaaugauucuaguugaguuuacauuguuauauauaguuauaucuuaaauuuacgcagaaaauuuuacuuacacagaaaauuaugucucaguuugaaauacaauuucuacaugcuuaguuuuuagaucuuaauucccaggauuuuagauuuuauuaacuuuaauaugaaguuuugaacuucuuuauauuugucacuaccugugauccaaggaugaagauuuguaucuuccuuuuuaaagauuguuuuguuuauuuuaugugugagugcuuugccugaauauaugugcaguguggugccuccagaggcccaaagaggcagggugauaugaacugagguugucuguugcugugugggugcuagggaucaaauuguuucucugcaacagccaugacccucuuaacugcugagcccucuuuccagcucugauuugugucuccuuucccuuccccucuuccuucccccuuucucuucuccucccuccuccucuucccuauuuuucuuucuuucuuucuaucuuucuuuuguuaaguacuuuuuuugucuucacagauaacuauuuuccaggagccaagaagaguccuguguauucuguaauacagcauaggaugaugcgcauguguacugugucguguuauuguucuaaguggaaauguuucugauccuuuuuaaauacauccucgugacaaggacucugagagaagugacaaggaguaauagccuuuuggcauauuuuucacuaguaguuucuuuuuauuugaacccccuccuucucaaauaauaauaaaccaaauuuuagagucuuauuagcaccuuccuccaguuuuugagacagggucuuacuuuauaucuuagucuuucaguaggaagaaccuuuaaauccuuaacaauggagguacucugauaugacacaguaauucauguuaaauacugguugcguuuauaaugcucagugacaugauuauuuguauaaauaucuaauaucuucauuuuuggugcccuuuuguuucuuuuuaagucuucaguuauguguauguguaggagugugugcaugugagugcaggugccuggaagucagagguguccaguuucugcagcaggaguuaaagcgcgcgauugugagcagccuggcauggggacuggggacugaucugcuagagcagcaggcugagccagcucuccacagccccgucuccuuuaguuuauuccugucuguccagagucgcaggaucacaggaucagcuugugaagaugcucacccagucaaguauggucagauacuguuggggauuauuuggguguguucuguagagaauggugaccauagguuaacgcacacuuagaaguugagaggaauagauguguguaggggagagagggcaaacuggaggaggccauggauuaaaggugugagacccuggggugggauuaauggagaccuuugaauuucagguuguaaucuuaccaaagcaagagguacaucugugguuuccuaugaguaacucaucugucugaagcaaacagcaacuucucuuuccagugacgcccucaucucacgaaacccaaguugugugaauucuuucacaguguuuccuugcucugcguguguugcggcuugccuguuagguuuugucucucugcacuuagacauguagagcacaagggacuguuuccuguauuuaccuggcuccugcuccuuccuacacagucaguuguuuaacauggaaaggcauguguaaguuuuucagaauuucuuuuuuuuuuuuuuuuuuuuuuuuuuuuuuuuuuuuuuuuuuuuuuuuuuuuuuuuuuuugguuuuuugagacaggguuucucuguguagcccuggcuguccuggcacucacuuuguagaccaggcuggccucgaacucagaaauccgccugccucugccucccgagugcugggauuaaaggcgugcgccaccacgcccgcagaauuucuuaaugucaggcuuagguuuucuuuuucuuggucuuagaucuuuugagggccaauuuugaaaacaguuacaguuaauuuauacagaaacauuuuaaagugucauuuuuuuuuugucaugaagaauucaguuucuuucaaugcauauguuguuuaauuagauuucuguuuuuguuuucuuagauaaugccugcguucuuuuugccgucucuguucuuauguuuauaaucaguucaaugcugguuuauggagccauuucuguaagucugccgugcuuuccucgcuccgaguuugaccuuuaccaaggcuagugauuuuguguguguaugcuaagugguacuuuccuucugcaguaucaagugggcuggcugauuccuuucuucugcuaccgacucuuugacuucguucucaguugucugguggccaucaguucucucacuuacuugccaagaaucaaagaauaucuggaucaguugguaagugugugugcuauuuaaacauuuccacuuaagugaaacauuuuaauugaaaucacgaggcacccuugcuacuauuuaacucucuuugccuuauacaguaucuuaaaaucacucccauguuaaaaccuguaagauagacauaaaugauuguuguacuguaccauuuggauagcacaguacaagacguccguaaagacagugaguguggacgagauaguugaguuaauugugauucaguaagauguucgacuguguuuaggacucuuaaggggcuggugcuucaucuuuaucagaagguggcaugugucugugugcuugcuguacccuuguccguuauugaugugccugcuguguccuagcccuggguaggaaacuuuagcuguuuaggaacaccugcucuuuuacagacucugguguguuuuccccucuguuugauuggauccuuuccauuagaagguauuuccuuugcuggccaguuuuugacccucccuucacuucuaaugccuuucuccugacucgcccagagucagaugagugcagccaauccuuuccagcacagugagcuugucagcaguaaaucauguccuuuugccuggcuuguagccagugccguguguucuuuguaaccauccacugaagagcugagaccaagguuugacuccugggaaaguuacuucgccaaagaccugagcgaucucaguucucccgacuuucugaacaaggacagaguuggggauccagacaagugguuauauuuugucaaaagcacaagaugggaaauaaccagcaaaaugaauauuagcucuguccagaccuuuuaguaaucuuagcuauuaaauaggcagacggcagugguccguccgucgaugaugggggucccgggugugcugcguucuucuguguagauuugcagaagcugucacugucugcuguacaugguuguguucuuaaaaugcucaagcgccugguguguccgugcuuuuguguuuucacagccugauuucccauacaaagaugaccuccuggcauuggacuccagcugccuccuguucaucguccuuguguucuuugugguauucaucauuuuuaagguaaggagcuugugacucacucuugggggcccuggugagacugcucaguaaaccuuuuucuaggaucgcaguugauguaggguuuguagugacagucacugcauuuaagggauggaguccccucugucuuguguccagugaguagaauuuuuguguuuucaaaagugguucaggagcuggagagauggcucagugguuaagagcacugauugcucuuucgaaguuccugaguucaaaucccagcaaccacaugguggcucacaaccaucuguaaugagaucuggcgcccucuuguggugugugugaagacagcuacaguguacuuacauauaacaauaaauaaaucuuaaaaaaaaaaaaaagugguucaggguuuauagagaaauccauuaaaauuccuaacauuugagcucaggaauuuccuccacagucugucgguuagcagaccaaagucuccagcuagagucucugugagaaacuugggauguuucagugagagccagucaggaugagccugccuuguccgaggucccuuuuccacagacagcguggugugggagagaugaggguccucugcuccccgagcagcccgcugagcucuguuucccuuucaggcuuaccuaaucaauuguguuuggaacugcuacaaauacaucaacaacagaaaugugccagagauugccguguacccugccuuugaaacaccuccacagguuaacuacuguucuacucaccaaacugucacucuuacugaugccuccagaagugcacguggggcuugacuuucccuucuuugccauaagcgugguuuggaauuuggauaguuugaacccacaaauguuuaagauuuaguauuuuccaccaggagucuugugcacacagggcuagagcucuuuacacuguuugcccagcuugacuguuagguuuauuucuuagugguccucacaaauguuucuggacagauaugagauaauugacuugugagaauucuaagggaugcgggcugauggucguguguguguguguguguguauguguguguguguguguguguguguguguguguguguacacaucuaucagauccaaagccugguccuuggauagaugauugugcaagcaucugagugcugagcccaccucucagaaccuuguuugcuacuuugcagguuuucagcauauaugauacacguggaccauauugagucagccugucacuuagaggacuuuaggcuagagugaccuuuagaaagguuuucuauuaucccaaagggcaggauagaaggucauuguccuauaagugcaaauuauuaugaaacuucagacacugacagcuuccauuagaggaguuaguggggccucuucccccagauccucagcccuugaauuugcacuggagcguuauugguugccugucaagagacccuuuauauuuaauauauaauuuagcuuguuaguuuaucuucuagguuaguucagaggaagaauucuaauucugucuuauaucuauccacacccaucacacccacccacccacccacccauccauccauccauccauccauccaucuacuuacucauuuauccauucccauccauccauccuauccauccacuccaucuacccguccauucguccaucucauuuacccauccuucccugcauuucguucguccaucugucuaucuugucuuggccacugaucuacugcugugaagagacaccaugaacaaggcaacuuuuauuuauaaaaaaaagcauuaaucgaggacuugcuuacaguucagaggcuuagucuauuaucaaggcagggagcguggcaggagugcacagcagcacugaccgugcuagagagauagcugagagcuacauccugaucauaggcaggcaggcagacugacagacagacacugacucugacaucaacuuucucggguuuugugcuucuacuuaugacauaaagucugaaagcugauuauuuuuggaaagaauuuaaagugacauugucugacgugauucuuuucucucuucaguauguuuugccaaccuaugaaauggcugugaagauuccugagaaagagccaccaccuccuuaccugccugccugaggacauucugccuugucaauaaagccuauaccagcuucucgucuuguuuauuuuacagaaagcugcagugcgggccucucagacuuguuugauagaaaguacacugucuugucugagcauuuauuuucaaacacuaaggagcuuuuggacauuuauuaaaaacuuuuuguuaaguaucacauuuuagagacuuuuugaagacaaucuagauuaagcaagagccaagugccauuguuagccuuuagcugaggguaugggggggaggggucuccauguuuucuuuuuuaacuuugcacuuucuuuguauaauaauaguuuauguuuuggauguuuggugcccugaguaguuuccggggcgugacuacaguguugaggaugaauagguuggguauaacaccugcaguuuccagcucuaugaaacaggagagagagagaaauagcaguuugacuugacuguggaagaugaugguugcaugcuucucauuuguacguuuccaucuuugugauaaaccgcuuuaauaaagcucauaaauuuuaccauuguccuuaaau

SEQ ID NO: 6574 - RNA, 24102 nt, Mus musculus
cagaagcgggaccuuuaaauugguugccaaugugaggcccuauggcugagaccucugacccuguguaccccaguuaccucgcggcucacagaccccggcaggucgucaagcccaucauguugcucucagcccccuuacgccaccucccggggcuucugcugcugcucuggccgcuguugcuccugccuucccuggcugcuccuggacguuuggcccgcgcgagcguccgccggcuggggacacgaguccccggaggcagcccugggcaucucucugcucuggcuacuuccacccgcgcgccauauuccgggggccgcggcgcagguacaguggggugggugggugguaaacuuauucuccagagagggugccacagccauagcugggaggagggaagaggggccgggacccaggaacguagcaugcuacaucuacgugccuuuaucccagccucaggcaggcagggugcugcauccuuucccccugcaguccugcucagaaacugagggucugacaacgcaggggagcggguagggcuagaauguaaggucaugcgcauauagcaucugguauccugaauuuccuugugauuugggaagggggcaacgugcaccuguaggagcgccagccagggaaugggggcucccagcucuaucuggccuuggucuuuuggcuagggagagcaaacuuuuccugacacucuguuugcuguuaccuggaaaucuucgucuauuuugcauucacugugugccuuuuuuccuaagaagaaaggauuuagaggagacucagaauauggaaaaaggcacgacuuagcggagguguaggaagugagaguaggauggcaaaccaagcugccauuuagguguccagggaggaucuuguucuagaacccuacucuguucugccccagcccugggauucugcucauaccgacugggccccacacuccaaacuauacucugucaguccccaaagaaccagacaggucuggucuuugacgaacaacuccacuccccccuacccccagccacuaacauugcucugagcagaacaaaucuacagagcccagagaagcugauaaacaccugucaugaccccucacaagacauacagggaccucaaggauuaacauagugaaaaaaaaaaaagccaaaaccaaaaucaacaucagauccccugagugaaaaucaaaaccccaaaagucaagcaggggcuccguccacuguacagcuugccaaaguuucugcaccacuuacagaagauugccucuuucuuacccaaagauccagcucuagucugucuggucuucacuugaaagaggcuauagcaaaccauguuuuaggcguucaggcucaucuggccagccgugguguuuggcuguuuugcauggucugucuccuccugugauuugcuggauauguggaggaccagcucaggaaacuccaucaaaacugauuugaaaucccagauugaaaaugacaagagcauuggcaccuagaugggcacaaguggaacccaugcaaguuaaguuaaccaucagaguugugcccacaagcccaaguucucuuuucuugagaaucaaacugucgaucuugagacugcgauuaaagaacacuguguaccuuugcagagggaguagggacgagaagagagcucuaccuugucuucccucuugaaaaauagcaacagcagcuugagcccaucucacaucuugcucacucagaccccucuucggcuaccucuuccacuuuuagggaccuugguaacucucuugaauucaucugagaaaaucuaggccaacuuccccaguaaaagcccuccaaucauagcugcaguguuuugcuauguuuagcagcauuugugcaagccccuggaaaaaggacaggaauuauucugccuaucacaucuaagagauuccucccccaaagagaagacuuauuggggaaaccaagaaggauagacucaggcauguuuaguuacaaggacacacggguuuguagggauagcacuuggggguuaguguaagcgauggguuacaacgcuuacaccaugaugguuuuucccuccgcuacaaccauggaaaauguauagaccuauguccggguaagauuuucuacacgagucuuuuuccuugcuccuugaucccuggaaaucuugaaggaaauugggggguuguuuuaaaaagugauuuguaauuccuugugacuuaaccaaacacaugacauauacagcaucuuuuggguggugguucaaagucaacauaugaucguuggcugggcacauguugguuuuuuuugugguggaaaacuuugccucagugggagcagcugcuguguacuggaaaggcuuuggggcagggagagaagagucauggaggccaggcuuauacuacugcuuuucagggcucgcuucccucaaaccucuacuaaacaugagcagcugccuaguuccuaggacccuguguuagcaugcugggauuccuacagugccuuucacagcaaggugggauuuuauuaaugcaguauauccagcugauaagguaaaaccaagaaguuaaaaauucugcuuuuugaaagcaaaauuugaaggcuaugagugguggcgcaugccuuuaaccuuggcaagcagaggcaggaggacagugagcacaaggucauucuuggcuacauaugugacuuagaggcuaaccugggcuacaguagguccugacucaaagaaauaauaaagugcuuagguauacugauguauagauaaauaaauaacugaagggauggugauguagcucagugguacaauauugucuaggguacacagguucugggcuugauuccagcccucagaaugaaacaacaacaaauaacacccagcaaugacagagggaaaaaucccugucccagagaaagcuuuuccucucagaaaugacuuagucuaaauauuuuguuuuuuuuuuuaaaaaugaugaucacuuguuuuucugagaggacuucauucuauaucucaagcuugguuuccucccccuuagccuccuaaguacuaugauuacagcuggugccaccauucacagcgaagaauuuguuuuuggaucuaccuaccgacgagcaaauagcaucaaucugcucuuuuauuaggaaagaaggagcccucacagacaccuccuaaggacucuauuuucaccuagggcuaugcuggugugcguguacaugugcaugcguguguguguguguguguguguguguguguguguguguguguguguguguguguguguguguguguacuugcauuccugugaguguugguugaaaguagagaauggcuugaaaaaaaaaaaaaagagaugugauaacuggauucucucccaucuagugcugacacuagacucaguucaguugggugagagagggcugugcaaaucagguuggaggaagcaguaaagacagacagacagacagagagagagagagagagagagagagagagagagagagaauggcuauaagcguguguugacguacuaaagacauaagaugccuuuguguagaaagaauguaagagcuuugaagcugacgacucuccuuuucugcccuuguggcagagcuguaggcaagugacaagggggaaaaugcaaagagaaguggccaggagaguugaggggaagcaggagaagugcuaggucauggucucugcuccuuaagauaugcucccaaagacugcauguagugcauauguguuaagugaaguccuugucccauugucuccgccaagugccaaggaaggccugggauccuuucaguaccaggacuuacaaggacucucaggaacagaacuuuaaacagucagauaaguccucaagcaaaacgcugggaaggcucaaggccuggguguuuuuaacagcagagugaggauggcccucgggaaggaagccggcaaugguacugcugggaucaggagaugcuccuggcucaggcuuuccagaaccccagaguucuuugggagugagaacuguaacauuucugaucgugaucuaauguaggcuuagccuuugguauucucuauacccuucuuugcagguguuugcaagagcaggccuuuggacuugguguucaucauugauaguucucguagcguccggccucuggaauucaccaaggugaagaccuuugucucccgcaucaucgacacucuggacaucggggccacagacacgaggguggcuguggugaacuaugccagcacugugaagauagaguuccagcucaacaccuauuccgacaagcaggcccugaaacaggcuguggcacggaucacacccuugucaacaggcaccaugucagggcuagcuauccagacagcgauggaggaagccuucacuguggaggccggggcucgggggcccaugucuaacauccccaagguagcuauuaucgugacagaugggaggccgcaggaccaggugaaugagguggcugcucgagcccgugcaucuggcauugagcuguaugcuguggguguggaccgggcagauauggagucccucaagaugauggcuagcaagccccuggaagagcacgucuucuacguggagaccuacggggucauugagaagcuuucugcuagauuccaggaaaccuuuugugguaagcagccaggucuucgcuuccagcuagcgaggauaaacuauaaaguuuguaguuuagcuucuagcuagcgaggauguuauagucuguaguuugcgcgaucggaaauugguuuuuaaagauuuaucuuuaauuauguuuauaugugcacaugaguguggggacuggaugaggucagugaccuaaaauucccuggagcuggagucguaugcagucgugagccacccaugaugggcacugggaaccaaaguugggccuucugcaagagaagugugugcucuucagugcugagccaacauuccagcccccugaaaaaagaaguuuauucauuuuggggaguugggggauagaaauuuucugaaagaaucauacacaugcaauguuuuuuuggugcuuuuuuguuuuuuuucuuaaaccaaccuaaacacauggaguuggucuggaagaacaaggcuguacuauauguaacuuggguugcucauaaaaccuucauguuugaguuagacauguuaaguucuggaaauaaccagaauaaacaauccuaccucucccugaaggggucggaaauaaaacccaagcccccaaacugaagccaucucuccugccucccuucuccaccauuaccauuccuccccucuccucggaagguuuccuuaugacuucuaucuucagguucaacagcgccccgcuguucuccugcagaauccggaguggcaacugcccugcgagaaccagcgggcucuggcccagugucucuggccaugugcauuuaauuaaugacacucguuuacagauucgacucuuucucugcugauucuuuuguggaauaauuggauuagagaccagaagaguugggguuucugauucacguaagcgacacaagaaacaaauugaaaacaaaucauccugcuaaucuucuauucuuucuuuuggauggcauuugaguaggaauaagcuaauauuguuagagguuuuuuucaugaauuaaucauaugcaauaguaugaauuuauuuagugcuggagauacccccacccccaaucaggauguaaucugggugugauacuugagagauggaguucaaggccagccucagcuacauccugaauuuggggccagccuuggcaacaugagacccugccauaaaaaagaaaaaucaaaaagaaagcuuuaaaaguuuaaaaaaaauagaauuaugguuuguggaaaucacauuuuuaaaaaugucaugaucguuugaaagccucuguagaacuauugaaggaaggcgacaccuuuccaaccuuggugacuuccuaagcacagaaaguuucugucgugcacauccugugucuuuucauauuucccacauacaaaguuaaagguggcuccucccagccuucucauaccuauggaguugguggagagacaggcaagugagccaggagcuacaguuguaaauaucaaugaggcuuucuaucuaaagucucauuucuacuguggagcccagaaucaucaacugguugggaaaugggagaugaagcguuggccucaucgcugccagaccuggcuggaaucucuccugucuuccgugcuccggacacuaggccuucacaaaaacaccacuggcuuugauggcaucuacuuggcgcuuacuagguucuugaaagaaaguggcguucuuucuuuuucccagaaaccuccucaagcugugggugagggcuguuccaucagggcucuggucugugguuaaguuaggucuuaaaguuagcaacugggggugggcucaaaggcuguaaaguaauagcggugggugagcggcagucuuuucccucucuuacaaaagaccugcuuguucugggggcggggaggaaugucuucucuggaaaaaacacgacugaggggcggcuuguuguagucaacggcuggaaagaucacuccacaaaaaggcacuccuugggaaaauauuagccuuguccuagugccaagggcacuggaggcugguuuaccugccacgggagcgcaagccuccucuaacaggccuuaguuuuguagaaaugacuaaauucauugauuugccuuucaaaacacgucacuggaugugggaagggggcauuccaauggaauauaaguguuuccaggagcaaaaagauggagaugugaucgagcugacauaaucucaugcuuuucuuuuuaaucuccuuguauuuacgguuugaauccaucaucuuugaagcuacuaagaacccaaggggauaccuggguuuuagacucaugcacaacgagguuguuagcuggauggccgugcacuauuugcacgcccaaguguggucagguccagaggauaggcauucuuguguucuaguucccuuuaggcacaaaagguggaacuguugcaagucagguuucaguuacagugggcccacucgcucacagaacucuugacaguacauuauuauucuccuugacgcuuagggucgagaggcaagaguaugguuuuuuuuuugcuuuuuuuuuguuuugggggaggguacagaguucaaccaaauacaauauacuguugccugaccuguggaaauguuugauucuagcagauccaaacucagaauucacuuucuccuuugagagaugguauagcaagagcuauaauucuaauuuugcaaugucucaagucaaguaucuaauaaaucagagacuuuuguuuuguaaauggugaagucaagauggagucagaaagaacccuggagggcacugucuuggaacuaggggagaugucuaacuggucuuagguauugcugucaucacugugcauuucuuugacuagcucuggaucagugcaugcuuggcacacaccagugucagcacgugugugucagcgauggugacggcaagcaucacugcgagugcagccaaggcuacaccuugaacgcugaugggaaaacguguucaggugaggcuuccugggggaccgugguugagugagaguuauuugacaccucuucuccaggggugaguuuuccuuugggcucugaccucuuuucuccugagugccuucuagcuguuuuaccccaguuuagcagccuugauagaaaccaugagaggaaaagugagaaccuacacaaggcagccuagcauagaccuugguaccauucuuuaaaaaaaaaaaaaaaaauuagagccgggcagugcuugcucucaggaggcagaggcgcagaggcagagaggcagagagacagagagacagagaggcaguggggcagagagaggggcagaggcagagaggcagagaggcagagagguagagaggaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcaggcagaucucugugaguucgaggccagucuggucuacacagugaguucugggacagccaggcuacagagagagacccaauaaaauggacuggagagacagcucagaagucaagagcacugacugcuuccagagguccugaguucaauucccagaaaccacauggugacucagaaccaucuguaaugagaucugaugcccucuucuggugugucugaagacagcuacaguguacucaucauauauauaaaauaaacaaauaaaaucuuuuuaaaaacaaacaaacaaaaaaagaaaaccaauaaaauaaaaauaaugaguaugugcacaggugugugaguugccuagaggugucagagauggccuuugagauggaguuacaggugaucagucacugcauguucuaggaacugaacucagguccccugcaaaagcgcuauguccucauaaauacagagcugucucuuuggccuggucauuaucuaaaauuuaaucuuuagguuaguauaugaauagguuguaccauggccucuucauaggcaugugccacugucuguguucucauuauucucucucccugcugccucucucaggguccucuccccacuucguuggccccccuccucccuccccuuuaacacccaucugcuucccugcgacuugucuuguaucaucuuguauuucucacccccuugagaucuuuuccuuuucucuuaugaacuccuuucugguucugugaugugcacacacauauaaacacacacacccaauuuuuuucaucuagauuucucauaugagacaaaacaugcagcaucuuucugagucuguuuccccuggauugaaauaguaauuuccaguugcauccaauuuccugaaaaaaaaaaucaugguuucaguuuucuucacaucuccauaagacccuguugugugucuguaccacguuuucuuuacccauccacucgcugauggacacuuaggcugguuccauuuccuggcuucugugaauagugcagcuguaaacccggaugugcaggaaccucugcgcuauguuggcuuagggccucacuagugugcguucuuuguuacuguucuucuuuuaaagaauuauuuauuuaauuuauguguaugagugcacuguagcuguccucagacacaccagaagagggcaucagauuccauuacagaugguugugagccaccaugugguugcugggaauugaaucagcauccuuuggaagagcaguugauguuguaaaucacugagccaucucuccacccuccuuuguuauuguucuuaaagaaaaacauuaauacaaggggaggugagaaggaaaggcuacaaagcucuuuauuuuuaaaauguauauguuaguuuauaaauuuauauaagugauacacacacacaugcacauaugcacacacacaugcaagcuugugcacgcacacacacaucauguuccugcagugccugcagaagccagaagagggcccuggauccgcugguacuggaguuagagacaguugugagcugccauguggaugcugggaaucaacuuggguccuguggaaguacagccaguauucuuaaccagagagcaaacucuccagccccaggauccaaaacucuccaucuuuuugaauguuugauauuuucuggguuuuauuucaauagauaugagcauuccagauuagcuuucugaccacacacucucuuggacacauggagaggaacacuaagaauucugcucacugguauuuaaacaccacacagaguuaacgaagaauagaguuuagacuuuuuuucuuucagauuuuuuucccuuuaauucuaggagagauuuugugaggaagaaaacugaucauuuaggucaaacugcuaauuuuauggauagggaagcugagaugcaaagaagggaagggauauauguaucaguguuaggauccgaaaauccaaaacaacccaagcagucgcaagagucuagcaaagcaagaccuuuauuugcauuaggcauaaaaaccugaguagucagugacaacaacacacacucagggguugacugcauccuugaacagucaucuuaggaaguauuuaaccagauggcaaaaguuacuguacucaggcugcuagcgaucgaucgggccgcagaacaggcuugggaguugaacugcaaccuggagcaagaguguuacagaauuuuuaagccugaaaucuacaaacaucuaugccaaguuaucccacuaaucaggauuuagggauagaagacguccuuaggaacaugacuuugugguacgcuuauccuguucccauugguuggguuauucaacugugguggggcaacuugccuagcauucucaaccaggaugucgguuacccacggaaguccugggaacuaaagcuuuauuugaccccuacucaagauggaaguucuguucaaaauggcuucaguuugguuccuuacaucagugaguuuguugguggaagaacaagaccagaaauuccaucaguucccuuuccugugcccacucccuccauucucucucccucucccucccccucccucccccucucccucccucccccucccucccccucucucccucucccccucuccucucucuccccccucucccucccaccccucucccucuucucucccucuucucccucucccucuccucccucucucucugugugagaaugugacuggugugaauuuguuuaccuccccuuuucauguguucacaguugcuaugcucauuuuuuggcagccauugauaagugugcccuuagcacucauggaugugaacagaucugugucaacgacagaaauggcucuuaccacugcgagugcuauggagguuacgccuugaaugcagacaggagaacgugugcaggugagugggcaguguacucagucacccgccaaccuaauggcugcugaagggaugccuaaacugggaacuugggucaguuuuccauuuuugccacccuggaauuuuucuguuucuuucuuuuuguuuguuuucuuuuuuuuguuuguuuuguuuugugcaugacccugguugugcuggaacuuucucuguagaccagguuggccaugaacucagaggucugccugccuuugccucccaagugcuggaauuaaaggugugcaccacuacugccuagcuggauuuccuguaacuaaguucuguaugaaauggggauguguaccuacuguacacauauauuccaaauacuacacaguguaguaaguuagcaucaaauaacacccuauaaaauacuuacugcuuacaaaggcaagcauugaugguauguggaggcaggagcaccauaaacucaaaguuagccuagcuaaaucgggagcucaagguuagccugggcaauaggaaacucggacucagaaacccaagccaacacacacacacacacacgagagagagagagagagagagagagagagagagagagagagagagagagagagagagagagagaggagagagagagagagagagagagagagagagagagagagagagagagagagagagagagagagaaacaguaacucugcaguggggaaccugguggaccuuagccauguaacaagagagcauuguguacaucacuacagaugaucucacggacuguaccacacgagguggcagcacaccuggucuauucuugcuaagaauuuagaaccaugaggaaacaucagacagaggaagagagggucuuuaguucacaauauuuuccaaauacuucccagaugugucaaggccauaaaaacaaagauagacuauugaaugucucagaauaugauaacuucaggucuuguggggucuuggguugaauccuggaccagaaaaaggacauuagaagaauaauuggaaacagcugaauauugaguagauaaaaaaaucaugcuauauguuuuuauuaucauauuagacaucuaaaguguuggcauuugggguuagaugaaguaaguuuuucagaagucugaacuuaccuuaaaauugaaaguuuaaaauuaaaagaaaaagauuaaagcuggcuaccguggcucaugguuagaacccugguggaggcgggagggucacuauaaauucuaggucugccugggcuguagauaaaacucugucucaauccucgcucaccaaaaucguauaaaauaugucaguacaagucuuuccccuucuuucugguuguggugauacacggcugcaguuccagcauucaaggcugaagauuucaugccggccuuggccacauaguaagaccuugucucaaaaccaucccaaauauguaucucuacucuacaucuguauguaugcauguauauauguacauauguaugcauguacacacguaucuaccuaccuagcucuccccuacuccucugucucucacagggaaguacauugaagaaagaguugggucucaggugcuccuuaaauuagcuggacuccuuggggcuccuguaccuuauuuaugaaaugaaagaguguuaagauagaaauucuccaaagugugaucccccuuccuggaucuaguguaauuagcugcauaauuagcugguuuauuucuggguuggaauaagugcaauaaaacuaaaaggaaugcauuaaguauuuaugagaugcuuagguuguaaaaaacucaacagugaugauguggaaagaagaaccgaguauaacggcggagaauaauuaccgugugugaaggauuuuauuaaguccucuaacuucuaguuaaagcaaauaacgcugacagcuuugccuagucuccagccagcuucuccucaucuauuucuguucuuuuuuuuuuuuuuuuuuuguuguuguuguuguuuuguuuguuuguuuuuuuucgagacaggauuucucuguagagcccuggcuguccuggaacucacucuguagaccaggcuggccucaaacucagaaauccaccucccaaguacugggauuaaaggcgugcgccaccacugccuggcuauuucugcucuuaagcauguuucuaucuauggguaauaaaagacucguugacuccuaauuuuaaaauuucacucucggaccuucgucugucagcucuggacaaaugcgccucugguacacaugguugccagcacaucugugugaaugauggagccgggucccaucacugugaauguuuugaaggcuacacucugaaugcagauaagaaaacauguucagguaacguccauucagcaaauccuuuccuaccugacucuuuccacgguggugaagucaacuguaauucaccagggaagagguugcuggggugggggcuuaaagauucagacucaggcauugggccagcuuaaggcacuccuugcccaggggguuuguugaggucacuggcuuuuacauacauagaucacuucagaaaauuacuggggaauagguaaggaauagggaauaugagaaaagcuaaugaucuauagggguucccacccaggaaagauuuuauagccguguauacuggggacuuuuuaggcacauagaggaagucagcuguauaguaacuauuuggugugauagguugaacugaucugucuccaguuaaaacuuggccugggacuuuucuguaguguugaucuucaagcuggguucuuucaguaaaggggacuuugugaaggcuucacuuagacccacacagaccuuccagggcguuggaaguggcacauucuugaccguugcuagcugaucagucuucagugacucagagccuugugacuugacuaaugagccccugccaggaccauuaauccucauuaauuugauuuaaacgcacugcuggaacagggcagcauuuauacacauagccgcucucccuuugggcaggcacucuuggcucuccaggggcugcuuaguuuggcauaucagcgcuuuucagaggucuuuccaucuucucuucuuccuuggggaguuagacauggugggaucuugucaagauaaaugaagggaaauggcacauuauuggaucuuuucccccaggcuggccaggagcucacuauguguccaguuggccucaacacgcagcaacugcaagugccgugguugcaggcauguaccacaaagcccggcucuucuccuccuuaagaaaugaaaucaugcuucuauucccagccacuacagagacugaggcaggaggacugugaucagugaaagacuaugaacauguucagcacuuugauucuugucacggcagggaacagaucugaucagucuuucugaauucacuauggguuuuuucacuuguccuaggccauucagauauaggacugguggggugcuuuccucugguugcuuucuuugggcaaacuaucuuaaucucugaaaugcuauuuaugugauaaaaguacuucacuauuuaauugaauauaucgccauuaaucuucuucuuucucagagagagauagauagauagaaagauagagauagauagauagauagauagauagagagaaaacacaugaguguuucaucagugcuuucuguuccacaucaaacuauuagugguuggucuuugagcaauauagugcgcgugcgcacgcguguguguguguguguguguguguguguguguagccauaucaaacuuaguuccauauauagugauguuugcugugaccaguugccaaagcaacuuaaggaagggagggagggaaggaggggggaaggaggaaagagggaggaagggaggaggggaggaaggaaggaaggaaggaaggaaggaaggaaggaaggaaggaaagaaggauggauuuacucuguuuacaguuugagggucacaguccaucaucgcaggggagucagagcagugggagcuugaggccauuggucucauugaauacaauagucaggaagcagagaugugagugcuuuggugcucagugaacauucuuuuuaauucauuucugaagcccagugccugcaauggugucacccacauuuaaaguggcucuugcuaucuagaaguccuucccagacacacacgacccaggugauugucuagauucugucaagguggcuagcaagguuaaccaccacagacuuccuaaucgauuauuuguggugaugaacuacaaauaacauugauagcuuucagaagugccuacgguaaguucuguauugccaagacuuuguaccucgaaguaccauaggcaggagagagguccccucagacagcugcaggagcacaaaggagaaggaccagucaggcaacagaucaggccaagggugugcaacucagggaaggaagccacacuuuccccuggaacccagggcucugggugauuacugaaggcuucauucccagugcuggcuggguccaacaaagcuuuguauugcagacauuuguguauaguggccuacuuaacuaauggguaaauauuuucuuuccugcaugguuugggucaguccggaacaagugugcucuaggcacucauggcugccagcacaucugugugagugauggagcaguggccuaccacugugacugcuucccuggcuacaccuugaaugaugacaagaagacauguucaggugacaauugguccuugacagaguuuuuuuucaaugggaaaauguaggaggaagcuccuuuuuuuuuuuaaacuuauauccaguuauugucuugcucuuuuacauggucugcuuucuguaauuugauccgauuuucuucuuucaucuuuuucuuucuaauuaaugucucuaaaucuguuuuauuuugcuauuaugauaagauaugcauaucaucaaaucuauuuuucccccuauuuuuaaacaugcagcucuguggcagcaguuaccacagccucuaacaugcagcucuguggcagcaguuaccacagccucuaacaugcagcucuguggcagaaguuaccacagccucuaacaugcagcucuguggcagcaguuaccacagccucuaacaugcagcucuguggcagaaguuaccacagccucuaacaugcagcucuguggcagcaguuaccacagccucuaacaugcagcucuguggcagcaguuaccacaguccucuaagaugcagcucuguggcagaaguuaccacagccucuaacaugcagcucuguggcagcaguuaccacagccucuaacaugcagcucuguggcagcaguuaccacagccucuaacaugcagcucuguggcagaaguuaccacagccucuaacaugcagcucuguggcagaaguuaccacagccucuaacaugcagcucuguggcagcaguuaccacagccucuaacauguagcucuguggcagcaguuaccacagccucuaacaugcagcucuguggcagcagcuaccacagccucuaacaugcaguucuguggcagaaguuaccauagccucuaacaugcagcucugugguagcaguuaccacagccucuaacaugcagcucuguggcagcaguuaccacagccucuaacaugcagcucuguggcagcaguuaccacaguccucuaacaugcagcucuguggcagcaguuaccacaguccucuaacaugcagcucuguggcagcaguuaccacaguccucuaagaugcagcucuguggcagcaguuaccacaguccucuaagaugcagcucuguggcagcaguuaccacaguccucuaagaugcagcucuguggcagcaguuaccacaguccucuaagaugcagcucuguggcagcaguuaccacagccucuaacaugcagcucuguggcagcaguuaccacaguccucuaagaugcagcucuguggcagcaguuaccacaguccucuaagaugcagcucuguggcagcaguuaccacagccucuaacaugcagcucuguggcagcaguuaccacaguccucuaacaugcagcucuguggcagcaguuaccacaguccucuaacaugcagcucuguggcagcaguuaccacaguccucuaagaugcagcucuguggcagcaguuaccacaguccucuaagaugcagcucuguggcagcaguuaccacaguccucuaagaugcagcucuguggcagcaguuaccacaguccucuaagaugcagcucuguggcagcaguuaccacaguccucuaagaugcagcucuguggcagcaguuaccacaguccucuaagaugcagcucuguggcagcaguuaccacaguccucuaagaugcagcucuguggcagcaguuaccacaguccucuaacaugcagcucuguggcagcaguuaccacaguccucuaagaugcagcucuguggcagcaguuaccacaguccucuaacaugcagcucuguggcagcaguuaccacagccucuaacaugcagcucuguggcagcaguuaccacaguccucuaacaugcagcucuguggcagcaguuaccacaguccucuaacaggcagcucuguggcagcaguuaccacagccucuaacauacaguucuguggcagcaguuaccacagccucuaacaugcagcucuguggcagcaguuaccacaguccucuaacaugcagcucuguggcagcaguuaccacagccucuaacaugcagcucuguggcagcaguuaccacaguccucuaagaugcagcucuguggcagcaguuaccacaguccucuaagaugcagcucugugguagcaguuaccacaguccucuaacacgcagcucuguggcagcaguuaccacaguccucuaacaugcagcucuguggcagcaguuaccacagccucuaacaugcagcucuguggcagcaguuaccacaguccucuaagaugcagcucuguggcagcaguuaccacaguccucuaagaugcagcucuguggcagcaguuaccacaguccucuaagaugcagcucuguggcagcaguuaccacagccucuaacaugcagcucuguggcagcaguuaccacagccucuaacaugcagcucuguggcagcaguuaccacagccucuaacaggcagcucuguggcagcaguuaagccaguccuuccucucugggauauuuucacccuuccuaucuaaagcuucgaacccacgggacagugacauguuuccgacuccccucggacaggucaguuucccacaaaauggccacugggacuugacagggauucuuagaucaauuuaaggaguacugccacuuuagcaaucuucagugcacucaauaccguggaugcuuuuccacuuguuuaagucuucuuuaauuuucuucaacaauguuuuguaauuuucaguguacaaguuauauacuuaaaaauaucccuaaguauuuuuaauguuauugugaauagaucucucuuucccucccuuucucucucucucucccucccucucucucccucccucucucucucucucucucucucucucucucucucucucucucucucucucucucucagcauucauuuuuguuauaccccugcuguguaauuuucuaaggggcguuuuaauaagaauauccgauugagcacguggcuucacagaucuuaguguuuauuaagcaggagcaaaauauaaagugacagugauagaagacaucugacaugcacacacaaacauacacacaugcacacacaaacauacacacaaaagcacacacauacacagauauacacauauacauauauacacauacacacacauacauacacacacauauacucauacauagacacauaacacagauacauacauauauacaaacacagacgcauacacacacauacacagacacaaacacacacauacauaaacacacauacacagacaugcacauaauauacucacauacacagauacauauacacacaugcacacacagacacagacacauacauacacaaacauauacucacaguggguuaucuagauugccuaucaaaauagcucugaauuuuuagcuccaaaguauuuaagggcaaaaauuauacuucucaauucaaaucacuuaauagaauagcaguccuuuguaggaaaucaccaguagcacaggcaagacuaucacugucuucucucuauggcuucuuccuaccaguggcucucaacccuccuagugcugagacccuuuaauauaguuccuuauguuguggugaccuccaaccauaaaauuauuuuauugcuacaucacaacaguaacuuugcuacuguuaugaauugugauguaauuaucugaucaacaaagggucacgacccgcaguuugagaaccccugcccuauaguggccaccuuuaaaaagcuuuguguaauggcugguuucugacaguaacaagagcagagagaaaaacaaugaacucucaaacaagcauuuccccaguguuuccuaauaaaguuuucuguaaaauuaacauuaauaagcauuauuuccuauuugcuuuauaugauuuuaccuucugaaaaaaauguauuuauguaaguggcaaauguugaagugaauuauagauuccacgguuugcuaucguuccuuuauuuugccucuugugcugggcaggagaucuacaccccaguccccacuuuguuguaaucccuuguagcuauaacaucuuggguauugucacugucuucagacauugaagaagcccgaagccucauuuccauagaagacgccugcggcuguggggccacgcuggcauuccaggagaaggucagcucccaucuccagaagcugaacaccaaacauauccuuuugggaagauuuucuuccucuuccucaacucccuucccuuccccucccuccccucucuuucuccuucccccucccccuuccccccuucuuuucuuuucuuuucuuuucuuuuuugagacagggucucauguagucaaggcuagccucaaccuugauaaguauaugaggaugaccuggaacuucuggcccuccuaucuacugcucucuauugcugggauuacagauccuccuaucuaccucuccccguugcugggauuacagggccuccuaucuaccucucccuguugcugggauuacagguccuccuaucuaccucucucuauugcugggauuacagguccucuuaucuaccucucccuguugcugggauuacagguccuccuaucuaccucucccuguugcugggauuacagguccuccuaucuaccucucucuauugcugggauuacagguccucuuaucuaccucucccuguugcugggauuacagaucuuccuaucuaccucucccuguugcugggauugcagguucuccuaucuaccucucucuauugcugggauuacagauccuccuaucuaccucucccuguugcugggauuacagguccuccuaucuaccucucccuguugcugggauuacagguccucuuaucuaccucucccuguugcugggauuacagguccucuuaucuaccucucccuguugcugggauuacagauccuccuaucuaccucucucuauugcugggauuacagguccuccuaucuaccucucucuauugcugggauuacagguccuccuaucuaccucucucuauugcugggauuacagguccuccuaucuaccucucucuauugcugggauuacagguccuccuaucuaccucucccuguugcugggauuacaggugugugcacccaugcuugguuuacgagguacgggggauugauccaagggcuucauccuggcuaagcgauuacucuccuaaccaugcuacaagccagacccccugucuucucuuaaaaauuuaucuguaaauuucaauuucugauugacauacuaauugggcagcaauaaacauaauaauaccauugcuguggcuucuagaagucagccuagauacugcuacugagccaaacguuuuaggauauucuacuagcaagaaucuuauucauuucugaaaguugagcauuugaaaaaauuuaguucuuuuuuuuuuuuuuuuaaagauuuauuuacuuaaaccgggcguaguggugcacaccuuuaaucccagcacucgggaggcagaggcaggcagauuucugaguucgaggccagccuggucuacagagugaguuccaggacagccagagcuauacagagaaacccugacucggggaaaaaaacaaaacaacaacaacaacaacaacaacaacaacaacaacaaaaacaaaacaaagaaaaagauuuauuuacuuauuuuauuuaugugaguacauuguagcugucuucagacacaccagaagaggacagcaggucucauuacagauggcugugaaccaccaugugguugcugggauuuggacucaggaccucuggaagagcaaucaguguucuuaaccacugagccauuucucuagccguagaguucuuuucaauggcacuauagaccauuuuuacucaugcaacauuuaaauguaagaaaacaucuuucuuugcugagugcuuuuuaauagcgauuuaugugcccaacugagcucuugcauaacagagcaauuaagcuauuauuccuuagaguaauuuuuucuuuuuuuuuaauuuaaauuuuauuucaugugcauugguguuuugccugcauguaugugugcaugaggguaccagaucuccuggaacuggaguuaaaguaaauugugagcugucauaugagugcugggaauugaaccagcagccucuggaagagccgccagugcucuuaaccgcugaagccaucuuuccagcccguuuuaaagugacucuuagccaaaaaucuuccuauauccagaauuaaaaaaaccaaaaaacaaaacacacaagcagcagaucuaugggauguuguaccucagacgacacgugcuugguuauacaauuugucaagccaagaugucaaaacguaacaggacacugucuccaaguuucaaagucagcagucggagcacuagcucuggaaaaaggcuuaaccucagcacagcucaaguucacagcucugcuccuuacaccucagaggaauggaauucaggcugggccaggacggcugaccuaggagugcucagacugugcaggcggggacaucugcuucuagagcugucacaugccuaggacgggauuugugguuagcggucauucacuuuuccuguguaguacugcccuucucaccacacaaagaagaaaucguuucucccuucaccuacuaaagucuauuuccuacaaaacuaaaaucuccagagagccaaaccaagggacaguucuguaacuccuuuaaucaagacuucauaaacauugcuccccacugagaguuguuguucuaauuaaauuuucgaugagagagagagagaaaaaaaaaaaaaagaaaagaccucagcaggaguguaauuucaugaugaauuuuugaauuuuagaguaggcuuuugaugagaaaguaguucuguucacuuacagugggauacaauuuuccuuuguguugaagccuuugacagugugcuucuguuuuugaauguguaaaauggaaucacuuuggccuuaacaucuagccacuugacaacauuuugaagaaguugaaaguaacagaauauggacaaguacaucguuaaacuguguaaaacucucgccuggaaauguggagggcuugauauaugcgauucucauucucuugucacgcuaucugaugugccugcuaauaaucugccauuauaaaugcuuaacauuauuugguaaacagugugagggguuucuggagaaccauauuguuuuccaaggagauaaauguguagacccuuauuaaaagcaaguuuaaugucucauagcuaugacugugaaaucauuaauaagauagagagugaaaaguuuaagguuuuguuaucuacuguuugagccauuuaaguuuaaauuguuuauauuaguaagaugaucuuacucauaaaacuuuaggucuauuuucucuuggucauauuuauaauacgaaccagccuuacuaccaagagugcaaauuuuaugaaauauuuacacauacaaagauaaacuaauuaaacugagauuuagaauugcuuacuauuuuuguuuuuuuuuuuugcuggaauauuauuaaagcuacaaacaagggauuauaauacauguaccuaaaaauaauuuacacagacuaaguggauguuauaugacacuuuuaauucauuaaugucauggaaaugaacaacuaaagaguacuggcuaugaacuuauggugcuaagauuuuugcuaagagaaaaaauuuugaauucuaucauuuuguuuuagcaugcaauuggcaaaauuacauauuuauagaauuaauauaauaaguaacaaguuauaauauuaucuuaaaaacugucaauaagccugauuuuucacucaaaauauacugaaugcauacacuuuuuaagcgcagcucauaacuuuuagaacgaaacaauucuguaaauuuugugcuacuugaucuguuuugguuuguauuguuucuaauauauuaaaaguucccgucuuucuacauuaacggcaugguugauguuuuuaugauucuuguuauuuuuuucuaucaagcauauuauguugaauggaaugaauaauuuuugaauauguaacagcugagaaacugaaagaaugaaauggugaugauacucuuucaauaauuuaaucucaugccucuguugaggcauaaaauguuaguaaguucaggguaaacagaaagaaguuccuaaauaaaaccagugggggaaaaugugauuacagaagugugcaugugcuugagcuaguguuugugcgcaugcgugugcuuaugucugcaugggugcacacgcaccacagcacauguggacguguguggguggacgguuuguggaauggcuucucuccuuccgccacuguguucuagugauccgguuggucaucaggcuuggaggugggugccucugccugccgagccaucuugccagccccucacugugacauuuucagaaucccaaucaugucuggauauuaucuucuguuucuucuugauaguugaauaauaauccucuguguauacaugcc

SEQ ID NO: 6575 - RNA, 12007 nt, Mus musculus
acguccuuuuccuuuagccaacgaagucccgugagcgguagcugugguuccgcuuccacccgggugaggcggucauggccuugcggccaggccgagagggcggagagagcucggccgcccuggccacggcgcaggcucgcuucuccaggggcgaguuugccgaggcccgggagcuguacuccgccuucauuggccagugcgcgcgucacgggagguaacuaucgcgagagcgggcugggcgcgugggugguccccgagccacgcgcggaccgcggaguccugggcugccgcuugguuuccccagaaaagauccccuccgagcccuguccuucggggaggggacgccuuggucuccgcagaggcccaggcggcaggaagccgcuguucugggcagggaagguggucguccucggaaccacagcgacgccuuuguguuccggacgcgaagguuccgguucagcacccgcuuaagcuaagcacagucgcugcacccagcugucccguuaguguuuaccacgacgucacagcacacuccugaaguuaaggguuguuaaugugacaccgcuagaacaucacaagaguccuuucuguagaauaucaagccagcgaugaaacguuuauugcccaguacaguucuuuguuacuuugauauuugaguucgagcagcuuaucaagaugugcacucugaccccucuauucccacuacgcuuugagucuuuagaaaacgggguuguaugucgagccaaaaucugauaauuauaaaaauuuugacauuuaggggucuugguugcauucuguuuucugccaguuaaggaauuaaaaggcaguaaaacucucaagccaggcagguagcagcggaggaggaggaggugguggaggaggaggagggugccacgacuaaguacagcuuaugagagaauccgcuaaugaggaaagguuuccuaggggugagaaaacuugagugggcaaacagauaaaacccucggcaaagcggaagaggauuucaggaacccgcagauccacuccuuugaggguuuaaggaacugaggguuggucaguuugagcacagagcccuaagcauguccgauccagcuuugaacuuguguaguaguagcauagcagagccaucagcggggguggggugggguggggggcucuauuggugaaaaaaaaguagaaaagccuuuuuaggcugccggguuuuuguuuccggucagccgggucaggaagaagcaggucagguuggcaguucacuauauuuauuaucuagucucagcuccucucuugauacaucugcuuaucagggagucuuacucuuagccccuccguauuguuugucccaaugucucuguauugguugugaauuggucguuaaaccgggagaaucgauccaacucugcagguucacaauuccacuguaauagagugaagucuuuuacucuuugugauauucacagccuggcuaucuucugugcuaaugccugcacauguagcauuaguuacuucaagauuugccuuuguugcgcuuauguaauguguggagugaacacagagaaacagagaaacugggaauuucucucucucucucucucucucucucucucucucucucucucucucucuuuguguagccccagcugucaugaaacucccucuacauaccaggcugcccuugaaugcagagauccaccugccucugccucccaagugcugagauuacaagcuguaguacuggaccuggaagaucuuuauaguagacugcaagcuugucuuugcaugagaucuaauacagaagacuauuuguuuguaagacuuaaauggaauuaagccagagaggcaaaauugcuuuuucauuuuaguacuacauuaucauaaaaguuaacagaaauuucuuuuuuuuuaauaaaguguuuuugucuuugauaauccucaccucccacuacucaccuuaauuccucucgccucuacccccacuucccuuccccccccuuuuuuuuuuaaaguuaccaaaucccauguugugcugccccaguuauucauagauauguggccauacaggaggguguuugaccuaccagggccauacuugguuugacauaccaagugcagcacugugacagcacaguggagcaaugugauaccacaguggagcacagugacaccaacuuggagcaugaaacaacacaguggagcacugugaaaacacauuagagcaugugacaccacaguuuagcacugugacaccacaguggagcacugugacaccacagagcagcacuuagacuuaagaaagcuaacucucccucccuuccucagaugcccuuaacuguucguagcuccucuaggauacccacucccacccagcuccauggaguguuuacugacuugaucucgugcagguccugugcaggcaaccauagcugugaguuuaugagcacagugccccugcaaugcccggaagacacugucucuugguuuuugccccagccccaggcucuucucauuucccugagccuugggggugggagaaggguguugauuggcauccuguuuguggcugaucacucugcugacauuugcuaauagaaaauuccacauagauggucgagugauguuaccaucucucucucauuuccaccaccacuccugauaaaaaggcuagcaaacacaggagacugccuuucuacucuccuuuaggcucuaaugggcuucuuuaggaaguuucaggaacaauuagcaguagguauguggaugguacaugagcugcugcuucuuucucauuugcgcaugucagcccaggaacccauguccaccacagcgagguaaucucugcccuagacuugcagccuggcugcaagcccacgcugcaguuucagcaucccuugcaucccuugcaccuuucucugguagaguucaaaacgugaagucuaccaguuccacgguuccccuuacacaugucuuugaaaguuucauuuuauuuuuuuaaauauuggguugcugaauaauucugaacaguacugacugccuucugggggccuaaugaguaaaggugccugccacacaagcccgaugaccucaucucagucccuggaauguuuguaaagccgaaggaagcagagagccacucccugacuucuccaugcaugugguagcaccuuacacaauacaauuaauaaaaacucaaaaaauauuauguuuaaaaaaucaguacuuuaacaaugaaaaucaaugguaucagccugucucuguccuucucugucucucuuuaaagcuuucuucuaaauacuuaugaauguuugcauacacaucuaucugugaccagaugcauacagugcccacagaggccaggagagggcauuaauuucucuggaacuggaguuacacaugucugugaaccacaguguugaugcuagguauugaaccugggcccuuuggaagagcagcaagugcucuuaacuguugaaccaucucuguagcccuugccugugucuuuaagauuguaagcaaaaugucuaccuucauggaaaguaauauuuuagaauuugucuuaaugaaaucuaacauucuaagauuauccaaggauaagacuucauaacaaagcuuugaaaccugagggaaugaauaaugaaaguuuugcugaaguccugggguguguuucuuucagucugggauagcaguucagcugauguccuaauaccugcuacagccuccuguucgugagccuuuaacacugaguuaguggccuucagagguauccuuuguccaucuuccucagagcugacaaaacaaaauuucuaaguuacaacaguuccucccaacuauuaugaccauguggguguggugguauaugcuuugcucccagcacucaggaggcagaggccagccugcccuacacacugagucccaggccagccaauguugcagagugagacccugugucaaaaaacuggaauagucaaauaaugcccccuccccaauaaacugcaaggaccuccaugugcuacaauagucauggucuuucucuggguugucaaggauuaauaugccaagaaaaccauugaugggucaauugcugugccaaccugcaacugaguuccauuccuggagcccauggaauggugagaagacagaaaugaugucacaggguuuuaacugaacucuguacccacgguggcaucugugcucacacacauacaauaagacaguuuuuaaaagauaaguuacugccauuaccaauauuuucugaggguuaugcuuuguacugcgggguaaaagagagagagguggaguauggaguuccucaguuugacuuuggggaaaagaagggaaggaagaaggaagaugguaacgccucuggcugggagcagugaagacaaguugucauaggcagugggagggaggaggcuuugacccgauggcggcucccagcuguggguaucaggccucccaggaccauuacaucuaugccacuacugcuuacccaggguuucuucacggguggaaaaugacuucauaccucauuguuugaagaccaccuacauuuagacuaaaguagugucugugacauuucuguagugcacuggcaccugggcaggcacuccuugcuuagcaugcauuuccuccccccgagugugcucugaaaauagucagcaaucauuuuaguauccagcagaacauguuggcagagagcaagggcguugaagacucuaauaacauuccaugcacuuuaaaauccacacuguguuguagccccacgaaagucgccgauggucuuccacagaacuugauuucuguuuccacacgcaccguuucuucaguuugccauuuuacccuccacacagcguguuguagcaauggaguuugaugguaccccaaagagcaaggaaguggaagcgagggguuuaacaauguuauuuuaaugugaacuuuuuguuuaaagcaaauguagcccugaggauuuggccacugcauauaacaacagggggcaaaccaaguacuucagcguugauuuuuaugaagccauggacgacuacacaucugccauagaaauccugcccagcuuugaaguucccuauuauaacagaggccugauacgcuacaggcuggguaaggugguuugguuuuucacuuuuuuauuuuuugcucuucucauggacugaauucuguugcuucagagcgaucagcugucgugagggaaucaaguuugacaauuaugugaaauuuagguuuagagcuaaggaacaaggaagcguucaugaaugguuuuaggcauuugcugggcccuacagaccacagcagagcacuguagugagaaugggaccggacgcaggagccggaagugaagcuuuuagaagccuggauuaaaggguuguagauacuguuucucauuuaaaauaaaaaauaaaaccccacuucucagcuuuccugcagcuagguagaagugagauaacugaugguuuccaugcugccuguauaaaaucugaugaaaagccaccacuaauuuuauuuguuucaguuuuuauauugucagagauugaacgcagggccucauguguuagaugggagcuacugcuucugcaccccugucuccguccccgauuuagacccacuuauucuguaagggcacacgcuacugugauagacgucuuagaucccugagagaggcagcuuccuucuggggggcucauaaaagaagcuauggauacucagacuucacugugcacugacagaaauccucgacuuuuuuuuuuuuuucuaucuaugggauucucugcuacaggguauuuugacgaagcuuuggaagauuucaagaaggcacuagaccucaauccuggauuucaagaugcuguuuugagcuuaaaacagaccauuuuagacaaagaagaaaagcaaagacgaaaugccgagaaaaguuacugaaaccuuuagcuuauugagauuuuaacucaagauccuuaaaucugcauuugauuggcucuaagaugggcauagagcuauuuugauuauauguaagagacugaauuuuagaagugaaaguaaaauaauguacuuauuaauuuuaagaaagaucauguuugauagaucucuuaauagaguaaauaaaugauaccaguguauaaauguaugcuauuacagcaaaauauuuaaaucaauauguacuaaauauguacuauuuuuaguaaagguuuuauuuuuaccacauauuucuauucccaacuuuguauuuuuuuuuucccgccuauaggaaaguuguugguaaauacagucaagucauaaacucuucaccuacuuaaaauaacacauuugcuuuuucugaauacuuaaaaccaaaacuuuccacucuaaagucugaggcaggaggauugcugugaguacgcuaagccuaaacuauagagacccuuaaacaaaacccaacaaaaauaaaacaaaagacggacaaagcuuuuuuugcugacucgcuugagaaugagauacugaugugacaacgcuucacuccccaaacaguucugccugcgucuuccuaaagacgcucucguccacagccacucacugcugugacaccuaauaaaaacaauacuacaacaugcuccauagccagcucguguccacauuccccugugacugcagauaauugcaucauauucucaugucucaguauucuuucccucuggggacaucgccugcucauuuucucugcacaguguguagagaacucgcuuacuuuacauaugguaauggacugagagacaggacccuugggcuuaaauauaaacacccauccuaugggagagcaguuggaaagaauucauccuacauuugaucuuuuuuuuucuaaaacucauuaaagagauaggcuaagauuuaaguguugaauauaauuucugucucuagaugacagcuauaacgauugacaccaccagcauuucucaaauacuuagaauaagccaaacacugcucaaagucuuuaugaauugaugcagcguagagagggaggugauaggcugacaagcacgcuaauguuaagcuuagcaauucuguuuugaguucugccagcgaacaacagggcucuucgcucugggaagaacucuggagaaagcaagucaaagccagcguguccccucuacaguuuuuauuguccugguuuggcauucaaagauacagacccucaucuuuaggucucccaaacugguuuauugcugcugugggaacacuguucuugguagaaauugcccccacuggagagagacaaaacacauuugccuggcagccaaagcccaacagaacuuuguggcuucaguggcuuccgccaucacccuuaacuuuccuuuccuuuccuuuccuuuccuuuccuuuccuuuccuuuccuuuccuuuccuuuccuuuccuuuccuuuccuuuccuuuccgucugucugccccucucccucucccucucccucucuccuuuaaaguggucucaugaagcagagaaaggaauucccuguuuguaaauaauaucuggaaaaauucauggagaauuugugcugcaggugaaugaauaggagauuaaguuuggugccagaaaugaaaaguugcucuauuuucauaaucacccacauuuuccaauaugauuuaucucuguugggaagaacauuaaaagaauuuauaauguugcauggaaacagaaaggucccuuuuuauacagucuuuuguaaaaagaagcaagcuguccugaccuugggagagcuaaacaccauuccacccagagaaucaaguaauacaauuuuauuuucucuuggcucauaguuucucuauuuuacuugugccuggaaucagauguaguauaaaaaagaaaacuuguuaaaaaguuuucauuugcuuugcucaauuuuauuacucaaaaguuucuuauuuucucagaaaaacaaaaucucugaugcuuaagaucaacccugccuccucuuaaaguugccuuugucuuuuacuggcuauagcuaaagaguaccaaauuuuaucuucuccaaaauuaggcuuugcacauccgaggcccauuucucauuggcugagugauaccuuggguauuuaaauaaucauucgauuauuccuguucuccacaucuagaugcugcuagaaaagugcucacacucuguuauccagcauucccccucuucgaaaacaaagcagaaaggacuuacaguccguuauacaagucguuucacgaaggacagugaacuggaguaaguggauuuaaauuacuuucgaguuuggaagauuauucuuaacacugcuugagaaacauguuuuucucuuccaagucuggaacugaaugcuguccaugaacugacucgacaacagcaaaauacagugaccgagcaagcuagauuuccugucaacucucagucacaaucugauugcucuuuuucugugucauuucuugguucuccgccauuuucgggcaucccuauccuacucuggugagcacuauaccauuuugggagguuguaacucucagugggcaugauacauuuuaucccugccauuggugggggagggaccaguucacuauuuaugcugcucuaggguucaaaguaucugcugagucuagccuccuuaagaauagaacuugaaguuucuuucuuuuuaucuuuuuacuuuuucuuuuucuuuuuuuguccagauaggguuuuucuauauagcccuggcuguccuggaacucacucuguagaccaggcuggccucgaacucagaaauccaccugccucugcuucccaagugcugggauuaaaggcgugagccaccacugcccagcugaacuugaaguuucuuaaggacuugaguuugucaaccaaaaugcuucuaagugaaagcuguuaacaagaaaaaaaaguuccuguuacuuuuaauuuauccuucuguaucuacaccucuacaccuuucuuuuuucuuuuccuuuuccuuucucuuucuccuucuccuucuccuccuucuccuucuccuucucuucuccuucucuucuccuccucccccuccccucuuccuccucucccuuucucuccccccucccccuccugcccuccuccccccuccucccccuucuccucuuccuccucuuccucauccuucuccuggaccucacuuuguagaacucagaggucugucugcuucuaccuuccagagcuguacaccaguacauccaguucacccaccuucacaaauagagaaaucgaucacuggaaacaaguguuuguaacaauguaaacaaucagucugcauauaaacgccuagaaucaauguuuacuuuuucugaaagcauuauuaaacaguuauauugauauguaauugauauauuuaaccaggccauucaaaguauauaauuagguggcuuugauuauauucagaauuucugcacuauuuuuuaaaaagcuguuuucaggcuuuggggcggggagaggcaugauucauggucaugugugugcuucaaaaauagcacauacauaagacagaucaaaggugcugccucuccuugaucucuagaugcaccacaugguuuaagucuuuauaagagucucuggcuagaaauuuguguugaggaaauggguucuguuugccuggaacacuaauguuagauauacuugggaagguugagcuaacagaugauuguuuugaaaaaugaauuguuggugcugaagagauaucuucgacauuaagagcacuggcuacuuuuccagaggacccugguuuaauaccuacuauccacaugguggcucguagucaucugucauccaguucuaggggacccaaugccaucuucuguccuccuccaacacuuuaugcauguagagcccagacauacacucaggcaagauaccuacaugcauaaaauaaucaaauuaaaucguugacguaugugaugugagaacccacugaacagcaccuuacacugcuacuguguggaccuugaacaaucuuaacaucuauauaaguuuagauuuuaguguuuucuauaguccuuaaaaaugugccaguuacucaggggacuggcauuccaguuugaaauagcaguagagcaaagagaggagagagguuugcuacauuucucagccaguguuaggggaccucaaaagacucuucccaccauaaagacuaaaggaggaugauaaauguaguuauuuauuuaauuuuucuauguaagauuuuucuuaguaagauuaaaaaacagcucaugcuuuaaaaaaugauaggagaguuaaaacccagaaugaagugcaaaagacaaaagauggagacuucuaagugaaggaccauuggauaggaccugggacuacacagacgacaguaaacuaauguauccuguguuagugacgcgugcgcuagcauacagcuggggggaugacaccugcuguguucacagagaaggaagccuaggccagucaggaacuucccaagcccagacagacaucuggaaccacaguuaguaucaauugguuuuuguuccucuucuggcaucaacucaaaguagcuauguaaauguuuuuggucccaauuaaaaaaacauugcuuauaaauguuuagugccuaucaaggugagcguccacaaagcauguaguuuugcuacucauaacagagcauuauugcaauguuagacuugcucgugggccauuuuacccuugauugaaaacagacacaggagauggugaaaagcagauuaauauuaagagcaaacuccacuuggaaacuugaaagccacagcugccaauauguaaauuugugucuuauguuaagaaaaagcauccaacacuuagaaagagugaagcagacaagugugugcuauuucagcaucguaggcggcccagucugagagacccacccaaggaccacugcauucuguugcuugugaugcaggcuaagguuacaugaacuugucugguuuuguccagaggacaugcaaaugagucgucugguaggcaagauaaccccaaagguucugguuuuauuguccuccggagcaccagccaguuuugcaugcaugugggcgggcagugugaguuguaccccugaguucuuccugcaccgccugcaaauccccaguucugccccuccucucagcgccucagggugagaugccgggauuucacuuggaacuaugggagucaugcuacucaaaggcuagcaucuuagcuagaacuucuuaugaggcaguccugccauuucuagcaggaacgagggugaagaaggacccaaagugucuccuuuccugcugucacgugugcagagauuuuacuugcccuggcugaagcaaugcacagggcaacccuucaccuaagacaccuagaaaagucaccucaacugcaggggaguaccugcaaaaugcaaaggcucccccaucucagcugcuaccgcugcaugccaaaauucauccccugccugcaugguacaaguggccugcuuugccagcacccaaagcuguggucacacagcugcagaguggggucuuccacgugugaugguuuaaucacuggagaagaagcagaucucacagagaccagcacuguagagccuugcuuucacugucccuccagagaccccucugcgcccccccccccaucccuagcuuugccuuguccuuucucugaccaccugcuuaagagucacaaacucaucaacucuuacauacuuuuguauucuguuuccacauaccauguuuuauuuuuaggucuguucuucacugacaggugaauuaugugggcugugaccugugucuuuuuuguuaacggcuacauccauagcaccuagaacugccgugggucuuaacugcguggaguggauuaaagagccagcuuucacaaucuguucaugcagccaacgacugauauaacaccaccccuuaugaccagagucuuuagaagaagaagggcauuuggacacagacacaagaaaggacgcuugugagacuugugugagguauguccuacaagcuaagggaugucuaggucugccauaacugaaagaggcaaggagaauccuuuccu

SEQ ID NO: 6576 - RNA, 1001 nt, Mus musculus
gcggugcucagaagaaagguggcaggaaugcuaacgcuggcaagcaaguugaagcaggaugauggucucaaaggaucccggacaucagccuccacaucugacuccugaggguuucugugagagacaaguugcuuguuaaagagguugcagaacuugaagcuaauuuaccuuguacauguaaaguauauuuuccugauccaaacaagcuucauugcuuucagcugacuguaagcccagaugaagguuacuaccaggguggaaaauuucaguuugaaacugaaguucccgaugccuacaacauggugccucccaaggugaaaugcuugacuaaaaucuggcaccccaacaucacggaaacgagggaaauaucucuaaguuuacuaagagaacauucgauugauggcacuggcugggcucccacuagaacauuaaaggauguuguuuggggauuaaacucuuuauuuaccgaucucuugaauuuugaugauccacugaauauugaaacugcagaacaucauuugcgggacaaggaggauuuucgggacaaaguggaugaauacaucaaacgcuaugccagaugauaagaggagagaucacaggucugaggacuuugucacaguugucucuaaugugaaacagcucgagguaguccuccuccccauccucauacucccugucagccccuugggauugucccaguucugcgaccaugcuguccugaagaagacgcuccugacugcccacuauagguggugaagaacauaauacagcaagaaagugugucugggccucgagagaguugucugcuucccuuaacauguuuacugaaacuacugucuaggcugucugguggaaucccuccgaaguuguaaugaacucaccacugaggagauagcgcuugcuuccuuucccccaacaaucgguguccugcacaagugguguaaugacaugucccaugugacuggcagauuggcaauaagaaacccgcuauaaacugugaa

SEQ ID NO: 6577 - RNA, 1076 nt, Mus musculus
uggaaaaaauuuugaacuuucaagcuacagucaagcauucuacuuuuuuaaagcuaaggauguuggauaucauugcaucuaucuauaaguuguaauggguggcucuuuagacaaguuuagaacuuugacacuuaaguuguuucacaagaagcuuaauuaauuuucaaaaagcauugcucacuuuuaguguuagucaaaugaaugaaucucuauaugcagcaucaccuagaaaagguauauucaggguggaaugagucugaucaauaauacugcugauaacuggggcugugucuuuuguuauccuuguguggcaagaauuuuaccaagaaaugucauuuugucuauaggcauauaaccaauucuaacacuguccacuucuaaauaaauccgcuggggcuuucauguguacuuccugaacgcuaagucaagucagccuuaggagcaaaacuacaagucccagaaagccccgcgcgcaguagcccaggacagcaggcggcgccccagaguccuucgcguguagguggccccauagcacuccggaaccugugcgcuaggcccagugcaccgggcccggaagguuauggcaguggcuaguguggccgcagcgcuccuggccgcacugggcggggcgcuguggcuggcggcccggcgguucucugggccaagaaaccagcggcagcagggaggcggggacccgggccucaugcacgggaagacagugcugaucaccggagcaaacagcggccugggccgugccaccgcggcggagcugcuccgccugggggcgcgggucaucaugggaugucgggaccgcgcucgagcagaggaggcggccggucagcucaggcaggagcucugucaggcugggggcgccgggcccgacggcaccgauggccagcuggucguuaaggagcuggaccuugccucgcugcgcucagugcgagcuuucugccaagaacugcuacaggugugggucgaauggagcucgccacccucggggagggcccucugaaaccuggugugaccuugaggguggccaugaccaaaccggaaaggcuccugccugccuuggaccc

SEQ ID NO: 6578 - RNA, 5497 nt, Mus musculus
uggaaaaaauuuugaacuuucaagcuacagucaagcauucuacuuuuuuaaagcuaaggauguuggauaucauugcaucuaucuauaaguuguaauggguggcucuuuagacaaguuuagaacuuugacacuuaaguuguuucacaagaagcuuaauuaauuuucaaaaagcauugcucacuuuuaguguuagucaaaugaaugaaucucuauaugcagcaucaccuagaaaagguauauucaggguggaaugagucugaucaauaauacugcugauaacuggggcugugucuuuuguuauccuuguguggcaagaauuuuaccaagaaaugucauuuugucuauaggcauauaaccaauucuaacacuguccacuucuaaauaaauccgcuggggcuuucauguguacuuccugaacgcuaagucaagucagccuuaggagcaaaacuacaagucccagaaagccccgcgcgcaguagcccaggacagcaggcggcgccccagaguccuucgcguguagguggccccauagcacuccggaaccugugcgcuaggcccagugcaccgggcccggaagguuauggcaguggcuaguguggccgcagcgcuccuggccgcacugggcggggcgcuguggcuggcggcccggcgguucucugggccaagaaaccagcggcagcagggaggcggggacccgggccucaugcacgggaagacagugcugaucaccggagcaaacagcggccugggccgugccaccgcggcggagcugcuccgccugggggcgcgggucaucaugggaugucgggaccgcgcucgagcagaggaggcggccggucagcucaggcaggagcucugucaggcugggggcgccgggcccgacggcaccgauggccagcuggucguuaaggagcuggaccuugccucgcugcgcucagugcgagcuuucugccaagaacugcuacaggugugggucgaauggagcucgccacccucggggagggcccucugaaaccuggugugaccuugaggguggccaugaccaaaccggaaaggcuccugccugccuuggacccggcuaggaggaggggcaggucugagaaggaauuccugggagguccuaaggagaagugcauaaauaagccagugucuggacauuugguuuuguuaggcuaggacagucaccagcugaucuuugaguuguuuucccccugucagaagugaaaugugugccaaaucuuacagugucacaaggccugugagcaccacaggagaaaagcuagccaaaaacuuucauuagacccuucuuaaaacuuuucuuucuguuuuuuuccccucguuaccugguuuuguuuguuuguuuguuuuuucuuuuuuuguuuuguuuuguccugcugaaguaggagggggugucacuugcugacacccugcaucaucccuaaacuuggaaucccauuaagugucugaaaagggacaggaauaaaaauaauuuaaugcuuagcuuuauggaagguuuuauacaugccaggggaugugcuaaggacauuuuuaauaucuuuggcuauuaucagaucuuguaaagcaagcaauaauaucucuacuucaugauagggaacugaggcauaggaaggcuaagugacgugucugucuucagaguccuugcuuuaaucuccuguugugcauuccuaguacuugaaggcugaggugugugauuuccuuggguguacaguaaauauucuaccgaaguagaaaggcuguggccaaagugacuugccacagguagaucuaaaggcagacacaggagggugcuugucucuucugaaaucucuugaaucuaaggcagacauucuaaauggccuguuuuucuuuuccgugauguacuuagaccaaaagaaauaucuguaaguucauuuguuaacauuuagauauuuaacucugacaauucuuauuagugggacuguggcauguuggacacuauacuaacuuuuccaaccuccaaguuagauggacacagccaccuucauucuuguucaacauagacuucuuuuuuuuuuuuaacuuuucacuugcacugaaaacaguagcuaauaacuacuaauaacugcuaaaagcacaacuguacaaagaaaccaucucaucagaagagagaccauauugaaccacuuggaguaguaguuauugagauaaugaguagagugucacucuuuugcucaaacuuuaagccauuguacaagauacuccuguuguguucugggacaucauguugcuuauuaagagccagguagauagagaaguugguauuuuguuuuguuguuagcauuccauuugcauguaguagaucaaguaauagugcuugucucugggagauuuuugaaagcauaggaagcaaguuuuccugucucacuaauguguaaauagaauugaccaugcucauuuuugauaccauuguugcuuuggugucuugagguaaaaccaauuaaaaaaaaaaaaguaugaauacaaagagguaccuaaguaguacuguccuuuuguugcuuggcucugagguucaguguuuauaauuagaagaaaagagaaauagaaguuuuaacauucuacuguuugguauucuuggaauuuaugguauuuaucuccuagaauuuaaaaaauagaaaaugauaaagucuuaaacccagcaaagaaugauagcucagaaaugauuaauucuggaacccuucccagaggauuagugaagaugaacacuccuuucucgccauaucuaugaacucgugccuucuuuuugaaguugacuguuggaaaacaugaaguguuuuucgacaggcgagaaugagaaacaguuaaccugacagguagccucugguaacaguuguaaaauuuaacacauuuuucuuucacuuacacuuggcaaaaaaaaaaaaaaaaaaaaaaaaaaaaaaaaaaaaagccauuaagaguugaaauuugaccugaaauuaauuugaugauaggucaucaccacagguuuacaccuggaacauguuguacauuuguuuuccucuaucaucagaagauagaggagccaggaaagagcugaggaaaaacaaauucuauaaggaacaaaaaggcucucagugagaacagugcaauguaggacuugaauuuuggaagauguggagguauaugaucaaaauacuaagcugaguauauacgucuuguaauuugggacccucuuaggguccuucccucuugauccuuagggaagaaaggacaguucuagaaucacagugaagguuaauggugucuguuaauggucucuuccuguacuauugugacacuuggguaacagucccuguugucaguaauauauuuuuuaaauuaaccauucaaugauuuuauaacuuuucuaucuugauuuagucacaauucucucuaauccaaagucuguaccuaugacuuucucuuuguaccaguuuuagggaugugcacucaguuauucugucucuguagugaccuuuuacacuuaacagaauuacagaugaaagcaucuucacuuacuacucauggugauacuaguaaggugggagucacaauaucagcucucugcuagauauggucgcccugcuuacccucucaagcucuguuuuacacguugaaacuagaagguuuagguuacuaauuaugagauuagguuacuaauuaugaggauggccuuuggagucuaagaauuucaucuucaggcugaauuugacaugccucuuagcuuguugacacugagcagucaccuggguuuaccuugaacuuaggauauuauuggaaguagauaagguuaucugagaaagggaccaaguaggccuuauuagucaugcaacaucacuauaaagguauauuuuuuucauauuuugaaagauguuuuuaagguuaucauaggaacauauaaguuuaauaugcuauaccaaauuuaacauaacaucaaaacugguauuuuucuaguucaucugaaauuaagauaagacaugcaauccuaggauucucucauccccaaauuugcuguauuuguuuuuuaagaaagaccuugauaauuaacauauagucaacaucugagugaaaugugaacuauacauauucauaauuacuaaguugcaaagagcaugacagugcuucaaauaguucccagauaaacugacuaaaacuugagauuaguuuuagucucaaauucuuguucuuauuaguaaacauagaugaauaaaagauacggaaaaugugugcucauaauccuucauucucuuccugguuucaaaggaggagcccaggcuagacguccugaucaauaaugcggggguuuuccacugcccguauacgaagacugaagauggguuugagaugcaguuuggagugaaccaucugggccacuuccuacucaccaaucuucuccuuggacuccucaaaaguucagcucccagcaggauuguagucguuucuuccaaacuuuauaaauauggagaaaucaacuuugaagacuugaacagugagcaaagcuauaauaaaagcuucuguuauagucgaagcaaacuggcuaacauucuuuucacaagagaauuagcccgucgcuuagaaggaacaaacgugacugucaaugugcugcauccugguauugugcgaacaaaccuagggaggcauauucacaucccacugcuggcaagaccacuuuucaauuugguauccugggcuuuuuucaaaacuccauuagaaggugcccagacuuccaucuauuuagccuguucaccugacguagaaggugugucaggaagguacuuuggagauuguaaggaggaagagcucuugcccaaagcuauggaugagucaguggcaagaaaacugugggauaucagugaagugaugguuggcauucuaaaauaggaguaaagagaacaggacuauguauaggaugauccauuauaccccuggucaggaauggcauguuguaagcaugugcuacgugacaacagucuagccgcaaucaugcugagaggugcacauggauauuucaaagacacugcuacuauuuggggcuaauacaaaguucagcaaagaugcuaucaauguggaucauaacuagaauauaacaauucuguuauuuauuauaauugggcaauuauaacuguuaaagauacugguaauuuaaaagcugucuuaagaggguuuucaaaaauuuugacuuucauggcaaauauguucagaauuuuuacuacaaugcuuguuuuguguaaauacuaugccuaaugugugcacauaaaucacuuggaauaaaugucugauguagguuuuucagugugcauuucuuuaaaagcagcuagcugaauguaguccuuuaguuuuuccucauuagccuuucuuggucuugcaguaccaggcucuuccugucacaucuugcauguugcucuguuucuaaaucugcaguuuaugaccugguguccugacacacuuccaauccugugaugguuuuccaguuuucauuuug

SEQ ID NO: 6579 - RNA, 818 nt, Mus musculus
cuuacucccgcugcuccaucuugacuuucgguggccgcaggaagguccaauucuucuucuccuucauccccuuuguauuugccuggaaauuucgccaacuguccacucgacaaucccgacuuuccucaaaguuuuucugccacucucuuucucgcuuggcuuuuuuucuggacuucgaucuccucuucucucugucgcuuccucucaugcauuucuuuggcuucucucucuuuccuuuuaaucucuagcucagcaaacagcuucauggucuguuuguagacugccuguuugaacaguucgggaucaucuuccuccacaucuguagguuuuccuuccuucuucaguuguuguuguuguuguuguuguuguuguuguuucacucuuuaacaguguguuccacguauucuuuucuugccugaauuacauccaggacccucuucuuuuguuccuaauccaguagcaacuuguaagcuuuguccacagcuucaaaagccuucuuugcucugucagcaucguccugguuuuugucaggaugcaccaagauggacaacugacgaaaccucuuuuuuauuucuucaucugucacuucaggaucuaucugaagaaccucaaauggguucagauuaaaguaagaggaaccaggacgagucaaucuuucgauuugauuuuuggauguuagaacugaaucucucuucucuauuuguuucaccucaguguagaaggucacaaaugccuccucugugcugccuccgccacccgaggcaccacucucucccgaagccgccauuuucauggcuagcccccacgugaccguucug

SEQ ID NO: 6580 - RNA, 1776 nt, Mus musculus
uggauggaagauuuuuuuuuuuucauuuuaguggacaucuuuauuguuuaauagaucaucaauuucugcagacuuacagcugggauuucaucagauugccaugcugagucaagaacagugagugacgaagcuaaccagaggcuacauacgucagagagagagcucagccuuuacagcucacuuccuuucucaggcagaauauaaauagacgcccucuacaaugcacaaugguuuuagucacuaaggaauuuaaaugggaucuugaagaacacagacaaauccugaugcaguaaagacgagcugagaugcugugcaacuguuuaaggguuccuggugccacaucucagccacuagcugaaucuugcgcuaacaccaaauggagauguggaaaacacuagguugacuuaggagcugugcacaggaaccaaaggcaggaaagaaaauacuaaacauugcugagagcauccaccccaggaaggacuuuaccuuccaggagcucuagacuggcaccgcccccagugcucacauggcugacuuuauccucuguguuccauuuggcacagcaaguggcagugucuccaccaccuaugauagugaugcaaccccuagaaguggcuuucaccaccucauccaugagugacuugguuccccuggcaaaggcuucccauucaaauaccccaacaggaccauuccaaacaaucugcuuagcucgacccacagccucggcauauuucuugcugcucucaguaccacaguccaagcccauccagccagcagguauaccagaggccacaguagcuuggccagucuuggcauucucaucaaauuugucagcagugacaaagucaacaggcaagguaaucuucacaccauuuuucucagcuuuggacaugagaucuuugacaaucuuggcuccuucuucaucauacagagaugugccaaucuccauguuguugagcaccuuaaggaagguaaaggccauuccaccaccaaugaucaucucauugacuuugucuagcauauuauugaucagcuggaucuugucugcaacuuuagcgccucccaagauagccaggaagggucgcucuggacucuccaaagccuuggcaaaguaguucagcuccuucuucaucaaaaauccaccagccuucuguggcagauucacacccaccauggagcuaugggcucggugugcagucccaaaagcaucauugacauagacaucuccuaguuuggacagugaggcucggaaagcaucaauuuuggccggcucagcuuuaaccuuguuuccagaagcaucuuuucccuucccuucuuccucuacaugaaagcggagguuuuccagcaggaugacagucccagccgcuggguuggcacaggcauucucgacuucugggcccacacaauccuucaagaacagaacauccuugcccagcagagauuugaguucagcagcaacuggcucuaaggaguacuugucaggcaugggaacaccaucaggccggcccagguggcucauaaggacaacggacuuggcuccauuguccaagcagaauuugaugcuuggaacagcagccuugauccuuugguuguuuguuaucugguuguucuucauaggaacguugaaguccacccucaucacgacccgcuuccccuucacguccagcuuguccaaagucagcuuguuggaaagcgacauuuuggcaacaccgugaggucgaaaggcccggagaugaggaagaggagaacagcgcggcagacgugcgcuuuuuuucu

SEQ ID NO: 6581 - RNA, 1776 nt, Mus musculus
agaaaaaaagcgcacgucugccgcgcuguucuccucuuccucaucuccgggccuuucgaccucacgguguugccaaaaugucgcuuuccaacaagcugacuuuggacaagcuggacgugaaggggaagcgggucgugaugaggguggacuucaacguuccuaugaagaacaaccagauaacaaacaaccaaaggaucaaggcugcuguuccaagcaucaaauucugcuuggacaauggagccaaguccguuguccuuaugagccaccugggccggccugaugguguucccaugccugacaaguacuccuuagagccaguugcugcugaacucaaaucucugcugggcaaggauguucuguucuugaaggauugugugggcccagaagucgagaaugccugugccaacccagcggcugggacugucauccugcuggaaaaccuccgcuuucauguagaggaagaagggaagggaaaagaugcuucuggaaacaagguuaaagcugagccggccaaaauugaugcuuuccgagccucacuguccaaacuaggagaugucuaugucaaugaugcuuuugggacugcacaccgagcccauagcuccauggugggugugaaucugccacagaaggcugguggauuuuugaugaagaaggagcugaacuacuuugccaaggcuuuggagaguccagagcgacccuuccuggcuaucuugggaggcgcuaaaguugcagacaagauccagcugaucaauaauaugcuagacaaagucaaugagaugaucauuggugguggaauggccuuuaccuuccuuaaggugcucaacaacauggagauuggcacaucucuguaugaugaagaaggagccaagauugucaaagaucucauguccaaagcugagaaaaauggugugaagauuaccuugccuguugacuuugucacugcugacaaauuugaugagaaugccaagacuggccaagcuacuguggccucugguauaccugcuggcuggaugggcuuggacugugguacugagagcagcaagaaauaugccgaggcugugggucgagcuaagcagauuguuuggaaugguccuguugggguauuugaaugggaagccuuugccaggggaaccaagucacucauggaugagguggugaaagccacuucuagggguugcaucacuaucauaggugguggagacacugccacuugcugugccaaauggaacacagaggauaaagucagccaugugagcacugggggcggugccagucuagagcuccuggaagguaaaguccuuccugggguggaugcucucagcaauguuuaguauuuucuuuccugccuuugguuccugugcacagcuccuaagucaaccuaguguuuuccacaucuccauuugguguuagcgcaagauucagcuaguggcugagauguggcaccaggaacccuuaaacaguugcacagcaucucagcucgucuuuacugcaucaggauuugucuguguucuucaagaucccauuuaaauuccuuagugacuaaaaccauugugcauuguagagggcgucuauuuauauucugccugagaaaggaagugagcuguaaaggcugagcucucucucugacguauguagccucugguuagcuucgucacucacuguucuugacucagcauggcaaucugaugaaaucccagcuguaagucugcagaaauugaugaucuauuaaacaauaaagauguccacuaaaaugaaaaaaaaaaaaucuuccaucca

SEQ ID NO: 6582 - RNA, 615 nt, Mus musculus
ugggauucuccagagggcacaacucacacacucuguggccugggcucucucccgcugcuguugaggaggucugugaguuccccgauguacuugaugguguacuugagugucuggaucuuggugagcgguuggccucucuggcuguagacaggcggcagguaauuccggagcguguggagggcaucggcuaagguccgcauccugaguuucucucucucgcuggccuuccgucuccgcuggacagacaucuugacuuugcugccuuucuggccuuugaggccaccagcaguguguagauagggagguugaaaagccaacaugcuguaauccagcucgacuaagccggcagccucgugacugccguagccaucgcugccuccugugcuggccccacugugcccgcagggcagugcgaccucagaguaggacuccagagaaggagcuggggagaggcuuugagugggggacuccuggaccagcuccaagggccuggcucugcuuuuccagucccaggaggccagcagaccagcggugucagaagaguccaggccauccuccaggcugaggaaggucucacccagguuguccauacccgggaggcagcaguacaagggc

SEQ ID NO: 6583 - RNA, 6588 nt, Mus musculus
uucuuucaguuucuccggaugggccagugacugaagucaggucuggauaagucgcuucuguuagccagggagaccacuuaggaggguauucaaaguaaugcccccucuuuuaccuauuuuccccacugaggcggucuagugucuccuuggagaagagccaaagcacugcagucuauauuaacugaaggggucaggaugcuauuucucagcuuuaaccagaccaaccagcuuauugaguccccgagggcccacuggugacaacauucaguuuuagauaaauuacuuugcucuugugcuuagggagaaaaaugcacacgugugcuuuguagauuugacuuuaguuguuuguucucagaaggcaggcuguugguuguuuuuucagaaauaauuccauugaauuccacagcguggugggguguccuaaguauggcaucuuaaucuagucuucacuuacaauguuauguccaguaauaagaauuaaguaauuuuuauugaguuaugggugugugggcaaugaccagcucuagauggcaguaaacagcauccugcagaaucugaacgauguccgggcuucagaauuuuaggaucaguucucagauaggaauguccaagauuccuacagugugagggaguccgcuguugucuucuccugcaugcaaaugcaggugucccuagugaccacgagcuagagcagagauauguagcccagagauggaugcuaugugcauaaggauacaggacugaauacagccucagguugaccgaggaguguuauuuacacgacaccauuccuuaauaucaaaaaaucaauuggcagcucuuauaguuggguguuuggaaugacuauggggugggguauguauaaaggaggcuagucaggaagauauaaggaggaaggaauuguuguuauucacagauacuagaugaauccucaacugaucagaagcaauugaggggucauuuuucguuuccuccuugcaaauuauagucuuaaaauuguacugcauagugacuaaucauaaagaagcauuuaugagauauaaaaugauacuauucuauaugcauguauauauacaauguaaaaugacugacucaagcuaauuaucauauccaucaccccagauaccaccacaguauaacugaaacauaccuucucaacaacauuuauauauagauuuuuauuguuuugguuuuacuauguagaccaaggagaccuggaacaggcguuguagcccaggcuuaccuugaacuugcaacaauucuccugcuuaagccauucaaauaucaagauugcuggauggaguacuauagcauuuugacagauuacauucuuuagagaagauucuagaaccucuaucucaucuuuuucuagguuaaaaugaacaaacaaaacaaaaccaagaguaguuuguaagugaguauacacaaccccauuuaauauccccaccagcuuuaagagcagcacaggaaggcgaguggauauaugaaaugccaucaggacaagcagucaaaguuugugggucugugaccucaugaugaccuuguuuauuugaaaugcuuguguaaaaauacguaagcuagcaaggaacuuaagacaugaaaguauucagaaaacugggagaaaaacuaagugaaggacauagcaaggaaaugaaaaaggacagaaguguaaguuacuuuagucagugggugaaaacucauuuaaauugacaaagaauagguacaguuauuuuuguguguguaauucauagauauagugccaaucaagucauuuaaauuagcacauugacaccuuucuucaccaaacuaucucugaaauccuauggaucucgucuucugacucuaauccauccuucacaucacugcaguguucagacuuucauuguugucugagauuaguuuuuucauucauucuuuuugguauguguguuauauguauauacauacauauauuugugggugugugcgugugugcauauacacauaugggcgugcauagagucagaagucuuuggauaucuuucuuagucacuauugaucucacucauucauucauucuaccauauuuuauuuuaaaaugggguuauucacugaaacagggguuaacugauugacuggacuggauggcuggugagccuccaggaucucucuuucuccagccccucaagcccugagguagguaguuuacugcacucagcuacuuuuaugugggcacuugggaauccaacucaugcauguggaacaaaacaccuccaaucuuuucccauuuucaugguuauugcaugaaacauggaagcuuugcgacuaaaacaauuauguagugucuccuuucaauccaauccaaucaaaccagaauaaauuaaacaaaaccccaaaaacccucuuagcagagaacauuucuagcucccauggacccauacaaaccuccuucuugcugcaucuuuuuagcucccugggcccuauuagacuguggcacuuguagccuacuacuaaugugcuucccaggucuccuuuugcaagaacuccuucuucugggaaacucucuuuuacuuugagugaccuuuaagaggccuauuacuccuucaaguucaacugcgauaacaucccuuaacagaaaaaucuuucuccucauagcacauagacauuuuacaaggcuacucugaagggcacccaagaacauauacaaaauacaaauuguacagcucugacucuaggcuacaaugaaaggacaacccauucgguaaugcaugcuacagggaaugacaguuacuucccucagugcugugaccaaugguaaguuucccaaacuuuggcaaauaugucucacccuccuaccccacucauaaacccggugggcagcaauuuaaaaagacgugaaaguaggaggggaaauuguuggaaauaauaaaggguucaucaggagaagaagggggaaagaaaagaauaauggaaaugaauauguucaaaauguguugcauguauauauucaauugucaguaucguauacgugugugaaauugucacaaaagaaaauguaaagacagagagacccucauccccaacgucaugaucuucuuccguuugcacugcccguguacucaugggugcaggguuguucaguagaacaugcugacuuaccagcguccacaccauugaagaaaacagacgcuuccucccaaggagccauaauuggcuuaaucuaguucagguuuuaugcaggcaaccacaguugcuguguguucaugacuugggaaggaggugaaaauagucaaaauacauuguaugauacucagagaaugacuacaaauauuauaguauuuuuuuuaaacagaggggaaaaaaagcuacaagauuuccaccuccauguuugcaugucuacugauacugccauugcucagaucuuguuuaugcagccacuguauuuuaaaguugcauaaaauaaaauaaaugaauaauuuaugucaacaagacaaaaucuguuguuuuacaacuccuacaugacuucacaaucuuauacuauuugauauccaaaaagauaucaguauuuucauuuuuauaacuucaaagaaagaccauaugauaucacuuucuaaagguuuuacacuuauacuguucuugaaguugguguaccugaguauucuaaucauaugucucguuacucuucugaggcuguggaauguuccuuucauuucuaucuuuccaagguccaacuucucauuuguaaucacaagaauauucaggaguggauucaaguuuaaaaagaaugugaauuauuguuacucauacuccaagaacacaaaauaaaauuauuuggcucaauuuguuuucuuugguuagaauacaagaacacauuaaaaacacucauuuuauuaaccauuuaucacugaauuccauggaaaaguuaaacuggaaauccaaagcacuuacugaagauuuuuuaaagcucauauaugaaggcauauauggauaucuaucuaucuaucuaucuaucuaucuaucuaucuaucuaucuaucuaucuaucuuuucagaacucagguguauaggaauauuuuuuaauacaaauuacuuaaaauaaagaaaaaaguaaaguuuuucacuggcaaauucuuaaaaauauaacuucuaaggaagucuaucacaccauuuacuuugucauuucaaucuggcuuguuauguuuucauuuuaaugaaacaagauuaaaauaaaaccagugaaacauuaucauuuaaaacaaaggcagguucaguuuuaaaugguguggugguuugaaagagaaugauccccagagguucauauauuugaaugcuuauuccuuaguugguggaacuguuugggaaggauuagguaugcggccuuguugaaggagggguaauauaccaauauauggacuuugagguuuucaaagccuaugcuauucccaguuaguccucuccuuuuuaucuccuguuuguggaucaaaugugagcucucaacuacugcugcaauaucaugccugccugcuugccugcugucaaaccucccacucacccucuaauaaagucucugauuaacuccuuuuuucuaucaguuacugcuuuggucauggugucuuuuuacagcaauagaaaaauaauuaauauauguaucuuacauacauaaauaaaauuuuuauguaugguuuuauuagaaggcaaaauugcacuuccucauuuuguuuuauuuuuauuuuuuaaauuacuagggcaauaaaauaggucuaauuggaggagaagagaauuguaagaaaaguuuuuacaaucacaucagacuaugggcuugucaaagaaaaauugccaaagacacggaaacaguguugauuugaagcugccaggggaagguaaaguggaaguuucuggugucaugugcugcagauucaugugguguuuugcugagggaagaccugugguaggacgugugauguuuggagaaaguauaaauaagacucaauggacagugauaggacaccugcauagcuagcuuugcaaaacuuucuuguucucaugucuucgcagauuuucacuucacugagagaggcagagcagagaauaucuccugguguccuugcuaauucuggucauuccugcugacuugugccaauuuggcggaggccuggcaguuucugcuggaucuugcugcugcugccgauucaaguuugguauccugacacuacuguacugaacugcugguauccugacaaauggagauuggaaucaccccagugaauuacuuuuaaacagguccacacccccuugucuuauuuaccaucuuuucucccugucuuuggauggugagcuagaagggguguggaaguguuugagaaaucuuauucaaaaccuaaaaaaguagguuuugaaaaaccuaagccuaaaguccacagaauuugaugcucacuugaaugaaaaggggaagauagauugaagcgcaaucaucuaacuagaguugggcuccccaaaccaugauauuaauuuuugaaaauagaagaggcacauuuuuaaauaaacagacugagagaugguccaguaagauuuaaaaauaaaaaaaguuuuaucaggcaacugugaagaacugaguucaaaucccagaaauuaccuaaaauccuaguauuuggaguuccagaagagaaggagaaggagacagaagaguccccagaaacuccugcagcagcuacccuggaguggaaaaccagcaaggacacuugagcccagccuuugacuuucaggggcaugaucacauuuacacauagaaacacagucauagcacccaguaagcaugcaaagaggagaaggagguucacaucuggauggguuugucaucuguaaagcuguaucacauccacacagagaggucaauggacaucaagcagagaugagacuggugagaggucugugcugggaaugcagaacuagcaguuauccacagacagcuaaagaaccgaggacauggggguugauuggugaugguggaagaggagugaguguagagagaaggggugaaacuuuaggaaccaucuaaauuuggaaaacggaauuugguuguauaaauuauagucauauuagcacaaauacacugacuggggguugggugaaagaaaaagauaaaguaaugcauuaaacuguaggaauucuugaauauaguacaugcucuuauuccuguuaauagucaaauaaauaaaaauaauuaaaaaaugaaaacagaacgcauugugugaucaguugacuagacucaauuacagguaccaguuuuagaguuguagaauauucauauuugaguuuuaccaaaaugacauauuaucugcuaugauaaucuucagggucauucauaaauggguacagccuaagaauaaaucuauaauagccacaaucuccuaaaucuugcuaccuaggaacaacauugaaaucuucacgucuuguucuguuugaaagguaaauaauuggaacuugagagugaauccacucugaaagcaaguggaaucugauggacuaaggacaauuuuaaaaugcucaaguuuauucauuccauuguauguaggcgucaauuuaaaugauuaaaaauagacccuucuaaugc

SEQ ID NO: 6584 - RNA, 2040 nt, Mus musculus
acauuuuaaaauccauuguuucuuacucauuguuggauugaguaaggccauuuuugguucaacuuauauugauagcauacccaaagaagaaacaaacaccugagcuuucagucuuuucuaaaggaagaaaauuuucuguguucagaaagguggauuuaaguugauaacaaagagcuugauagggagaaaggaagagaaagaaaagaggacacuguuaggacacaaagguuuaugugauuuuagccauuacaacaggaguucagaaagaucucgaguguuacauugauguuaucgguauuacaaaaagagaaaaaaagugacaggcaacagugaagagcaccagagacccaguacaaaccuaagaccauucuccuuccuucaacugccaagguauuuucacaaauuaagcccccaccccccccccccuuucaucucaacuuucccuaaccugcuuggccuggggaacucaagccucaucuucgcccuccuccuccucgaacucgcccugcucaucagccguggcauccugguacugcugguacucagacaccaggucauucauguugcucuccaccucggugaacuccaucucguccaugcccucacccguguaccagugcaggaaagccuugcgacggaacauggcagugaacugcuccgagaugcgcuugaacacuccuggauggcagugcuguugccagugaagguggcugacaucuugaggccacgaggagggaugucacacagccgucuugacguuguuggggauccacuccacgaaguagcugcuggucuuguucugcacguugagcaucugcucauccaccuccuucauggacaugcggccacggaaaauggcggccacggucagguagcggccauggcgagggucgcaggcagccaucauguucuuggagucgaacaucugcugggucagcucgggcacugucagggcucgguagugcuggcugccccggcuggucagaggugcaaagccuggccugaagaagugcaggcgugggaauggcaccauguucacggccagcuugcgcaggucugcguucagcuggccugggaagcguaggcagguggucacuccacucaugguggcugacaccaggugguugagaucgccauagguggguguggucagcuucagggugcggaagcaggugucauacagagagccucauugucggugcaguagguuucaucuguguucucuaccagcuggugcacugagaggguggcauuauagggcuccaccacaguaucagagaccuugggugagggcaugacgcugaagguguucaugauguggucuggguacuccucucugaucuugcugaugagcaggguccccaugccugagucagugccucccccccagugagugggucagcuggaaacacugaagacagucacagcuuucugacucguuccucaccacguccaggacagaguccaccagcuuggcaccaucuguguaguggcccuuugcccaguuauuuccugcaccacucuggccgaacacgaaguugucuggccugaagaucugcccaaaugauccagaccugacugaguccauugugccuggcuccagguccaccaggauggcccuaggcacauauuuauuaccaauugcuucauuguaguauacauugauucuuuccaguugcaaaucacugucuccaugguaacuuccaguggggucuauaccaugcucaucacugaugaccucccaaaacuuggcaccgaucugguugccgcacuggucugccugaaugugcacgaucucucgcauggugccugguuagcuucuugcugccuugggucugugucagugcccaacuauguuuucuaauauacagagugaaauaguguacauuaaacuuuucuuguaugaucuauuuugagucacaaauuaucaacuuaugagucuucugaaaaucacucucaaaauauauuaauacaaucauauuuaaaggaaaauacuccaaaaauaaacuucuaaggcaucaaaaugcauuuuugauauua

SEQ ID NO: 6585 - RNA, 2040 nt, Mus musculus
uaauaucaaaaaugcauuuugaugccuuagaaguuuauuuuuggaguauuuuccuuuaaauaugauuguauuaauauauuuugagagugauuuucagaagacucauaaguugauaauuugugacucaaaauagaucauacaagaaaaguuuaauguacacuauuucacucuguauauuagaaaacauaguugggcacugacacagacccaaggcagcaagaagcuaaccaggcaccaugcgagagaucgugcacauucaggcagaccagugcggcaaccagaucggugccaaguuuugggaggucaucagugaugagcaugguauagaccccacuggaaguuaccauggagacagugauuugcaacuggaaagaaucaauguauacuacaaugaagcaauugguaauaaauaugugccuagggccauccugguggaccuggagccaggcacaauggacucagucaggucuggaucauuugggcagaucuucaggccagacaacuucguguucggccagaguggugcaggaaauaacugggcaaagggccacuacacagauggugccaagcugguggacucuguccuggacguggugaggaacgagucagaaagcugugacugucuucaguguuuccagcugacccacucacugggggggaggcacugacucaggcauggggacccugcucaucagcaagaucagagaggaguacccagaccacaucaugaacaccuucagcgucaugcccucacccaaggucucugauacugugguggagcccuauaaugccacccucucagugcaccagcugguagagaacacagaugaaaccuacugcaccgacaaugaggcucucuguaugacaccugcuuccgcacccugaagcugaccacacccaccuauggcgaucucaaccaccuggugucagccaccaugaguggagugaccaccugccuacgcuucccaggccagcugaacgcagaccugcgcaagcuggccgugaacauggugccauucccacgccugcacuucuucaggccaggcuuugcaccucugaccagccggggcagccagcacuaccgagcccugacagugcccgagcugacccagcagauguucgacuccaagaacaugauggcugccugcgacccucgccauggccgcuaccugaccguggccgccauuuuccguggccgcauguccaugaaggagguggaugagcagaugcucaacgugcagaacaagaccagcagcuacuucguggaguggauccccaacaacgucaagacggcugugugacaucccuccucguggccucaagaugucagccaccuucacuggcaacagcacugccauccaggaguguucaagcgcaucucggagcaguucacugccauguuccgucgcaaggcuuuccugcacugguacacgggugagggcauggacgagauggaguucaccgagguggagagcaacaugaaugaccuggugucugaguaccagcaguaccaggaugccacggcugaugagcagggcgaguucgaggaggaggagggcgaagaugaggcuugaguuccccaggccaagcagguuagggaaaguugagaugaaaggggggggggggugggggcuuaauuugugaaaauaccuuggcaguugaaggaaggagaauggucuuagguuuguacugggucucuggugcucuucacuguugccugucacuuuuuuucucuuuuuguaauaccgauaacaucaauguaacacucgagaucuuucugaacuccuguuguaauggcuaaaaucacauaaaccuuuguguccuaacaguguccucuuuucuuucucuuccuuucucccuaucaagcucuuuguuaucaacuuaaauccaccuuucugaacacagaaaauuuucuuccuuuagaaaagacugaaagcucagguguuuguuucuucuuuggguaugcuaucaauauaaguugaaccaaaaauggccuuacucaauccaacaaugaguaagaaacaauggauuuuaaaaugu

SEQ ID NO: 6586 - RNA, 984 nt, Mus musculus
caugcuuuuuuccuuuccucuggcggcagccaucaggugagccaagaugggugcauacaaguacauccaggagcuauggaggaagaagcaguccgacgugaugcgcuuucuucugaggguccgcuguuggcaauaccgccagcucucugcgcugcacagggcuccccgccccacccggccugauaaagcucgaagacugggauacaaggcuaagcaaggcuaugucauuuacaggauucguguccgccgugguggucguaaacgcccaguuccuaagggugcaacuuacggcaagccuguccaccaugguguuaaccagcugaaauuugcccgaagccuucagucuguugcugaggagagagcugggcgccauuguggggcuuugagaguccugaauuccuacuggguuggugaagauuccacauauaaauuuuuugagguuauccucauugauccguuccauaaagcuaucagaagaaauccugacacccaguggaucaccaaaccaguccacaaacacagagaaaugcgugggcugacaucugcuggccgaaagagccguggccuuggaaagggccacaaguuccaccacacuauuggugguucccgccgugcagccuggagaaggcgcaauacucuccagcuccaccguuaccacuaauacacgugauauuuguaaaauucauauccaauaaacaauuuaggacagucaaaaaaaaaaaaaaaaagaacuaagaacauccauuaucguucucucuccuuggaugaguugucaaggucauacccaucaauaauugggccauuacgauaucauucugauccaaguugacgucaaugagugguccuugaggaucaggcuccuuucaguguuuuucugcuggcaguaguucaccuuucauuuaguuuuccuccucuccucucugggauucugcauggcugagaccuaagauuaguugcuugcagaagaacggguaggcguuuaua

SEQ ID NO: 6587 - RNA, 3604 nt, Mus musculus
cugacaguaauaguaugugccuuuaaucugggggggagggcagauucuuuuguaaguacaaggugguagacuacgacccucuuucauauuaagccaaaacaaugaagauaaaaaagucuaugcccucagucucacauguuguggcaggcacucagaggccacuguauuauucuucacugcagaaacuucuaguggaggguuggcaagaugguuuggagggcaaaggucauugcugcucaucucugaaauccaugaaaaaguagaagaaaaaaaggggcauuuauuauuuauucauggagagaaacggagggugaagacuucuugucucuucuacuccuuuaggggaaucuauuugauuagggcucacuagguuagcuagcgacuggaggauggugggaccugcaugcucagauacuugaagcuucguauagccaugcacuggcuugcaauuuugccugagaaguuaaucgaguacacauguaauacaaugucauaaaaugaagaauacgaugacacuuagagguaaaaaacaaacaguuccaagaaucccaaggagggaauagacacauugauauagcuucaaggaauauucaaaggcuuaggugggccuuuaaggaccuuuaacaauccuguccauugaaacaguuuuuuuuuuuuuuguaggaaccaucuuuuauugggggaggguucaucaauccuucuuggccgccgccuuccucauggcugccagcacguugcucagcuccucccgcuuucucuuggcgcggaugugcgugcccaccuucuucuugaugaacuugagugcgcgcuuguccuuggauacuuugagcaacuccauggcucgccgcucguagggugcgaagccgcacaccucccggaucaugucccacacgaacuugguguguuuggugaggcgcccgcgucgccggcugugucucggcuuacugacguuuuuugucaccuuguggcccuuguugaggcccacggccaugggguagcgcagagccauggcugaugcucuccgauggcggccgggacaggaagcugaaacaguuuuuaaauuauggcgugguguacggccauguguauaccugauuaugggcauucaugcaguaguucaaagcugaugucuggaaucuuauuucaauaacccuccaccauuauuuauguauuuauuuauuugugagugugugaguguguguguguguguguguguguguguguguguguguguguguguguacauguuuaggcacaugccgccaccuuauuucccaggacagucuuucucaguugagcccagagcuuuagugguauuccuagucuggccagugagcuuguuccaaggaucccaucuccacuuuggauuaugggaggguguacauagguucuagguauucaaauucuagucuuuacacuuuuuuaaaaagcacuuuaaccacugaaucaucucccccaacccugagugggacaaggucuugugauguagcccucaucugaccugaaacucaaacccaggcuggcuuugaacuuguagcaaaccugcgucagucuccugauugcuggaauuacagacauguacugccacauguacccaaaauucuauuuuauauuucucggggguuuuuugaagguggucuuuuggucuuccaugaagaaguuuguaucacaucauuagccuacagauuacaaaucugugaacucuccugggaauaaacagagcacugucugggaacuuugguaaauuagguagaaauuuguccggugcaugaguggagugacuucucgguggaggacugaagggaacugccaagucuuucuuccagaacaaauggugagaucgcuguuuucuguaacccaaagcccuugcaacaaauagaguccucuccugcucauuaucuugucauuaaaaccucuggcuugauguguuucccuauaaaauaaaccugagaucuuauucauacggagggaaacgcaaaggcaggcucuccugugcauaaaaggacccaguguaaaggagcuuucuccugccucuucaguuugaugaugggaucucauggccagacaacauuuuuugacugguaagugcagaaaccgcccucuugaguuacuguugagugaaugagagccuuuguuuccccccaaagaauuaaaaaccuaugggccucccccacacaagcaggagcagguuucacacagcgguguugggauuaaaugacuguaucaugaggaaagccagaacaaugugugcucacauuuuaaucauuuaccaggcauuccagucucacuauaaguuuuacccacagcuagaugacucggucaggaaugacuggcucuagcauucucauuuugugccaccuuuccaccugaaaguaaacugcuccaccagagacaucuaacagacaggauccagagucugcgagccggaaggggcucccugacggcucuagagagugugguccuacuccuucacgcugcagguuuccaagugagguucagagaagggcaagcugcacagggucacucccagggacagaggcaugcagagaucagaacguuccugacuccagguucucauuuucaucaacuaccaguuuugacauuucucacacucaaaaugauauucgcgaugcuugcuuucucguuauuguuuuugagacagggucucuuguagucuagggcuguccucgaacucuuaaauguagucaaagaugaccauuuguuucacucugugugugaguguguguguguguguguguguguguguguguguguguuagcgugugcucacacuugcucucucucaagcagggacgcauacucaugccauaguuuuugugugaaagucagaggacaacuuucagagcuugaguuauggguuccguggauuaaacuugggcuuuuaagguuggugacaagcaucuuagcucgcugagucaucuugagggcccuaaccuucaacuucuccucuugcucgccaugcugagaacacaggugugguccacauacucaguucauuguguuggggguugagcccaggucuuugugaaugccaauggagcuccuugcccugagcucaacgacuguuuugaaguaaggcuccacagaaagacugcaaaguauaggauaggaaccccaccccaccccacccccaguucuucacucaggcagcaccacgcuggcauuccugcccugcgugccuuuccuuucucugugcgaggcagggucgcugucaaucucucggacucguuagaauaguacaaggaaauggcugggagagugcugugacgcuuugggagugcuaagcgaaugcaaagcauaauuaugcgugugaaaacggcugcuuugcucaguguaaaacagaaggaggggggaaucaaugagaagggugaugaggugccccagaggugguguucacuuacagacacugcauccuuccacaugaaauggguccuguagacagauacuggaaccaagauauuacccaaaagacagcagugggacuucucaaagguggcaggaagaauggagugaauucaagagcaacuaugcagccuugaaaugagaagagcauggagcucagugcugacauucacugccugug

SEQ ID NO: 6588 - RNA, 5836 nt, Mus musculus
ggaaaacaucgccuugcaucauuuaauugcuauuuauuuucauaaacaugagguauuucaaagugcucuaaggugcagcacuaaauauauacauuuugaagaaauuaaacacagaacuuugccauuuuacccaguucuaugcaccaaacaugaacaaauacaguaaacaaggaagaaacaggcuaggaaaaaaaggaauauauauauauaguaaaauuucuuuacaaaaguuucuuaguucaaaaagugauaaaguaauaucuacucaaaacuuccacaacucauuuucauacgaaaauauaaguaucaaauuuaguuauguaucagcgucauacuaaaguauacaggccguguaggaauuaguacaguacauaacagauuaacaauauauuuguauacaaaacaugccccucaaacauugagguauucuuacaguacuuaggugugaacuuccagucuaauacuggccgcaagagccaccucucauuacccaggacguauacaaaaggcggguguaucaaugguauuuacacaaguguucccaggggcaucaaauggcaacccccccuucuguggcauuugcuggaacuuaagcaccauuguaaaaagaaggaaugacucuguuuggaaucuuggaccggaacaaggugacuucacagccuccugaagcuccuuagugucccgaacuuccacggcugucaccaggugauauggaggaggaaaacaagccacccagcaucccauaagucaguuuuuuuuccaaggucauggcagaaccccguguccugcccccuacccagauccagacucgacaggggaccaauuugaaaguaaaccaacauucuuaaugucaacacaauguuuguuuaaaaaaaaaaaaaaaucaaaaugugcaaaguggcagugacuguccgugugggaaacguuuagcaaguccgagcguguucgaucuucuuuagcaacugcugcugccucgccugcaguuucuccuuuuccagcaggagcuggugcucguuggccuguagggcgugcacguacucgguggccuuuuucaagaugaccaccuuggcggccuucucguucuucaccagcucaggcacauggucccugagcgucaggaagcuggagcgcaggucguuccggcguugacgcuccaggauguugugguugcggcggcgcucgcuguccuccgagucugaguuucgggggcucaggcucuucgcuuuugcuggaacaacacuuuugagggggcguggagaagccucgcucuugaucuuuuucugcgggggcgcguccucgcucuccacguagggugagggugcagcauaguugugcugcugauggaugggaacacagcgcuugaggaucagcucgccaggcugugcucgccccaggcccagagcggaggucuugggacgcacagugaucgugaaagugguuaccgccuuguuguuagaggaggaacgucucuucucuacggugaccacaucgauuuccuccucuucaucuuccuccucgucauccucaucaucugaggggaaaaauaguuucugguuaauugugcgauuaacauacacuuguuauuuaagucagcuagguuugcugaucacaacgcggacaagagguacgccccaccccuuuccuucccugggugguguggggccagcagggcacuugucugauguggaagggcccaggauucaaccccuggugacaaacuugaggauguggcagaaacucgaggaacccaacuggagucagaacgagccguugucggcaugauccuggaaaaacucuucaguguccucagcuauucaauggggguaauaaccacaguguuugaguuuggcagacacuauguagacuuggcgacagaugcucgguaauaggggcuuuuagcauaaucaccagccagucugccccauggauuuacuuauacacacuuccacagccgcccuucagaccggaggcuccuccuuugguaaaacccauggcuggguuugauucugccauccuuaaaacucuaggacaaucucauucacuacgacaacaaccuuuccuggugcgaacaugcguuguacggaguaagcaguuuuucaucuaggcagagaucagaucucaauuauaaagcucuaauccacaguagcucagagucccaaagggggcggugcacgagaaaaaaaaaaaaaaaagccuguaucguccuauguguauucauucugacuucguuuacugccaggcuaggagagaaaauuauggcuuaaaagaagaaaauaaaagcaagcacgaaaaccaaaacacaucgucugcuuaaucuagggaggaccggaaagcggaacaauugugagguuucuucuucuaaggcugaaauguuaggcugcuccagccgguaggucccuuuaagccaguguuuugguuuucagccaagaagacagcuguuggaaggaacugcuuccuaacagaaagcugucaaggcacagacauuaaagggacagagcccuuucaaagugcaggcuuaucaccaaguuuccucccaggagccuuagagcgaucccuccacagcccaggaggaaauuuagacuuuuuauucuuuggcauuuugaaaacacuggcuuccaaggucuaauaggggggcuggaccuacagcucgaaggacaagggcagacuggauuuggguaaagugugguagguacuuucacagccccauggaaaaaaaaagcuuucuucuucuuuuuaacccuuucuuuccgaggacagcgcagauaaaggcuuacaauagaaccaaugaauccuaagggugcgugcauuccuuaggagcggcagugguagggacccgcccucaaccuucaagggcaauggguuauggaacacaacucagcucaauuaggucagaaauuccagcuaggaaacacaacgggacuaguacucaaucaaaaccggaaagaggcucucugaaaacguacacaaccacuaaugcacuugcugccagcugcugaacuggagggagggggugcccccaucacccccagucuuuuugauccugccugucuugcgucagacacaacgccgccugcuggccacgcaccaaacgcaaacagcccaccacccacggagggcucagaguccuaggggaggggagggaggaauugccaggcauucucuuaacuuuugcaagugggauugugcagcccucgucuugcagggagucuuuucccuuccuugaccuggcuuaaagguuccuuuccaacggacuaacagauuucuguacagguaguuuuuuggacuccacagacugacugagcuggccaccaacuuuugccacagugagggcaugccuaccgcaaggauucgcgaaaaaggggauggcaaauuuaagagaagguguagcugguguuuccagccucuucugucccgggaggcuggugaacagaagagaaucacccgcacaaaucuaugauaacaaagggaacgcagcacccccaccuucccaguccguaaggagcuagcaagaacucuacucuaggcuuuaccugagucgcucaagguauccucuccggaggugcugagggccuuggccuccccacugcuggcaggacggccgccugcacgagcaggagcagccaccggggcaguagcuggaacagacacacuagugaccgcagcgcuggucgccggggcgcuagugggggcagcgggcaccgacgccgacucucgcuuguucaccgggaaggggaagaccacggcgggguccacacauucggcagccgggugggagaggucgguaggcaggguggccccgguguggcuagcacucgacgacccaccaagggcacggcccccggggcugcuggcacccacuccgggagccgagcaggcugagcugacgcccgggggcccguggccgugcuguaguuuuucguucacugcgcgcucuagcuucucgcgggcagagaagccgcuccacaugcaguccugaaggaugaccggauuaggagugaggccacccaggcccccgagaccgaacgcauccuccucggccggguugccccacaggucggccuccggcagcagcaucuccguagcccaauucgaaggcuccgggcugugcucugggaaggcgcggcugggcgacaacgggggcgugggcagcagcucaaacuucuuccagauguccucccccgguggggucgagucgggaccgccgaaguagaagucaucuucguccggguagaagcagggcugcagugagucaaacucgaggucuggguucuugcagaucauccccggcaugguggacgcggugcagcugggcauggguucgccucucuuuuaauaucuccgcucuuuuuaauaugggggagugcuuccuucccguggagagcagcagagucgcgccaaccuccaacucuacaaccaauaggcaaaccaagagagaaugagccaaagggguggguugguggggacaggcagugggagcccccaaucucuucugcaagcuccccacagcucuggaaggugggagaaaguugagcgucuccccuacucccuccuuuuguguacaagcugucuaagacugggagugggagggggcuugcagaugcagggggugguguggcucucugcaacuuuggaaacugccguuucauucacacaaggcacugccugggggaggggggcuguucaagcugcagaucucagcucuuacuagcgcgacuaccccacuugcacuaguugcuuaaaggaaguccuugcucucuagcccagcuaccaggcaugggauugaaguaccuuucauuccccuuuugcagaaaugcgaucacgggagcgcaaacgcuaacgggguucaggaaacuuuauuaauuauuaagggccuuucuccagucagaccaacaacaggcaauuacauacaacccucuccaccuagaccuagagccucaaucuuggcagauacccuugguacucaucgcugccuauaccuauacccuuuccauuccccuuccuucagagaccucaaccucuucaacaggcggggggaaaggcugaaccccaucccuaggaauggugcagggucgccggcgagaaucgcgucuccuaagccggagcagccgugaccuacauuaucacucaggcaccuagcuucgccuaaccccuuuuccuucuuuccccgcggcaccuuuuggagaaccccagcuugggguggggacgcaccgguucccagucaccucacacucagacaaaucuuguggagccgggcgaauuucuuuucgcuaaagcuauuucucugccugggccagggcuguaaaagggauuagggcgggucucuuccagccagggugccuucgggugcugaauaggcuuuucaggaaaaaaaaaaaaacaaaaaacccagaugguuuuguuucggaagcagacgcgguguguugcccccuuacccccucccccagaaaagcccggcauauuugggugcagggugcggagccgcguccaggggcuugccuagccgcagcgcuccgccguuccccgggcgcucgaagcuucgcaaguaccgcuucuuaccucccgcagacugccggggauccggaggcgacucggggcuggggucuccgggugggcugagggagcggcggcgggaggggguuguccuccggcggcugcagugugugcgcgcuuacgccuggcuagcgcucguucggcuccaacccaguucccaggagccccccgcauccacccagcgcguccagacagaugacugucacuggcugcgcuuugaagcucgggggauauuauuaacugaaaaaaucugacacacccggggggcggggagagaagggggcug

SEQ ID NO: 6589 - RNA, 34069 nt, Mus musculus
ccauuagcacauagguuuuauucugcaguguuuucuuggugcuggguugugagccagugggaaaacgaguaacaauuuauggauggacacacauuacaagauuuguuauuacagucuacaguacuaauaccaauauuuuaaguaaacaguauguaaugauacggauaugauccaauuucuccaaauugccuggcuuuuaaugccaaacaaaauaucucaaacuguagucugagacuguaagccgguccucgcucaagcaugucucaggguucuuuagcaagcgcuuguaagucugacuguggcuaagcaugccaucucaugaacuuuaaauggcuucuacagggcuuucuugcuagcccccuuuacaacaauuuccucacaguaaaagaucagaaucaguucccaccaguccaguaccacuuugucuaaacacagaauuucccuuuauguccagucagacuuuaagcagcuaacaucugcgagcagccagggaaucacaauauguggggaaggaaaagccaaacucaugauggccaucacuacuucaacacucaaguaauagucucuccuccucuaaucaguuucuauccgagauucucuacaaaacccugaaugcacacucaugcacaugugcaugcaugcaugcauagggauggaucaggcuccacuuaaaacagcuugcuagcaucaccugggacacccaaggccuacuccauccagagcagucacggcagaguuccuggaggcaaggucuagacagacccugcacuucauuuaaggaaucuggcucucauguccuuugggccaucuuuaggguaaaaauuugccaugagaaaagcucugagagcuacuucuguguuucucucagugguccuggguucuguccuugaacuaacagacucugaugugaguagguuaaagagaagucuguaacucuuauuggguccugcagaccuccuagauugcaaaaucuuucagauuucucucaauaguuuaacuagaaguggaauaucagaaacaaagaaacuaaggcuuuaaagaauuuuaaaugaaucuaaaacaacugaacagaaauugacagcaaaauacucaaucuuuuccucccuuaaaggaaccaacccccuacagugcccucucucccuauaaaucccaucccuccuccccaccccaccccccaggaacccccuuuaguucccucaucucuuccucccuugaaagacauccuucacaauagcaaacuaguaucccucccuuuccuuccuggaccauugcauuuuuguuccaauagucccuccuccacucccacgaaaccagaucacuucgggacugcuacuaguccuuuggaaaaugacauuaucuagucaaacgauaagauugcuguaaggaaaucuacccuggguuuccuugugcauuuacucuuuuuuuuaauuuauuuaauguaucuuaucaaaugacaaugaagcacauaauuucucuaagucaaaacaaggcaaggaaugugacgaaaugguucuacccauuuccaauuggccaggaaccaauucuuuucuuucuuuuuaaaucuggggcagacugagucauugccacauaguucuaccuugaaaagggaaaaaaagaaaaaagaaaaaaagaccgacuucaagcuuagaucuuaguuuauauuuagcuuauaacccauaauauaguggccggguggggguaggaagggugggggugguggcagucacagggaaggagcaggguacagagucaagugggaagugccuccuaucugcuucucacuagcacugaucuauacucuauaaacacacagcaagguuuaaguacaacaaguucuauuuuaauucauaaaauauauuccacaaggcucuuccuggguuguuagugugacugucaaucagcacaaccccuucagaaaguaaucuggcacuggcggucugguccuggaaaauauccaguguucagucuugaauucaguguucaagacaacauucugagaagguacgcacugcagcacuguacaaggacaauggaaauaauguaaauaacaagaaauacgguacgagugccccucaucuacugaacuuucgcagaacgccugauaggcugcugaauaaugcacauucuuuuccuuuucaugaaggaaccacagcuuagagaagcugugaccuugcgcucugauauacugaagcaugggcucaugcagauuccacccaggccacagugacugaagcucauaugccucuaaguuccccucagugcucaucagcacugcgggagcguuaugacauaaauuaucaauggauuguuacaagcuuauuaagaguggaaauacaucccaauuccucaagcacaaaaccacuccagucacuaugcaggggugacccucagaaucaaagcccgaagccacacccaucgaacacugaaguggaguaaaccauagcauuuguuuagagagaagaaugacccagaccugugagcagcauuucagcuccuguagaacugaaaaaacaagggacaauaaggaagcugagucagaaacaguaccauuuacaaguuaauauuuaacauguucuagccuuugcagggccucuagugcucugaggcagacgccaaaguucugugaccaagaucugaccaugcagcagcucagauaagacccaguuacaguaccagacaauucacagagagugggcagcuauuuccuagggucagccaggucccuuaucaggucuuucugccauuucccaagaaucacacuaaacuaauaguaucuacuggcucacuaguacugcucccauggccgagugaggggaaggcagaggaggcacagaagugacagccauucuucuuauacccuacugaugggaugcugggaaggagacccuagcagacucaggaguuccuauuuguaaagggaagaaggaugcaguagcauuucucagguucagucaucaauggcaagcaggcuuaaugaacaacucauaggcuuaccccuggcacaaacacuaggagagcauuaguggggaggcgggaaaagagacagcaguuugggucaggucuccacacugcacacauguacaucccccaaaccuccaccgugggucgguuuacgugacgcuuucucccgcaacagcucaaagcuagacagcaacuugaaccacuccucagcugucacucagcucgucagcguugcucuuagcugcccagucacuacuggguucaaaggugguucagagaacaaacaaugaaaccaaggaauuccagagcuguuugcaguccuaucauccaguagcucagguggauucuuucuggcucuuaguauuuaagcaaugcuaaguucaguacugaacuucagggcuguauuugcuacuaugcacguaagcaugcauuucuaccuacaaagagcaguccucacauggccaagagaugcgagagcaguccuaggacaucucuauaaaguaacuggucuacaaguuaacuaaugaccggcacugacaaaucccuuuguacagagucuggaagggaagcauccgcgguggcgcucccauuaguguucccuugagauuuugcuggacgauuucauugcucuugggcaaucucuagguagagaacacaucuaccccugaaacuacuuccucaccuaggaguccaaaggcuccacagagcaauucaauuaugucucgaaauuucuccuugagguuauuuuaaucaaaggacagaaauuaacugauuuucgaacacagagacacagcaaagucauuuuguccuucugugaaucaacugcaaagaaagguucuugaaaaaaauucagagacacccugucaccagcauuagucaucaauccauacugaauuuccaagcacccuccuaguuuccaaaccaccuugagguccuuggcuuuuguuuuacagcucuccuccagcuucauaauguaccuagacagccugaaauaucugaaaaucacuucagcguagcaucacuccuguggaaaauuucacucaaaagauauucagucuggguuugauauggguccagggucacauuuguacauccauaaacuauauuucacaagcccacaguguucuuaaaagaaaaaaaaaaaaaaaaaacaaguauaacuuuaaaagaagacacaagccuucaugaaaauauaguugucaaguuuauuuucauugggcugccauuuuauggagaaucgcuaaggucuguguuuccugacaugcgagaguuagccgugauagcucgguuauuguaaauacugcugcucagagagcagcaccagaggguuagaguuaagacuacagacuuuaugacuccaaugcuccucugucuacaugacgucagaagguucggaacagcugguugggaagguagccaagguguaggaaagaggucugugcuuccuuuucaagggcagccaacucuugaacgguaggugccaggacauccacauggccuuuguaguuuccaccugcacgaacauacaaaccaggagcaauguaaguggcaugcuugaagcacuugucaggaagcccugcucccaauuuuaucacuucaaauauuguuuccagcaguaaaaacuugccaacagacaaguuaucuucagaaccuugagcuuuaaguuuuuaaaucaagaauuucaauauaaaucaguaaucaagccucacuacuaguugccucgaugcccacaucucccacuccuuuaguauacccugaaucaaaagaauucggaaacauucuggggaaagagaacacuaaccgagguugccacuuaaagacuccugacucuuuguucaaaaaugauaauacugauuuccuaauaauucuuuaaaaguucaaguacucuuaauaugaauacuucaagacaaucagcuaauugcugccccucauucacauacagaucacacaauaaaaugcuggaagucaaauaacaaagcacuggagagcaauuaggagaggacaauuaauaugcuaauaauauacuguuagcauaauggaacaaaaucauggucuucauaaacucacacucaaagaggcaaauuuagcuacaugugcugguggaugucuauaaucccagcacucagaaggcugaggcaggaggaucuugagucugggauaggagaaacagcgggugcagucgagggagggagggagggagccagagcacacugaagcaucugaaagcuuaccgccagcagcccuuuuuugaccguaugugacuuucccaucaaacucauccacuggaaccuuuauaucuggcucgaccugggaaauggugcaguucaggugcucuucuaucucggaaaguagcuaagaaagagugagaaaaugcaaguauuuuagauaaaaaauucacugugauaagaguuucacuguaauagcaugaaauaacacuaugcaagcugaaugcguaauauacauggaggcuagaucccuggaagucaagucacaguuuacagacaaaaugauaagccaauuacccuucucucaucacugacaaacagaugaaaguagacauguaaauuuucuagaugaaugcaggcuguuuaucaaugucaauaaagucucugggagucuuaccugcauuucauuguaccagauaguacagccgccaucuuccuugagucuaguguuauagcaucccuucccacgguugcuacauacaugauaccaaaccuacauuaaaaagaaagaaacauugcaaauucaucuggaauaacaaaaaaccuaggauagcaaaaacucuucucaaggauaaaagaaccucugguggaaucaccaugccugaccuaaagcuuuacuacagagcaauugugguaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaaauggugcuggcacaacugguuguuaucauguagaagaauucgaaucgauccauacuuaucuccuuguacuaaggucaaaucuaaauggaucaaagaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaagagaccaccaacagauugggaaaggaucuuuaccuauccuaaaucagauaggggacuaauauccaacauauauaaagaacucaagaagguggacuucagaaaaucaaacaaccccauuaaaaaauggggcucagaacugaacaaagaauucucaccugaagaauaccgaauggcagagaagcaccugaaaaaauguucaacauccuuaaucaucagggaaaugcaaaucaaaacaacccugagauuccaccucacaccagucagaaugucuaagaucaaaaauucaggugacagcagaugcuggcgaggauguggagaaagaggaacacuccuccauuguuggugggauugcaggcuuguacaaccacucuggaaauccgucuggcgguuccucagaaaauuggacauaguacuaccggaggauccagcaauaccucuccugggcauauauccagaagaugccccaacugguaagaaggacacaugcuccacuauguucauagcagccuuauuuauuauaaccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaggauacccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggagggaccauguagagacugccuuauccagggauccaccccauaaucagcauccaaacgcugacaccauugcauacacuagcaagauuuuaucgaaaggacccagauguagcugucucuugugagacuaugccggggccuagcaaacacagaaguggaugcccacagucagcuaauggauggaucacagggcucccaauggaggagcuagagaaaguacccaaggagcuaaagggaucugcaacccuauagguggaucaacauuaugaacuaaccaguaccccggagcucuugacucuagcugcauauguaucaaaagauggccuagucggccaucacugcaaagagaggcccauuggacacacaaacuuuauaugccccagaauaggggaacgccagggccaaaaagggggagugggcggguaggggaguggggguggguggguaugggggacuuuugguauagcauuggaaauguaaaugagcuaaauaccuaauaaaaaauggaaagaaaaaaaaauaaauaaagccuaaaaaaaaaaaaaaaaaaaaaaaaaagaaacaugaccauguauacagauggaaauuaaauacugugcucuacauuuguguguguguguuuaacauuuuauuuccuuaaaacacuagaaaaaagauuaugcauuuuaucaaacagcuauuacuugauggcucauuuaauagaucuggguuauuuuggaaauaauacaaaaggcugugaguuaaaggaagaaauucucaaaccaaacaaaccccuaaacugacaccauagccugaugucucacgaggcgcacgcaggcagccaggcguggugguggaugccuggaaacccagcacucaggcuaaggcaaggagggccgagucugaggccagccuagacuacaaaaagggaggcauggaggggggaaaauuuuggagaauguuguaucaaaauuaauauuuuaauaagucuguuuauauccaaaggaaaauaaagcacauagggaaaguaugcacauaaauuugagaaaaaaauugcacaggagaccuuaauaaaaguuuuucuacaaaccauaauuauauauucaaguaugaccccuaaguguccuaugguaucauacuauauaguauuuaaauaguuuuuguugaaaaaacuauauuagugcuauuaggaauauugauaucuuauuccuuucuuuguaaaccacaugcuaauauuugacuacucaauccauagagaaggaaaaaaauccuauaaaauguucacuuccauuugugacugauuccaauuucaaugggggaauuaaacugcuuuuacuucccauaugaaacguagcucacaacgacgaacagagacgagaggauuaccuuuucuuucucgguugccaccagggaaauagccaggcccauccugaaagauuucaaagccugcauuagacuuugguccugaaacacaggagcucaagggggagaacuugacgguaccuuucagcucgucccacucugccgauccggugcacauaauucugcuucucaucaggcagggugacguugaucacugcaaagggagacaaugguuaacagcucucauucgucuguuaggucaguguguuaaguagaaaguuucuucuuaccauaaggaacgccauggauaucaaucccucuagcagcuacaucugugcaaaucaagaaucuuacgucuccuuucuaagagaaccaagacaaggaggugucugucagugaaugcauaaaacauaaaaacaaauacuccacuaagaaagcuacaugguacuuucagauuaccuguuugaacauaauaaucuacugcaccaaauccugaaauuuuacucuauggucugcugagaugacauuaaugguugcauuguuuuucuuauaccaguguauuaaagcauugcuaaacucaggcuuuaucuuuagucuuuagaaauauuuuuggaauaccaaaaauauauaacagaagagaacacagaagcagcauagguguugucuuuauucuuauacuaaaauaaaccucgggaaugggagggggaaaugguucauuucccauggaugugguuaagagcacugacuguucugccagagacgaucuggguuccauucccaacaccuauaaagcacuaacaaucuguaaugucaguuccagaggauucaacacccucuucugacuuuugugggcacugaacacacauagugcaggcaacacacccacaagcauuaaaagaaaacaaaaaaaaaaaacaaaaaacaaaacaaaacaaaacaaaacaagagguaguaggaaauaagccccuagagcuuacaaaggaaauacauauuaacccuuuggaugccuuugugcagaagaaaguuaagguuuggaggugagggaugcauacugacucuagaucuaguguaauacccaggacaaauggcagugaacuuggugaaaugucagcacauaagccugacaugucccacuuuuuccaaaugacaggaaaaaaacaacuauccuauacauggcaguaaacauuauggaaugauggugggaagaaacuacugaugcuaguucuauauggccaaggccuacuacacacuccaagggcuccgaaggccuucagaaugcaagcaucuggaagggugcacuccaaagaaccauaaagccaggcauauuugcuuccacacuaccaaacucuaaugaucaucuucauuucagaacaaaguacauucucuacacguauuuguguacuuuucagaaagguuuauagacaugguuuaccuaaucccacuuuuuacuucuaaaaagugucuaccugauaaaauuauguaugaauauaagaauguacguauguaugucagucaaagaauacuuuauugaguauauuacgagggagcaguggacuaccugacagaguacaugaaaauuaauuaucugacugucaaagaugacuaauuccugccacaauguauggauaagaguaaaaugcuuuaagucacuaggaaaagaauuguuuuaaugauauuaaguggcauaaggaacgccagaacagcccuuuaaguaagaaggaaaugcagguaacgaggcacauuguaccuuaaaucguuccaaguuuugcuuucucucaugaggcuuucugucaccaugaagacauacacaugagaacugguguccuuuuuugucagguccuagggaaaagcauauuuaacaucugaccuugaaaugcauuaugccaaagacuauaaaaacacauguuuauaaaacucuauacuccacaaucuggcacaaaggaaggcagcacacuuucugaaacaggcaaaaugccauuaaaauaaauuccuucgaagacuggggagauggcucaggugguaaaguauaagcacggagauaugggcucagauucucagcacccacguaaaagcugggcaguguuggcaucuuuaaccccagcaucuggcucugucaaugcuggguugacagguggacccuagaccucacuggccagcaagccuagcugaaucuaguagcuccagguucugugagagucucuuaaaaaguaaggaagacaguucugaccuccacaggcguguguucacauucuuccacagacgcacacacaaacuccauaaaacauuaacauugacuugcuuuuaagagaauucuaaauucuaucaaacuuuuguauuaacuuuccaagaagcugggguuagaggcacaccccaccaugcccagcuuacuguccaacuuuaugacagaauguauagcccuucaacugagauggcuuuacugcuuaauauucgcaacaacaaauuagaguacuuagguauguuccacggccuugccagacuuggaguuucauuuuugaauacaaaguaagcauuucuauacugacuaagaauaucuccauauuugauaagaaacauaaaguuaucuagacacaaaaaaaaaucuaaugugaaacuacaccauuuccauucuaaugucuauucuagcuguacagaaauucauugacuuguauagaucuugggucaaguuaauuuuaguguggaaugucuuauuuauuugcaaaguuugggucauauuuucacaacaguagugccccuuuauuucuacugauauuuuuguuuaaggucuacuucaucucuuauuagaucuuuagauuagcauuucaccauauguguuuauguguguuaaucuuuauauuaaaauucaaaguaucauaaccagcauauuagaauguguaucuugcaaaaccaaguguuuucuaagaucuuccuuggccuuuuuuugguauguuuuuaacagcuauaccuaacacagaucuagauuaauacucuaugugaacuuagcagaagacuucgguucacugacucauaauauauauucagguuuuuuguaauacugaucuuauucugugauuccuaagauguauuuuuccucuaagacuagaauuugaagcaggagucuuacccauaaccacugaguucuauuuccaccucugagcuauauucccagcucuuagguuuugagauccuaucucacuacgcagcucaggccaaccuaaacuugguuugugacuuagugaccucaccauccuccaaccucugccucccaagugcugcgacuacacacggguaccacaaugcuuggcuucuuucuuccuguauuuacgguuucucccuuacucaauuuuuccuauuuaccaguuuagaaaauagacauucuaauauuuuagucauuauacuuuagauuuuaguuguuaaucaauaaucuagauguauggcauuagaauccugugauucagguucaugcuaaugacaacuguagcacuguggaagaaguucucauguuuacccagggcuuauuccuagaaaagcauugggcagcuacagauagacuacaaugugccaucauugcuuuaaacucugugcacgcauucuagcuuucaucaacgugaggguaauagucuaugaaauaaaggaauaagugaggacaaauuuaccuccuccuugcugcauaaaguacugcuccaaguuaucacagucaauuuuaguucuacagaagauaauugcuugauccaucuuguguuccuugauugcucggacagcauacucccccuucaguauuuuaauagcuucagaccacaucucuugauuaccauagcaacagaaaaagcaacagaaugucaacuugaagcugucaugagcacacauuaucagucagauauauugcuuaacucuaaacaucccugcaauacuauccacaaggcacagugugagagugaggaacuuaguuaauucauugcuucauuuauuugcaaugaauaauucugucagugucuuaugcacuauuuuugggucucggucucucucauaaacacacacacacacacacacacacacacacacacacacacacacacacacccaugcagcacacaggcacacacaugcacgcagacauacaaccauaaccuuuuaagaagaaacacaaauauguaaacauccuaacaaaagagccugcgcaccaagacuugguaccuuccucucaagcauuaguuagaaucugucugucuguccuguacugacuuccauuuaugcuuaaguccugauuauuggauuaucuuaacccuucuuaaagaaaguacuaaaucuaaccaaucuaaaaccacuccacagaaugaaaaccugguuagcagcuuuucaguccucucuuuccugggaaggaguguuauucuuguuucuccucugcugacacaugcuuuuaauccaaccuauuucuaaagguuuucuguugucuccaacaguaguggagaguaagcaaaagcuuuacaaaaccaucaucacaguaaaagcugguauuuuauaaagugcacucccuaauuauggguuaacaguuugugcuuaacuagcaguuucucuacuucaacaggaaagguaagugaguauggaucaugucaaucugguguuagacauaaaaccaauuucuaaggaacuugaaacaagacuucaggcaauccacccuugagacaugugucaaagugcucagugaauucaaccaaaaaguaaaagcacucugaccuagucuaaggacccacucaagacaucugaugucagacaugcagucuaaucaguuuaagauccaggcacuuagguuuuagauuuagcaccuuauauccuacuguaucuucauacaauuuugaaauguuguagacaugaaagaaauugucugcuaggcuaucuucacugcacugagacuguuaggcuuuuucagagcugaucaaugagcauacaguuucuguuugagaacaacaagugcuacagacaguacuaaggccgaauaauguaaaugugcuuaaugcccugaaucauacacuaaagagucaagacaaucauaaaaauaauuaagaaauccacacuauuugucuuucaccauuucauaaagacacccccaacccccagcauccuucaucuuuauuuuucuggaauuucagggucaauauaaauuuguuucuagacagauuugcuaguuuuccaucaucuacaucaacaauccagaaggcuuaugauccugaggccacacaacuaacaccuacguucagugguuaacacuacuccucuaagcuaagugguacgagcuugccccaucucgugauuauucuuauuacuucuauuuuccccauucuaacuuuguaggucauaucucccaucuuucaagagaacacuaggcacagaaacaaaccaaucauuuccaagcuauguaacacuuucuacucacucuuucaucuuaccuggacuguuagcaccaggucuuguguuauccuuugcguguacaucaucagucuguugagaggcagagauaaagaaggcaugaggaugcuaaggaaugacucggccugaggagacuagcucaccaguguccacaccucgcagcgcuuacucgaaugugguucuuccccagccuuucccaaagcuugucaguuuugggguucacagggacaacgacaugaugcacaguaucuggaacagaaucuucuccuuucaaaucgacccaugugggaaaaugcauuaucuucuccgauagcuucuuuacaucaaaagaaugcagaguagcagagcaaacaaucaccuagagacaggaaaacgaacauucagaccaacuuuuauaacagucagcuuucuaucacacuaguuuuuaaaaaauauuuauuuuguuuugagauucacacuaacaauggaugauaagagaacacagaauaguagucagggaacccagaacacaucuaaucccugccuccauguaguaacuaacagugugaccuuggcaggcugucaguccugacucucucacacaaaccaugccaucucucccucuaggaagguuuguuuuuuuguuuuuuguuuuaaaucaaaggccacaaauuguuauucacucccuucucucaaaagucucucccucucaaauguuuccuauggauaaaacaagggcaacguuuucagaaacaacccuacaaaggugccugacagucaacagccgaugcuacuuccccuuugcacaagcagcagcacccacuagacucuaagcacccagggcucuacagaaagagccacugagacuaucugacgguuaucuguaacaacuaagaaauuacccugauuucuaaaaggagccccccaacccuacuuucccgcaaaacagagcuucccuguguaacagaguccuggcuauccugaacucacuuuguagaccaggauggccucaaacucaaagugcugggauuaaaggucugcugugugccaccaugaccagcccuaaaaccaucuuuuaagauugucagcucugugugugugugugugaguaacuagacgauaacaaaggaaagguacacaaugaauugaaucauaacaaccuuaaagcaaaagccccugacucuacaacccugaggaacagcugccuccauguguuugggcugcauuugucauucgauaccugaagucuuuucccaucacacguaaucugcggaaucugguugugcauccgguuaaugaagucagaguagccuugagagagaagcccauccugcagaaaaagaguuuuccaucacuaugaaaguccuuuaaguuucaaauuuaaaauacaagguaaaagaauuaacauauacauauauaucucccuauauuuacaaaauaaucauaaucugcuggguaauuaaaggaaguuauaaauuuaaccuuagguuccuugugacuaaaauaugaaaaaguauaauaaauaaacccaacuacacuccaguauucuagcaugaauacaacaguuuauaacacauauccuuaagauaaugauuuuaaugugaaaacugaaaaaguuccugugcuggaaaauuaacccaaccaucuuuagaauaauuugaaagagugucucaaaagcuucagacacauuucuguccuuccagauggccacaguauacaucucaagcaaaaaaaugauuuguugaauaaaaaauaauguaugcacaguuauuuggaauaaaaaagcaaacuacucgugucauuaauuggagaguaauuaaagaaaccaugacguagccaugcccauguaacagaucauuaaauagccuucagagaauaaucacaaauaaucaagugaaauauuugagauauaauuuuuuuuaaauaaagguuugccuaaauuccucaaagucugacuucaacucccuaaaguaaucccgugucaggacccuugcugggucccuaauuucugugucagggccccugcuggaccccuaaaucagaugcucaaguccuuggugcacaauuauagauucaccccaucuaccaaucacacguagauucucacuccuuugugcaauguaaaugcuauguaaauagcuaucacacuguauuauuuagagcgaguaaaaaaacuacauauauucaauauaaaugaaaaauuucaaauauuuuaaauucaacauugacuuaauaugcggguaaaaaagucaacuacauguguaucaauacaguaaaugaaaauguguuuaacugugauuuuagguaauaggauuaaggaucuuuuuuuuucacuuuauaaaucuuaucauaaguauacucucuaaagaaaauaugaacguauuucaacccacugcuucauccaggaccaggaaucuaacuugagacaaguugagcuuuccagucgacaccaaaucauccaaucuuccuggaguaccgacaacaaugucaaccugaaaagacauaagcaacacccaaggcaaacuaaaaaauuaauauaauuacuuuaaaacagcaaaaugccacuuucuacuucaagcaugugagcugaaauagugcccaucagcgcaaagcguccucaaagucauuauggacacacagugcuguacagcacaugcugacuguagcaauucaucugggauagcuuuaacguuuacauauaaucgaauaugaaaugucuguauuuuauaaaaaaaaaaaaaagaaaccaggugaguuuccaugaauuguagaauaaagcaggaacuccaguccaagcuccacuauuaucccacagugggguaucaucaucuagcacaucaacuuccucauauucccaacagaggaauagcuuucuuuuacaagauagcuuugauaauucagagaagacacaacggacccuggaugcccaguaugcugagugcucacuguauuugauuauaguuuaacaguaacuguuuagacuggccaggaaauuauuauaguguuuguugauacucacuauuauuacuccuauuuuuaaaucaacagauuaaaguguaguguagacuuaacacuaaaaucauagcauuuagauauagcacuaguaaguaccuacaccgaauccauccucugaaucgacauauauauaagaagagguuuauggggcuagaacgcuggcuuaaguuaagaguacuuauugcauuugcagggcacuguguccauguagcaucccaucucuauccauaacuccaguuccagaggacagaacgcccucuucugacuuccacauauacuagccacguacaugguacguauacauauggaagcaaaacacuauacaaauaaaucuaaaaaauaaaauauuuaagggucaaauugaaaugauagaaaguuuaacuuuguaucauaaaaaauuucaaguacaaaauucguacacuuugcauucucccucacaucucauagccaacuccacaggacaaguugauuaggaacaacuuuuagucuuugcagucaaguucuauagguaacuuuuucauucuuuggccagcuaugaaauuguugauacaugcccaguuccuaauauguaaaaacagggaugaguaucauguuuucauacacgguaggguuccuguggcuaauaagauguacgcacggacugcagcaguacagcaccugcaaggacggacacaaagagcccaagcaagaaagccccacagaccccuucuuauguuuaaacucagggagggagacuucaagcuacagaauaccugugaaacgugaaaguuaaaccuguucaaugaaguaggacucuacuauacacaccaaccacagggacaaaguccacucugaccuguguguaacaucucuuugguuuauaauucuaaccagcuguuuccucccuccugaguggcaggaggcaaagggauguaaaaacagaucuagguuaccacaggcuugagaagaagcugcugggaaguauuuagugauauggcguguauagcagcacaugguccguaaugcagcacccuuggaaguuacaagcuaaaauaacucuacucuccaccuccaaagcuaacuuggacucuagcauaaacagcgugauggcugacccgagggacguagagaugacaguggagaaugcaggguggaaagaugcacaaagaaaauagaggugcuccuuuaagaacagaacagaacagaacagaauauugccaagaaaacaauaaaauaauacugccuuuccuuugccauuggccucagugagcaucguguguguguguguguguguguguguguguguguguguguguguguguacauguguuauacaugugggugcauaugcaugggaaaccagagacugucuccaucuguuugguacagauggaaauggaggaaacuugacuuaguauaaacugguuuagauuucacaauuaaauauuauggaaaggaaguaagagagguuuguaagaaguucauuucauauacauaaauaaagaacuuuaugaagucccaaacagcagggcccagaguguccuaguuuggcccuacacacuacacguauaucuaagcagucuguaagacuccccuuacacgugucugagcucagagacugucucaauacuacucaucauuuccaaguacugcagagucuucuacuuucuccaaaaucuacuuuaguccauacuuauacucagcauugguuuguuuaaucaaaaauacaggcaugcaugcacaaaaacaugcauacaugcaaugacuuuuaaucagaaaggcuagaagaaaauucucaagaagucaaaggcuaaacaacucagaauuucagaugaauuuaaaacgaacuacuguucucuaaucccagauagagaggugugcccacacagcaucuuccaacaaauguacucuucuugucuggugcuaauuuuacccccuuugacuuuuauuggcaaaacagaauuuauucccaaguuaaaaguacagcagcuuaccccauuauccagaacagagagcugaucccgagccgcaacgccaccaauuaugagaagcucccugaaaccaaaggcagagugaugauggagaaagaucaaagucuguccuacagucugauguauaccagucuuuucauguggaauaagucacuaagagcuguggcagugugagugcacaguguacagugcguacacagacagcgggaagcacagcacuucaccuccacagccagacacgccggaugccgaggcgagugcaagcucagagugaggaaaccaucagcccucacucacuccacccacccugccgcagugaaaacugcacuccaccuuuuaaaauacacugguuuccaguauaaagaauauuucuagaugaauggguugaaaucaggaccaaaagguuguuuucaggagggauauccagaaaaugaagaugaaacuuuauuuaguguuauucacagcucuuuaaggagaaaaaagugaucuuguaaaaacagaaaaugaagauuuauguacaugaguguuuugcuuacacacauaauauaugugcacuacaugcaugccugcugucgauggggagguaauuucagaccugcuggaaauggaguuccagauuguuguaagccucuauguggauguuggaaauugaaguggaagagcaaugaaugcucuuuaccacugagccaucucucuagcugcuuuccacccccacccccacccccacccucuuuuugaaacaggcucuccuuguguaguccugcuuggccucaaacucacuguguaagaguaguuaggcucguuucaaagauagacuaggcuucuuaguaaggugagggcuuacuuguauuaaauaccaauuagcaagcuauaauuucaccaucuucaccaguaaacuguuuuuaucauccaucuccccuugcagucuuugucuaugguacacuaguuuuauagauaaugauagcaaugaaucacaucauacagguauuuugccuguuuccaaaaccaguccucgggaagaucucagacucucacacuaagcagggacucugucaucucucuuaggagauuccuuuuccucaugcucaagucacuucccaaagcaguuuccuucucucucccucugccaugcuauucuacagcuccauaauggauucuguugcgggcccagucuagaucccaggccuacauuuuacagcacagggcauuuaguaucugccaaaugaguaacaugcauuaauccauucaaaaauuaaggauuauuuugcauacuguaauuuauaacuaagucaguuugcuuaacguguaagugaggccaccagauccucuaaguuucugguuuuaagaagguggcaacagucacauaauacuguaaauguaugaaaugccaccuaaauggacauuuccacgcagugaacuuuauugcccaaauugcuccaauaaaaaaaauaauuaaaagcaaaguaacaaaagucaagugugagauccacaaaagucuucacauaggauccggcuuuccaccaauaaaaaugguuccuagcugaauguggugcucacacugucaucccaguacucagaggcaggaggauggugaaucugaggccaguaaaguccuaucucacaaaagaaauaaaggaccagacaaagucuacucagaacucauggucucccuccauggaaugcccaagagggagaggaccagaccugugggagucuuagguuaaccaacacccuaaacagagcugcacuuuuuucuagacagugaagagaagaaauuaauuuaucgcugauugaaaucaaccucuguccaaagaaaggaaacuagaauggaaacacuguuacuacaaaguuaaagguuuauccaguccaccaccaacucugcugauuucuacugcauucuuccagaccacuuuaaacuuaaagacagcaaacaucugagcacagaaggaaggcuuaccgcaauuuaggauuaucaauauacuucuuaaacugcuugacguuguucaagguuugcucagcuaacucucuggaggguuccacaaugagagcuuuuggagcauucgggagaaauuuuguuugugacaccugugcauuaccuuaggagagcagaaaagauugcaggucauggaaaacacacccgaaaaugccaucagcuguaaaacacaaaugcuaaugucccaguaucaaauuuuagguaauaauuguaaaauacagaagauaaucuaacaaaauaaaucuaacaaaauaaguugggauuuuuaaaagacuaguugggaugagaauaauugauugauacaguuguaaaaauaaccuauuuccuuugugacaagccaaaaaauguacuucaacuguguaaacuuaacucuagcaggcaauaauacagaaaaugguaugagccuucaggucaagcuuggcaucugcucugcaaccuuggccaagcuacuucaauuccuuacuguagugaguauucuggaauuuugguuucuuuaaaaaacacagcaauauuauaaugugcuuucucuuuaaucucaggugcagggauguggggcugcuuccaaccguccucaguggcuaugacuggcuuugugcucuagcggaggcaugguuuuaccagcugcagaucauuucuguaauucuguaacaucuggaguuuugggcacuuuucagaagaugcauaaaugagagcgccccagagacagggugaguggcugcugaggagcuuagggucagugaucucuccccuguacccuucuuuuucuccucuuuaauguaagggagagaaacaggggugggguauagagaguggaaaaaagaaaacccuacaaguagcaaagaccagguacaccuuguucuucaggccccuguaaaauaugaagaguucuuucucagggugcugugugaagacuaaacaauccauggaaagcacuuagcauucugcuauggcauuucacaagcacaggaaccaagcauaucacugccaucaagacugagguagcuuaagagccuuaacagacacaaaaguaguucaucaauuaaguuuucaaacugaaguucauuaaucuguuaaccaaugagguugguuaaaccagagcaggaggcaaaagggacucacuaagagaaguccuacgcacuaguccuaguccagaaacccccacccucucugcugcaacaaauaccugugugcugagauuugacgauguaauuaucuggggccuuggaaagagcaacaaaaccaucuuuugguggaaacuuaaauucuucuucaccaaaguuaaauuucaauucagcauucuagcauugaauaaaagaaaacaaaaguuuaaccuaauggcaaacugcccaguaaaacaaaaauaaugaaaaaucaaacaguuuagauuacagcaaaacuucuucuucuuuuuuaauguucauucuuucuucauuucuuucuuuaaaguucagauuuuauuccucuccuggaauagucgaaccucugacuguuccacaucccauacccccuccccacacccgucuccacaaggauuuccccacccuuccccuuuaccccagcagaccucuaaacucccuggggccuccaggcuuuugagggauggguagaucuucucugaguaaacccagacccggcaguccucugcuguguaugcuaucuauguugggggccucauagcagcaguaaaacuucuaauuaccuucaaaacacaggcagggaagagggcuugguuuuuuauaugugcugguauuucaaaugccagaccaagaucuuuuccuuuaaaacaaauaaacaaacaaaaccagagaaauuaaaaugaagauuuuccacauacacaacaaaaucucccaaccugccuuacuuucucauucuuucuuccuuaaggaacccauggaugaagugaguugccuagagccaaccuaguuaccgugugacuucacuaacgccucccuccuccugucuacguaucugcaagaccucugccucuggagaccucauggcucacacucucacauuacagacacacaaauccucccuugauucgacagcucuauucauuuaccuugcauucucccuuucacuagugaaguacaaucccugguuuuuauuuuuaggacaucauucugucucuucaucugguugucuacaggucugacucaugcucacccacugccguguccuaccaaaacagccaucagguaccaaauccugaagugauaugucacuccugcccucuugacaaucccuucagcaguacuggucacacauugacuucucccuccucugggacgcacugucuuccuuuggguagccagaguucaugcacccuuguucgcccuucucuugccucucugcuggauucuucuuaguuagcuugauuuuugccauaggaaaccagaccucggcucuuuacuauuauuuauauaccuuacuccauaggugauuuuaacccacuuccuauuuccuaguguuuucaacacaguuggccagaagcuguuaaagagauggcacugcuuggcucagaaugccagaguguuuccaucuuacccagaauaaaaaguaaagcugaugcucacugagcuagcccuucagccccucccuccagcucagggcacaugacacgugcaucuccucacuauuacuaaggcagugcagacacauccauccugaaccuucucugcucuucccucugccugaaaugcucuucaguucucagcauaagccaaccaugacuuuguuuuaaaugucuucucuuagcagagccuucccugagcacccucuggaaagcacauaucccacacagcagcucaccucaugccuugcuuucccuugcuuacuaccuccuaacguauuuguaaauacuguaugacugccucuccucaccaguacgaaagcaccagggcuaccuccaccuacuacuccaucuucucuaguagugugcacgacacagagcaaauccacaacaaagagccagugaaaugaaaggcagcuggauaggggagaggacugaagagaaugagagaauguaaaaacaaaucacagauuuguuuuugcugauaagauccagagagcuuaccauucuuagagaacuucacaugcccuuuaucgauaucuaaguaacauccaaugguaucaugcauagugaauuccuaaaaacccagaaagugaaaagucauuaacagaaaguaggaucagaaaugaaguugcagacaguaggaccaaaagcagacacugguauuucaaaagaauuucucuaacugguacacagguaucaaaaaugucugucacagaugggcauaguggcuagcuccuguaaucccagcacugggggagcuaauaaaaauuuaaacuacuauuuauucaucuauguuuuuuuuuucaaguccaaaucagaacuaucuuuggaaaacacuugucuuuaagaagcacuuccacauuaaacaaacagcaccauagcuuaccucuccauaauuaucaaauuguuuauuaugagauuucuuuccuguuccaccgaagccaaauccaaacuugucaguaccuagauuuuaaaaguaguuuaaagguuugagcuuaauuaaaagaauugcagugugggggacuacaugagauaaaacucccucugguugccaggucugcaguaucugggcacugucaaucuauaccaaauacgcaauagcauggacacaaguggcacugccucacucuuagcucuggucacuaacaaacucaauaauuugaagcaucugugcaguaaugcaugcuucaagcaugugaauuuuagccugaucuucagucacaaucuuauagucccuauguggugguuugcauaagaauggcccccacagacucaugugccugaaugcuugguccauacagagugucacuagguauggucuaguuaaaguagguguggccuuggaggaauuaugucacugugggggagggcuuuaaggucuccuaugcuuaagcuauaacaaaggaggcacacagucuccugcugccuacagaucaagauauucaacuuucagcuccuucagcaucacguuugccuacaugcugcuauguuucccucuaugacaauaauggacuaaaucucugauacugcaagccaauuaaaugguuucauuuauauggauugccauagucagcuaggagguggugguccaccccuuuaaucccagcauuugggaagcagaggcaagcagaucucagugaguucgaggcuagccugauauacacagcaaguuccaggacauuauacagagaaaccuugucuuggggucauggugugucuucauagcaaaaaaacccaaacaccccgauuucacauugucagaacauggggcgcaggugcuaacagggagcacgcaguaucucauuucaagucuuuccugaaccaggugagguacagauaaaggguuuuuuuguccauaaaauuaaauuacaguaaagccuauuaguuugucucucaauuaauaugcuaacauccuauaaauauaaagcaguucagguuuuuuagaaacacuuaccuaggucuaaggaagccugcaugguagaccacccaacucugcauagcccuuggucaugacaggacaccucauaguagugcuucccuguaaaggucaaguuccaugaaauuuacacaaauugcauaugcaugacucauauaccaacuuccacuguguuacauuuguaugugacagaagaccuguggaucuuucugugucauuaagacuguucaggucuuugcuuuaaagcuccugcgggaaauccauagugacaguuucaacacguagacggacaugagcacuggccaaguaccuuucagcaguccucuaguuccucugcauccaugccacuccuucacuucucugcucugacaacacagaccaucugauccaauugcugcauuggagaacaagcguacagaaaugggagucaguacagguuuuacaaaccauccuuuauaaaacaaaagccauucauucuaauaaucuuguuacuuguuagaauguucuuguugacuccaagaugacagcaguucuucuucuuuaucccuaccaucucuuuggcuaugcuggugaccagggucuacacugucacuguuaggacaagaauacacaccaacaaauccaggaaagaugagcacagacccuagaggguuuugcuggaauaauagccucauggcccccacacacuggucuagaaggccauacuccagugcugugaaacaaggguacuaagggauggcauggggccuauucaccacacuuugcugcccugacuucgagaagcaaacaaauacccagugugcgcuuggcuaguaucagggcucuaagcgaucaaguuuuacaucauacaccagucagacaggugcuuauguaaauaaagauuuagcuuuugucuauacuggaaagaaauuguauacucugcuccuuucauguuucaaagucauauucaguaccuggucaaaaagaaacuuguaaaaugucuucaccaaacaucuuagcucauuuuucaaaaauucuaaguucuuaaucauaugauaaugaauaauauaaaacuuuguaaaagguucucuagggaacugccaacacuugggagauacugaggcaggagaaacaagacuuuaagcaggggaucaagagaaggaagguagauggaugcauguaauuaaaacacaaugucugcacaaauggaacucccacaugaguccuacuaguuuauacaauuaauguguuaauuaaaauaauaaaacaguaacaaaaccgaacauucuaucuuuucuuuucuaauuucuugugucuucuauuuggguuagaaaaguuuuucuucuacuaaauuaugcaugcuaaauuauacaaauacaucuacacuuaaacuuuuauauauuauacaugcacaaacacacauaggcaauuuaaaccucaaguacaugugaaauuuauuucuaguuauuauauauagaagccaauuguuuuguuggcccagauggaucaccaauggugccagagucuuuuacugacucaaucuuccuuuucuuuacugaaauaacuuguaugugcacauuaacuugucauagaggaauuguuuccauuauauucuacugucuauuucuaguucacuacuacacuguuuaucuucaguaacuagauccaaaucuguuaauuaaaucauguacaacacuuuuccaucauuuucuugguauuuguauauacauuuuuaaguuucugaguuaucaaugaauagaucaaauuauuaucuacuuaccaaaagcagacccucuaucauauggguucaucugccacuuguugagcacuaaacaaauuaauauaagaaaagugagacauagccacgugaaauguacagcucuauagaaacagaaguuuauauuuauaucucaauuccuuuguuuugacaauauuuugcaaauuauuuauaauacacacauauauagaguuguuuuuauuaaaggcaaaacuaaaccugaaaaaucaaaagguguuaaugauaggcacuggcucacuugggaguaagaccuaacccccucccugcuucagagcacuuuguauauaggacacugaucuuugucacugauaaaguuuagugaacugagcaacuugaccuuuaacacaagggaaauaaaugaccucaucacccaguccucuaggugaaguuaagucacacuuucacuucucuuccuguuuuuauaugauuggcauuuuuccuuuucuaaaguaucuuaauagcucaugaaaaauaaaaacuuauacucacaacuagcauuuuagcccaucuuccugcccaaggcagaaauccuuucuagaucaugccugaugaagagcuaucugccaaguuuaaauauugugaagaauggagaaauaugcuccguaggauucucccuucuuggcucacccaaaacauaagcaaauccuuaaguuaagagacccugcagauuauguguaagcuguauccuacuccucacauuucuuuggucaucaaccaucccuauucuucauguuuauuaaucuagguuucuguuuucucaccagacacaugauuuuuagagccauccuacuucuccuaagcuaucucagaagcauucuuuucuagcaucuuuucucauaaaugauggcauauagcuauugaaaguuccaaagguauuuuaaacuaggccaacaguguuaauaguuacauucauuguccaucacacaacccauuuacuaaacuagucuauccuaugucauuaucacuuuucuauagaaaaaaaaaguugauauagcaaguucagacaauugaaaccugcuauuuuaucucaauucugcuuugaaacauaaaacaaguuacuucaaaauauguaauacauuuuguuaaaaguguagcaggaacaaagaugaugaauaaaauuuagaaaccaaguaagaaaaaacuuaagagauaaggaaugaaugugagauuauucauaauaaugguuauuauggauuauuaggaacagaacccaauaaauagauagaccuccauguaaggaagacaaaucacuuuuguacaauguaccaauucauccuuacaguuauguauggugaagaaaggcacagaaacaccuaaagguaaacuccaaucauuuuuuuucccucaacagaaguauuauuuguauuuuaggguggacaguucacucacuaauucuaaugucacuugcuuucccuguugcaggacacaaugcugcaauguuauguugcauacaugggcaauaaaaugcauacccccaaacuugaacuugcaaaccaagacaaugacuaauuuauagaaagaaaauaucaauauaaauauuaccugaagcaccaguuuuaauaguuguuuucccuuucuuuccuuccuguuggucuuucagaguuucauacacuaucuggauaacgggaauacuaaaugccugucaaaggaacauuuccuguguuagucaucagagagugauauuagucaguauaaugcuaaggcuaugcaaguacauuauaaacuauccagauggcugcucccauuucauuuaccuacagcuuaauaauaaucagauaaucccgagcugaaagacagaagccagcuguaggccuggauguaaacaaugaggaccuucaagaugaacuuaaagcagagcaggaaauuacuacaacucacacugccuccuagucuaggccaaaaguggauguauuuaaacgccuuuaauccuagcacucaggaggcagaggcagguggauuugaguucaaggccagccuggucuacagagugaguuccagacagccagggcuauacagagaaaccaugucucuuaaaacaaaacaaaaaaaucugaaaugccuauaaacauuacaguauauaugccuccuccuguaagaccucuuuaaauagcauuccuaaaagcauacccuuuauagaccaacaagagaacuauuacucucagugguugugcuggcuaguuuuaugucaacuggaaauaaacuaaagucacugaggagaaggaaccuguaggacauuuuccuaauuaguguuaugggagggcccagcccauuguggggggcgcccccugagcugcugguccugggugcuauaaaaacaacuagucugugaaagcuacgggaggaagccugcaugaacugcugcucgguggucucugcaccagcuccugccuccaggaguccaccuguuugguuucugcauugucuucccucaguggucagugauuuaggauauguaagucuuuccuuuuccuccccaaguuguuuuugguuaugguguuucauuacaauauuaacccuaacuaagacaacgcuaagccaccauuucuuacauauuagaggagauuguuuuaacuaaguauuucaaaauaaaagcuacuguucacauacacuuuaaaaauuauauuuuaaugaaacuuaauguauuacuuacaccaguuuuuccacuuccuguuucugcagccugaauaggaggaaaauuaauuauaguucaaauugugaauuaaaagagaucaaagucagcauagugccauguagagaucuugucacacuugacuagcuaacuuuacgucaagugccucaagauaacucacacugccccaggcaacuuugauucuuguguauugggucaccacucccaauucaggaagcaagugcccucuucuuuucuuucccauuacuacaccaaauugaagcccucauuguuuuaaucuaauuauuagugugucuuaagaauaucuaacuauagaucuauacuacaauuugcuauacaacugguauuaacaaaaccauaauucuaacugauacuuauuucuuaaccuuccauguccaccacugccagcaaaugcccaaucuacucugagaaagaauccaaccugauucaauauauauuucucacuguaccgcaaguuauuccaccauuccagguauauauacuuuaugauaccacccaccauuuuccugcaguaaaaauuaaagucaccccaggccuauucccacagcuucuauagaauacacucaccauaguacauguguuaucaaagcuaaugaaugaauaaaaugaauuuguuaaagcauuuccacucuuaagugucacacacagcuccagaacauguguuuucccucaaccaccuuauuaaauguaaacauaccaugaguacauccccuccuccuaggaucaaugggauagauucugccuggauaucaguugguagacuaaaagaaucacaugugaagaauuauaguuaguuauaaacagaaaaucaucuaggcuacuuaagucaugcuaaagcaaccuaaaacaaauuguauguggcaauccagccauuuuuuccagcuagaaauaaaauuucaaaggaaacaaucuaugaucuaaagaaucagcaugaacugaaauucauuuccuaaacuagacagaaauauauuugauaaaaauuacuguucacauuaggaaagauaugucacaauugcaccugaguucucuguacuuacagccaauccaucuccuccacagcuugugcaaucuccggcauaacacccauuucuggagggaaaaaagucauuuaaauaaucaaaccuauuaauacaucauauucucuuaaagcugcuuccacagaacuggggcaaagccuugaaguuuggcuuuuauauuguaccuuuguacugcucagaguguugaguuuugggcuggagagauggcucagccguuaaaggcuagguagacucacaaccaaaaauauaagagaguguugaguuauggagacagauuuaaguucucuccaaggcuguguuuauagaagaccucgggacaaaacuauguauuuguuuucuuugcagaaaaugggccuugucacaccuaccuguggguacagggaaaggggaggcaauguaaugacacugcugguacagugucaugagcacaugguagccaccacggcacguuuagcucuuaaagaaaggaguaaaaaucugacaguuggguuccuagaccugcauucccacuguuucucugugugauaauguagcaguucucugucuuggcuagucuaagacgaucucuacacccucuaugaucuaaggaaaacacagagcccacauuuaaugacagccauagccaaaauguugcuaauaaggcacugucucagacuauuugagagguuuuuaauuuccuuacuagagagauauggcaaguauaagguaaugaacaugguauuuacccuuaguugacuauuaugaagcauauuuaaggaccauagcuuuacacuguagucuauaacuacaagcaaauacuauguccaaauaaaaaacuaaaaguuuaaauaaaucagaaacuuccaaauauaggaaauagguaacuuuuggccaugugcuucagaauugauuacuauauucaaccuugguauuggggucuuucuugcuaaguuuacacagccuaucagccaaucucuauacugcauagcccaaggggugugaaaaaagagaguguuuucauaguaacagacuuuguuuuaaggaagauuuuguuucucuaagguugagaaauaguuuuuauuuuuaacaauaaaaacaaauucuaguuaacugaagggggggggggucaugccaauggaaauugucaggugaagauaugcuaugucccuuugguuucuuucuuucuucuuuccuuucccuuuccccuuuuuucuucucuucucuuuucuuuucuuucuuuuuugguuugagacaggauuuccccuggcuguccuggaauucacucuguagaccaggcugggcucaaacucagagaucugccuuccuuugccucccgaggccugggauuaaaggcauggccacacuguuuauuuuaaaugauuuugcauaaaggucggucauaaauggauagcguaggcaguuccugaguguucugccauuuuaucauucaagugaaaucaguuauagguagaugcuaaaccuucccuugcucagacaaacuaauugagccauaaagaugaacaacaagauugacuugccuaacaacuaugccaguuaagagucuaguuacauucugucuccuagaaugaaaacuacugggaaaaggggggcaaugggccaggcucaguggcacuugccaccaagccugaagacccaagucccuggucccacaaggugggagaggaccaacucuagcaagcugacuugaccucugcuuggaaagaccccuguuccccugacauggagauauaaauagcaauguagaaaaaaaaaaaaaaaaaagaaagugauggucuaaaauaugcuacacacagaauauugcaaggugcgugcaagacugucacaaacagcaaccacgaauugcuuggcaaauuuuaggcuguaucuuacaggauccuggucauuugcuaggucuauuuucuacagaaaacuugucuuucacaguuuaacaguuaaacucuuuaaggagaaacagauacauauucaaauucuucuacuuuuguucauaucagaauauugucuuguccuuaaauuugugcauuucucccaaaaaugugugccuauaaaacaaugaccuacaacccccugacagaucucggggcuaaaaauuguguuaagugacagaauuccucucagaagugacuuuaaaagaaaugcuuuccccugaagccugagauuuggaauuccugauauucuuacaggagaaaaaggaaacagccaacaauaguauaaugucguuuaaauagguuaauaacacaaaaagauaguacauuuaauuuuaucuguucauuuacauauguguauguguacauauauauguauauauuuauguacauaugcacauauguauguauugagaaggaaagacgauauuuaguauauucaaggcugguuggaacuuuccaaauugugugugggugguaagagguuaauagagaaaacaagaaauauuaacugguggguucaguaccccaucccaaauccuguuugguaucacaaagcaaguaacuaauucucaaaaauuauauuuaguccgugaggaaaaaaauauuuuucuuuagcuuugccauucaaugcuaacucucgaaguguccagcuucccgaaugccgaucauuuuuacuaucagcagcuuuauguauucauguauuuauuuauuuauuuuguaaagaccuagggggauaaauccaagcaggacaacaucaucuuugccccaaauguccccuucccccacgcucagcggcugcucauccuggccaggacccgagacagaaaaggguucccaacagucaccgccacgucagagaggcagaaaacuggaccaggcgagcgcagacgccacgggacgcgacaggugagugcucggcgggaaagccgaaggcagaagggaggaaggagaagccgcuuagcaaagacucccgggcgcugccggcggggaaaagcccggccugaacccaccgucccugccccaccgcgcagggccccaggcggagacagcucucccaccaucccaccgaccccacugccacagcagcacacuccacccgcucccugugggucgaggcgacucguucguaacccuuuagcuucccacaacgaaccggagaaggccgccaucuucccgcacuccuccgcugcgggcccgggcgauucccuccuuccagacacgccggggccgcggcggcgcgcgcuuccggcucgagcucuucgguguuccgauu

SEQ ID NO: 6590 - RNA, 2112 nt, Mus musculus
cuuuuuuuuuuuuuuuuuguagccuucagaaaacuuuauuuagugauaagcugagcucugcugccaaaagcccaccuaugaaaagggagcaggucugauucacaaagaguauacaugcauggcccaagauaauaaugaccuucaaacgcaaaugauccuaaagcuauuggaacuucuaauuaugagugacucauucagaugugccucuauuagccuuaaaaacugauugacacacaucugaggaguugugcuucccuugccauuaacacaaacacucgaccagaaaaggccugggacaaaaaacaaugaacaaaaaauuuagagucugacacucuuuucuccaucgacucggugaacacacauccacaacgaggauggaacggaaucagugucccgaagcuugccuccagggacgugugucuggccagugugaucuggaaccuccuaccacaacacagcgcagcacaaaugcucugggcacacagucaguucacuccuccgaagaaacccaaggggaucacguuuaaacccauccugugucaggagcaacuuugcuaugguucugaucacguggcucagagggagaaaagugccuagcaacaaguccuaacccucaucacucccagucugggccaccagugacgcaguggugccuuuggguaugaauaucugagaaggcggcaaauggcggcacugcggacaggcggaugcaggccccacagcagaggaagcgcuuccuccgcugcuccaucuucucccuacuguuaagguccugccugugauggccgagagccaugugugaagcagcucuuugugaccaagcguuggcaaaagucaguaaguuugucaaaggcaaaacccuucuguggacaacucuagcugcaacucuggggacaugugugagaggaaaggguccuuugacuggauuugguuaaccaaccccucuugcccagcucauuauucagauggaaggggaggaagagaagacaccagaaaaugagucaguuuugaaaucugcacagcugauauuuguucuucauagcaguaaggacuugaaugagaaucaugaaacuugaggaacacuuguauuuuccuugaggacuuaaaaaugugucuuguacugaaagacuacauucagugugggucagguccaagagcggcagcaagagcucggccauuaagcgugcccagcacugggaggagucugucaucugcucggcauggcuggugagcaggccagggcugccccucacugguuuccaaucggaagcccuggccccaguugugucucccgccucugccauucugaucagcagcucgcuucaugcuagcagggggcacaccaaauccugacaccccuccucuccuacuggguagucagcgguccaaaaacugagguguggacagaaaauuccuuccucccaaguccacuggguaucuaaacaucaggaagaaauaaagauguccgacaagguuuccaaugagcucauugaucaccgagccuccauauauguauccuugauauaguugaauccaaggauaacccaauguaaguaacaggccuuaaaucgcguuccgaaccagaacgacacgaucaggucucucuguucagcugggcucagacguagagcacugacaugaucagagggaucagcagcagcugcauauccauugcuaagccaguaauaacgaugcagauccaguuaaagagaagcaugaauaaauagucugcuggccucccgucaaaagcuccugcuucaagccgcguagaauacugauauaagaaauauaaauugaccaaauacagaaauccagucccugggcccacggggaaguaaaagguggcagugaacggccuccauaucuggaagcgauagaggaaggcuucgggccagaggaagaaguaggccgggcugaugaugccgagcuugcagaucaagaaggggacagcaaccguagcagcaaaccaguagugugugauggccgggaugcuccugaaccaguccccgauguccgacauggucgcccaucaggugaccgguuuugcagugccgcgcguccucaugugcccacucugcgcuccguggccggcuuggcuagggaaaguggagg

SEQ ID NO: 6591 - RNA, 2112 nt, Mus musculus
ccuccacuuucccuagccaagccggccacggagcgcagagugggcacaugaggacgcgcggcacugcaaaaccggucaccugaugggcgaccaugucggacaucggggacugguucaggagcaucccggccaucacacacuacugguuugcugcuacgguugcuguccccuucuugaucugcaagcucggcaucaucagcccggccuacuucuuccucuggcccgaagccuuccucuaucgcuuccagauauggaggccguucacugccaccuuuuacuuccccgugggcccagggacuggauuucuguauuuggucaauuuauauuucuuauaucaguauucuacgcggcuugaagcaggagcuuuugacgggaggccagcagacuauuuauucaugcuucucuuuaacuggaucugcaucguuauuacuggcuuagcaauggauaugcagcugcugcugaucccucugaucaugucagugcucuacgucugagcccagcugaacagagagaccugaucgugucguucugguucggaacgcgauuuaaggccuguuacuuacauuggguuauccuuggauucaacuauaucaaggauacauauauggaggcucggugaucaaugagcucauuggaaaccuugucggacaucuuuauuucuuccugauguuuagauacccaguggacuugggaggaaggaauuuucuguccacaccucaguuuuuggaccgcugacuacccaguaggagaggaggggugucaggauuuggugugcccccugcuagcaugaagcgagcugcugaucagaauggcagaggcgggagacacaacuggggccagggcuuccgauuggaaaccagugaggggcagcccuggccugcucaccagccaugccgagcagaugacagacuccucccagugcugggcacgcuuaauggccgagcucuugcugccgcucuuggaccugacccacacugaauguagucuuucaguacaagacacauuuuuaaguccucaaggaaaauacaaguguuccucaaguuucaugauucucauucaaguccuuacugcuaugaagaacaaauaucagcugugcagauuucaaaacugacucauuuucuggugucuucucuuccuccccuuccaucugaauaaugagcugggcaagagggguugguuaaccaaauccagucaaaggacccuuuccucucacacauguccccagaguugcagcuagaguuguccacagaaggguuuugccuuugacaaacuuacugacuuuugccaacgcuuggucacaaagagcugcuucacacauggcucucggccaucacaggcaggaccuuaacaguagggagaagauggagcagcggaggaagcgcuuccucugcuguggggccugcauccgccuguccgcagugccgccauuugccgccuucucagauauucauacccaaaggcaccacugcgucacugguggcccagacugggagugaugaggguuaggacuuguugcuaggcacuuuucucccucugagccacgugaucagaaccauagcaaaguugcuccugacacaggauggguuuaaacgugauccccuuggguuucuucggaggagugaacugacugugugcccagagcauuugugcugcgcuguguugugguaggagguuccagaucacacuggccagacacacgucccuggaggcaagcuucgggacacugauuccguuccauccucguuguggauguguguucaccgagucgauggagaaaagagugucagacucuaaauuuuuuguucauuguuuuuugucccaggccuuuucuggucgaguguuuguguuaauggcaagggaagcacaacuccucagaugugugucaaucaguuuuuaaggcuaauagaggcacaucugaaugagucacucauaauuagaaguuccaauagcuuuaggaucauuugcguuugaaggucauuauuaucuugggccaugcauguauacucuuugugaaucagaccugcucccuuuucauaggugggcuuuuggcagcagagcucagcuuaucacuaaauaaaguuuucugaaggcuacaaaaaaaaaaaaaaaaag

SEQ ID NO: 6592 - RNA, 1356 nt, Mus musculus
cgguuuguaacgugcagcgaucauggccagccaucuggaacucaacaacggcaccaagaugcccacccugggccugggcaccuggaaguccccuccuggccaggugacugaggccgugaagguugcuauugacuugggguaccgccacauugacugcgcccagguguaccagaaugagaaggaggugggaguggcccuccaggagaagcucaaggagcagguggugaagcggcaggaucucuucauugucagcaagcuguggugcacguuccaugacaagagcauggugaaaggagccuuccagaagacacugagcgaccugcagcuggacuaccuggaucucuaccuuauucacuggccaacgggguucaagccugggcccgacuauuucccacuggaugccucagggaacgugauaccuagugacaccgauuuuguggacacuuggacggcuauggaacaacuagugaaugaagguuuggugaaaacaaucggugucuccaacuucaacccucuucagauugagaggaucuugaacaaaccuggcuuaaaauauaagccugcggugaaccagaucgagugccacccguaccuaacucaggagaagcugauugaauacugccacagcaaaggcaucguggugacagcauacaguccccuugguucuccugacaggcccugggccaagccugaagacccgucucuccuggaggaucccaggaucaaagcaauugcagccaaguacaauaaaacuacagcccaggugcugauccgguuccccauucagaggaacuugguagugauccccaagucugugacaccagugcgcauugcugagaacuugaaggucuuugacuuugagcugagcagcgaggacauggccacucuacucagcuacaacaggaacuggagggugugcgccuugaugagcugugccaaacacaaggauuaccccuuccacgccgaagucugaagcuguggcgagcggaucccugcuccuccucaaguggcuugcaccuguucuuucugccucaucugcccuugcaaguguccugugucucugcacuagguggcaccuugcaaaccagauggugagaguuaguuaguuugacauagagucuggagggcaguaccaguagccaagguguuucuuccagccuuccuuggucuuucuucuuacccaccuggaggacuuuaacacaaguacccuuuccaaccaaagagaagcaagcuuuagaguccaagccgugccacuaacacuuaaaugugagugcuuagaacuguaauccuuugggucagacuucuccuugccucaaauaaaaacugcuuuugugaaaaaaaaaaaaaaaucugagg

SEQ ID NO: 6593 - RNA, 761 nt, Mus musculus
acgagguccacuggccccagcucgggcgaccaccugucugggacguguugacucaucucccaugacccugcggugccuggagcccuccgggaauggagcggacaggacgcggagccagugggggaccgcgggguugccggaggaacagucccccgaggcggcacgucuggcgaaagcccugcgcgagcucagucaaacaggaugguacuggggaaguaugacuguuaaugaagccaaagagaaauuaaaagaggcuccagaaggaacuuucuugauuagagauaguucgcauucagacuaccuacuaacuauauucguuaagacgucagcuggaccgacuaaccugcggauugaguaccaagaugggaaauucagauuggauucuaucauaugcgucaaguccaagcuuaaacaguuugacagugugguucaucugauugacuacuauguccagaugugcaaggauaaacggacaggcccagaagccccacggaaugggacuguucaccuguaccugaccaaaccucuguauacaucagcacccacucugcagcauuucugucgacucgccauuaacaaauguaccgguacgaucuggggacugccuuuaccaacaagacuaaaagauuacuuggaagaauauaaauuccagguauaaguauuucucucucuuuuucguuuuuuuaaaaaaaaaaaaaaaacacaugccucauauagacuaucuccgaaugcagcuaugugaaagagaacccagaggcccc

SEQ ID NO: 6594 - RNA, 742 nt, Mus musculus
uuuaaucacuaaguucuucuucaucgcugaagaaugcgcuuuucuuuauccuugguugucuagaauaauccgaggucgaggguuccccuggguugggucuccauuugcuuugccguucuucaaucuuggccugcuggaacgcuauggccugacucagacuguccagagccggaucauccccuuucucuucacucacuucuacuuccucaauuucuucuuccgguucagggacuuuccuuuucuucuucucuuucaucuuuggaggcucacacucuccaagcaugcuuuuaggacaggcauaacuuaagcguccacuuuccccacauucauaacacuuagauuuauccaguuucgucuucggaugaacuccggugcucuuccauugucaauagcgaugcuugccuuuaucacucuaccaaauagcuguuuauuauuuauugcucuggugcaguuuaaggcagagucuuuauccaaaaacaaauaaauacaacccguuacucuuccuaguaucuuugccuuucauuauaguaaccuuuacaacuuugccauacuuggaaaauauccgguauaaaucauuguuuguuagggagaaaggcaaguuggauacauaaacugugcuuuuacuuggcgccaagccaccgcucauuucuucggcgcaucggcgaagcagggaggaggaugcgagcccgcgaaggcuucaccuccggcugccuuccgcagugcgcaacagcgugggcgucca

SEQ ID NO: 6595 - RNA, 25179 nt, Mus musculus
ggaaaugugucggugacauugaauggggagaccgagcgcgagcaagcgaggcgcgcgcgcacacauacgcgcacacacagccgggcucgcuccgagauccccggccacguaaguaacuauuaauaccgccucgcccggggaugcgggcgugcuugagcgccgggauuggccuagggcgccguggccauccccuuuaauuuuuaaauacacgguccucuccuacuucuggguggcaagaaaaaaaaaauaauaagaaaagaagacaagccgucgauuuuuauuuuuccugcagagcaaaccccgccgugcaauuuggucgcaaggcaucgggagacaagagugguuugcaaauuguuucaaggcucaagacccaguugugcagcggaaaaggaacgccgcggguugacggaguccggggagcaucugcuggcagcuccugcaggacccccggaaagcuccugcugcugguaccccccaggucaccgcccgcacuucuugcuucaucggaggaggaucugggacgugagcagcgacagcaagagcuagugcugaccgcgcgggcucugccuugggcuuugucgcgguaccugugccugcccuacuccgcgcacucccuacucagcuuuugcaaucuuuuguugccacugcugaccgccccaaguuaaaagcgccuuugcaauuuuuuuuuucugucuuuuuuuuuuuuucuugagagagacagcucugcgauuuuuuggaaaagccucagacgccaucuacaguuaagacuuagguaacugcccucucuagcaccccccuuacacgccccccacccuuuccaccaaaaagaggggggugcagcgcggauucuggcugccgcgcggcgugagccgguagacccgagcuuauuuccuuuuucuuuuuguuugguuucuaacgcguggagggcgagccggcgccgcgcgcucccugaagacugcacaaacuccacgcagggcuucuccgcccggucugcggauccucagcuggggaucgcucagaagcccggcgcugcagcuccucaccccagaggcacgcucacucguccagauccacgcugcgaacagagacccacugaguccagcgugcgguucugcaccgcgcuggcagcuucuggguaacaaaaggacccgaguuguccgcagagcgagcacccccgggagcggggcucgcagccggggaccagcccugcagcgcccaucugggggcuaguucuuaacucuuccuccacggagccccagacggguccccucccuucuugauccuuuuaagucgguagcaccgaggcgccugcaccggcgcggcucauccaucucuccagagggguuuuuugguuuguuuguuuguuuugucgugugcgauccucacacucaugaacauacacaggucuaccccuaucacaauagcgagauaugggagaucgcggaacaaaacccaggauuucgaagagcugucgucuauaagguccgcugagcccagccagaguuucagcccgaaccuuggcucuccgagcccgcccgagacuccgaacuugucgcauugcguuucuugcaucgggaaauacuuacuguuggagccucuggagggagaccacguuuuccgcgcugugcaucugcacagcggagaggagcugguuugcaagguaaccagcccagcuuugcuuuugcguuuuguuuuuuugcuuaaaaaaaauuaaaauuuuuuuuuuaaaaaauuaaaaaaaaaucauccugggucuuuugccaggggccggggacggugcgggaggucggaaagcucucaaguccaggggcgaaagacucccgggaucauuaugcguggccucguuaagaggguuuauuugugugucuguccacguucgacuaguugcgaaguuuucagaccguuucagacaaugaggcgggcugcagcgggggcguuuuggggagauccgggaagggagggcggcgaaucugaacuggggcacggacacgcgugccccuuaggaggcucguagagcucgggugcaccgggcugauuccccuugccugggcauuucucucucugagucgauuccccuccccucgcugcaaggacuagggaauccccgguugguuuucaaacgcugcuccucugguuucuuuuguagccauuguucuuagcagccugcagguguuaaaccuuuguuccaaagguggccuuuuaaaagagacacaaaaaguguccccucuggcugagaccaaggcucuagccggggaaaagaggaguuuuaaagcucuuucuucggcuugaagccuggaaaggaagguugggguggaaauucgccccuugcgcaccuuugggugaacaacgaauccuuugguucuuuuugucuagguuucuucgcgucuucagacucccugacugcacacccccauugcuacuccccugcacccacaaggccaccuuugccuguuuagagacugcccuuuagagcccccugggcuaguacuaagaaggacacuucaauuuccuuuuugucuuugacccugaacaguaacugguuugugucucuaugugucagugugucuuugugugugcuaaccgaguaccagacaagaggaccaaggaaggauaauaacaaaguauuugacuacagucaguuuccuacugcaguggagaacaggacuuccccagauguagaucaagaauacauuaccacuuaaauuuagguucuucuuauuuauuuauuuauuuauuuauuuauuuauuuauugagguggaagugcgacugugcugccuuuaaaauggguaaugugcacagcugugcuacaaauacuguauuacacuuuuccucaauuaaucacuggcugcuuugugaaaucaccuucuuucgugcugacuuggagcgcuuccuugcaaaaaccgggugggugaagaucucagaaggcaguucugagauuauuuauuuccgauuuuuagaggaaaccagagacucuuuaaaugcugcuguuugcauguacuaaguguuggggguuuuugcaucuucuccaaguuacuguaaucaagagcaacuaugcccagcuaaagcauuaaauuuaguaggcaacucagagccugauuggagccccacacacugcacaauaggacagucauccuuugaaaugaaugaauuccacugagcugucauucuccuaugaaauaugcaccaucaucggcagagagccccucccccuccuuuugcucacccucaguccagcacuuuaauauauuucucuuccaaaggcuggagaugauuuuacguaagaacugucuguggccaaauucugcaagagcaucuugcuauucuuucuuuguuuaaaacuagggcuaucucuggucucucuguucguuuuccuuucugauccuucgagacauauuucacucuaggcugaccuuacagugucauuugccgacuugcucccuggccccaaacuguacuuaaucuguugguuuaguuauuucaaagauugaaucagguccucgccaauuacagugcggcugcaagcggauuuaagugugguaucauuguuuuguuugacagaggucaucccuuuacgacuccacagcuucuguucuccugucuuuuuccccugaggugaugugggugacuucugagcacagcugugugccacccucucuaggagaguuuuauuacggugaugcuaugacugccccaauauacacacugugggcucuuuagcucgcuacaggauucgaaaaccuccacauuugaacccaccuccuuuuggugucuuaacaugggguuccuguuuccuaacuucauguuuaugcaaaaaaaauguacaaaaccagaaagguuguauuuauuguggggguucauuagaguauucuguaggacacucugugguggggaggaggcggggaggggggaggggcuuccaggggcauaagcaaaauucccuagccugauuaucaccuccacaagccuacuuuaguuagccaaaguaggaaaggaucuuuagggggccuuuagcuguuuuuacaaaaauucuuguagcuacugugcagaauaacauaauuacuaucuuggcagaaugggcccucuuucuuuuuuuucuuuucagacaugaugaauguggccugaucuuagggccuuaucugaacugucacauuauauaaccaagacucccaauuaaacauuuaaaaggagcuggcacccaggcucagggcuugauuuuugcacuugagggugaugguuuaaauaccagcccaagccuauaaaugccuguuauagccacuaauaaaacuuugacuccuuccuguuuaggaaaauguaagcaauucuuuuagcuuuucauuuucuguccaccauuuugcauucuccuacaaagggcacggccacauugggaggcugccacgaaucugcuacuuucauuuaguucucuguucauucaguuuuucagcugugcgauggggaagagaacaggcuaaccaugccgagcaaaagguuacuuuauuuuauuuuuugaaaggcaacuggaaacaggaaauguauuauaaauaaucagaccgguaggcccuggugacagaagccacagccuggugcuucagaacaaaucaugccacuuauauaaugcagcuuguugacauuagccacuacggugugugaguguguguguguguguauguguguguguguguguguguauguuugugugugugagugugugugugagugugugugugagugugugugugagugugugagugugugugaaugugugugagugugugugugagagugugugugugagugugugugugugagugugugagagagagagagagaguguguguguguguguuccuugaugaaauugcugaggcuuccccgauucuguggccugcagccuguaagcuaagguugacucgagcauuucagauuccuaauugagugggccacugaggucacugcucugaggucaucauuugacaguaucagggugugauuuguggucuccggggaggcugaagcauucauucuuaaauucaaggguguaguggcaacagcugcgccacuuuccugagguaccucauuaugccucauucacagcugauuguugacuuugcuuccucagccccaguuagcaccagccucagugaggugcuuauugucccuguuugacucacagguuuuuuuuuuuuuuuaaaugcucaguuacuuaacucuuggaauuuuauauugcagccuguguuccuugaaugggcuacagaaggcccaggaauucccucagaaggauuuuaggguaacacgugcauuccggacugggccuuguuaacaaagcgaagggcgacagagguuccugggugggaucgggacccacaaaagguugugaugccuaagucaggguacuuaugauacaaaagggagguucuuugugcacuuuaucuauccuauucgggugaaugguggccuagugagagcgguaagcacccccagguaggguuuuuuuuccugcuucucuccuacugcacuccaaauacugaugaggaagaagagcucacugccacagaggauggcuagaccuucuuuuaaaugaaccucccccacccccuuauucaccccauaccauuuucaaacagccccuccccucccugcacauucucccccugagcaagggaaacccguuccagcccuaggugcugcccuagcugaguaacuacaggcugugacgugaaugaaaagcucccuuuccacccuucaaaucuuuguugugcguucguucguuucuuaggucuguucagaagguauugauggugcauuuuuuucuuaagcaacagugagguggcauuucgcaggcuaacucugauucauagaaaaucguugcauaauugauucauugaguuagauaucuguggagggaagagggaagccagccuggcucucuacagagaaggccccugugcuaauccuagagccacccuggggggugggagugaggacaacagcgaugagaguuuaggcuuguuuucugugccucaguuugcacagcuguaaaacuaauuuaucacacauaggaaaccauggaagaaagccuugauaguaaaugaauuaauuguucauucauguaugucuuccaugcauuuuuaaaaaguaaagaguuguuuguguuuuuccugggcucacuuaguuuuuuccuucuauuaguauuuuucugcauccauuucuucuauaaauauguaacuauagaaacuauagggaagaauaauaguauuugggcuuagaugauagcccagacaguaaaaugcuugccauacaacuguaaagaucugaguuggauaccuaacacccacauuuaaaaagcugugugugaugcaugugauaucagcucuggaaagacaaggacaggaggauuccagggcucccuggucagcuaggcucaccacguugguagguucaagggcaaugagagaccuugucucaaaaaacaaguggauaguuuccucaagagcuguaccugagauugaccucugaccucuacauagacacagggauacacacauggauacagacagacagacagacagacagacacacacacacacacacacacacacuaguaaaacuuagcauuuuacuauuuuuccuagacuucucccaacauggaaucguuucauuuauccauguuaugccauuuaagauuuggagguucagaggaggcaagacaugguuuguuuguuuguuuguuuguuuuuccccugaacuacauuacacagcugguagcagacagaacuggugugugggguguaaguuucauacucuuuaugccaugucaaagcacgagccugugggaggauucagcauucugcaguuugggucauaggagguaccucugacuggggucuugucaauucuguccuagguguuugagaucagcugcuaccaggagucccuggcccccugcuucugccugucugcccauagcaacaucaaccaaaucacggaaauccuccugggagagaccaaagccuauguguucuuugagcgaagcuauggagacaugcauuccuuuguccgcacuuguaagaagcugagggaggaggaggcagcccgacuguucuaccagauugccucagcuguggcccauugccacgauggaggccuggugcugcgugaccucaagcugcggaaauuuaucuucaaggaugaagagagguaaguggggcucagcccaugcagguguguguuugugugugugugugugugugugugugugugugugugugugugugugugugugcucgcgcgauaggguaucugcagggaacuuguggugaugccuguuacccaggugaggguuaaggcaagcagaacaaagagagagcauuguggugucccaaugcccuuggcaaacaaggagccauuacucccgaucaugaaacauucaaaggccaggaggcagagagaguagucugugaccugcugaaugccugugguuuuuaugaagaauucugaagaaggcugcaaacuaguguggcaguuucaaagucaacaaagacagguuuauaaaggcuucauguugucagaacacugagaaccuagaggacuuuguuuauuuuuuauuagauauuuuauucauuuacauuucaaaugcuaucccaaaaguccccuauauccucccccacccugcuccccuaccuacccacuuucacuucuuggcccugguguuccccuguacuggggcauauaacguuugcaaguccaaugggccucucuucccaaugauggccaacuaggccaucuucugcuacauaugcagcuagagacaugagcucuggagguacugguuaguucauauuguuguuccaccuauaggguugcagaccccuucagcuucuuggguacuuuuucuagcucccuagaguaaggaauaaaauacccauggaagaaguugcagagacaaaguuuggagcuaagacgaaaguauagaccauccagagacugccccacccggggguccaucccauaaucagccaccaaacacagacacuauugcauauaucaggaaguuuuuuucugaaaggacccugauauaacugucuccugcaaggcuaugccagugccuggcaaauucagaaguggaugcucacagucaucuauaggaaggaacacagggcccccaauggaggacuuuguuuauaguccuuucacgcccucaauagcucuuuccuaugcacguaguagguaugaaccacaggcuugcaaguaagccucagaaauagauagaccgcagaccugucaaaagcuagaggugaguccugggucccaugugauguggagggggauggggcuugccgguucucacuagaucuugaguaaccaagaaagguuucaaggagagagaaacaugguagccugggaagggcuggcuugucaggugaggaguugauggugugagaccagccaccaaggaugccugguuaucucaagaaacaucuguugaagacacaggcaucuggacuucauucauggauacaccauuaacucaucagguuccauuuagccaaccuggccagaguccagcuuucucuucacuuguaaagcuucuuuuuaagaauguaguuuuuuagagggacacaggcaaugucuucagucagugucaccuacguguuccuugugcccuauuggaaugacccacaaaucaaaagccccagacuagugcuccagggauugguuaagagacuccacacacccaaguccauggaguccuuggucauucuggacuggaaaagagggcaggaaagccucaaggcugucaucuaggaccaucugaugucagucugcuccacuuccuucaaucccucacccugcugacauaucuuugguacuuucugcaaaucacacagaccuuggggagcaaaccuuucugcuuucuauugccuuugacauccagcucagugggcugugauauuuucacacuauuguuuacagaaacccauuguccccuccccccaugaacuggcgcuagugaauuguacgcuuuugucuucucucucucucucucucucucucucucucucucucucucucucaucucucucucacucuccucuuucuccuccuaccucucuuucuuuccaucuaucuguauuccuuuuuuuuuuuuccuucaugguuugaacuaauuggagacuuaaugucuggcaaguacuuggggcuuagcaaaggaaaagggccuguuguuacuuaagucaaauggaauaauuucauggguguuuauaauccugcuauguauacagcaugcagaaagcuucuggacuuccugugccuauaaagguugcuucuuuuguauauuauacccauggggguggggucgguggacacuagcuacucuggcagcucauaugcuggucuuugauuagaugacuucauuuuuaaaaacaaagugaagaagcaggcucuucgaagauaagaaugugggcaauuuguaucuuuuccuucuccagcucagauacuccagccuucgaacuuagacccagggauaugguccuuauacuuuuguccuuaauaauuguuaugaccuugggcugccgccaucucucaaccuuauggcuuuaccauaaacacucuucacucguuuuuaguuuucacauauauaucuccucuuugaauguucucauuuggaagaugaauauggauuggucaaagauauuuccuuuaccaucuuuagcuacaaaaguaagaggcaguguuuacugaccuccugcaauacaguuguaggucagccugccuaauuauguguguguguguguguguguguguguguguguguguguugcagcagagcaaacucucuuugugcauuuguggcuggcacuccaccacugagcuaccucccagcccaugaacauuuuguagccagugccucugaacgcaggaaugugaaggucucagaaucaacaccaagaacaugcaguagguggaugagcuucucuaggaagucaacccaacugucaaggacuccuuucuucugccagagcacauggccccucgaaugcuguagccguaucucacgggcucugugggauuaaagguuacuuuagagaccuagucaggcaucagugaguaucaggguggcacaucccaaggucagacccauggcaaauagacauuucugaagugagccaaaggaauguagauaucgucaugugacagaacauuagagcaugacccgaaggcagucuuugucugauuucuaacacuuucuuccuuggucugauggacaaaacucugaaacaacuaacugcaaaagacuacuuugguggaguccucguuuacuuauucaaccaccaguuucucucucucucucucucucucucucuccccccccccccagcccauucuuccuuugagacaguuuuucaauauagauguguuacuuugcaauuuaggauccuucugcuucaaccaccuaaguaugcaagcauaggcuccaccccugacucaaccuucuguuuccugaucuaccgaguaguagaagguaaagcuguccuguggcagaauuggcugagcccuaccuguguucuguugacugaauccagagcugucuaugaagauucuuaguggagcuguccaugcucuacacauacuaugucauuuagaugucacccaaggucaugugcaaacucaaggccaggauaccuacgacgguugcauugggaucaucaauagcuuggcuucaucugauucccuuuggcuuugauuuagguucuagauucagguccuggucucgaauuucucuaaagguuuauaagcuguagcuuccucaagacugacagaaugguugcuucccuggaaggugauuagcauucagcaaggugauggugugaucugcaugcagagcuguacuugaaaucauugugagaaaacaaaacaaaacagugucuuuaugcaugaacaguccagaagccuuaguggguucgugagugaugaagucacucucucuagcagucacaguaguuccuucuagugcaaaguugauuccacccagacuggggagggggcgguguuuuucagaguagacccccucuucuguguucacugugacgacccaccaucacugaaccuuauuuugaagaaaugaauccuaagccuucauugaacuugccuggggcaaauuucaaggaaccuuuugcacccucaguccugcagaagccugugugacuuccuccagaucugaaagaaggcagaacauuuacccauaaugacacagggucucucccauaccuccuggccuauuuuuccccaugggaccugcuugaucacaggaccauauugcuagagacccuguauauuucuacugggccuuaaagaaaggccugagcucagaagugagccagaguggcugucuagauuccagccccugcuguugcacuuauuaagaaauuucacuuugacagaacaccuaaccuguacacuccgaaagccuccacuauaaaauggacugggaauacucuccuuacagaaggaaggugauuaauguugaccuuggcuucuuccacagcugcuuuccucugcccuuuuguuucuuugcacccacaggcugcuaaggaaaguggugcaacauugcucugucagugaccuuugcuccguuuuguccugcuggaugcuucuucugggacacaucuucuugccaucuccaggcuccacccccuagccucagaucaguguuuacaucucucagcacugaaaugucccaugugaacucagaaacuugccuuuuuacaugcugcugcucugcuccagagaucuuuaucucuuaaggugguugcuuuuuagcugcugugaggaagcagaucuucuuucugggcucugagaccuccuguaggcacucuguggcuaggggaggggguguggguggguuugguauaagaagugcagcuuguaccccuuuguuggggaaagccuuccugccucccccaacagcagaagucaaggccaucucucuggggugcugcugucuguuggcucuuuagaucuucaaguugcucccuccuucacugagguugcuauaucuaauaaaggauucagggcaggcaucagagccccagaggacaggcacagcuuuucgcucacuaauaucuauauauauaguuuugcaacuuguagguacucuaguuuagggauguuuucccucucugucucucagucucucugucucugucugucugucucucucucccccucucuuucagcuuugaugagacaaagcuuucaggaaauguucauauuuugguagaccaauuauauguccuugugccuauggcaacucuugggcaaaguugucuuuccauuauagucuuaacaagcucuccaggaugccugugaaggacaaagggacuuuggcugcugcuuuuugggagccagaagccaggagcuguccaccuuguuuucugagagagggucucucacugggaccucaggcuuguuaaguaggcuagguugacuuggcaguuaucccagggaucccugacugccucuaccugcccagaaucggaauuagaaguacaccccacacugagguuuuuagaacucagauucucaggcuuguucagcaaacacuuuaaggacugaccuaucccccggcccucccuacucuauuuucaugguccgaccucaauaccccuuaccaagcucuccucuuguugcuuugccauugcuccugcuggacggcugaguuuccuggagacagaagugggaucucauucauggcuuccagaacaugguaggcauugcuauuuguugaauaagugagaaucuccuuuuuuggguaggaacagcucagauugaauucuaauggcaggaugagagagacagggauaaauagaaaucauugaaauguaggucguugccuagaaugggagccuagaaaacuuauggauccccauggagacaccuuucaaagagagcuauuuucaaaguugcacauugagugagaaauuaacccauugcugcugucuugguuuauugauuuaugccuaaggaaggcuuauuuaaguccuuguuuucagcagacuguaauuucauuuaggaagggcuuuguucaucccagugagaauuggcccgucuucccagggcucuugcccuagaagcagccuggcuccuagcuaugcuugguagaauguauugcugugcuagacuuaguccuucaacugaugggagugucugaggaccuaggaaaguaggaaguuggcacaguggugagaaacuaaauucuuccacuuuguccuaugaucucagcuuccucucucauuuuucauaagucuuauuuuuauuuuuauuugugugugugugugugugugccugucugugccugugugugugugugugugugugugugugugugccuaugucugugccagugucugucucuguguguauguguguguguguauguguuuuugccacacguguuuguguauccccugagaccaggagaggacacuggauccaguggaacuagaguuacaggugguugugagcaacccaagugaguucuagaaaccgaaauggguccucugcaaaaauaguaagugcucuuaaguuuugaaccaucuuuccugcacuuugaacaucccccauccccaaaaggguuuugcuauguaaccuuggcuugccuccaaucugcaaugaucuuuaugccucugccuccuuagucuucucuguaauuaauuagggaugguguauggaaagcccccaggacugagccuauugcacuggcugaucugaaagaugccaaugccaucccugcuuccagccacugucuaugggauugcacuuuauaaaucugaaacuuggagacucaccuguucauucaaggaacacuuguuaagcaccaguuaugugcuaggcacuucuagaggcuauuaugccaaugaagccagugucuuguuuuuauaggauccacauggaucagaaugacucuauccuaacuaccgugcuuaaaucaacucauuucaauuuaguuacucuuuuauuuguuuguuuguuuguuuguuuacugagugugugugugcaugcaugcaagugugcacauguaugcauucaggcacauggauacugaggcacaugcauggaagucagaggacaguuuguaggagucggugcucuccuaauaccaugcagauucuugggauugaacucaauucauuagacuuggcagaaagugccuuaaccacugaaccaucuuguuggcucauacugucugucgaugugugaauugaugaaacuuaaaaccaccuaguagagacuuuguacaucugcagguaaggaaguugaggcccauuauuuuccagccagguuucugcaagcuuugaagccagggaagcuagcuguaaagucuucccugugaaacauaauggcagcuucagguucuguccuuuaugucauauguguaagauacugccucucaaacccaacucccuagaaagacucuugugacacaguuagacagguguacacuuaguggagccagcacccagugucuaccugaagcucagauuuccaagcaguuuugacauuuauggaugguaccaccaauuaagcaaaaccacaggcaguccuguuacuccauggguggcuucuguuucuuucacagcacuguaugauauggacuuagcauuuuaauuauauaaugagugacaguuggugaaauggauguaucaauagucccucacacccaagaagaugcauauuauaagaaaaaucccugucuguguugaacagauauagaaggcaguggauagaaacauuuuccaaaugugcuuuuuccaguccuugugggguuuucucuagccaauggaaaaguccaaucuguuugaaguuucucugggcuccagacauagcucuuaauuauucuuuaagaauccuagauaugaauguuaggguuggaggaagcggggcuuagauccugaaaucaucuguccucgcaaauguuuauuaaguauuuauuuugucugcuugcagugcuagauguugguggggcaagcaucaguaaaagaaagcccagaaugggaaagacaaugggacgggcaguucacuauuucagcagcuggaguguggaacaaagaggcaccuggggauagggggguggggguggggcagaagagcuguugugggguggggcucaucuagagaaccaguaaugagaaugacaggugacuagggccuuggauacauucccugaucuuguucuugaccugaagcccacaaauggacucucuagaccaauuguuggaaccauauucgaauggcgagaaguauacaaggaagacaaccagggauagugagacuggaagcuauacucucuacaucugaaacacgucaauacuaaaacauggccagacuuuuugguucccugaacuuguugguuaagccaucuguagggaucccuaguuuuugggcugccugccaggggaagcauccucuucuggcccagggaaugcccaaggcuuagagaggagcuuucagguagauacccagccugagcgguacaaugucaaaaccaaagggcaugcucgcucacaagcaccgauccuggagaagcuuuuccgagacgugaaucaauccauugcucugggguaggacagauccuucaggagccacuucuaagugcaggaagcaaguggugaauggggaaucaguguggcuuuguguuccagcucggguuucccugucuguuuccauggugacaagagucaggaagcccugagggcugcaagcugugguuucuguggaaucuuccaagcaguagaaugacacuccagguggaauggcuucccuuguguauccgguggccucagugagucagaggugugcccacaaugccggaggcuccauugcaguggguguguuacucaaguggcuuccucauccuagccaugucuugacagguccuuuaccuuucucagcugcuggggucuuuccaauugucuugagcauccaauaugugcaaacaaccaguccuggguugugugcugguacaagauacuguggcuuagcuucccuggcauuugccuuccuuuugacaucugucuugcaccauggaggguuuucuugacugugggccagcugccauccgucgugagcucuuccagacaggagaaccacugauacuggcccuggagcagaaguggcucacaguugauuacuggaaaaaucuguacauaccuaaaacaagauuaaaugaaggacuguuuugugccauguagcagccugaccaggucugguagggcugcagaguuugagccaugcuaccuacagugcuagaugguucuuuccugggcaccuucugugacucacuauaguggggauuuuucuugcacaguuggccugauuauggaggguacacuuucaggaacagaguaaggccagccuggcaguagcccaucuuuucuucuuggcucuuagucugcccuggacccugaggcugaccuagucugcagcucuggaugaucugcgcccggauuuccugucccugucaggcccacuuugcugaacuccuggcugagcuccacucuguuccacccuguccucucuucuuccugccaggagcucagggugaggcuuaaggguuugaaagcaaaacaugguuuguuguugggggcugguuucucucucucucuccuuuuguucuuucuuuuuguugucauagguaggacacuauaauagaggguaaaaaaaaauuuuuuuuugaauaccagcucugcuuuuacuugccagauagcaagucuccucagcuuuugauagcuuagccuuuuucaucuagaaaguauaugggucuuuccaucucuacaucucuaucuacaccauguacuauauauggcacugaguuaacucauaggauggcuuuguaugucaauaaaucugggacaggauaaaucugaaacuggaagagcccugucuccaucuacuuagcaccaugucuuugcaaacaucuucagcaccuuuaguuuuugaucaugguaccaugauguacugggaggggacagugacacccgaaucuuccugacaugaauucaggugagcuucugauucaguuagcuugggugugccuugggguguuuaauucuccccaccucuguuuccuuauuugauaggaaucaugcauagccuaagcccagucuuucuuuuuuuuuuuuuaugagacacaaaaaggcaggcuguugaaucccagcgucuggcgauucuugucugugcuacauggguacugcugcuuuucagaucaucgcauugugauuguaaggguguccucuaggaagcauaacggccugacagcugcagaaugauuaggaauauagaagcuagaaaagcccuuuucauaguaguuauuacaucauauuucaugggagagaaacaauugaaagagccuuggguuacuuugcgaaauggauuugguaguuggaggaucuuuggggccugugcuggagaugggugaggggaccugguuuuugaggggggaucuugcugccccacaggcgcugggaggggaauagaauucugcuaguucuggcuucccuacucggcccugagcuaugaugauacaggccuggcacuagguugccuaucauugaguacacagguuacccucuugugagcaucgucuaucugugacgucuaaagcaacucaucuuguuaccuucucaagccagagacaggcagaagugggcccagggagaucuagcuucccugguccaauguggucuguucuaggcuucugccuuccuuggaguuuauaguuauucaguccccauuguucuugucucccccuccuaucaccaugucacuuucauaaauguuuucgucauaaaucaucccugucuccuccaacacaauaauggauagccugauuaucugagagacaaggcugagcuaacccacauacuaggcaagagcaucucaagcaagggugaacaaguacagaagucccaauggaaaaugugggcacagcaucuucucuggucccaucugcccagccuugcauuuauacuugcuccucugucugcaccgcucagcucugggguugagagcaggaaucucaguugaacauuuggaucuguauaguuacuaccaugcuauagucagcucuguuacacugggcucuuugggauauccugucuugaguuacuuuaauccucagcaaaacagaggggaugguuguggccuugcuuguuauggacacaucccuagugccuaauuugggaguucuaucagaguaagugcuccugaaugucuuuuaaaugccugaaugauuagugggcuauuugaaucaccagguccacagaugcucuuguugguuuuuauggaaaucaacuucuuugccugggaaauucaucaccccccagacuguuuaggagacuucaggaaaagucuauucauucaugucuacucugaaaucuguuugcaaaggucacuucccugaacucaguccuggaaaaagaagcagagacagcuccguuccugagaggagauaaagggucaggcuuggaggcacuggguagcuccugugguugcacaauaggaccucaggcacuggggcuugcagcccaagucuccugucgcacuucccucugucccagcacauggagaacaucccggaagaucaguguuuaaagauagaauccagaccacuugccucgacccuuguuaggagugauauaaacaagccgaggauguuccggggaggagcaaggucagggagagccucuggggcugcauuucuuuuccacccugucuccaggcugcucuuccccucuccucuguccugacuuggaugcugaugcuguggaaggaaguagaagcuggcuguaccgaccuggauggagccuucugaguaucaguggcugaacgggcuccaugggauaacugagcacccagucuggaugugacugacuuggccucugugccuagggcuccugguacauacacacacacacacacacacacacauaccauauacuccacuuaugucauaauguaaagaaaacagauccauaaacacauggauugcauuaggcauguagaugacauuugacauuuguacuuaguacuuuuuaaagaacgaacuugagcuugaagcugacuucgguaugugcuuuguuaucugaguugcccugguuccuaggacagcucacuggcuucagcacaugauccagagucagagugauccagcugcuccucacugcauccucagaccuugccugauggagcucuggaaacagugguucucaaccuuccuagugcugcgacccuuuaaugcaguuccuccuguuguggugacccccaaccauaaaauuaucuucacugcuacuucauaacuguaacuuugcuacuguuaugaauuguaauguaacuauuuggaaggauaacgguuugccaaugggguuucgacucacagguugagaauggcuaaagggaaggagguugaaguccccuguagauuggccaggagcagcccagccucaguuauaggcuagugguuuuaguaaccuuauucuguugcguuaagcaucugcauaguuucugaguucuugucuugagguacgggagagagaggggaacuucacuugggggagugguaauggacaauguggugguccuggcuacaguccaaagcccuaauuauggggccacacacgggucuccaugaugaggggucagggaacuuuaaauauggggguaggaguaaaaaauaaccagaauguacaguuaugaugugcaagagauaaacagggacuacacuacagguuuaaagauuuggcauagcauaaauucuguggaguuccucccgagaagguggagggaggguuucauuccuguugucucuccuuccccaucacaggccugguuaauagaccuguccugacuucuacauaauucuaguuagauaguagaacaggggcuacuauuucuuuacagcagagcugaaacccccauagucagcaucugcuugucuguaucauucauauaagccaguuggugccagcagugggcccaggcauguaagccacagcagcaacagguagcaagucucucccucuguauccaaagucacucuguuuugcuuccacaagcuccuggaggcgaggaagccaggguucauccaagaugaccaccuagcgauuuaggaguucugaauaacaaacuguguugauggacaugagcagcauugccaaggcugaucggagcggcagggcagcuuuguguagggcacacaggugagaccuacaucaugucauuuaaacagaggccgacucacagugaauuguaccucagcagaacauucuaagcaggggacauuaugaguccucggagggacugagugagacauugccuuugaggcaaucagaagaguguguaacacagauagauuaggcucggaggguagggacacagacaugggaucaaucagcagacaugacaaggacacuggccucuauguggaugaccuagggcacuccuagagggauuuguaaugagaauccugccccaacuugaacccucugucuccaacuuuuccuccugaacugguagccauucacacagaaguaggaauuacuuccaagguuacaguucauagcuacaucaacugcucugcugccgaaucaaggaagcuagagguggaaggagcuguugagaggagcccugguauauguuacucagaauccccucccucccucccucuuuuccucccucccucccuguggcuucauagucuccucucugggcaguuuggaacaucuggugagaccagugggugggucacugccaccugccaccuccuauuaagagaaauaagcuggagaaagaaagauuugucuuuaaucaguucaauuccagauuaacacagcuagagccuccuuaguuucguaggccauuaguuucaggagcauucgaaagcaggcaugggguagggguguuguagaagauggcucagggaaugccagagggaauuacauguugcuguguauugcggaauguuagaucuggcacagagacagccuugugcgggugggugcauggugauuacuggauaucaugagugaacuaaauggaugcucaaaaaugguuaugauggugaaucguuuaauguaaaauuuauuguauuaaaagaaaaaaacagcacccucaaaauaaaccauacagagagagagagacagggacagagacagacagacagacagacagacacacacacacaacacaacacagccuucugcaguauuccucuuuaaagggagauugagugacuuagcuggagcuacagcugaaguuggugagagauacgccugacugggagucugcaccccuaaagaccacacugucuaggaaagcaaucagugcuugauuuuuggaacauguucauagaagauccuagaagcaacccaucuuuugucaucuucucuacuauugagcucccagcagcucuccuuaacuaguugccauaggugacuuuucagacuaccuugagagacugagaucuguagguacagagaguaaaaaaggaagaagaugagaggaagauggucuugggcuacacgcugugagugaugaccaaggugaccccauuguaguuuguccagacacuuucuguugcuaauuugaacccuuuagcuuaugcacucaagcaggaugaaggccuggauguaugcacugagagacaaggauaagugaugugaauuuaugggucuuuuaaguaccccagaggcccaauuccagcuccaacuguccuuagcuaccaucuuagcaggacuccaggagugugguaagaacuaccuacucaaaggguugugcucugcucugucugccuaagagaaaaggguuuucauuucaaacacagggaaggaguauguuuaccagucucacaaagcccaggcuggcuuccaauuugcuguguagguuaaucuugaacugcugaucuuugccucugccuuccaagugcugugauuacagguguguaccaccacgcccagcagcaguuuguuuugcacuaauaugauugaucuaagaagucaucuuaguuucuagauuuuccauuuccauaguguauaucuuuauuucacacucaaugaugaagcguggugugugugugugugugucauauaggugauguaagcuagguguuagggccagaaauucacauguauuucuccacuccuucuagcacaucuagggcuugcauauuuguauagauaaguugcugaguucuugaagagucgguggauugggaggugggauaaauaguuugagaagacucuuggcaacacacugcuauugucacacccaucuacccagacacacagucacaugcgaaccaugcaccuguaauuagugauaggugccaggucaaggacccaaggcuuuggggguaugacaggcgggccagggcaggugaaaaucuggaaaugaagauggacuugguauuuggaugcuaggcuuagaugaguaggucguggagaccacuugagccgaaauucucccugccuuucuucuugugucccaagaaaaguggcggguacagcuaaagaacccagaaggcaaaguaaggaauucuuguccacgcuagaaggcuucaagaaaauuacucaaacccccagcuucaguauucugugcuaugagugacauccagcuuguuacagggauggauggauggauggauggauggauggauggauggaugcacaaacaucagcaacccugauauaccgaugggauggaugugucgauggaugugucucccucauccuuaggagcuucugucuuugucucuuuccuacaggacucgugucaagcuggagaguuuggaagacgcuuacauucuccggggugaugaugacucacucucugacaagcauggcugcccagcguaugucagcccagagaucuugaacaccagcggcaguuauucgggcaaggcagcggacguguggagccuggggguaaugcuguacaccauguugguggggcguuacccuuuccaugacauugagccuaguucucuuuucaguaagauccgcaggggccaguucaacauuccagaaacucugucucccaaggccaagugccucauccgaagcauccugcgacgggagccgucagagcggcugaccucgcaggaaauucuggaccauccuugguuuucuacagauuuuagugucucaaauucgggauuuggugcuaaagaggcgugugaccagcuggugccagacgucaacauggaggagaacuuggacccuuucuuuaacugagcucaaggcccagggacacauagcagguaccaggagcaagagagagccccagaaaggaguucugggacacagguggccuggcugagaagcaagacggacauucauauuuacacauuucuugguucagagaaggaauauguucuaggagcugacggaacacguagcaugggaacaagacgugugggauggggguuggguucagauggacgggagccccuccccuaagcuucucuucccugggguagccugagagucccccuuaccaguagggcuauucuaccccacuuuucauuuuguucagaaauaguugcagaucucgauagaauccaaacucuucugccucaaacaccuaccuuggcauugcacuguuagcauuuaacuucuuguuacgauucagggaagggacaauugaucgaagauuuuuuuuuuuuuuuuggaacagaccaaccaccuauguaauaauuaauaagauucaccuaaaaauaauaauaauucggugcacacagacugaccugaaaccugggugcuaaacuaaaagaaaacaaaaguuccaguugucgucucucauucgcacuuuccaauucauuucuucuaaauaaacgauguccuauucugguuaggaaguaacacauuaacgcuuugcucccugaacggggagggggagucuguuccuccacagacauuucuguuuuguaucagcugguuuuuguagcaggaaacuaucagaagucaaacuuccagauguauuaucacaguucaggggaagaagaaaggaaaagaagaaaaauccaacuccuuucugguuuuuguucuuuugaaggaagaggguucacauuguagacauugcucucugcuccaaauucagugaggggcucccagagggcaggcgccuccuggagucagaucuuuuugaugaugcugaucucaacguuuuguuuuugcuuuaugggaaacuaguaaaacgagacagguugucccauguguauaaaauacagggcagcuauuuccuuuucuuugcuaagaaugauccuuugggcuuggaaaggcccucugguuugaacagaaagaguaaacgggcaauaagccaaaagccaggaugauauacauacaaacagcucucugucccaauacgcaccuuguauuuauuaaggaaaaugucacauugugauguauuaagccaguacuucaauuacgggucaacgggaugacauguuacaugcuguaguuuaacauuuauaauuuuguuccccuguuuugaguauuucugucccuggaauaaccuuuuauuuggcuuucucuagauagccuuauuugauuuugaguggcaaaauguuuuuccuuuuguacucuggcuuuucuauugcuguaugauacagaacucuuuuggcauaaauauuuguguucccaguaccucagucguuuggguuuuccugccugcaucuguuuugugaaaugguccuguuuuuggguaggugacacguggacucuaguguguaaauguuacuugaaucugugcuucacucuaguauguggcaugugugugcggacucuuggaugcuucacgccuacuccacuggagccccuguccccaggaggacagcuuccccacugauaaucaggagaccaagcugccauggauuuacccuugauucuauuuugauaauggaagauacagagagaggguuuuuacauucagaagauggugcuguggcaagaaggaccuuuuaucuucccucuccccuguuuuuaaaguccucggugggaggaaagauuggaaacaugcaugauggggacuaauggccucuggugcuuuguccuguauuugguuuaauguuuuuguccuaaucucuucaaucaauaaaauugugcguauuuaacuaaaaguuuggggccuca

SEQ ID NO: 6596 - RNA, 11763 nt, Mus musculus
auucgggggcguucaacaaauuaaaguuuauuaaauauagaaaacuaaacauuuuucaguaaacuucauuuacuuucuugcaguauaccagaguaaugacauucacuuagaagaagaaacugagcuuuuaaaggcuggauuuauaaaacaucagaggaaguucugcagacaacaguguuuaggauaugcuuaggauauucuuacuuuaguaugaauaaaauaccuaagaauuggcuaggacuuagcaauacuuuuuacuguauguauaccuuccaguaacuaaaacuuauacaaaguuccaacagugguaauugugagauauagcccuuuaaaaaauggugggauugugcuuaaauagagagacaguugagauuuccucgucuaaacagauggggcucuguuuaguaaggcacacuguguuggacgacugcuugguauaugaacccaguuccaucucugcauacuuugcuagcccugcuuagcuugagaggauguuauacugcauuauguuuauggaagaguuaaacugcccaggugugaacaguuccacuuguuacugagcagaccccacucacugugggaagacuacuuaauauucugaaagccacaguguagcuguagcuggcucuucggggaauauaaucaugacuuuaagggugaagauggccucuugggcagguuccaucauuugaguugucaaagucaagagugguccacucuuguccagcacucccagugcucaaaaggcugcuggaggaucacagguuggaggauagcuugggcuauauagugagacuuuaucuuguggggaagggagggacaaaaaaccacacacaacccaaucuaagcccuuccacaaccuaggggacuggggggaaggaaguuggcauuuuauacaagugucucuuuccaucucuccuagucuuccuucucugaguuugcuguguagcccaggcuaccucagacucccaagugcugggauuauagguuugcacuucccguauucagcuaaguggcuuuuucaaguuuaacaaaccugcuuuaaaguuucugaaaugguugacuaguaaaagauuuuaaauguagcaauggaaagcaauggugcaucaucugguccagucguuugaaguccacuguguguaggaagaagacauccaucauucagcuuugguggcagacuuccgguagugaaguacuguugcuguuacccauauauuuaaagccaacaugaucacaaaacguauaagaacugaaauaaauuaaaagaaaguuucaacauuaauaaaacugggcauuagccuggcgugguggcgcacaccuuuaaucccagcacuugggaggcagaggcaggcugauuucuaaguuccaggccaaccuggucuacagagugaguuccaggacagccaaggcuacacagagaaacacuguguaacccccccccaaaaaaaaaaaaaacaaaaacuggacauuauacugcuuuaauuagaagccuauguaaaguuucacccugacuccagacaaaacaauugagauugugagagcauugguuccagacagucuaggaaaaggacguuccuguagaaaugcccaccuggguacucagccaugcauccugagugguucauugaaguaauacagcccuggcugagaaguucaacuaagaccccuuugcuuacgucucaaggauauggcuguuucaaagugcugugcucuaugaagaccuuuuuaguaagguggugggcccugcuuauggaucccugaggaaggcugagggaggaggacugccugaggccugagugaaaagccaaccugggcagcacagcagauuucaccucaugagaaaugagcccagagucaguacauguuguauaaugaaguagucacuuaaaaaugugacugagagggcuggagagauggcucagugguuaagagcaccgauugcucuucugaagguccuaaguucaaaucccagcaaccacaugguggcucacaaccaucuguaaugagaucugaugcccucuucugguguaucugaagacagcuacagugugcuuagauauaauaauaaauaaaucuuuuuuuaaaaaaaaaugugacugagagaccaugagaacaguggccugcccuuuaagacaugaaagcuguguuuguuuuaugacaggucucacugacucuaauucuguagcugaggauagcuuuaaacuccucauucuccugcgucugcauccuaaaugcugggauuacaauuuuagacauguugaauauugaagccagagcucccuacaugcaaggcaagccauuuuaccaaaugagcuacauacauaugucauaguagcacuguguguguguguguguguguguguguguguguguguguguaggggugaguggauggugguguccuuauguagccuuggcuggcuuggaacuuuuuguguaaccagguauacccugaauucaaagaaauaagccugccucugucuccccaguguugggauuacaggcaugcaccaucagucccagcuagccacacuguuuuuaaaagcuagucacucaggaacaguggugacagauaagaaaaagccuacagugagagcauucuuggucuuuuaaauacagacuucauaugugcagguucuuugcuguucaauuacguccuguccuuccugugaacucaagucccacaggacaaggucugucuccuuuucuauccugucacuaaagucagagcugacaaaaguaugggacuucacuuuucuaaagcucgcuuucucaaugaaaggucuggugcugaggacauuugccacuuacuggauagguuucuguuuugucacuuuccaaagauguuggguccagaguugagaacagcuuaaggaauuaaucucuuucaguuagccaaaguauuuucuuggcuuuguuucaugugugugcucagugcccuaaaacacaguuggaggugucuuucugcucaaaggcaugccuuacuucuugucucucuggcuccugccagccucacuuucuccuucgucucccagcuucccugucccuguguccugaacuacuugcuauggccagcccuggccauauugggugucacuccucugaucaaauccuuauuuagcuuuuaagaccuugcccccucuggagacucugcucucagcucccuccaaguacaccgggcuccuucagcuacccaacccgcuggucucucucuggugucucucauuuuuguuuuggaaacuguuucuccuaggcuggccuggcucuguggccucagcugcuuaaguguaugaaacuagaagugcaugcucccacaccuaugccuauucugaaaacccauuucacagcauaauucagcaguuaauugugggacuccuguucaauuuccuuguugaaguagaaacuucaggaugaguguugacucccuuggauauguuccuccccgaggacugcaagaagaugcuuaauagagacagccaccacuguuguagacuaaauguaugugauuuugucuuuugaaucuguagcccaauucagucaaauggaucuguuaagccuuaugauggauuccauguggagauccaaguuucgccaaaaauaugcaaauaggaagucagagguuuuuacuuacuugucaagucauugguggucauuaaaguuguuauuauucuugcuguaaaagaaaauucauagaaauaaauaacuugauucccacacauuuugauauuucuauuuagcucaugccuuuccauuuuacuauaacgauauauaguaacuucuugaauggcauugaugggacccuuauuaauacuguauuguguaaccaucuaaugacaagccaugcacucugacccagucauauagaagcugcucacaaaagcagaagugauuuguaucaguagcucugcacugccagggagaguuccaaucucuccaugugcccacccuaagaaaaggaaaaaaaaacuuaaaaugccucauuugcauauugagcuuccagcacuuuagcugaagaaauaaggauuuuaaacguguguguguguguguguguguguguguguguguguguguguguguguguacacaugugcauccacacaucuuaugaagauauagguagauaggcuggagggauggcucagcaguuaguuaaaagcccugaaugcuuuuccagaggaccuggguucaauucccagcaaccauguggggguauauaacccuagucccagaggcucugacccccucuuccagccugugagggcaccagcuaugcauauggugcauauacauaaauuugggcaaaacacuaauauacauaaaaaauuuuuaauguuuuaaaaaaaccauauguuuugagacaugaccugacuguaccgcuggcuggccuugaacuugcagagacccagcugccucugcuuccugagcacugugacuaagguaccaugcuuggcaaaaaucuuuacacauuuaauaaaacuccgccucauuuuucauaggugagaaaaccaaggcuugagaaaacaagcucuucugccuauccaguguucugugggguuuguuguuauuuaguuccuuucuccauuaacagcccucuguagugaacaggacccuggguaacaguugaagccaguacucagucagccgcagucuacauuacacccucuuguacacaaaggugcccuuagcagguucuguugaauaguuaauuacaaaaguauuaguaugaaaaagaccucaggcaaucaguuaaacccaggaagauccugauauugaugaaacccaguuccuagagagugguuaucuuacuugcacagguguaggcagaaaggccccaggucagugcgcucacagcuccugaaucuuguaccuuccacaaauacuggagcugggcaaacuuacuggcugcacuaaugacugugcauaaguucuauugggauaaaaugagagagucaggaaccuaaaaagauaaaugacuacauacagugcuuugcuuauuuuuuauuuauuuaauuuauuucuuuaaauguuugauucucuggagaggagacucaacucaugggaaccauuuucuucccaccauguaauccuggggauugaacucagguugucaggcuuggcaguaagcaccuuuaaccacggcgucaucagcccagauacagugcuuucuaagccagauuuucaagucuugccauccccaacuugcuaagguuugaaaccucaauuugaugaagaauggcucucggcuaccucuguggaagggggugaauuggccagagauaguggaagaaucccagaccuggcugcagacuuaccuguccccuccucucccauccugggauggcacuuaacugaccaacuuccaaacuaacgccaaaagcuuugugucuuacuucccauccugagugccagucuccugugaccucucagaaaaggaagccuugcaaauugacuaucaacccaccaggccccagcuccacagcagcuucuaggcuuagacaggccagagggaggccacuguagucacacccaggcugagcaggauggcacgcgcagcauucaagaauucaggggagugaggaggcagaacauauuaggaaggaccacagaaagugauguguuuggcaaucaggcaagagaaccaagugaauaguagacguccuagucuauagugaauguuugaggauggugcaugccaagugaggugggacuggcuuucccagggcccuugacaggcucuggaggacagugccugcucugcuuccuguugagacaguagcaccuauauagauggccuccauagguccuugaggguggagauagagcuauacggggaagaaccauggggcaaggagugccagaguguuugggggcagaggagggggcagugcuauugccagaccugaacagacaaaagugacagugggagcugggcagguggcuugaagaaaugcugacuccaaccagggaagccugugggaaaacagcucuugagaaauuggggugcugaauaaagcaaaagaagagggccaggucaaaucagugugguagguaggagccagugagagagagacacacaccgagcagguuacaacguggccaugucugaauggacaagcugcucuugaguguuuacuugucaugacacagcuaacuuugagaucaagggguaauguuugacugggccauaagagaauccugguagugccagcacacgcuccaggaaagcaucguguuuucucaaacaguccagugcaggcaagggacugggaagcagagaugugaaucugcuucauguggucauugcaaaguaccagucuccaauucugccagggcacaggugcacaguaaugcuuguugaggaacugaaggcgaagucagaguggaggaaaggggaaaauuaauuuuuuaaauaugaagcugccagggauggcaagauggcuccaugggaggaggggagagauugcuguggggccugaugaucuaauuuuagucccugaaacccacaagguggaaggagauaacugacuacugcaaaugaccguaugugucucuauaucagcaucauuccugaaucgcaucauuagagaauugcacuguaagcaccccauuuacuugccaaggucaccugauaauggcauucaggaaaccaggccgguuggaggggccacagcaaaacuugagggaaauaggaaaaacaagauugaugagauuaauguucaaaaccaauuguccucucaaguuucuaugcuuccuugacuacuaagagaacauacagagaaucaaaucggcuugacuguuuugcugcccgagggugcaguggucucgggaacuagaaggcauauugugccccugaagccauggacucuaaccugaaaacccuaugcugcaagccaacuccaugguucucuacagauguggggcagagagaagguagcugcuuuuucagucuguuaguggcaccacucaccauggccaagucgaugauccauuucugcaggcugaggaugaaccaagaagacacaaaucuggucagaugcuaagggaccuagcagugagucacuggugggcccacccacccccucccaucuuguccugcacagaccaagccagaccacagggggugacacagaaggcaagguagaguggggggacuguucugcucgacgguguguaguuugggaaacaugcaagguguugcacaugaacaucugcucugaguucaaagaacagaagaaaauuauggaagaaaacacacagaccuguguucacacacugugaaucugggucugggaauauccacagggcuauaacuuucagcugguuuuucuuuccuuuuaauaaaucauguuuguuuuauguaauugguguuuugccuacaugugugucugugugagaaugcuggauccccuggaaguagaguuacaaacaguugugagcugccaugugagugcuggaaagugaaccggggucauuuggaagagcagccggugcucuuaaccacagagucucuccagacuucccuggcugcugguuuucugaccauggaaagacaucucuaaggcauugucaaaaguaagcacuuagaaaaaagguccagccuugcaaaggagagguguucugccaaacgggagugcugugugugagcuuuuuacugaauccucaccccuuucucacuaacuguuguaaaagcacacuaguuggggugcgcaguaguagguaaggaggaaccacuucccaucuggccugugcaggaacucaguggcuucaugaaacagagggacccaaccagagcaaagggacaaagcuaugaggguuggaggcccguggccugaguagcagugacugggaagaacacgucacuucccacuacuuugccuuggguuuccucccuugccuuguccaccucccacaugcugucagcauacagaagaaaggcaaaggugacgaaaaacaauggucacacuaaguaggugaagagauuauacuaaagacgggucuauggcaggaggcagcaauggccagcauccagcuguucucgguuuacuaaggcauucucuaugcauagugcaguggcucaagccuguaguccuagcauuugaagaaagauguggaguuuaaggucagccucagcuacagggggagaugaaggcagcacccccuuggaaaugaucucagaacagaaguggaccacagcgauguucucccucuuucuauggagggagggggaucuuagccaggggucuaacggcaaucggagacagcuucuggucaagauuugcccaagcccuugggccugucacuguuaaauggguguguggccauaucauggcggcagcaggguuaacugacugccacuaccaugcaaacauuuucuuggccuuuuaaagaguaugaaauucaagaaaagugaacuaaaucugacaugaaaucucacccuuuaccuagaagauuccacugaguggcaccgucugcuggcuggccaucuguacuguaagccuccaaaccaacacagccacccacaugacaagacucagccucuaaauuacaguuuugcauaggugugugguuaguggaacccaucuggccagugcuuauccacugagaggcaccugccaggugcauccugcaugggacuuggugccaggcacacaugguauuaauccccuggggacaugcucucagaaggaaggagugcccaagauaagcacagauggagcguguugcucuuagcaggguaacugcacaguucucauguucagcagggacacagcaaaucuauauccuacugggucuuggagggcaguggagcauccuguuauggggauaccucuggcagcaacuguacuaaccuaagguauaugucaagacuagaauuugugauucuuucuccaugcugaggacagaauccagagccucuguaugccacaacugagccuccuuccuuaggcccuccaucucuaucuccagcucauaugcaggaaggauacacggccauguaggguaaggcuugcuucacguucccauugaaaugaaagacgaagagcaggaggacaaugucugaaacgagaggcucugugagaugggcagggcagcaggugggaaggcuggggacuagagggccaguuaccuugugcgaugagaaugggguauuccagauaggugagcaguggguucccauaguaaugcugauaacgaaggaagaccaggaaccugcagagagaugcauauauucacagcccacccugugccugaccuccccagacuccagacacuggcauauuuacccaacacuagccuauguggucuucaucauaugugugauugaccugaggacagaccuucaggaauauugccagagccccauauguuguauccaauaguccuugaaggucaaccuucaggguuaccuacacugccuuccacaucacaccaucacuugggaaaacuaagguccaaaagccaaggccaugugaggacacaaggguuagagucucaccaggagauguugcccuaguucugguuaugcuuuuagggggaccccugugcccuggggauggugcauaaguaacucuguuuuucagguuucucuaaagcaaucaucagccaggcauggagucucuggugucauuaaaguaggcucuggccaagauccaguucccucaagucaugauuuuagaguuugagcuugaaaucagaggagggccuaugcccccaaggaaucgccucugguguaugaaagcugguuugacagugguguccuuuagugucuuccugaugccucagagaccaucuggcuggugaggggcaggcagacaggcaagcaaggcccaggagggaagcagaauuguagugaccacccuacucauggagggagaaggagggggaagggagcuaaagaagggaaggaggagucagaauguagaccgacaggauccagguagauugccguccuaucccuauuguuccugccucuggauuaaaacaacuuuaccaauaaagcugcuugaggauuugccuguaggggccccagaaggaccuucagaaaguucucaggaacuaggaaccauuguagucuggcggaaguagggauaaauaacuaguagauuucaaugguggaucauauucgugccuucuggccacagaacuggucuuaacccugcuaagcccaccuacugccucaaagggagaaagggaggccuuugggaguuccagaaagagccugcuauuuacagcacgaccuacugcaagacccuuccagaucccggggaacauuccauggccagagcuguuuucuacuggagucagcuguuggauuugagaccaucucugguugaguuuacgaauuuaaagccaggcagcaaagaguuagcuacaagcagaauaggagacguugggcuggcacucuguaggcaucccugagcuuucuauucaguccugcauccugaagccucagcuucagaugccuaugaagaauuuagcaaaccagaggucaaauagcucuccugacuucacacccgcauccucugccacagccagacugucacuuuugcauccuccagucugucuguugccuuaccucucacccugacagccuucucccuucucugaaauucacauacucuuguacugugcagccuuacgggccagagacccuucagagccccgccuaccaucaagcgucccuggaaagguacaccuugaagcaccgcaccccuuccccaacucuauagaugggcgcgccccacugaauggacacaggaccaaugggugaccguggggugaggcuagugucaaaccgagagggcucagccuggugcaagaucacaggacuuagggguguguuuuccguuugcuuuuuccaaccaaaguuuuacaacuuugccccuuacucuacuacauagccaaggcuauugagaacuuggcuccugcagcagucacaggccaucccuacccguuggaccccagcucaauuuucaaacgucuacucaaguuccccaucuucgcugaauuuguaaaaugggcaugcucaggcaaaucguggaauuugggaagaagcaggggaggugggugggagcgccccggguaagcaccuccuagccccgagcccccgaguuaacccuugguuucccggacucccaauuccucgcaggccucccgggaccuuaccccgccagcuccaaaaguaaacuagggaggcugaugccccgcgcgcugcgcgccgccagcugcgcguaaaucugcggcagcuugagugcggcgcagacgcccagcgugcuccaguugcagaaccauagcaguccggccuccauucugcaaucucggacgugccgggccagggggguucaggaucuuauaggugagaaccggaggcucaaaguccaaaaaguccuuccgccuugccgccggccgggucccgcccugaucacgccccgagcugcugugcagcaagugcgcuccgccccgagucugcuccacucaagaugcucccuaccccuuuagucuguuccgcgcccgugcgccccgcccagagucugcuccgcucggagcgcaccccgccccagucugcuccgcuccuagcgcacccagcucggaguuggcuuggcucgggaugcucccugcccugugucugcugugcucccgguccuuccagacuccagggcggugguucuguccugcccugugugcgcacugccuggagucugcucugcucccgguccuuccagaccccagggcggugguucugcccugcccugucaggcacug

SEQ ID NO: 6597 - RNA, 11763 nt, Mus musculus
cagugccugacagggcagggcagaaccaccgcccuggggucuggaaggaccgggagcagagcagacuccaggcagugcgcacacagggcaggacagaaccaccgcccuggagucuggaaggaccgggagcacagcagacacagggcagggagcaucccgagccaagccaacuccgagcugggugcgcuaggagcggagcagacuggggcggggugcgcuccgagcggagcagacucugggcggggcgcacgggcgcggaacagacuaaagggguagggagcaucuugaguggagcagacucggggcggagcgcacuugcugcacagcagcucggggcgugaucagggcgggacccggccggcggcaaggcggaaggacuuuuuggacuuugagccuccgguucucaccuauaagauccugaaccccccuggcccggcacguccgagauugcagaauggaggccggacugcuaugguucugcaacuggagcacgcugggcgucugcgccgcacucaagcugccgcagauuuacgcgcagcuggcggcgcgcagcgcgcggggcaucagccucccuaguuuacuuuuggagcuggcgggguaaggucccgggaggccugcgaggaauugggaguccgggaaaccaaggguuaacucgggggcucggggcuaggaggugcuuacccggggcgcucccacccaccuccccugcuucuucccaaauuccacgauuugccugagcaugcccauuuuacaaauucagcgaagauggggaacuugaguagacguuugaaaauugagcugggguccaacggguagggauggccugugacugcugcaggagccaaguucucaauagccuuggcuauguaguagaguaaggggcaaaguuguaaaacuuugguuggaaaaagcaaacggaaaacacaccccuaaguccugugaucuugcaccaggcugagcccucucgguuugacacuagccucaccccacggucacccauugguccuguguccauucaguggggcgcgcccaucuauagaguuggggaaggggugcggugcuucaagguguaccuuuccagggacgcuugaugguaggcggggcucugaagggucucuggcccguaaggcugcacaguacaagaguaugugaauuucagagaagggagaaggcugucagggugagagguaaggcaacagacagacuggaggaugcaaaagugacagucuggcuguggcagaggaugcgggugugaagucaggagagcuauuugaccucugguuugcuaaauucuucauaggcaucugaagcugaggcuucaggaugcaggacugaauagaaagcucagggaugccuacagagugccagcccaacgucuccuauucugcuuguagcuaacucuuugcugccuggcuuuaaauucguaaacucaaccagagauggucucaaauccaacagcugacuccaguagaaaacagcucuggccauggaauguuccccgggaucuggaagggucuugcaguaggucgugcuguaaauagcaggcucuuucuggaacucccaaaggccucccuuucucccuuugaggcaguaggugggcuuagcaggguuaagaccaguucuguggccagaaggcacgaauaugauccaccauugaaaucuacuaguuauuuaucccuacuuccgccagacuacaaugguuccuaguuccugagaacuuucugaagguccuucuggggccccuacaggcaaauccucaagcagcuuuauugguaaaguuguuuuaauccagaggcaggaacaauagggauaggacggcaaucuaccuggauccugucggucuacauucugacuccuccuucccuucuuuagcucccuucccccuccuucucccuccaugaguaggguggucacuacaauucugcuucccuccugggccuugcuugccugucugccugccccucaccagccagauggucucugaggcaucaggaagacacuaaaggacaccacugucaaaccagcuuucauacaccagaggcgauuccuugggggcauaggcccuccucugauuucaagcucaaacucuaaaaucaugacuugagggaacuggaucuuggccagagccuacuuuaaugacaccagagacuccaugccuggcugaugauugcuuuagagaaaccugaaaaacagaguuacuuaugcaccauccccagggcacaggggucccccuaaaagcauaaccagaacuagggcaacaucuccuggugagacucuaacccuuguguccucacauggccuuggcuuuuggaccuuaguuuucccaagugauggugugauguggaaggcaguguagguaacccugaagguugaccuucaaggacuauuggauacaacauauggggcucuggcaauauuccugaaggucuguccucaggucaaucacacauaugaugaagaccacauaggcuaguguuggguaaauaugccagugucuggagucuggggaggucaggcacagggugggcugugaauauaugcaucucucugcagguuccuggucuuccuucguuaucagcauuacuaugggaacccacugcucaccuaucuggaauaccccauucucaucgcacaagguaacuggcccucuaguccccagccuucccaccugcugcccugcccaucucacagagccucucguuucagacauuguccuccugcucuucgucuuucauuucaaugggaacgugaagcaagccuuacccuacauggccguguauccuuccugcauaugagcuggagauagagauggagggccuaaggaaggaggcucaguuguggcauacagaggcucuggauucuguccucagcauggagaaagaaucacaaauucuagucuugacauauaccuuagguuaguacaguugcugccagagguauccccauaacaggaugcuccacugcccuccaagacccaguaggauauagauuugcugugucccugcugaacaugagaacugugcaguuacccugcuaagagcaacacgcuccaucugugcuuaucuugggcacuccuuccuucugagagcauguccccaggggauuaauaccaugugugccuggcaccaagucccaugcaggaugcaccuggcaggugccucucaguggauaagcacuggccagauggguuccacuaaccacacaccuaugcaaaacuguaauuuagaggcugagucuugucauguggguggcuguguugguuuggaggcuuacaguacagauggccagccagcagacggugccacucaguggaaucuucuagguaaagggugagauuucaugucagauuuaguucacuuuucuugaauuucauacucuuuaaaaggccaagaaaauguuugcaugguaguggcagucaguuaacccugcugccgccaugauauggccacacacccauuuaacagugacaggcccaagggcuugggcaaaucuugaccagaagcugucuccgauugccguuagaccccuggcuaagaucccccucccuccauagaaagagggagaacaucgcugugguccacuucuguucugagaucauuuccaagggggugcugccuucaucucccccuguagcugaggcugaccuuaaacuccacaucuuucuucaaaugcuaggacuacaggcuugagccacugcacuaugcauagagaaugccuuaguaaaccgagaacagcuggaugcuggccauugcugccuccugccauagacccgucuuuaguauaaucucuucaccuacuuagugugaccauuguuuuucgucaccuuugccuuucuucuguaugcugacagcaugugggagguggacaaggcaagggaggaaacccaaggcaaaguagugggaagugacguguucuucccagucacugcuacucaggccacgggccuccaacccucauagcuuugucccuuugcucugguugggucccucuguuucaugaagccacugaguuccugcacaggccagaugggaagugguuccuccuuaccuacuacugcgcaccccaacuagugugcuuuuacaacaguuagugagaaaggggugaggauucaguaaaaagcucacacacagcacucccguuuggcagaacaccucuccuuugcaaggcuggaccuuuuuucuaagugcuuacuuuugacaaugccuuagagaugucuuuccauggucagaaaaccagcagccagggaagucuggagagacucugugguuaagagcaccggcugcucuuccaaaugaccccgguucacuuuccagcacucacauggcagcucacaacuguuuguaacucuacuuccaggggauccagcauucucacacagacacacauguaggcaaaacaccaauuacauaaaacaaacaugauuuauuaaaaggaaagaaaaaccagcugaaaguuauagcccuguggauauucccagacccagauucacagugugugaacacaggucuguguguuuucuuccauaauuuucuucuguucuuugaacucagagcagauguucaugugcaacaccuugcauguuucccaaacuacacaccgucgagcagaacaguccccccacucuaccuugccuucugugucacccccuguggucuggcuuggucugugcaggacaagaugggagggggugggugggcccaccagugacucacugcuaggucccuuagcaucugaccagauuugugucuucuugguucauccucagccugcagaaauggaucaucgacuuggccauggugaguggugccacuaacagacugaaaaagcagcuaccuucucucugccccacaucuguagagaaccauggaguuggcuugcagcauaggguuuucagguuagaguccauggcuucaggggcacaauaugccuucuaguucccgagaccacugcacccucgggcagcaaaacagucaagccgauuugauucucuguauguucucuuaguagucaaggaagcauagaaacuugagaggacaauugguuuugaacauuaaucucaucaaucuuguuuuuccuauuucccucaaguuuugcuguggccccuccaaccggccugguuuccugaaugccauuaucaggugaccuuggcaaguaaauggggugcuuacagugcaauucucuaaugaugcgauucaggaaugaugcugauauagagacacauacggucauuugcaguagucaguuaucuccuuccaccuuguggguuucagggacuaaaauuagaucaucaggccccacagcaaucucuccccuccucccauggagccaucuugccaucccuggcagcuucauauuuaaaaaauuaauuuuccccuuuccuccacucugacuucgccuucaguuccucaacaagcauuacugugcaccugugcccuggcagaauuggagacugguacuuugcaaugaccacaugaagcagauucacaucucugcuucccagucccuugccugcacuggacuguuugagaaaacacgaugcuuuccuggagcgugugcuggcacuaccaggauucucuuauggcccagucaaacauuaccccuugaucucaaaguuagcugugucaugacaaguaaacacucaagagcagcuuguccauucagacauggccacguuguaaccugcucggugugugucucucucucacuggcuccuaccuaccacacugauuugaccuggcccucuucuuuugcuuuauucagcaccccaauuucucaagagcuguuuucccacaggcuucccugguuggagucagcauuucuucaagccaccugcccagcucccacugucacuuuugucuguucaggucuggcaauagcacugcccccuccucugcccccaaacacucuggcacuccuugccccaugguucuuccccguauagcucuaucuccacccucaaggaccuauggaggccaucuauauaggugcuacugucucaacaggaagcagagcaggcacuguccuccagagccugucaagggcccugggaaagccagucccaccucacuuggcaugcaccauccucaaacauucacuauagacuaggacgucuacuauucacuugguucucuugccugauugccaaacacaucacuuucugugguccuuccuaauauguucugccuccucacuccccugaauucuugaaugcugcgcgugccauccugcucagccugggugugacuacaguggccucccucuggccugucuaagccuagaagcugcuguggagcuggggccugguggguugauagucaauuugcaaggcuuccuuuucugagaggucacaggagacuggcacucaggaugggaaguaagacacaaagcuuuuggcguuaguuuggaaguuggucaguuaagugccaucccaggaugggagaggaggggacagguaagucugcagccaggucugggauucuuccacuaucucuggccaauucacccccuuccacagagguagccgagagccauucuucaucaaauugagguuucaaaccuuagcaaguuggggauggcaagacuugaaaaucuggcuuagaaagcacuguaucugggcugaugacgccgugguuaaaggugcuuacugccaagccugacaaccugaguucaauccccaggauuacauggugggaagaaaaugguucccaugaguugagucuccucuccagagaaucaaacauuuaaagaaauaaauuaaauaaauaaaaaauaagcaaagcacuguauguagucauuuaucuuuuuagguuccugacucucucauuuuaucccaauagaacuuaugcacagucauuagugcagccaguaaguuugcccagcuccaguauuuguggaagguacaagauucaggagcugugagcgcacugaccuggggccuuucugccuacaccugugcaaguaagauaaccacucucuaggaacuggguuucaucaauaucaggaucuuccuggguuuaacugauugccugaggucuuuuucauacuaauacuuuuguaauuaacuauucaacagaaccugcuaagggcaccuuuguguacaagaggguguaauguagacugcggcugacugaguacuggcuucaacuguuacccaggguccuguucacuacagagggcuguuaauggagaaaggaacuaaauaacaacaaaccccacagaacacuggauaggcagaagagcuuguuuucucaagccuugguuuucucaccuaugaaaaaugaggcggaguuuuauuaaauguguaaagauuuuugccaagcaugguaccuuagucacagugcucaggaagcagaggcagcugggucucugcaaguucaaggccagccagcgguacagucaggucaugucucaaaacauaugguuuuuuuaaaacauuaaaaauuuuuuauguauauuaguguuuugcccaaauuuauguauaugcaccauaugcauagcuggugcccucacaggcuggaagagggggucagagccucugggacuaggguuauauacccccacaugguugcugggaauugaacccagguccucuggaaaagcauucagggcuuuuaacuaacugcugagccaucccuccagccuaucuaccuauaucuucauaagauguguggaugcacauguguacacacacacacacacacacacacacacacacacacacacacacacacacguuuaaaauccuuauuucuucagcuaaagugcuggaagcucaauaugcaaaugaggcauuuuaaguuuuuuuuuccuuuucuuagggugggcacauggagagauuggaacucucccuggcagugcagagcuacugauacaaaucacuucugcuuuugugagcagcuucuauaugacugggucagagugcauggcuugucauuagaugguuacacaauacaguauuaauaagggucccaucaaugccauucaagaaguuacuauauaucguuauaguaaaauggaaaggcaugagcuaaauagaaauaucaaaaugugugggaaucaaguuauuuauuucuaugaauuuucuuuuacagcaagaauaauaacaacuuuaaugaccaccaaugacuugacaaguaaguaaaaaccucugacuuccuauuugcauauuuuuggcgaaacuuggaucuccacauggaauccaucauaaggcuuaacagauccauuugacugaauugggcuacagauucaaaagacaaaaucacauacauuuagucuacaacagugguggcugucucuauuaagcaucuucuugcaguccucggggaggaacauauccaagggagucaacacucauccugaaguuucuacuucaacaaggaaauugaacaggagucccacaauuaacugcugaauuaugcugugaaauggguuuucagaauaggcauaggugugggagcaugcacuucuaguuucauacacuuaagcagcugaggccacagagccaggccagccuaggagaaacaguuuccaaaacaaaaaugagagacaccagagagagaccagcggguuggguagcugaaggagcccgguguacuuggagggagcugagagcagagucuccagagggggcaaggucuuaaaagcuaaauaaggauuugaucagaggagugacacccaauauggccagggcuggccauagcaaguaguucaggacacagggacagggaagcugggagacgaaggagaaagugaggcuggcaggagccagagagacaagaaguaaggcaugccuuugagcagaaagacaccuccaacuguguuuuagggcacugagcacacacaugaaacaaagccaagaaaauacuuuggcuaacugaaagagauuaauuccuuaagcuguucucaacucuggacccaacaucuuuggaaagugacaaaacagaaaccuauccaguaaguggcaaauguccucagcaccagaccuuucauugagaaagcgagcuuuagaaaagugaagucccauacuuuugucagcucugacuuuagugacaggauagaaaaggagacagaccuuguccugugggacuugaguucacaggaaggacaggacguaauugaacagcaaagaaccugcacauaugaagucuguauuuaaaagaccaagaaugcucucacuguaggcuuuuucuuaucugucaccacuguuccugagugacuagcuuuuaaaaacaguguggcuagcugggacugauggugcaugccuguaaucccaacacuggggagacagaggcaggcuuauuucuuugaauucaggguauaccugguuacacaaaaaguuccaagccagccaaggcuacauaaggacaccaccauccacucaccccuacacacacacacacacacacacacacacacacacacacacagugcuacuaugacauauguauguagcucauuugguaaaauggcuugccuugcauguagggagcucuggcuucaauauucaacaugucuaaaauuguaaucccagcauuuaggaugcagacgcaggagaaugaggaguuuaaagcuauccucagcuacagaauuagagucagugagaccugucauaaaacaaacacagcuuucaugucuuaaagggcaggccacuguucucauggucucucagucacauuuuuuuuuaaaaaaagauuuauuuauuauuauaucuaagcacacuguagcugucuucagauacaccagaagagggcaucagaucucauuacagaugguugugagccaccaugugguugcugggauuugaacuuaggaccuucagaagagcaaucggugcucuuaaccacugagccaucucuccagcccucucagucacauuuuuaagugacuacuucauuauacaacauguacugacucugggcucauuucucaugaggugaaaucugcugugcugcccagguuggcuuuucacucaggccucaggcaguccuccucccucagccuuccucagggauccauaagcagggcccaccaccuuacuaaaaaggucuucauagagcacagcacuuugaaacagccauauccuugagacguaagcaaaggggucuuaguugaacuucucagccagggcuguauuacuucaaugaaccacucaggaugcauggcugaguacccaggugggcauuucuacaggaacguccuuuuccuagacugucuggaaccaaugcucucacaaucucaauuguuuugucuggagucagggugaaacuuuacauaggcuucuaauuaaagcaguauaauguccaguuuuuguuuuuuuuuuuuuuggggggggguuacacaguguuucucuguguagccuuggcuguccuggaacucacucuguagaccagguuggccuggaacuuagaaaucagccugccucugccucccaagugcugggauuaaaggugugcgccaccacgccaggcuaaugcccaguuuuauuaauguugaaacuuucuuuuaauuuauuucaguucuuauacguuuugugaucauguuggcuuuaaauauauggguaacagcaacaguacuucacuaccggaagucugccaccaaagcugaaugauggaugucuucuuccuacacacaguggacuucaaacgacuggaccagaugaugcaccauugcuuuccauugcuacauuuaaaaucuuuuacuagucaaccauuucagaaacuuuaaagcagguuuguuaaacuugaaaaagccacuuagcugaauacgggaagugcaaaccuauaaucccagcacuugggagucugagguagccugggcuacacagcaaacucagagaaggaagacuaggagagauggaaagagacacuuguauaaaaugccaacuuccuuccccccaguccccuagguuguggaagggcuuagauuggguugugugugguuuuuugucccucccuuccccacaagauaaagucucacuauauagcccaagcuauccuccaaccugugauccuccagcagccuuuugagcacugggagugcuggacaagaguggaccacucuugacuuugacaacucaaaugauggaaccugcccaagaggccaucuucacccuuaaagucaugauuauauuccccgaagagccagcuacagcuacacuguggcuuucagaauauuaaguagucuucccacagugaguggggucugcucaguaacaaguggaacuguucacaccugggcaguuuaacucuuccauaaacauaaugcaguauaacauccucucaagcuaagcagggcuagcaaaguaugcagagauggaacuggguucauauaccaagcagucguccaacacagugugccuuacuaaacagagccccaucuguuuagacgaggaaaucucaacugucucucuauuuaagcacaaucccaccauuuuuuaaagggcuauaucucacaauuaccacuguuggaacuuuguauaaguuuuaguuacuggaagguauacauacaguaaaaaguauugcuaaguccuagccaauucuuagguauuuuauucauacuaaaguaagaauauccuaagcauauccuaaacacuguugucugcagaacuuccucugauguuuuauaaauccagccuuuaaaagcucaguuucuucuucuaagugaaugucauuacucugguauacugcaagaaaguaaaugaaguuuacugaaaaauguuuaguuuucuauauuuaauaaacuuuaauuuguugaacgcccccgaau

SEQ ID NO: 6598 - RNA, 530 nt, Mus musculus
aaucggggcccguggcgccggcaagaugggcaagugucguggucuccgaacugcccggaagcuccgcagucaccgacgggaucagaaguggcaugacaaacaguacaagaaagcccacuugggcacagcccugaaggccaauccguuuggggugccucucaugcaaagggaauugugcuggaaaaaguagggguugaggccaaacagccaaauucugccaucaggaagugcgucagggugcagcucauuaagaacggcaagaagaucacagcguuccugcccaaugauggcugccugaacuucauugaggaaaaugaugaagaucugguugcuggauuuggucgaaaaggucaugcuguaggugauauuccuggaguccgcuuuaaggugguuaaaguagccaauguuucucuguuggcucuguacaaaggcaagaaagaaaggccaagaucauaaaauuugacaaugaaaaacaguaauaaauuuucauauucugaaaaaaaucaaggaagaauuaagaauuauuugug

SEQ ID NO: 6599 - RNA, 78922 nt, Mus musculus
gcuugguggcgcgcaguucccccugacugugcgcccccgcgucugggcuccuuugcagaggacucgguagcugcagcucccggagcacagcgggcagagcugcgggcugcgcgcgccccugcugccaccgggcgucccgcgguggcucccgcgccccgcggcgacuuccgcgcccgcgcuccccuuuguucaaguccccgagcggcggcggggucggagcccgcgcccugggcgacugaggcggccgcaguccgcgccccggcgcccuggcgaugccggaccagaucuccgugucggaauucguggccgagacccuugaggauuauaaggcgcccacggccucuugcuucaccacgggcacggcccagugccggaacaccgcggcggccaucgaggaggugagcgguagcauagcccgcgcccugcgggaggcuagggucgcggggaucgcgcugcgcccuggccacccgcuaggcuuccgcgccuggugcccgauacccaguguccuccgccugcgcccucacccgggaaaaguuucuggucccccaaagccggacgcagccggaccaacagugcccgacacagaagcccuuuguucccugcucuagggagaggcugcuuggccaccuugggccuuuuuuugggaacgcuccucuauucccauuuccaacgcaggguuucagguucuuugcucccauccucggagaggucaacuucagcugcagagucuguggcggcuucgagccggggaacccugcgagcucugcggccccggagugaugggucucccugcgcggaccucuccaacuuguuccggaaguagcccggcgggggcagcuguggcuucugagccaacauguagagcagauccagggaccccaagcugcuuaggcacgggugcccaucccaucuugggaggccuggcaguucccacaaugugccacagagcagcgcuguagagggauguggagaauggucucuuugagguccaaaaggucuuugguggccacuucugggcuaccuguguggugccuauugacaguaugaucagcuccuuugcccuuaaccuggguaaguuauccaccuggauaacugcauagucauuguauugaguggcuaagcagugagcucuccagacccuggggaagagggacugcgagaaggaagcaguuuggguugaaaauugaagcaggcuuggaagaggcugugugaguccagagaccacggcuguccauagcuugggaaagccucacuuacaucauuuucuuuaccuccccaacagaauuuagaguuucguguuuucagcucuguaggcuuugugcguccagcuggacucacaaaagguagcuggagaacgagacacacauguguagcaguagugaaccgaugacuauauuucuuuugcucagaauuuuaagaucaagguagacauuuuaaaauacuugugccagagauugguguucggagagcuuuuaaauuaagcuaugucauuauauccuuuccccuugcuugaacaaagcauucgcuauuaggcuuugccugggcgggggugggggguggggugggguggaggacuagacuauuauucuuacguguaaaaugucuacacagucaggacuagacucaaugaaaaauacuagguucagcauccugcucuuggaagugagcuaggguauccguucuucuccuucgcccuaguccccuuucuuuucucucuccugucuucccaaagaucugcuuguaaaucuuuuguagcaaauucagugagagcagauugcuuuaguccacuuuucucagccuggccuuuaggugccacugaugccuuuaaugaggcaggugggggaugagggggaugagagccccucccccaugagggcccuugaaaagcacuaggaagauagucacaguguuuugaaaauacaucauuaaugcuuaugaaaaugauuacauccaaaaaggugggauucccucuguggaaaggacacuugugugugauguccuuaaaagacagcccauguuuauaaaguuaggacgcuucucucacuguauugaaucaguuaggugucaguaauacuggcagauguuggaaagcccggcaaauaggaguugcaauuaaaguuggcauggccucucucugauuaauuuuaguuuauaguggaugaacccaaagcugccuuugcaugcagugcaggagauuacccaagagcucaguuacugaauagaucaaagagagacuggauuuggucauucugucaaauugcaggcuggcuucacucagccucuaaagcagaaaauggauuugaguuggaaacagggaaaaccugaacucuuugcaggcuuaucucauuuuaagugaggccagcauccacucuaagcuaauaguguguaugaacugauuugaagggugaaaggacucaguguggauuacuuaaaauaaugcugucuuucuccuccugcauuauuuaauguuuacuuccaauacaaaaaguuguucucugucuaguguaauaacacaccauguuuacaauacuuagacuuuaagcaaaugucuuuuuauggucagaugagacauuaggguagguuuugugacauacaaaaaguuaagcauuucauagaaauacaacuaaaaaaauaagucccuggccuucuacuuaaaugaguuauggaauuaguaaacuuaucugauuaacuuuggcaaaacugauugcucccaauggagaauaugucuagcuguugucauuuucugacugaaauaggcuuucuugacuugcacaccuguagcuagaaugucaguaguuagccagucccugaccuguguuacagauaucaaacuguuguguuuaaucucuauccccgaugugcagauaaggaauuugaggcuaggacauuaguugagguuauagacacagcaaguggaguuuaaacuuggcuggaugcugcuuucucaaacugcaggguguuaucuaaugcuuagugauggugcuuucucaaaacugcccaaggcuagaucagccaccuccaagucaggcuccaucacuuuccaguuguaugaauugggaugagacccucccugcucauauauaccuuuaccguuuucaguccaguucacagucuagauaaucaugucuauuucugaagguucugguacaguacccaguagacuuaguaaaugguagcugcuuuaccagauuucacuguaauuacuguauagacccuggaaugagaauggaggaggggagaagaaaauggaugaauggaugaaggcauauaaauggaaauuguugucccucccccuaggugugccuguguguggauggguguguguguguguguguuugugugugugugugugugugugugugugugugauggcuccugugcugacugagcacagaggcugaacuugcaaugcuuuccugaaucaguuccccacgaccugucucugcuuccccugaauccuggggauccccaugcagguucacaagcuugugcagcaagcaccugacccccuaagcugccuucccagcccccaugcauucucucuaaggagcuuauugucuugguaacaggugagaguguagcugguuugaaacuuuucacuuccugaugacuuucucugggugacuuacuuugcacaguuuacaaagugcagagcgcaacuggugucagcuuugugcuuuggaaauaagggagaaaauaaauaguuguggcauaaaucugaaaacugugcugggccaccccccacccucuucccagcuuugauuuuuguaucuuaguuuuuuuaagccucugguuacuucaaaauacucuggaaauagagaaacauugugugcauucuugggacacuccuguuguuuguuagggcuucuucauagcuccauucauuccuaccuugcuuauuuggcauugauuuaaaaauaaauuugauauugacucuuaaguauuaaaauuuaacuuuuuccuuccaugccaugagucucuuauucuguuguccuugguuaccuuggaaaucacuuugcuguucuaacugcaaaaggaaaaugaccuucuggacuguacagacucucagggggaugcuguucauggggccaggcucugcccagcaguuccagugggaacuggccuugcauuugauucugaguuguagucuuuugugacuuguuuguaaaccagcuccuuaagaaucccaggcuaacagauuuugaaucuauggucagaaggaugcccccuuuuucucaguguauccuuggaagggaguagguuaacaggugaucauuuuaugcugcucugaaaucugaauuggugucucuggaacgucuugaaucaguuaggguggaauugguuucucuccagcugaauucaauuucucuuuuaugauuaguagugcaguuacuaugauaccacuccuugugcaucccagcucuugcugugguucauuugggaccugcugcuguguguaaggugaagggauuagacaucucuucucuuugaaagaaucugugguuccguggugagaaaccgauucuccaggcagaucagugaugugagcucaugucugccagagcaucuauggugaugauguagugaacaggaagaguggaccacuuacaugugaucagagcaucuguggugaugauguagugaacaggaagacuggaccacuuacaugugaucagagcaucuauggugaugauguagagaacaggaagacuggaccacuuacaugugaucagagcaucuguggugaugauguagagaacaggaagacuggaccacuuacaugugaucagagcaucuauggugaugauguagagaacaggaagacuggacugcuuacaugugaucagggauguggaugaaaggccuugaauggaagccugguguaagaggcuccagggugguuuaauccagucuuccauauccgugucccuaccuuagggaaauauuuauccacucuugggcuggugaucaacuaggccuuugguggaauuuuccuauccauccagacugcagaaggcuccuuaggccaagaaauuacagaggccuuucaugguggggaacugcacuucuggcuuuuggucagcauuguagcccaagaaugaagucagcucuuuguuaacauuacucugucucagaugcuugguggccacauugguugguggccacucuguugcaugauguagauucaggacuuuguucuccauacuuguaggaaguccuguugaugagcacaguuuuaggcccuugcaacuguaaaaugcuucaccugacagcaccagucagugugguuugcaacuugcagagccucagguuccauggcagagcuguggaaauagagugugcauuuuaauagcacucucaggagcagugugugcaccaggguuugaaaguacuguuguaggcugcccugaguccuggcuguguucagaguugccuggugggggagguggugucuguggacuggaagaaccugguucugcucuccugaauucugauuucauaagauuugggugaggccuggagcuuuuauauuuguaaaaggcuccucccuaguugaucaucacuaauagacuggugauuaugucauguugugugccagguagugaugaaucaagguuaugcauaacuuggggauaggaugugguuuuggaggggaggaaacugaagucaagacaggcaucucugcagaggugaccuuugagcagucuggaauguagaggcugccugcuugcaaagaccugggcauagaggaguccuggaaaagggcugagaugugaguaucagggcagacagaaggccugugaucagaggugagggagagcagaggggccuguguggagggguagcuuagguccagauagcacugggcuuuuccuuggggagagaguuugcacuuuggcuguggcguggggcgaagcuguuagaggguuuggggcucagacucccauggucugauuuccucuuuaggauuuacuuuuuauugauuuguaucugugugugacacucagaaugcagauuuccuuagaguuuaugcagccggaguuguaggcagcugugaauuacuugguugugggugcugggaaugaaacuugguaccuccagaagagcaggaaguucucuuacaauaaaccauuucuccagccacugcuucacaguuuaaagacauuucggugcuuguuccuaggccuuggaggaaaguggggagaccagcaaaggaguagggguucauuuggaugcugcggugguggcagugcagaaguguccuuugagcugggugucauucccugauacuugaaggaugggucuccuaucauccccaagguaaaagugacacuguccagcaugccuuagugguagagaccaggucuucugugaagauuggcuggcuggaggccuuguauugaaagcagucuuuuuuuuguuuuuguuuuuuguuuguuuguuugguuuugguuuugguuuuuuuuuuuuuuuuuuuuuucuugugggguggguuuuuuuuugagaccgggguuucucuguauagcccuggguguccuggaacucacuuaguagaccagucuggccucgaacccaggaauccaccugccucugccuccugagugcugguauuaaagacgugcaccaccacaccuggcuauaacuagcauuuuuaugaacuuuaaugcuauguuaagaaaaugugcuuuucagguuauguuacuuggaaaauucuggauaagugagucaaaaauaauucuguauaugauaaauuuuugcaaugcuuaggcaacuuguuuuguuuuuagccauguauacggacggauacauaggaauggcauuugauaagaauguuuccagcuaagucuaaaaugguucuuugugaguauaaaauaguccuguguaguaagaaaagguggcagaaacaucaaaauacaagcuggagggacagacugucaugguuaccagacagggaaaaauaagcaaauaguaggauggaccauaaagcaagugcauuuaaaguugccaagaaauagccacugggaagggaagugggucacaaaaaaaaaaaaaaaaaaaaaaagaaaaaaaaaaagaaaaugugauuuugccaguugguugccuaauaccaaauggucaaauggucagcaccgaagccagacauauaaauaauauuauacagauugugcaggcuguguuuacauguuuagggaauauacauauauguauaaaauaacaaaggaaaagagaguuuaugaauuugaaagagaggaagcgaggauauguggguugguuuggagaauagaaaugaugagauuauauuacaauuucaaaaaauaaagaaaaguaauuguaaaguaagaaagcauuaaaugggcucauuuaagauuauuucuuuuugagagagguuauauuggcaccauggagucaugugacucuggguuucagcaguugacaaaacaggaguuuugaccacucugguugguucuucaauguccuuucacuguacagagguggguuuccuuagugcaagcugguguccagugagucucugcaggccagcuuccauuguugucaacuuagagcagccaagacugacaacuccagagauaucaagugcuaaccccuggggaggcauuagaggcccuuuuuuagaggcuuuucuuuucuuguuuuacuuuuuagucagggcuucaggguugccuugaacucuauguaccaaauauaacuuuggauuucagauccuccugccucugccuccaccuucgaaggcugcaauuacagcauguguuaucauauuuguuuuauguagugccagggaucaaacccugggccucuugaaugccaggcaaacauucuaccaacugagcugccucuguagccucuagagguguuuucugaagagaggccuucacuaucacagagugaguugucuaauaauauaccuggucccuuagggcuguggguuccagaaaaccaucuggguuguguacauaaaggccucauagugaauggacucaggcugggucuucuaggccaggagaucugagugugguggcugcugcuucuuagaggggcacaagcuaaaccaugccaauuaagguaacuguuagggacagaccuuccaccuagggcuguccuaaucaucaggauccauucuucucagaucaaagaaaaagucuccaaaacuaauacccacaggaacauggcagaagaguggcuaaaaagagcaucagaggauacauuuggucaaacacuuguuuucuggauauaaugcgaaaaacacuuguuuucuggauauaaugggaccauugcacccugggcagugccauuccauuuauaugcacaagauccagccuaacagauauugaguaauauuccaucaggcagcacuaagugaccuuaguaaugaugaugauggugaugaagaaagaggaggaggaagaagaggaggaagaagagaagaagaggaggaggaggaggaggaggaggggaugguaagggaggagaaaugggggaacuaggaggaaaaagaagacacaauggagacaugaaggugcaagugucagagaggauguagguagagguaggaaugagagauagaaacaaucaagauauacugugugcacauaugaaauugucaaagaauaaauuacuaacaaauaaguaauaaaccuuccaguucagcucaccccugcuuccugaccauugccuugccucuaacaacccuaacacuaagaacccuaauccuaacccuaacccucuaauagccuaacccuaagucuaacccugcuuacuaugagggaaaugucuucaguauaccuuuugaagugagaaaccauuucuuaaucuugaucuuuuggaucaucagauccaccuccaaucuaggcaauagauucuuuuggcauccuacauacauaaaagacaaugaacagaguuguucuuucauuuuuuuauacuugcccuaguuuuguauuuuagaaaaggcgauuugcguguuugaguuuuaaaauuggcauuggaaaauacuuauuucuucagaauucugguacaugcuaaauaucagcuguaauaucaugcaauaugagauaacccguccuugauuuuucuaaguucccuuggccaagaaccuuucuauauuagacauuagagagacauucucuuaaauuuacuuucuguauccacggagaaauuaauucugauuugagauauguuuaucuagagaaccuguccuaauacaacuguggcuuuucucuacuuugccacugauggcgaugugcuggcuaacaagagggcucaacaguguuucccuuauguuucuggcuuuccucccaggguugguugguacuuaucaucugggaaagggagcggcagucucccugagcccagcacugagccacaaacaaaacucuuguuuccuaaaaucccucuuuaauguucauugccugggcacccucccacucggguugauaaccccacugcaccuuggguaaugggcuaugcauguucuuccccuggauuucaggaagaagaaggcaagugaugugaggccagcucaggcaaggucugaagucagguccugguaaugcaggaucauugcucacagagaacaggagcaggcagcugacuacccugagcuggaauguguugggaacuaaaagggggcccuggguaagacaggaaaggggagaaggcuaacacccugccagaguuccacguaugcucuggacagagaugugggagagcugccauacacucucugcucagccccgggugggcaucuaagccuuugacccacucuuugggucugaacaaggggcuccugugcuuacagaugggcgagcaccacuuugaagugauguuagcucacagagccagcugacucuuguuuguaaggugugcaugcagagccuaccucacagauaguuaacauggugaaguaugacagaacacaggccacaccuccuuacuguagugguuugaaauagaaauauccccuagagcagugcuucucaaccauccugaugcugugaagcuuuaauacauucccucauguuguggggacccccaaccauaaaaguauuucacugcuaauucauaacuguaauuuugcuacuguagugaaucauaauguaaauaucuuauauaugacccguaugacaaggucauaugacuccccacaaguggucgccacccaaagguugagaaucacugcccuauaggcucagggauuuaaacagcaaaucuccaguugguggugcugucagaggaaguucaggagguauagcuuugcuggagcaagcguagcauagggguggucuuucagacuuuauaaaugcuccccacuuccacuuuggcucuucuccucuuucugaauggaguugaagaucugaucuuucaaccuccucuuccuccguuugugccugucauuugcuguugugccuucccgccaugagacuuguauccuacuguagcuaugagcuaaaacgaacccugucuuccaugaguuguuuuuggugagggguuuuguuauagcaacagaaaagcaaugaacccacuuucccuuucuaucaucccaagggaucugcuuucuaaggaauugauggggaaaacacacagaacauagauuuuugcuucuaugaggcuuagugugccagcuuagucuuauuauccuggaaauuccuccuucuuacucuauggcuagauaugcaaugauaggccuugguuucucucuggagaaacauaagcagcaucuacucccuccuccuaaggccccaaugacaaaccaacauauguuucuacugaggaucauccagcagaaccaaugaauuuacuaagguuauguccugguuaguuuuuuucucaacuugacacaagcuggagucaacaaaaagaaccacaauugagaaaaugccuccaucagauuuacuauacgcaaaucugcaggguuuucuugacugauaauugagagaggacgacucagcccaccauggaugguguuccccuaagcacaugcucuugaacugcauaagaaaagagguugagcaauccaugggagcaagccaguaagcagcauacuuccauggcuucuuuuucaguuccugcuuccaggucccugcuuuuagcucagccccaacuuccugucaugauggacuacaagcuguaagaugaaauaaacccuuuccaucccaugucacuuccuuuaauggcagucuaucccaccaauagaaaacaaacuaagcaaacuauuuccuuacagugugggggugaagaguuacaagcagguacacgggugaacccuaagaaggcgcacuggaaacucuucacacagcacaucugauacaucccaucuaacuacauccccuccacagccauugugcuuuaguaaucccuaagccccaaacuaaguacaauuggggcgaauugaaaauggcugcaaggagaagcuggagucucaccuaaggauccagggacuccuuuucugaggaaggucagcauuccacagguugcuucugauggucucuugagagaaugcaugguugaugagggagaauguaugauaaagaugaugucuguuuuguucagagggcuguguucuacaacauuguucaccugcuaaaggcccucuggcuagcauuccaguaccaugauuccuaccauucagcucaguccuugggauccagcccucuggguuagggucagagaucagcuccauucacaguagcagcaacagguguaggacugaaggacccaggucuaucuuaugaaggcuccuuucuacuucucaugccaacuguucuucaucuuugaguccagcacuuugauaagccugaagacagagguuuggacaccaguguuuuagcaccaaaaaauuuucucauccaguaaucccaucuuuuuuucuuucugagaacuuguguuucagacauggaaaacuuagcauuacucuauaaaagaacugauccuuguaagcagauguuuaucaugaaggaauaaucaucaggcugcauaguauaauuauuuuauauaugcuaaacucuauucaaaagauagcuaugaaauuauaagauugaaagcaaucccaucuaccaaguacuuuugaaagcauaauaaauuuguaugguagcaaaccccauagacaugaacaccauagaccacacuaaagcauccauaacaguagagagccuaagguaacagguuucauguaaaauagaucccuaaugacuagggaguguuucccaggggagucgugguauguaauguagauacaaacaguauucuauauuuguuuguuuauaauaauaggaucucaauacaacuauggcugaccuccaacuugcugcaaggagggaaauggccuugaacuuugaucuugccuccacccuccaagggcugucauaaaaggccuguaccauccccacacccacauugugcagugcugggacuugaagccaggacugagugagcucuaaccccagucagucagacaugcauuuauucacugaacagaucuugaaagaguuaagagccuggauaccaagcacucccuccaccaugagcuuuacuguucugaccacacuuccuuuuacauccacagccugcuccagcuccagagacacaggcucugugguaagcagagcuauaauaacugacaugcuauaaaacuccaaagaauuaggaaaagcccacagucugccuuucuccuugcugccaaagaaugugcuucacguuuuauugccuaggaagauaaaauagaacacugagucugaucugcagguuguucugcuaauuugaaucccuccuaccuuaugugugcuuggauggcauagggccccuucuuagccucuuaaauuuuauaucacuggagcagaggcuaugacuuuucaaagguuagugcggggggggggggggggcuugcauaacucaguccuuccacccuucuguuuucaacaccuccugauguuugcaaccuuccaggaugauagagcuugagaaccagagcugcaugcaaucacuugcucugugaucucauccucuucucugcaucuccaaauucugucagugccaagaagcugccucacagguugccagucuggaagguucuuccuggagccagggagauaaaucaaugaucaaugagagaugacucagcaauuaagaucuacugccccuucagaacaucuggguucauuucccagcauucccaacuggggaucgcaaccaagcucuggcuucuggcuucuaugggaaagugcacucaugaaaguaccugcgggugagcacacacacacacacacacacacacacacacacacacacacacaugcacgcacacacauaauagaaaauuuuuuaaaaaaaucaaagugcauagugguauaaaauuuaauuccaacacuuugggaggcagaaguaggcagaguucugugaguucgaggccacccuagucuauauagugagguccaggauaggaccuucuauugcaggucauugguauuuccugacaugccucaguucuuaaagggagaggacccagacugaaacccuacauuauguccuaaauuaagcacacuuauuuagcuuuguaaguagcacgguggcgauuauaauagaugcacuaaaaaggcuuuguuagaauaaacugugcagagucauugcuaggcacaaaagugaugcuuggaccaguaacauggcucaguagguaacagugcccacaugcaauucugacaucuugaguucaaucccuggaacccagaauagaaggagaaaacuuacucuugaaaaugguccucagauggggcuggagagauggcucagcgguuaagagcagagacuacucuuccagagguccugagaucacuuccuagcaaccacaugguggcucacaaccaucuguaaugggaucugaugcacccuucuggugugucugaagacagcaacaguguacacauaaauaauaaauagauaaaacuuuaaaaauaaaaaaaauuuuuugaaaaaagaaaagaaaaugguccccugacuuuugcaugcauagugugguacgugugugauaaaacaauuaauaaugauaaaagugauaaaauaauaauuuuuaagguauuaaauaaaauaaaacuauuagaaacgcgguccuucaugaacauguugacuggaugaaugaagaaaugaaugaaagaaugagugaaucucaguuuuuaaggauucguauauagaaaugagccuaccauuucagcaaauuuguuaggugcauuccgaguucgagucccaaccugcuucuuccuaaauugauuaaucucaacuaaagacugacaggauuuagucacaaauucagucaagcuucucacccaaacaccccuucugguuuucaaaccucacaagcuuuacuaugucuagucuguggggagcuguuuucaucacagggaaguuaccuauuucucuuauuuccaaugucacccauaggccauggagaccaggaauucugcaggucgaucuugacaauuaugaaggacaaggggacccuuccuccccauaguuccaugucacacagucugcauggcauucugcccugcuucacugaagccuacugugaguuuacaccucccauguaggucuguguucaagagacuucuauuccaaaucaugcaauuuugggagaaugcucaaaaccucccuccuugggcgaaggaacagcucaauggcagagugcuugucuggcaagcuuaagauccuggguuugacuccccaggacaacaacagcaacagccaaaccuaaccaacucaauaaaaauaaacccucuuccccuuuccucuagaaggcuguuuguggaauauugaacaacacacagggcccaccuaucccuuacaagauuuuugggacuuagauggacaggguccuccaguagagaaagacugugaauaaaggcauuuucuaugauucaaaggaggaccuuucuguacucucaccacacacacacacacacacacacaaacaccaguauaaauguauccauucaaaggauacaauuaaaucaagugcuggguuuuggggacauaaagcugaaaggauuauaugccugaucugcugcaaacucaucuagugacaaagacagaccugugaguggagagugcugugugucacuuacuuuuacaucacugucacaaaaugaaagaaucaauuuaggaggaaagaguuaguuuuuggcucaugguuucuguccaugauuucuuggcccuguagcuuugggcaucuagcaacuuagugcaucaugguagcagcuuguagcagguuuaccauggcagagaagcagggaggggaaggggagcaaggucccaacagugccucaaaggcaugcucccaaugaccuaacuuucuuccucaggccacaacuagaggagcaauucuucaaaacuugggucuuuggcagacauuucacaucuaaacuaccacaugcuauaacagaacaaggugccuugggaaguguugaagauaugcucaacuuggcaugagaagaagggaaggugugcucuugaauuuuaaagcuugcaagcugaguuuuggacugugggaaugaauucaucagguagacugaaguggaaguuagcccuaguggauaaaagguugguuggcuucuguuaagcgcagaagaccaugugguaaucuggguuccaggcauucguuuugguuuucucgagacagagucucacuauguaguccuggcugacuuggaacucauuauggagaucaggcuggccucaaacucacagagaucuaccugccucugccucuuuaaaugcugggauucaaggcauguaccacuaugccuggauuucaaaauguucuuucauucccaaucagggagauacuuugaaaaugcagacuuucuugaagugguuuggugacuuuccaugagcagacaacaggaguuugauccugugaccuaaaucauggguagauagaacaaccaauuucugcaaguugcccucuaaccucauguuagggcaaaugcacacucccuuauauguaugcuccagcccccgcucccaacacuaauuguguaaugauaaauaaagcaggaauuggggcaggagagaugguucagugguuaagagcacagacugcucuuccauggauccugaguucaauuuccagcaaccacaugguggcucacaaccaucuguaaugggaucugaugcccucaccuagugugucugaagacagcuacaguguacucauauacauacaauagauacaccuuuaaaaaaaaauaaagcaggaacugaaugaggaaaugccugagucaauagacuaugguucaaucucuggguacaagcaagguuggaggagaagugaggcagcacagucaggcauucugggccaugaaggaucuuuuacaacauauugaagaauuuaggguucauuaguagacuguagggagacccuggaagauuuugagccacuuaaaacuacauuugcuuuuuagaaggaucacuaugggaaagagucuggcacccaguaaacacggugauuggaaaguucauuaacccagagaugggaagauuuauuaugaaauaacacuugcagaugaggagagacguaaauggauaagggcagagugggaaaugagugcucaggaccacagugcccguggauaauaaacugaaaucuccaauccaacgacacguggauucguugccaacugauugucauuaguugaagaggaagagccuggaaaguggugcugaagcuucugcuuagauaacuagagggagaagaacaaagauagugaacagugggcaagagaagcguccacucccuguggguuggcagccacuggaaccuccgugaaagugagcauguuuuacugccccaaguaguucaucugacaagggaccuguugaagucagggcuaccauuacugugcugaaacagcaugaccaaagcaacuuggggaagaaaagggcuuauuuggcuuaggcuuccaccucacaguucaucaucaaaggaagucagaacaggagcuugagcagggagaaaccuggaguaaggagcugaugcagaggucauauaggagugagugcuaguuauugguuugcuccuccuggcuugcucagccugcuuucuuauagaacccaggaccgccagcccagagaugacagcacccacaauuggcugggcccucccccaccuaauuaugaaauugccuuaauuucuuuuuuuucuauauuuuuauuggguguuuauuucaaucacauuuccaaugcuaucccaaaaguuccccccacccacccacccagucccacuucuuggcccuggcguuccccuguacugaggcauauaaaguuugcacgaccaaugggccuuucuuuccacugauggccgacuaggccauauuaugauucauaugcagcuagagacacgagcuccaguggggguauugguuaguucauauuguuguuccaccuauaggauugcaaaucccuucugcuguuugcguacuuucccuagcuccugcguugggggcccugugauccaauaacuuacuguaagcauccacuucuguguuugccaggccccagcauagucucacaagagacagccauauuuggguccuuuuagcaaaaucuugcuaguguaugcaauggugucagcguuuggaagcuaauuaugggauggaucccuggauauggcaguuuaaagacuguccaucuuuucgucucagcuccaaacuuugucucuguaacuccuucgauggguguuuuguucccaauucuaagaaggggcaaaguguccacacuuuggucuucauucuucuugaguuucaugcguuuagcaaguuguaccuuaauuucuucauuaagaaaaugccuuacagcuggaucuuauggaagcauuuucuaaaucuagauuucuccacucagaugacucuagcuuguguuaaguugacauaaaaguagccaggacaggaucuguagggucuuuuguucuguugagcucagacuucagacaagugagcugccugcuuauaugggcuaagaguccccugagacaugaaggauggagguuacuccuggcuugccaucagugcucuuccugguucacaguagugagcagcaucuuccagggaugcugcuuguuccuaaaagcuccaggcuggaucgcugugucaucuuuuuugaacaagggacaaggaccacauugaacagcuggcaacucugcugucaaaucccuugguguuggccuugcugggcucccgucuccagcuaauuacucagagggacccagagagccugccuaaccagacauuucuacaggucuggcccauguucuuugcaacacucagggguucuacccaggggaggguucagggcauggccauggggaggcugggagccccuaggaaacuuugaccaggacaggagcuagcugcuucugcguuuacuucuuggcacuaguaagugggacucaccaaaaugcaaugcagagucagccagugagaucagcauuggcugugaagcccaagcuuagugggagaggucaggagagagagaggggaguacuggaacaaacagaaccagaauguaacccuguuuuuuaagcacuaacaggaaagggaaaguuugggggcaaagugacuggcucuccacugcugucugggggacuaugcccaacccucaggcugcuagaguugguuuuccaagcaaaucaaaaagccucaggaaaacaaucuauaagcuuuuugcaaagaaagccccccacagggaaucagacacuaggaauuccacugcacugagaaaacagucuguagggacuaggucaccucugugauuugggcauugcuuccacuuacagguagcucagaauccuacaagcaaaucccucugccucaaacacauaccaggagaacaaaggagugauccaagcauggauauuagacacuuucagcuccacugggaacgcuuuuggucuuaaaaguauuucucauuaucuuugugugagcaugcacuaauguggaaaucagagggcacucugcaggacuugguucucucuucuaccauguugguucugagaacugaacuuaggucaccaggcucuguggcaaguguuuuucccuacuuuuuggccauguuuauucuccagucauuauuuuguagacggauccucagagguuugcuggacugugggcucuggaaugggcucacugcucacuuaccuccaagaaugaccccaugccugcuuacacucauaaagaaauucccaacacucuggcuuugagcuucuccaccuaaauaccacauaaagcuucugaauuuuguuugauggaaaauccuggaaauccuauuaagcauacaagcuaccugaucuccucuacugaagacuaauuuuaaaggucuaaauaaggccucccagaaucuagauuuggaaaaugaggucagggcaaguguacuuacugggcaagcaugacuugaguucaaagcccagcacccauguggagaggaauuuuaauucagcagcauggcagcucuggcacgggaucacauccaaagacaugaucauggcuuggaccauggucauuguaaccauagccccaguaggugagaaaagaugcugaggacuguaccuauggcaacccaggaguggagaugccuaggcuggccaugacaaaagacacagcauucugaacagguggagaggggagguuuugcuggacuauucuguguguuggaguucauagcccauccuuggauaauacuucugaaauaacguggggcugcuguugauggaaugaauccugaggugagcacccacauggcaguucacaacugucuguaacucuagcucaaggagaucggacacccuaacacagacauucaugcaggugaaauaccagugcacuagaaugaaaacgaauauuuucuuuaaaaaaaagaaaacuauuguggaaaaaugaugaaaaaagauagacaugagcucucaauugcuggucaugguggucguuuuuucucagcaauaggaaguaacuaauaugacugcuguccuuaugaaaggaguaauguggaaugcuugcccaguuccaacuaggcuguccucucauucuguggucuaacaauucccaugcucccuuaccagaccuucccugaaauucuuucuaucuucaucuacuuauccagcuaaucuuaucuucuaguaucugucucuauuaacuacagaucuccuguauaacaaucaaucucugugauaucuucuucuaugaucuagaccugucaucuauuucaucugcauuuugguuuuguuuuaguuuuaguuuuucaagacaagcuuuaucugaauagcccugccuauccuagcacucaguauuuagaucaggcuggcuuugaacucacaaacauccuauugaucuggccccugaguacugugguuaaagaaucaggcuaucaugcucggcuacuuuauuuaucuauugucuuuguuaucuaccuagcucugucuucuuuuuucuuaccucuucaucugccagucauguaccuuauuauucccuaucaucuauagauaguaucauaucugucauccaucucucuucuauuaucuuuuaccuaucaccugaaucauuauuuucuaucaucuucucuaucuaucuaucuaucuaucuaucuaucuaucuaucuaucuaucuaucuaucuaaaauuuaucuaucuaucuaucugguaaacugucuucuauuauucaccacuaucaucuauaaucuauauuugucaaccauuaucuacuuuccuauuuugugguauuggggaugaaacaaguguuuccuggguaaauguauuuauuuauucaucuaucucuuuucauauaugaacuugacgcaagcuggaagagugaaccauaauuuuuaagaaaugccuccacaaaacugaccuguaggcaagacuguagggcauuuucuuaauuagugacuauuaggguuaggcccuacccaucugagcaccucugggcaggugguccuggaauguauaagcaggccgagcaacucaugaggaacaagccaguaaguagcccuucucacuggccucugcuucaguaccugcccugaguuccugccccuacuuccuuuaauaaggaaccgugacacgugggagcaaaagauggaauuaacccuuuccuuuccuucccaauuugcuuuuguucuuugguuuguucgggguuguuuuauucguuuuuggagacagagaccaguuucuuuauguaggcccagcagccccagaacucccucuguaaacaaagcugagcucaaacucagaaaucugccugccucugccucccaugugcuggaugaaagguguguaccaucacuggcuuuggucaugguguuuugucucagcaacaggaacccuaacuaagacacaggguuuguugcauccuaaauagucuacucuuuccacugagcuuuaauuugaauuuucaaucauucuuaaauuuuuuuaggcuauaccccaacccauuugauuuacgauuuugauugcgauaauauuuguagauggauauacacacauauucauaucuguguauauguauaucuccagauauguauucucuaacuauccgaaucauauacuuuauauaaacucuaggcaaguuuguaggacauuuucuuaauuagugaguaauuaauuagugauuaauuaauuagucagugauuaacaugcaguugacugugccagcuauuuuucagcaaagcuuuuaggaagucccagauuggucuuggaggagacacaugaugagaaauaagaguccaaugaaaaguuagugcuuggucaggagggacuauuccagaguuccgauaggcuccuaaaacccagcauccaacaaaagcuucaaauuuuugcauucugcggccuguagcucaucacaaugcccaccuccaucgcuuucuugcuuagcagcaggcagcaaggucagcacugccuggagcccccuuuaucuggagcccacuguggcuccuaccuuuacuuccuuuauguguccugccaaagaacacccauguauaauuugauaaugaacccuguuauuuuguacaaauaacauaagguaauuaauuuaacagguggauguaaucugacuuucuaucacuaauaagugcuuuaccaucuguguuggcuccacccuuaacccaugaaaucauuucucuauaagcagccaaaggaauauuagugugugugugugugugugugugugugugugugugugugugugugagugaguguagugugugguguaugcaugugugugaguuucuggaguacuguuaacauuggauuguuggcuauccccuuucauugcuccccugcccucuugucuuguuaagcuuagacagggucucuugcucaaccugaugcucaccaauuggcuauagugcugagcagugugucccugggauucuccugccucugucuaucaacaccuggaugaaaagcugccacacccaguuuguucccgaguguuagggguccccaugcuggagcagugaccacuauacaugcugagccaucuccccagagucaagucuucuuuguuuuuaaagugaaaggacaguuguuuuaguugcagacaugaaaaacaacacucuagaagguucuaggucccugcgcagucagugccugccaaugucugcagcaccagcuuuugucagagaccaucccgugagaaagcaagcccuucacaaucucccuaggugaaauggccuuugcuaggagcugguugucauccccuccucccuauucccuuccuggcaccuaaggcuguaaaagcugaauuauaguccccucuucccuaucucuuccugaacucccaugccauccaaagacaggaguuacgccugagcccagccugacacccaaggcugucaaggaggaucuauguuccaaagauuagaugcagagugcccgcugccuggugccugacuucgcuccccaugucagcagaugccugcuucuuuguucuuuguaaaauucccccucgaccccuccccuacuccccgagauguaugcuuuaaaaagaaggcaccucagcauaauaaacgagaccuggacaaacuugcuuggucuccugcuuucuuucccuuccucucaucuccuuccagguuuguggucccccucucaaccacgaaugacugaauacggcaggaugggauaggcuuucuuuuccuuugagggcaggacucuaacccauguaaggacuucuuucucacagcuaacaaguucccaccucagggccuuggcucucuacauuccuuuggaggacucuccccagccccuuaggcucagcuguuucuucucuucaucucagacuuagcucuaaaguugcuuccucuaggaagccuuuucugacugccacuguugauguccugccccugccccaguuauuauuacaucaccucauuuuguuucucucaauaggacucacaggaggacuguagauguagcucagugauagaguccuucuccagcaugcacaaaacucugaguuguaacuucucccacccccgcccccgcccugaccccagaacaaaauaaacugugcauagaguguauucccacauaugagagguagagacaggaggcucaggaguucaagguuauccuuagcuacguaucaauuuagaggaaaaccugggagacacaugagccuaaacacacacauacacacaacuucaaaaugacacauucauaugauagagacccaaaccucuguuuucuuagauuaaaucccaauaguacaauagaguuugcacacuuugaaauuguagccuucugacaagauaagaauacaaaguccuuguuuuugguguauuccuguguaagcuagaaaaacaucucucaaagguuaagugcaaacgaguuagcucgaggucucccuaagucuugguaggagugaguucugcauuucuaccaggcucccaggcagcugcugcucuccagaccacaguuggcacaucacagauugaggcaggaguuccucuauucauauggaacuguguucauggcugucaucuugauccuuaggcuuccaacauggaggaggaggaagcuugaaaguuacugugucugauugggggcaguguggggaagugcaaggugguccaaucaccacccucccaacuagcauguacauuccucuguaaauaaguuucccagacuacuugagcagcuugccuaaccuaucaugggugaagaccccauucugucuuggcagauggcgaccaauggcuuucucaguaagaauuucaugucgccucucauucugccuuccaaaagcuaaguggugccaugcaauuaguuuucuaguaauguuuauggaguccauaaaaagacccagucucaaaaagacaaaugaaauuuauggagguccuacucugugucugccccaauuuagagcuucccagaagcugagugcaagaggugagcaucaagcagcagagucuggagcuggugagcuggcucagugguuaagagugcagacugcucuuccaaagguccugaguucaaaucccagcaaccacaugguggcucacaaccauugguaacaaaaucugaugcucucuucuggagugucuaaagacaacuacaguguauuuacauauaauaaauaaauaaauaaauaaauaaauaaauaaauaaauaaauaaauaaauaaauaaauaaauauuaagaagcagaugcuuuggcgauaagugcaaaucguucuauaauggaagcuucuagaacagauugggguugagauguauuguaaguucagugaaaugagugcucucaccuugucugacucaguaauuguccaaaaaccaaucacuucacauuucagugaggauggagacaggcagagaaaugggugguaggugucucacugugcaccaggaucuauuaguauuauucuuuuuaauuauaguucuuuuuucuacaguccagucauuaucccccuccuggucuaaccucugacaguuucucaucccuuuccucuucccagucuccaagacgaugucccuccccgcugcccccauguaucaagaacuuagugcugugcucugcucuguuucuuuucugcugccuuacagauucucugucuaaugcuugaaggaaggagaguagccaagaccacgaauuuugcacagacagucugagaaacuggacccucaggcucagguuugggguugauucugaaagaugaccaagacacuucccaagcagucaagaaaaagaaaguguuccaggccaaggauuuggugugaggguaugaaggugugugaagaugaggaagcucccaacaauguuccagggucagaagcuagcuagccuguccuacaggaagccaaugaggagcagagcugcucucagugggggaaacacagaggagaggggcacugugagcuguggggaagggcagcuugaagucucaaggauguggcugacacucucugcugagcaggucuaguguacugcagaugcuuuaguguggggcucuugggugagugcugcaacuucucaaugcucuacaggugaaugaaugcuguggucaagaaacuuucucaggggaagagagguaaaggcaggucaccucugaggagccagugacggguuggagugugaguaaugguguggaguugugguucuagauucucccuggucucgccauuaugggggugugcuugaucaucucugggguguccacugcauacauccacaauuucaccaacaggggcaaggaaacagcugcucaaguucagucccaagggucuggagaacauugacuaagaaaauguuuuccuggcugaugagaaaaaucacucagcuauggucaucuguuccuguuagaaggccuugcagcauauuauauacuaugggcauguuaugaaaugcauaauaaaaaaaguuucccagucauucauggcugagucccacagaaacugucaaaguuauucuuaguggaaggccccuacaaaggcaggcaggguuuggagguccuuagagguuagaggguagcugugauaaggguugggggaagggcuagaauagaaucaagagcuucacuuuuauuucauagacaauaggaaaacacuggagaaaugccugccccaucuaaaggagagggagagaaaccuaugaaugcauccacacgcugaaggaagagggauuuuuuguuuguuuguuuuguuuucuagaaauaggaucucacuaugucuggcuucuaauuggcucugcugcccagaauuuguaguuucaaauuccugagcuuuccacucagccucaccagugcugggaucacaggcaugcaccaccacaccuagcuaugaagagagugcugugaucuaagaaaaaaauaaaguaugcaagcacucuuuaaaagcuuuagcaaaggcuauuugcauauggagugcuaauuaaacucuuuuuuuuuuuuugguuuguuuugguuucccaugaaaacaaacccagcccuucucuggcacuuguuuguauuauucuaagugcuugaaaacaacaaauggcauucccuuaauugcugaaagacaaauaauauuuauaacacuaguugccuuugcuugcauuucagcauaucagggcuuuaauccuauauguauuucauuccaggagcaggaaucagaguugggagggccacugccuguucuguuggcaggaaagguagaauuauauucaaagugggcugguaaauacugaaagccuagucucugaaaauagaugcguguguauauccauaaauacacuuauuuuauguuuguugacuacagacuggagagcacacagucugcaaagcauucagagauaucugcuacucuauagugaagcccauguagcuaauugauucucauagaugcuuccauugauuuuugccaagugcuugcaucaauacccagucugcaguuuaaccaugccuggacaaaauaagacauagaagaaaugcuuauuauccaacucagucagcaaagaaguaguugcugucauugacagaugagucucuuuccgacaucaaugucaguuggcauuuguuuauguuaaugagcaagcaagguugcuaaagaugucugguguaacuucaucugcccaugacaccuguggccucccugcuauaacauagaggauuggcagcguuuuuccacaaacaucuuugcuacucacgaugcaguggcucagaugugccugccugugaauauaauccucaacaaagucacaacauuccucugccuuguuugucaauuaucaaccuccggggguucagaccucagcucaacuggagaccaaccugucugcauagucaaaugccccacaugaauggugaguucucccccagagcugggagaguugagagucaucuugggggacugacucaaaugcuaauguagugcaaaccacaccugaaaucuggaaaaggucuggcccuggacaugaagcacacuuuaaccuugaggaugggugagacccacuggccaaucaaggucuccacaggcagaccugccagucugacaaggaggugggaucuuccaggugccuuuccccaaguucacuguggcugugcaggcuugaaugguucucuguguccugcucugaccucugcuguugggugcugucagaggaccucagggaagcucugaauucgagacauggugagcacaggguuacugcccacagaggguaggagcagggugcugaguaguggaagcugggguggugaguccucucuggggcuggaugggaaguauaggccauaugugagcaccugugaggucucuccuguugcuccucacuugcuccacuggggguuaccucugaaugacuucccuaucauugcccaaaucauuuggaccuaguuaggcuggcuugugaaaagaagggugguuucuuugagucuguagcacacauguccaaaccccuuugacauuuaguauacauuaagaagacagguaaaaaaaaaaaaaaaaaaaaaaaaaaagaagacagguaaaaaucuaaaaaaaucuaauagguuugauuucauacauuauacuuguuuuuguuuuguuuagguuuuguuaauuuuuuuuuucuguugcaguuuuuucauauuuuuugcaucauauguuuagugaguugauuaucauuuggcaaagggacuuuaauaauuucagauuuuuuugugguuuuauugaaaaaugauagaccucugagcugauauucuucuauuccaaucguuucuaauuuucgccuucacauauuuugcagaagucccaguuguuuauugccaugaaacuuuuagaauccacauuuuuugacugagauaucaauuuuuucucuuagucuugaaucccugaguuucugucuuccuuuccuguucugugggugaaccuugccucuguaguugucaguguacagguaaucacauguucugcucuuagggacuuagcaacugcuuaugucauuuccugccuccauccccugugucuguugucaggcgugcuuuauauacauggagcaccagcuauagcagcucucuauuuuuguucccugucuuuguucucugcacaugcacacucucugucaucucuccccucauggcucucuuucuccucccugucgugugccugucugcagguccucuuguguauuucuaucccuuccccagguucucaccccucccccuucccccaaacaaccucuuuugcacuuuaucuguugcaaucuuuaauuucucagaccugcugugauggcauagcuuggauuucuugguugcaauuguuccuggcuguuacucucuauguugcuaugcugguguguagccaucucuguuugggugauuauugaccuagguacuggccucuggguuugucuuuuugggugggaguuuuguuccuggguuacuguuugaugcauggauuugaagagaguguucacugacaguuuccuauuuuacugaccuauuugguggguauggucaacaguggaugcuuugugauauuaaaagcugguagaagcaauaggcaggaacagaagaucuuaguaauccacaaggagauauaggagagaggucaagcaacccaugguguuuaauacaauguuggaacaacugggaaaauugaaucugggguaaaucaaucaaucaugaaguugaucuauggaagcuuaccuuguguccuuucaggcauggaaugugguugaacagggaguaucuucccaaguccgggcugagacacagggaugagccaggaauggaugggcagguggggauugucuaugguguuauaggaggcuugcagaggaggagaggaaauuuccagugguauucuguuucaguguuaagggcagcugauauuagggucugcaguaacagauagugagguaggucuuuggacaaagucuagucuacagacaggcaugguugugguuaaccaggaguuucugucuauaaucaggggguuaggaacagagaugaguuuguaaaucccaguuugcuuuuugagaauguauuuugcacauguaggaccccaaauuuagggaccccgcucuaauccaggaacaggcggcacccacaaacacaagaauccucucuuguugcaagacgcaugagguuuauuuggcagagcucugggucaacacguaccucgcacaggaggcaggggagucgacccccagacucggagccuaggggcuuuuaaagacgcaaaagguugggaauacaaggaauuuuggcaaaaggcacgggauugauucauuaacagaaagauuacaugucagcagaaaaagggggcauuagagcuguuccggugggcuugggacuuaucuaacaaccaguugauuuaugugacuuuacuuggcgccaagagguaaugaagagacaggaagcucuggccagaugguguggauggccuugccugucuccggauugaggggugaauccaaccagaugguguuagcuuagauaauauagccccauuuguccuugaauaccuuuucauacagucaagcuguucuuaggaaugcuuuaacaacagccccgccuuggccugccugggggcuguucugcuuuguucccagucccgaucccggcugugggcuccuaaacaaguuauaaaaucucaucuuccuucauuccccucuucuucuacuaaguaauucuaauccuagaauuuaaagcccuguaucuccugauucuucuucuaucuggauuauggguugauauugucguuguaaaacaaggaguuugacugcauuuauccuacucuggauaaaagccauuccccuauuaauuaugcagggaccaaagaucagaauuagacauauggaaauaacagguccagcuagggcagagaauaaagaugucguccacggugaccgagaauaccaugacucuaaccaucccuguugugccucucguucucgcuuuugccguucgagucuuucccucagcuuuugcauagaaucccugacuaucccagugugaucugcauaaaaacagcauucuucuuucagggcugcacacaauccucccucuuuuaggaagagcagaucaagaccucgccuauuuuguaacacuaccucugauagugaggauaaagaguuuuccaaagcauuaauugauuuuucuaacaucucuagaucuucguuaacagcaucucuuaaggauuggauuccuugucucccuucaauuaaggccgauacuccaguccccacuccuacugccaucccuaugcccaaaaagguggcuaagguuaaaguaacagguucucucuuaaaccuuguaccugcguacauuuccucuaggcuagaugcagaaugauaauacacucgggguaacaguuggaucauaacacagaaaucaugggaagauucaaaaaccuuaguugauacacaggggguaaguccugaguuacaggcccaccagccaacuggagacggcacaagauaauaauuaguuucuguucuggauacaggcugaauucggcugcacaaauguuuguggguaggagggggcguaccuauacagagaccuggguuucuugccgauaccucggucagagucaauuucugcccugucccccaugagcaggagguauggcugcuaguuuuauugaaaucuccaucaaaggcaauuccuucauaauaaggggggcccgaggacaagcauagccaacaauccucaguggcaucuggauuuguccuauugagggcauagaaagcuccucucacuaaauuaaacauucucugucccgucguaggguucguuggggccagaguuaggggguuuuguaaggcggcggugggagugagaguggcaguauaagaggggcccgugagcagggcuggcauuugcgucgggaguuuggauuuggccggagggcccuguuccauaaggaccuuauugggcccuaugggugccacugccgggucucccacugucagucugaucuuaaaaaugaacccagggucccucgauggagcguauacucgccagccccaucuauuucccuuaagccaacuuugacgaucuuguuucccuuucucggugaauuuuauaaguaggggguugcaguauuuaccuuugcaugguccuggggggcuguuuuuaauagcacacccacucuccggauacuuagaggggucccuuucuccuugguuugacccaucauagucaccaccccgcuuuaccgugauuaggucccaggcagaggaaggauuccaguaggcaucuccuguuguuucacauccccauuuaccgcaaaaaaaacuugaugccccuccacauuccugccgaagucuucugcucugacccugaccagggcaaacauagaaaucugcagcucuaagguuagcucgguaaaacugccccgaacagccauacgugcucccuaucccauuugggacacaccgcucuucagggggugggucaguaagaucgguaugaucagggaggucccaagugagagaucccgccgcuaacuuacaaaugucaggugugagaucaggccaccaaguccaagggggguguacugcgguggccgcccauacaauguuacccucuucauuaagcaccucccaagacugcugaauuggagugugaggguuaaagucugguggggccgccucugcgcagcaggcguaacuuaagaggauuagcaguucuuuccaagguccacucgucuggcucagccucugggggagccuucuuaacaugggaagcaugaacccaggcagggauuccuucuacuuugacggcaguggguguugucagcagcaccagguaggguccuuuccaccguggcucaagguucccugcucgaugucuccucaccaggacagcgucucccacuucgaacuggugcggcaccugaauaucaccagcgacauagguuucuuuuaauuguucccagacuucuuuccucaccguuucaagagccuugagucgggcuaaaaggcgaguggaaggaacaaaggaaauaucugggcaaaucuuacuuucuacagucauauagaugggugggggugccccauauaauaauucaaaaggcgucagaccuagggcuccggggguguuccggacccggaauaaagcacaagggagaagggcuguccaaucauucccgccggauucuaacgcuaauuuaguuaaggucuccuuuaaaguucuauucauccucucuaccuguccugaacuuuggggucuguaagcacaauguaauuuccaauuuguccccagcugucuggccaaucccuggcuuaccugagagacgaaggcaggcccauugucugacccgauuaccuuggguacuccgaagcgaggaaguauuucuucaaguaucuucuuggcuacuacaguagcuguuucuuucuugguggggaacgcuucaacccacccugaaaagguaucuauaaagacuaacagauacuuauuuccauaucgggcuggcuuuaccucuguaaaaucgacuucccaguagguccccggucuaucuccccuuaaacguuucccaccauggagcuuacuggauccagcguuagugagugcacaggcucgacaguuucucauuaagcccucugcagccuguuguaguccagggauaugauaaggggaccuacugaccagccuuaucaucuuucuagcuccuaagugagucaggcgaugaaugucagcuaaauauuuuagccccucuucuucugugagaacucuuuucucaguccucccuucaacugucuggggcgcguuuuugauuaccaaagucauuggccccugggccgccuccuuagccacuuggucugccaucugguuuccucucucuacugguccaguucccuucugauguccugggcaguggaugauugccaccuugaggggcagguggacagccucuagcaggcuaagaaucucuucucuguuuuugauguccuucccugcggagguuaacaggccacgcugucuguagauugccccauggacgugagccguggcaaacgcauaucggcuauccguguagauauugauagccuugcccuccgccagucucaaagcuugugucaaagcaauaagcucagcuuuuugagcugagguuccuucaggcaaacugcuagaccauauaacagauuuuccaucuacuaccgcugccccggaucugcgcuuaccuucuaccaugaagcuacuuccaucaguguaccaggucguugcucccggccacggcugaucugugaggucuggucgaguuccaguuucuucugccaauauuucuucacaguuaugcacuggagucucgucaauuucagguaacaggguggcaggguugagagaggcaggagcggcaaaagucacccucucagugaggagcaggcucugauagugggucauucgagcguuggucauccaucggucuggcggcugccugauaaugcucucgagggaguguggagccaccacagugauauuuuggcccaugguuaauuuaucagcauccuuuaccaucacugcuguagccgcuacugcacgcaggcaagaaggccauccgcuagccacaggguccaguuucuuggacagauaagccacgggacgcuuccagggccccagagucugagugaggaccccucgcgcuauuccguuccuuucaucgauguauaggguaaacggcuuaucuaaauuuggcagugcuagggcuggggccugaagcaaagccuuuuucagagucucaaacgcugauugauggucuuggguccaaguaaauuccccuuuuucuuucguuagaggguacaaaggggcugcuaggguggcaaaucccgguacccacagucugcaaaauccugcuguucccaggaacucucuuaccugacggggagugguuggaguuggaauccgcaucacuguuuguuuccuggcaucagucagccaucguuguccgucuuucaggacauaucccagauaggucaccuggguccugcauagcugugccuucuuugcugaggcucgauaucccaacucaccuaacucgacuaggagauuacaaguucccaguuugcacuccucaagugucccugcagcuagcaaaaggucaucagcauauugcaccagagucacuugcggauuauuggcucgaaaagaggccaagucccgauguaaggccucaucaaaaagagugggugaauuuuugaacccuuggggcagccucguccaggugagcugucccgcccuuccgcuuuccggaucucgccacucaaaggcgaacaguggcuggcuauugggaugcaaucuuagacagaagaaggcaucuuuaagaucuaaaacuguauaccaaguccguucagguggcaaugugcuaagcaggcuauaaggguuggacacuguaggguggaugucuuguacucuucuguuuaccucccuaagguccuguauuggccuguauucgucuguuccuggcuuuuugaccgguagcagugggguauuccaaggggauuugcagggaacuaggacccccugcuguagaaaucuggcuauaugagggcguaugccgucucgugccucuuugcucauaggauacugccgaaccccaauggggguggcccccgacuuaagcucaaucacuaccgggggaacuugucuugccaaccccauuccuccugucuccgcccaugccuggggaaauugaucaagccaguccuguagccccucaggggguuuugacucgcuuugauaaauccgguauucuucucccaguugcagagauagugcuaaagucugaggcuguuccauuccccaugauacugucggcccaggaggggaaaagguuaucugugccuuuaauuuagucaauaagucucuuccuagcaggggcauagggcacucuggaaugaccaggaaugagugagucaccugauuccgucccaggucuacuguccuggucguaguccacggguaugacuuuuguccuguggccccaauuacuaagguuuucucauucuuccuuaauuugccuagcgggguuuuaagcacugaaaauucugcgccuguaucgaccagaaaauuuacagggguccccuccacuucuaggguuacccuaggcucggggaggggggccgagccccgucuccccuagucuuccucuucuccaagagacaauacucgugacccuugcuucuuuucaggacacucguuggcccagugaccuuucuuuuugcaguaugcacauuggucuuuuucuaggcguggucggucuuuucugggucuccuuggccccugccucuuuucaucucucagguccccugucugucuagcccuaucccuaucucuaucuaccacuguggccagaauccgagucagagcuuucuccugccuccugucucucuuaucuucaucuucccuucucucuuuccuuucucucucuaacuucucuuccucuguuucucucuugugauacacuuucucagccucucgaaccacaucccuuauaguauaaucuugcaauccuucaauccgcugcagcuuccuucuaauaucaggagcugacugcccuauauaggccaugaucacugaagcccgcugccccucugacgcagggucaaacgggguauaccuccuauaagccuccaugagucuuucuaaaaagacugaggggggcucagcuggccccugcauaacuucccuuaccuuagccaaauuugugggcuuacgagcagccccucugagacccgcgacuagugcccgccgguaauuggacagccguucccuaccuugugcuguauuauaaucccauugggggcgagucaagggaaauccuucgucuaucucaaccgagguuuggaccggccgcccggcuccaucucggacguucuuccgugccucgaggagaauucucucucucuccucggugguaaacaggguuuguaggagcuguuggcaaucaucccaggugggcuggugcgaguacaucagggauucuaucaacccuguaagcccuguaggauuuucugagaaagaaggaugguuaacuuuccaauuauaaaggucagaagacgaaaacggccaauauuguagaagcuguaggucauucuggcugguggggggugcucccacagcucuaaguggaagcgccacgguagaaucgcuggccccucugggagcacuccccgccggcuucucguuccugcugaggggccucccuccccacuccccggaaccaaagguggcggugcaggagcugaggguugggcggaggcgcuggggagggguacagguuggagggcugggggauaagguggggguagagaguugggccauuccggagguuccucuaucucuggauagauuuuagaaacggccgcugguugcgaagggguggauuucucgcuggcuccuucaggaaaugguuuuaauuucuccuucucagcauucucucgaacugucaaaaccuugguaccuggacguaggggcgggagaaauggacgaacccaggcaggugggaaucgcgcuaaaucuucccacacugugauauaaggcugcugaucuggauaugauccggagccuuccugaaagacaauggccuuuacggcccuaaugguggggagaugaaacgucccuuccggaggccaacccacuccgaaggugggccauuccaaggugcaguaagacugccagggcuucuuuuuaacuauuaccgauaaauuuuguccucuugcccuaacguccguccaaugguccucagucaaagauaacgggguagagacgcucugucccaugacaagaaacagaaacagagacaaaacgaggacagagacaaaggacaccagaacguccaagcacacucgucccugccuggacuuguacaaccagccgaacgcuaccucugacggggugggauuccgcguccacucccguucuggcagaaagagcaccuuaucuuccucacucugccaaaggacagccggguccucccgacugucccugacccugggcaguuccuccagggucgccccagaaacgucuccccggggcugcagcuuugcgggcucaggacgucucccuccgcacugacuggauccucacggaucucagcagcagcugccggaauacuagcacuugaaaaccgagacacagauucagcggcgccgcacucagacacaccaacucacacagacguaccuccaagggguauucuugggguucggggugcccccaaaaucccggacgagcccccacgauguaggaccccaaauuuagggaccccgcucuaauccaggaacaggcggcacccacaaacacaagaauccucucuuguugcaagacgcaugagguuuauuuggcagagcucugggucaacacguaccucgcacaggaggcaggggagucgacccccagacucggagccuaggggcuuuuaaagacgcaaaagguugggaauacaaggaauuuuggcaaaaggcacgggauugauucauuaacagaaagauuacaugucagcagaaaaagggggcauuagagcuguuccggugggcuugggacuuaucuaacaaccaguugauuuaugugacuuuacuuggcgccaagagguaaugaagagacaggaagcucuggccagaugguguggauggccuugccugucuccggauugaggggugaauccaaccagaugguguuagcuuagauaauauagccccauuuguccuugaauaccuuuucauacagucaagcuguucuuaggaaugcuuuaacaacagccccgccuuggccugccugggggcuguucugcuuuguucccagucccgaucccggcugugggcuccuaaacaaguuauaaaaucucaucuuccuucacacauuccagcaaaaaucccaugacaaaauccccuuaucaacagccaguuaagguacaucagcagggucaagcuacauagagauaacuaagaccuccuauagaaaacaaaaacagaaacagcuuacccaucaugguugucagaauuuuuuugccacccuugcuugguuccugcacauuaugccagacauacaauuuuuaaauauuacaaugcugauuuguaugcaaauuccccacucuuguuguaacuacaauaaauacucaaaaccucuagacuugaucucucaguuuguaccuaaagggaguuugacugcugagaguccuuguuacugagcucauaaaaaagaccucuguguguuugcauugcaaucggcucugugcuggucauugcaguuucugugacuuaggcauaaaaccuugaugcuuugacuggaaccccaagacccucaggacucccaucggaaggguugaaagacugcuguuagggugugucauugcuguucuuuguaucagugaccugucugucagaaaugugucuguguaccuugguuuuuuguuuuuuuuugaguacucguggagggagaugaacauagugaauguggaacuccagugaaguggaaaugcuggagagucauagcuacaaaguacuaggaagauguuccagggccuggaacaggggucaugugccucugguccuaauuucugggaaguuacagcagucuuggaacccugcuccaugucucacagcugccauccugucuucauuuucuacucuguacaagugguggaaucugcugcuuagccuucaccgccaccuguggcccucuauuaugugugugccacuuuaguauucucuuacugagagaggaagugagacuguuuccaucccaauuuauauaguuacucaccuuccaccuuggguuaaaucccucuuaucaagaggaccuguacccauuaaauugcuccugacagagagcucuuuaugaccgcauucagggcaaaaucagacucugcaaaacaugguggaaaggacaaagaccucauuuuucccccuucuaaacaacccuguucucagucuauaugugacucuguagguuugaacuuggagcugucaguauaugguagguuguuuuuaaucccuuccagcaaaguuagcauaucuuccuuagaccagagucuuauuuccaagucugugggacaaucugcuccuccguucaccuuccagcuguuuggccaccucuuuugucucccuggccugggaauccaggguuaaggacaccucaccacagggcagugcagccucccuucuccccauuccacuguauccuuccaugcucugagccaggagcccuucccauuuuauccuggcucagacacuacuccaacucucugaugugguggcagggguccuguaauugauaugguuagaucguugguuuuggaguuuuacaacuuucucauuauuauuauuauuucucauuauuauugucucugugucauaguuguuuuaacucaacauuucagacuacagucaucugaaggagccucaguugcaggugugcccucaucagaauggcugguuucugucucugagagauaguguugauaauugauauaggaagacucuuccaugaaggguggcaauauagggaagcaaguggacuuggguuggaugagagagguagguaagcauuguagcugccuguggccaugugaacuggguuccccugaaaggcagcccggggcugaaagagaucagagggcaacaaaagaaugaggccaagacaaaccuuucuguucaaagccucugaaguuuacugagagucccugcuuauaaagaggguaggcccaucugccagcccauucuuugugccuggagccagcccauaggcgaucuacagggcuugucuccagauagucuccaggaccuuucagcaggaagcagaguauuggagaagaucaaauagagccaucaaggucaaaaggcucuacccuagguguacuggcuuguuuuaugugucuacuugacacagcuggaguuaucacagagaaaggagcuucaguugaggaaaugccuccaugagauccaacuguaaggcauuuucuccauuagugaucaagggggaaaggccccuugugggugggaccaucucugggcugguagucuugguucuauaagagagcaggcugagcaagccaggggaggcaagccaguagugaacaucccuccauggccucugcaucagcuccugcuuucugaccugcuuuaguuccaguccugacuuccuuggugaugaaccaguauugaaguguaagcugaauaaacccuuucuuccccaacuugcuucuuggucaugauguuuguuuaggaauagaaacccugacuaagacacuagguaaucuccuucuuaguggcagcaaggucaaagucuggaucagccugcuccaaggcugagggaggcuacagagcaugagagagugaccaagcaagaaagcaaggcaggaaguaguguuugucaaauauuuuugccuucauuuucuagcuucaguuucuagucugagcucgcagaaggauggucggcugugaucugacagaaccguguaaaacaaacauuuauuaccugagaugcuucugcucagaggaaaccaucacagcagcagaguugcaagguagaacaacaacaacaacaagaacaacagcaacaacaauuguuucaaaagcugauuuugcugcuggacagaaucucuggucucuuuugaaggaauauagaaaauaucagaaauugagauggcaaaaucguagaaagcuguacauggagcuuaauugguucuucccauagggucuggaagauuggaguguugacagcaaugcagccacacaaaguugaggucauacuauuucaguggaaaauagacugaaaaacuuuaggaagaggucauuucugugauauuuuggccaaaaaaaaaaaaaaaaaaaacagaaaacuuuuguacuuggcuuaugcccugagauauugaguaggucaaacaaacaaaaaaacaaaaauauugccugauuuguauauuuuuacgcuauugauaaguauuuguucaaucuuucuauuucuuuuuuuuuuuucccacugagacagaguuucucuguaucucccuggcuguccaggaacuuacuuuguagaucaggcuguccucgaacucagauaucccccuggcucugccuccugaguucugggauuaaaguugugcuccaccacgacccaacuuccccuauuucuuuauucaauuuacauucuaauuguuacacccaucccauuccaccuuccauagucccucaucacugacucccuuuuaucuccccagggagggugggaaccacuugaguaucccccaacuauggcaugucaagucucugcaggguuagacacauccuuuccuacugaugucagacaaagcagcccaguuauggaaacaguuugcacagacaggaacaacuuaagggacaugcccggcucuggauguuggggaccccaugaagagugagcagcauauccacuacauauauggugggggccuccaucccagccugugugugcucuuugguugguggcuccaucucugagagucuccuagguucuggguuaguugacugagggucuucucauggccuuccuauuccuucagaggccgucaauucuuuccccaacucuuuuaaaauacucccugagcccuguccaauauaggcugugggucucugcauauguuucagucagaugcugaauggagacgcucagaggacaaugaugcuaagcuacuaucugcaaguauaaccaauuauccucaguaaugccagccuuggugcuugcccaugggauggguuauuaguugggcaggguauaguuuggccauuccuugaaucucuauuucaacuuugugccugccuuacuugcagacagaacaaauuuugggagaaaagguuuuugguuuuuuugggguacugaacacuugacugguaguucugccugacugcaagaugucaccucuucaugguccauaacucaaugcuaucuaucucagcuaagaucacuucccuagcugcauuugugcccucccauucauagucucaggcacauucuauagaugcccccacacuaaccccgcucccucucagcaucugcuaauuucauuucauuuuccuggcucucaggccuucccuugucucucacccaucccuaaaacuccccuucuucuuucuuaacuacagucccauccaguuuucucccuuccaucugccucuucugucucuuucaaccccguucugagugagauucaaccaugcucauuugugccuugucuuguuuauugucuuucggucuaugaagugcaguguggguauccuguacuuaugguuauuauucacuuguaagugaguacguauaugcauguccuuuugucucugaguuaccgcauuccagauauuaguuucuaauuguacccauuucucugcaaaauucaugauguccuuguuuuucauaccugaguagcacuccauuuuguaaaugaaacaugguuuuuguguccacauuuuaguugaggaacaucugcauucuuuccuguuucuaacuguuaccaauaaagugccugugaacuuaguggagcaaaugcccuuuugguuauaugccuaugaagguacccuaaguguaguacuuccuccugcuugcuauguuuuaaauuaauggaaggaguauucaacguguuuccucaucccaggauggaaccuuaaacaaaaccugcugcaaauugguccaagcgaggcaggguccauuaauuuagaagccaaacuucacaggaucauccauauugugcugcuucuagaaacugaaagaugaaaauagcauagucauauauucuuucucuaugguuucaguuuagcaccacuccagccaucuuuugacagagucaggaucccagggaagacucugugagaguuccuugccuuuaagugguucagguugaugcuugaauugcauuuugugaccacagguuguggaguaaacuaacguauugagaaaucugccauggagagaugcuuacagggagaugaaguacccaaacugagagauguaugagaaguuacaggaagagcaccaucuaugccuuaagcaauuuaaguccaauguguuugugacaaaacuauaggauuugguguuuccccuguuguuuuucuuaccuuuguccaaucuucucucccuaugugcacauuccuaucgauuggaauggaaagggguauucagugccaguuuauguuggaaagauauaacuugcuguuugauuuugcaacuuugcuuucugauguggcugucaugauacugucuugagugucagcagagacuuuacauauuugaacagugcgggagccuuucuagauucaucuuggggaaggugaaaguguauauacacucaaaaaauuuccuuuuucuuucuuuccuuuuuuuuuguuuauccuauaauuuagauauucauuaucacccugaucacugucccuacucuaggucccugcccucacagacucccuccucccaaucuccucuguuucuuuuuugagugggguuggggcccccuguguaccccgugggcacauagguuauagucuauuuuuuaggauggcauaugcucaugacaucaauacugccugaggcuucagagucauuggauucuggguguugauguuuccccaaacucuuguauuuguuuugaaauuuuuaaauaaauagggguguuuugcuuguaugcgugaauaugaauaucaugugugccucaucguuaguguuguuugaagguggacucagaaguccuguucauaaagccaugggucacgugaaugcuaguauugaccacuguuaucuggaagaccagcaagagcuuuccauggcugaguuaucauucucuccugccuuaugcugcuuuuuauguucaacaccauauuacuaauauuuucaguccauugguccauuaaaugugccuugauugccaguaaaguuuuacuaauguugcaguuuaaagcgguacacuuccuguuucugcuagaugaguacagaagugcagggaauguauacuucuuuguaggaacuguaguaaacaacugaguucuuucuaucauuuuugucuccgugguugauuuuugcaguggaguaaauaauuaauauguaaccuuugcaguccuggaauuuguuacauagaacagacuaggauccagcucaaugauguauaccugcccgugacucugggauuaaagacauaaacaaauacacccugcuuguccaugauuuuucucauuagugauucuucuuacaaauuaugggauaugugcucaguacuguugaucuguuucacccuacaucucccucucaauuguaauuccucuugaagacuuuacccuauuuauuuaaaauguucauaagcaacacaggugaaacuucaacucaauuuccuuuaaaauguuaugguacuuagauuauaacuucugugucaagaagucaguggaggaaacaccagaauugcaugaauauauggucaaggaagcgcacauuuacuuuacagugaugucaguaccaugcuuugugauguacacauguaugggauauuuuaggaugcagugacuuaugaugaugugcaugugaacuucacuggggaagaguggaauuugcuggauccuucccagaagagucucuacaaagaugugaugcuggagaccuacuggaaccucacuguuauagguaugacuguaaauuuucuuugcuuuucaaaauaguaggaaaacaugucucuugguuagugauggugcucuguuauuacaacugagaacaaggaagacugagcugaauaaauaguguccagugaugugaaaauucacaguaccuugaauuuugccuauucccaauacuggaucauucauuuuucucguacugucuuuuaggcuauacuugggaaaaccaucauauugaaagacguugucaaaauucaagaagaaaugaaagguaauuuucacgugaaagcuuaugcaauuaugccucuaaggaaauuuuacuaugauacggaagcucuaaagaaaagcaggaguguaaaaugucaauacuugaaguguaacuauaguuacaauauuuuuuaagauuuauuuauuuauuauauguaaauauacuguagcuguucucagauacuccagaagagggcaucagauuucguuauggaugaaugugagccaccaugugguugcugggauuugaacucaggaccuacggaagagcagucugugcucuuaaccacugagccaucucaccagcccuaauuacacuauucuuaaaaaacauauacugccucgauguaguuaucugauuuaucuaucaaagcauuccucuuuuuuaaaaaaagaugaggaaacauugccuuaagagauaccuuuauucaauuuguagcucuauuagagcuauacugaucugacaauguguauagacuuacaagacucagauauugcacaucgaauagugauaaauauauauccaaaaccuuccaauaagcaaauaauccaugggaaaguuggugauacucauagucuuauagugaaauugaucauuuguuuaggguacaguuuaugagagucaagauuguugucauaggagaaaccuuaauucauauauuacaugucuaugagaacaaaagucaaacagugugaaugcaauuuauaaaccuuucaucuguuacucuucuuuuaauauauauaucaugugucacaauggauaaaagccaugugagcaaaggauauugaaagaagcaauguaccucuuucuauuccugaacugggagcuaauugucagauucugccuuugguagacauucugaauaugauaaaaguuugcaaucaauugguuuucuaauuuuacugggaacuuccccaagcucacacuguagaaaaucuuuauggguacuaggaauuuggaaauucuuuuguuuguccuaguucacagucaaauguuguacaauucaugcuacaggaaaaauuacgaaagcaauuacuguuauaaagcuaugaguuguucuauuauccucauauagaugaaauacaucauauaaaaaucccauauaaaaaggauguuauaaaugucagccauguaauaaccaucacagauaucucgaaagaugcaaaacaacccauaaugagggagaacaccaugaacauaugaagugauaaaaccagaugaucugguccaccuuuaucaguagaccaauuuguaaacuuuauucaucuugaugaaauuacugaacaaagaaauuaauguaguaaacauaucacaugugccaauuuucauugcagguauguaaguaaucauaguggagagaaacucuaugaauguaaugaacguucuaaagccuuuucaugucccagucaucugcaaugucauaaaaaaagaaaaauuggagagaaaacacaugaacauaaccaaugugguaaagccuuuccaauacccagucaucuucaauaucauaaaagaacccauacuggagagaaaccuuaugaaugucaucaauguggucaagccuuuaaaaaaugcagucaucuccaacgucauaaaagaacacauacuggagagaaacccuaugaauguaaucaacgugguaaagccuuuggaagacccagucaucuccaaugucauaagggagcacauacuggaguaaaacccuaugaauguaaucaaugugguaaagcuuuuacaagucacagugguuuccaauaucauaaaagaacacauacuggagagaaacccuauaaauguaaucagugugguaaagccuuugcacgucacaguuaucuccaaugucauaaaagaacacauacuggagagaaacccuaugaauguaaucaaugugguaaagccuuugcacaacucaauaaucuccaaugucauaaaagaacacauacuggagagaaacccuaugaauguaaucaaugugggaaagccuuuguacuacucaguagcuuccaauuucauaaaagaacacauacuggagagaaacccuaugaguguaaucagugugguaaagccuuuguacgucacaguuaucuccaacgucauaaaagaacacauacuggagagaaacccuaugaauguaaucaaugugguaaagcuuuuacaagucacaguggucuucaauaucauaaaagaucacauacuggagagaaacccuaugaauguaaucaaugugggaaagccuuugcagaucacaguauucuucaguaucauaaaagaacacauacuggagagaaacccuaugaauguaaucaaugugguaaagccuuugcacaacucacuaaucuccaauaucauaaaagaacacauacuggagagaaacccuaugaauguauucaaugugguaaagccuuugcaagacccagucuucuccaauuucauaacagaacacauacuggagagaaacccuaugaauguaaucaaugugguaaagccuuugcacaacucucuaguuuccaaugucaugaaagaacacauacuggagagaaacccuaugaauguauucaaugugguaaagccuuugcaagacccagucuucuccaauuucauaaaagaacacauacuggagagaaacccuaugaauguauucaaugugguaaagccuuugcaagacccagucaucuccaacaucauaaaagaacacauacuggagagaaacccuaugaauguaaucaaugugguaaagccuuuacaagucacaauggucuccaaugucauaaaagaacacauacuggagagaaacccuaugaauguaaucaaugugggaaagccuuugcacgucacaguaaucuccaacaucauaaaagaacacauacgggagagaaacccuaugaauguaaucaaugugugaaagccuuugcacaacucaguaguuuccaacgucauaaaagaacacauacuggagagaaacccuaugaauguaaucagugugguaaagccuuugcacgucacaguuaucuccaaugucauaaaagaacacauacuggagagaaacccuaugaauguaaucaaugugguaaagucuuuucacaacacagucaucuccaaugucauaaaagaacacauacuuucccgauauaacugucuccugugaggcuauuccagugcugagcaaauacauaaguggaugcucacagucaucuauuggauggaacacagggcucucaauggaggagccugagaaaguacccaaggagcugaaggggucuacaacccuauagguggaacaacaauauaacuaaccaguaacccccagagcucaugucuccagcugcaaaucuagcagaagauggccuagucugccaucauugggaagagaggccccuuggccuugcaaacuuuauaagcuccaguacaggggaacuccaaggcccagaagugggauuggguggguaggggagcagugcagggggggggggaguguauaggggaacugucugaauagcuuuuuaaauguaaaugaagaaaauaucuaguaaaaauugaaauauaaaaaaaacauacuggagagaaaucuaugaauguaaucaaugugguaaagccuuuucacaauucaguagucuccaauguuauaaaauuacacauacuggagagaaacccuaugaauguaaucaaugugguaaagcuuuugcaggucacaaucaucuccaauaucauaaaagaauccauaauggagagaaaccuuagaaauauaaucaauguuauaaaagccuuuucacaaaguuauugucucuauaaucauaaaagaacccauauucgauagaaaccuuaugaauguagucaaugugcuaaagccugugcauaucccacucgucuucaaaauguuaaagauuccacacuggaaagaaaccucauaaaagcaaucaaugugguaaauaaagacuuuuuacaacucuauagucuccauuauuuuuaaagaacacauagaagacagaaaccuuuggaagguaaucgauguuguaaagcauuugaugucacggucaucuaugaugacuuaaaagaucacauacaagugagaacccaugugaauguuaugaacguaguaaagccuuuguaugucauaguucuuuaggcacacacaagacaaaccacacugcagagaaaccccaauuuaaauguuugcuuuucugagaguugguuuggucaugagaucuguuccuagccauugaaaggcugagggagaaacccucugaguauauuuaauaugguaaagccuuugcacaauuuuguagucauuuucaucauggaagaaauugaacuggguagaaacauugugaaucuauuuaguauggugaagcuuuuucauugaacuucuuuuuauguauauuuuucuuuuuaugagaauauucauacuggagacagaugcuaugaauaucagcagugugguaaagcuuuuaaguuguuggguccacugagguucaacacaacucacacuccaggacaaugcaaaugauaagaauuuauuggacuggguggugguggugcacuccuuuaauccuagcacucgggagguggaugcaggcagauuucugaguucgagucccaacuagucuagagugcguuccaggacagccagggcuacacagagaaacccucucggaaaaaaaaaauuauuggaaacauacugagaaguuuaucuucaaaaccccaccgcccacacccaaccugagacagaaaguuguauaacuuucaaacacaaaagccucaaaguccuaggccaauuuacagcuacauuuucucccaaaucaaaacuuauuuuuauugaaugagucaauaaauggugauugcuaacuccuuguauuuggugguuguuguugcagcugcgggugguguugguguugggcugugugugugcuuucccuucuuuuguagacagugagagauuauuuacuaccuguguuuucauguguauccuuaacuuccucgguuagauucuaccucuaucucuuuguguuggucaguauguuuagagagagguuguuuaaguuugaguuuaucguggacuaucuuaauuuuuuccauuaacgguguagucauuuuuuuacauauuaaaauccaggcauguguuguuucugcggcacauguguacaaacccuucuggcaucuacagacuccaagaagacaucugugaucuuaauagaucuuccuuuauguuuuuccuggcuuuuuaccuuugcagcuuuuaguauucuuuccuugaacuguauguuuugauuauuacacagggaagagacuuuauuuuauagucccuucuguuugguguuuugaugauucuuguguuuucuuuauguuaggaaguuuuucuucuaagauuugguugucaauacuuucugagacuuugagcaaggauucuucuuccucucuuccuaaguauucuuauguuuaguccuuuuacaauguccuggauuuccaugauacuuuauaucaggaagauuuagacuuaacauuuucauugucugguuuacccauuccuucuauugcuuauucaaugauugagauuuuucuuccaugucuguguucugugggugaaccuugccucuguaguuccuuuuugcaguccuaaauuuuuauuuccacuauuuccuaaguuuuaguuuucuuuuuugcuucuguuuccacuuuuauguauugaauaguuuuuuuacuucacauguugguguguucuuucuuggcuucauuuauaggaauuuuggcuuccucuccuuuuugguuuguguuuuuauggccuucuuuguggaauuuauugauuuccuccaauuuucuuauguuuuccuggauuucucuaagugauuuggucauuuccucuuuacggaacucugucaucuccauacauuugggguuagaguguuuuucuuguaauuuagcuuuguuggaauauuuaagaccuucuuugacaauauaaaugagcucagagucauuaaccagagagugauaaauguugguccuuauuacauuaucgagcaccaaugucauggaauggaauggcgcuaucuaagcuaaguauucagcuuagauuuaagccgauguguuaucaaucccaagguuguucuuucuccuuacacuggauggguagccaagugagacacuuuuugauagaguuacuuuuugugagacaccuguuuuuaucacuaaccuuggagucaccauuuaaaaaacaaaacaaaaacuugauggugacagggugacugacuuuguaauuuuccagcauguauuuauucaugucuugugaaugaagacagaccagauugauagauauguaaauuggggacuuuagcuugguucaagcaauauugaauuucuuacuuuggagauauguccaaugcacuuucaggguuuggucagcucagaugauugugacacaagccauuggcuguaguuuugugucauguuacagaucacagcaacugauauugcacacaggagccaggucaaagaguaauguauuaaugccauuuuuuucugccagauaagcgcucucucucucucucucucucucucugucugucucucucucucucucucucucccuauauauauguauauauauauauucaauuauauuucauuuuuccauuuuuaauuuuuuuuuucauuuauuuauguacauccuguuugugucccauuguggacagagagacaaggcaguccucugcuacauaugugccuggggcaaugagccagccccuggaugcugcuugguuuuuggcugggaggucugaaguguccagguuagcucccaguuuuguucuucuuaucggguugccaucuucuucacccccuuaagucaguacagugaccugcccuuauguaacauuucaaccuacaacaauauaucgguauaucgaucuacauguuucuauaucuaucuaucuauucaucuauauaucuucaaucuauacauccuuacaucuauauaucaccuauuaaucuauauaucuacauaucuauauguauauaucuauacaucuauauagcuaucaauaaauauauaucaucuauauaucuauauagcaucuauaaaucuauauaucuauaaaucuauauauaaaaaucuauauauauauaaaucaaucugucuaucuaucuauccauccauccaucuaucuauaagucuguccauaugguuagcuugauuuaccccugucuaaaaggucuguuauuuucuagguuucagacguucagccugagaggaaacaguaugaguaacauuugaucugauaccagauccucgacucuggacccauauuuuagauaauuuuggggauugugauuacaucaguccuaccuccuguaaucaaucaguaaacacaucuaaugccugcagcuggcaagaagaaagguugauggcacuucaguucccagccuugguaucuuuggaagagaccaugaaggagagggaagaagaagcaggaaaagggucccauggguggauagauugggagagcauggccaggugggugagccugagaguaugagcagccuaggcagaauauggcaagugcgccgggcgugguggcacucgccuuuaauuccaacacuugggaggcagaggcaggcagauuucugaguucgaggucagccuggucuacaaagugaguuccaggacagccagggcuauacagagaaacccugucucggaaaaaaaaaaaaaaaagaauauggcaagugauaucucacuguucuuaguaaagaaguagagaaauuagcauagaggaaugguaucugccacaugcuggugcuuuaaugcuuauaauaauaauuauuaauuauuuuauuguuuuauuauuucauauuauuucacauuauuaucauuuacuauauuauuauaucacauuuaauauuucuuauuucauauuacuucauauaauuauuucuuauuuuauuauuucauauaauuucuuuuuauaucauauuauuucuuguuauuaauuuacuaucauuuccucucuucuucaucuuauuaucaucaucaucauuauuauuauuauuucauaccucuauaauuuauguggugguaagaaauccacaaguaauauuuaccacaacaaguuggcuguaaaaacagcuugugcccaaugagugaaaugcaauugaaaguaagaugugguuuuacacacuuguaaccuuagaacccaacagacaaaacagaaacauggccaacaguuaucuucuugggauacaggaagaaacuccucuggggucucugauaauaaggucacacacauacauacacacacacauacccccacaaacaugcgcacacacacaugcuacauacauacauuaacacacaccacaaacauacugcauacaugcaccacacauacaccaaacacacacacauaaucaugcccccacaaaagcacgcacacgcacauauaccacauacuuacauucacacacacacauauaccacacauacacaugcacacacaccauguacaguaacacacauacaccacacauaaccccacacagucacauacauacauucacacauauacacauacaccacacauacacaugcacacacaccacauacuuacuuucacacacauacaccauacagcccaugcacacacaccauauacauucauucacacgcauauauacaaacacaccacacauaccucccuuuuugauucugcuucauuuugcuuaacaaugauuucuaguuccuucuguuucugugcaaguaucaugauuucacuuuucuuccugauugcaugaagucaugucauguguacucuguaaucaauuugguuaacaaggguaaacgcauaaagcagggccugggcugaggaauuugcauuuuggguguuccacuuagccaagagugacauggcaugucccagagucucuucucccccagugagccccuuggagcauggcucuuggccaagguuguggggaaggcaggaugaggaaaucaguagcugacauuguuuguauaccuacuugccuggugauuucugcugcaaccaccagguuguuugucugaugaccuuccacaggcuccaccaucugccugcacuuugaccccaugaguguuaaaugagaacuccucuaaccuauugaaucugggggcuuugaagcuguccugugagauaaggagucucgccagcgaggacacacacacaggacacacacggguccuucugcagcauaacuuuaauccaucucgagagagagaugaucagcuucugggggaggaggcccagaacacaggaaacucgguccuuaaauagaccccaagagcgguuggagacguuuuucacccugacugguuguucacuaugagcccagaugacgccacgggacaggcagggcacaaggaauggaaaaauacccuagcacaugugcagacuacuuguuuaccaguuagaacaccggauaucagcgccaucuuguaauggugauugcaagggcgccuccucacaucucccccuuuuauuuaaaaggcaacaggccacccaguacugagaguggagauggaggucaaauccccagugugcaaaaauaggggcauuacacaaaaccuucucccaggcucaucacccggaggggucuugguccgcuccccugucguuuuuuuuccugggggaaggacacuuggacacucaaccuuuauacaagaugacgugucuccuuagaauagguucauuuuaugccacagagccuuucuacugcagugcuuagccgugcaacccucucaggcugcugaagcacacucacucuaucccgugcaaugagacuagccucguggggugcaagagcugaguggccagcgaccuauugcuuaaguauagauaaccauauaucaggggaggcaccguguucuaaugcugcaagugcuuggguuaucaccaucuugucccuuuuuguuugggcuuuaaguuuacagaccauccagagcaaaagcaaugcuccaccacauaggaucacggcaaacaagccuacccccacccacuccuuaaaauaagaaaaugcagaugaaauccaggaggagaggcccucugucaaugacagguccacuugccucgaguugauccuuagaacggcugcccucaaggccucaagggucucaucgaauccuucagaccaauuuccugcaagauacaaagaaagcugccuagauagauuagcugcaugaguaaaauuuucauauugaacacugguaaugcacagagcacccaauuuucuuucacagcccaccugagccaacugguaugggacaccuaucuguuccucaaccagaucaaggcgcugauucaaaaucaucagcccuccuuucaacugggcacuagcaccugucucauuucuuagaacccauugguaauuuggccaaauauuuucuuuuucuguagcaucuccuuuaucauucauuacagcaaaaauccaauggaggugacaaaacaaaacccuuuguuauuucuuuucgaggaaaaaauauuugauugacaaggugaaaaaacuauaggaaaugcaugguccggaugacaccaaggcaugcuguguauagcaguagcauugucaacagaccaucgugaucuuuuuggaauagucgcauuucccuuuaucauaaucguggugauguuuauaggugaaguuacauuauuuccaacaucacuugagccugacugugcuccuugagcaacuugcguuaaagcauuaaauaacacuccagagcucacuuuauuuuugcuaaugaaaucugccaaauuagagauaaucuuuuucuuuaaaaauauucaguugccaaaaacaaaagcaagguagaagaauuggaauguacuguaaagguaccggccaugaucuuacuauggcccacaaagcuauacuuauccuugucucaaccaucaggaguaagaauaacaggaucaucuugagauucaucuugcucuuuuacgguccuugucagucgcgucggaacccaaaguggauugucuucacccuguggaaaaaacacaaauagcuucccgggaucugauuaagauaggaucugggccauaccauuuauuaucaaggacauucuuccauuugaccauuucacugggcgauugaggccauaguccgugccuuucagcuggugaucucccagcaucauccaauuuuuaaaaauuaagaguaaauauuauaagggauagagccaucuuuggcgucauagccucuauccccccuuuuuguuuuuguuuuuuaaagaaguuuuaauucuccuaguuaccuaaugaccaguuugaguuagaggccuuuauauacauuucguguccuccccaggacauagccugugggagucaguugccuugaugcuagguguagaucaugauguuucugacuaacaagaacagaacauuuguuucuaggguggcuuuucagcccagucauauaugcuauuuagauuuacaaaauaaacugcuaggacuuaucuguuuagucuuuuuugccaguggcuaacuucagcuuaggaauuucucccuugaauaggagccagguaaugauguaugugcucuaauauguuggauauaaaaaggggugcucacgcaucaaaauacaaucuucuauuuucaucaaaauuuuagauacugaacuguuagucaguuuuaauauaacaugaacagugacuaauuacacuuucaauuguuucucuugaugagagauuguaacuagaaugcuugaaaagucauuauagucacuuguguauaauauauuuauuuauuaaucagaaauuagagaaaaucuuuaaguugucucugcaaauaacuaucuucuaaaacccaaauaaauauaagaauccugaguuuguaucuuuuccggagcuaucuguaaucuuuaucaguuaaagcuuuauguaaaccucuauaacacaaaagcaaauccugggggucauuuccaggcaacccaggacaaguucuuaacugcccaaaaacaauuuucuuaaaggaacaguauuuuucuuauaaguugcauaagcaauugcaagcucugagauauaauauugacuauuaauauacaacuuaaaguuugaauuuucaacauuuuuaaacaccaucuucagcaucuuuaauuaucuguggugaaacaggaggaaacucaaaagaauaaucaugugauuuaguucacauauacuuuucucucauauaaaggcuauuuuuuaagcacaguaaaugggaugcaugcaugcauaaauuuauaggaaauaugggaacaugcaugaaaauaaaauuuuaacuuaucuuaggauaaugaugaucaguuuuacuucauaugaugguaugcaauagaucaaacaucaauauucugcaauaaccaaauuaauggcuguuuggaacaaggaacagacacuuauacauguaagcacacucuguacacuauaacuuuauauaaaguagguaagucaaaucgcaauguauugauaaauuucacagccuaauugaccuuucaugaacuuugaauuuaaauuuuuuuuuagaacaacaucuggcuaggucuguaauaaggcucuaagaagugccacacaagccgagcugaggcugcuccccuccgcgcucagccuuaacccaaaugcaaacuuuucucaaucugaacacucugccagagucuucucaggucaaaaauuaucccuauguugaaguauccuuaaagaccuguuuucuuguguuuguucauguuguuuagaaagacucuaaccuugaguucccaauuuuaagcuaacauucuguuacaagcaaaaggcugccugccccuuuaagagcuccguuuguaaucgguccucagcaaggcuuuuucagcuguacuuggcucccagccacagcgcuuuuugcuguguaaauugagacagccagcagauucaacaugaaacauaaaacagucagucauucagacaacgaaacaaucauucagacaaugaaacaaaagacauauaugaauugacagacacauggacaauuuguuuuggugcaccaaaagcagacaauagacagacagggaauagaacuuggugucucaaagggacacagauaucuuaaccagagcuaagagcucugaaauagcuuauuuucauuuuuuucuuuuuuugcuaaaagaucccaaacagggaauaacugccuuuuuaaaaacuuauuuucucucucucauguucagacucuacuuccuuaucuccuucuucugggaauacugccagagaagagagaagaggcacagugacccugagagcuaucucuaagccuuauaugaaggcugccuuuuuacuagggucuaaaucauuaggaucugagcuaucauguucuagggcuuuuagcucucaggugggauaaauauuacuaaguuuaucuguagggggugcguuuucaccuuccccuuuuuucacuccccacuuccaacuuccggggagguccuuuuuccuuagacaugucuuuuuuuucuuuuuaugagcuccuuaucucucgcuccguuugguuucugacaugcuguccugaaccuccucucaaagggaacaacaggcucaaggucagacauaccucuccgaaucuuaucuuuuccacugcaguucugaacccaccccauuucugggggccuccucaaugccggugauguagaauucccggguuuuggcaccagaugucccugugugaugaggaguuucgccagcaaggacacacacacacacacaggacacacacggguccuucugcagcauagcuuuaauccaucucgagagaaaggugaucagcuucugggggaggaggcccagaacacaggaaacucgguccuuaaauagaccacaagagugguuggagacguuuuucacccugacugguugcucacuaugagcccagaugacgccaugggacaggaagggcacaaggaauggaaaaauacccuagcacaugugcagacuacuuguuuaccaguuagaacacuggauaucagcgccaucuuguaauggcgauugcaagggcagcuccucacagaagcacuuugagaaaauauggacaagguggagcacgggauauccgaggucagugaagcuggucuguauacauuguagaagacauucaucuguaaacccagaacaugcaguucaaagcaugaaugcugugaaggcuguagaccgaaugagggcaaugauuguccaugcuacagaugccccauucugguggaggguguugaccagauggacccagggaaugucucuaugccugucccucaauuuuucuaugaaucuaaaacugcccuaaaauaaagucaguuaaaaauacauaugggacccaaggagcuaaagggguuugcagccccauaggagaaacaauauaaaccaacaaguacccccaaagcucccugggacuaaaccaccaaccaaaaagaaacccauggcuccagcugcauauguagcagaggauagccuacucagucaucaaugggaggagagacccuugguccuuugauagugauaagcccuaguauaggggaaugccugggccaggaagcaggagugugugcauugaggagcauaagggggggggagugaaaggugauuuucaaaggggaaacaggaaaggggauaauauuugaaauguaaauaaugaaaauaucuaauaaaaauacauauggagacuggugggguggcuccaugcuuaagaguucuuacuguucuuugagcagacccuaguucauuuccucccaauuugagaggcucacaaucacugguaacuccagcucugggggaucgggugcccucuucuggccuccacaggcaccugcacuaacgugcauauucccaaccuaaucugcaaauaucuguuagggaagugcauggcuuuucuaguccagaucuuggauuuuuggucugagucugaauucagggguaguccuuuguaaagcacugaguauugagugccugcuuuguuuauagcuccuggcuaggcacugaugcaagguaaugaaugaagugaugcccucuugacuucauggugcccagucaaccuggcugugugggaggagggcagacacacaggccccacaucuccucccagugugcagaucaagggaaguccuagguccucugcucuuuagaacagacucugggacaaaccagugcuugguucaguaagaacaugcaaguaugaucauugcugugaauagagagacucugcaccauaaggggaaacugagacagugcuguagccuaggaagagaaguugugcucgggugacaggacuuuccugucccauacugacugccacuuaguucuugagucaauuacuagccucccugugagcuccauuuucccucucaaggaaauggagguaacacugggccucccucauuggucuguccugaggaucucagggggcaaugacagcuuugagugggguacaagacuauuuaacagucccauaauacuguucacugggaauaggccuccaguacccauguguggagcagacagggaggaaagagauggucuucagaccuggcucuacaggggaccuaagguuuauucaugaugcugacuguguguaucuuugaccagauuggugagggcuugugugcugucugaguugggauauaguuuuacuccauguguacauuuucuauguuccauuuucugagccagggaagcaugucuggacaauaugggcuuugagggaaaggccuagcuggggucagccccgauaagguccagagcaggaccuugggugcuccuuugagccuucccaagcccagccaggaugcuccaucaagcauccuaaugaccagaagggaaauagguccaggagccacacacagcugcaucuggauagcccagucaccaguugaguuauaauuaauauucugaguccagagagccauggcuaugaccaucacccacacuugcuuugugacaauguuauuccagcugagguugaccaguaucucaccaggcuucuguuaaugggggaucauaggaauuauaugcacacacacacacacacacacacagagagagagagagagagagagagagagagagagagagagagagaggagagagagagagagagagagaacauggauacacaaaugcacacaugguacacaggugcauacucauguaaacacacacacagucagauuuguuuggguacuuggggcaagugaagagagguugugagcucacccaggugccagugcccuaugugaccuguggucuucuuuuccacaggcauggucuagcagcuugucaagccugugcaucaucccccagugguucugaucccugcucugccuuggccuccacuggguccuagaaaagucaaccugaggccaaagggccugcagagcauuagagcuauggaugaaaggggugccauuugcagagacuguggggacagucucuucagugaucucagaggauagguaggaaacugaggcugagagguaagaagaacccuguaaguacaaggaugagccaugcauacuuaaccaugaggccagcaucaccaccauuguuucagagauugugcaugugucaugguucuuucuaaucccaauggcugcuaccucaagaggucugcaacaugaagaggcaaaugucaagcaguacuucugucccuggcucugauaaaugcagcuaguuccccagagauuagaccagcaguucccagcagaccuggggguggcugggucucccucacaccuacccccagcccccagacacccuagcuccuacagcauucaucgagggauuuucauggcacaggguguccucaggacuuccuguggguggaguuccuuuucuggccuucaucuucuggaggaagaggauauuuccugcugccuuuuucuucacucccccacauuccauagacacucuguucagguugucagugagucugaaggagauaccuagaaagaggcccuugucuuugcaaagagagucuuuggguccccucaaucgaaaauagacacaauggaauauggugugcacugcuggggauaaagagagcaguuccugagucuauaugacugaaugucacuugcauacaugcuuccaggccccaugguccucgacuccagaugcuauaagugcacaagugcaugguaggguccagucaagucuggaaauugaugucuggaagcuggagcagagaaagaggucagaggaguacaaguucuagccuauagugucucuuuucauccugaggcccuuggaugcuuugguguauacccagugacuccucuauagccaaauacaccucagcacugaaugaggagagucugggucagauaguucuuaaucuuaugucagaacuuugcuauggugucagaagucagagggugaucaguagaaagaucccucugaagaugggaccuccuccauucccacccaccugccugugguugaaagcauguacaagucuggggcacagccuugcugccagcuguguaccuuggcgggcaguauggcugugcucagcauguauuaagaauauacucuauccccagugagcuagagggcucuggcuucuaauggcaaagaaaagcaaauuaaagccugggcauugaauucauuauaauauugggaaaaguaaagcuggaaagagguuaggcuuagaagguuguguguagaggcuucacuuuucaaccaaguauuccagcaaggcuaagagaugugagcacggagagagccugaagaaggugugggagcaaaggcccaguggcagccauagggauggagacagaagcaguggagauauucguggccaaagaggaugggaagaugggucaggcugaugggggugcaaugaaucacagcugcaguucagagcucaacuuguacugagugacagcucugugguuguagauaaugaccuguucccucccucccuauuuuccccacauguuccugcucucucugugucauagugacucaccucugagcacacugaggcuugcucugagcauccaucuuucccguccaccagucagcaucuucuccaucuguccaaaguuagggucauuagcucagcacaucuucaggccaaguccaugcauacuugguaaagguggcuggaugaaugaaugagcaaaggacucauauuccuguguguaagaauagcaaaggacucauauuccuguguguaagaauagugaguucccaaugggauaucuucuggaguccuguguggugcucugaggauuccuucuucugaccgcuuuuccuccugggcuaucacuggagccaggagggaugggagccucugaguagucagugagguaacacaucucuguguuggggggguuuguuggugugugugugugugucuguaaacuuggcgacauauauggcaugaagugugagccacugccugagggucccuaacccucacaauccuauucccaagcaguaggcauugacuucccaggauaccugcugucaugagagaaggggccuuccuccugaauccccaccccugugucuagcaagcccuuggugcuugugccccuguacuagaccugccccucagcaacaggagccucugcggucccugcccugauguuuuccuggauacauccuuccuucccuccccacauuuccucuuugaaguacaggaguuaggaagucacuggcccuacccagggaugcuuccagaucacagugaucccaggcucuuuaccagcacagaacaugguuuuuaaugccacugcacuaggugugaccugcaagaaaagcuuuucaggucgguggcuucccugcucacagggugcuguacucagauggagcucauugaggaagccuguggucuuucacaguaaaaguucucaaauguccccaccgagcauuugccuggugguucaguuugucucugucuccucauagcuucuguuucccuuccuuucauagaaauaggcuguaaacuccacacacagggaccuucacucuugguuuacagcuaaggagacaggacucagagaaaucaagguagcaagaacauauggcuagaagggaaggcuguaggcagggauugacccagggaccaccaaaucugcaugccccauugcagccugacacacugcaucuccuuuuagagagagacacacauaggcucagucaggagaaaugagauccuggcucagcaccccuguguuacugcuggaccccccaggaguguugggugccggccacuggccaggucagccugagucauugaccauggagaaccaguccuagaggcccugugccauuccccuggcuacugcggaaaggccauugcugacuucuuggccugcagcaucaaaacacaguugauaugaacugucaucccagccaaucaggagcccaugugugagucauuacauagcuggcucagggaccccaaggagccugcuggauccagccugggacaacaugccaaccugagucugggugcugagcagcaaggcagagaagccuauucugacuccaucccacccggacugacugcacaagacguccaucuguagagggacuggggaaugaauuuagagggcaucuaccacugcccucuccugcuugcagcaaugucuuacauauccuucaaaagaggugugcugugcuccaguaauuucagcagacugaggagugucaugaguuuaaggcuguccugggcuguauagaaagacucuaccauagccagauggugguaaggcucuccuuuaaucccaguacucaugaggcagagguagauggaucugugugaguuccaagccagccugguguacagagcaaguuucaggacagccagggcuacacagagaaaccuuguuucaaaaaaaaaaaaaaaaagacugccacaugaaaacgggaguggggggagaggagggaagauaggcuggaguuggcuauaaauguugguagaaugcuugccuaagauucaccuaagucuaaagucuaucgcuaagugcuccacaaaaugcaugcgauggugcauggcccuaaccccaauccuugggaaaucgaggcaggaugaucaggaguucaaggucaucguccuuuacauaaugaguucaguguccagccugggauacaugagacccugucucaaaaccacaggguguggacucagcccacaggaagaagacuguauaacacagguggcugucccucuggcucacccuggagcuucuauugugcagucgaguauugauuguaccugauauuuugacuugcuaauucccuaagguuucuauaaagcuggaaauuaggugaggaacaugagggccuggaucugcccugccuuucaugucuuuccagcuauccccauugccaguuccuagucuucuuggguuggucaucuucguugugcuccauguuagcuggccgaccucugucccuguagggauacuaucacuuccucauugggcagcuguugugugcugcagggcagugaguucuccuuagcccuggcccuggcacacacccacacauugcuuuuugauuuccccuccuccaccgcugggaacuagcugcccagauguccugcuggucccauacagaagcagaggccuguaaaaggucuagucugguuaugagccuuuuugaugauaaugaccucuugggaaggaacaagaagccuuacuugggaccccauagcuggauugcuguccaaaaggagggacaucagcaucuggcaagugaauaccccuagugugacacauuccugaguggcuauucuacugucacuauugugccagaauggagcuuucuagaagacuaauucacccacaucccucacauuucuuccugagucccuaacccuggaggucacaaaguguuugagccuucaggauaggaagagucucuugggucucaugcugagccuuugaaaugucaugcagccccgauucacaguuauaaacagugugaguacccugccuuguuuugggccacuguggggguucaagguggcaaaguauuaaauacagaaaugcaggaccccgcagucugagagguggagugcucccuguguguaagcauaaggaccuggguucagauccccagcacccguguaaagcgccacauauguccuuguuugcugugacccuggcacugugggauagagacaacaggaaccaauucuagggucauucuggcuggcuagucuagacacaaugaugaauaguacucucuggguucagagagagguccugacucaaaaacaggggcaggacucugaggccuguagaccuggcucuguucuuacaaacaacuacuacuguuucagaggaccugaauucaguugacagcacccacaucuggcucugugagccaccaauaacuucaguuccagagcccugacuucuucccacuucucuaagcauacauacacacagacauacacgugaauagaaauuuaaaaaucuuuuuuaaaacgaaaaagauagcugggcaguggcagcacacaaccucaaucacagcauucgugaagcagaugcaggugggucucugugaguuugaggccagccuugucuacagagugaguuccaggauagccagggcuacacagagaaacccugucuugggagaaguacagaguaaagaaaagcaaaaagaaagaaaaagauucucaugucaaccucuauauccuucaugggaaagcaugccuguguuuauguguauaagggugcauguguguguuuaugagggugugugugaugguuuguauaugcucagccaagggauuggcaauauuagaauguguggcacuuuuggaguauguguggccuugugggaguaggcaugccacugugggugugggcuuuaagacccucauccuagcugccuggaagucaguauucugcuagcagcuuucagaugaagucauagaacucccaguuccuccugcgccaugccugccuggaugaugccauguucccuccuugaugauaauggacugaaccucugaaccuguaagccagcaccaauuaaauguuguccuuuguaagaguugcuauguucauggugucuguucauagcaguaaaacucuaaccaauauaguguguaacauacauauacacauaucugcauacacacacaaacacacacacgaaaagggaagggaagggaagggaagggaagggaagggaagggaaaggaggggacgagaggguaggggaggggaggggacaggaggguaggggaggggaggaaagggaagggaagggaagggaggggaugagaggguagggaaggggaggggaggggagggaagggaagggaagggaagggaagggaagggaagggaagggaagggaagggaagggaagggaagggaagggaagggaagggaagggaagggaagagaagggaagggaagggaauucaguaccuagucugaggaagugcucugaacaaaauaggaccagagucugaagguagaugagaauugaugcuaauccuagaggccucuuccaagagaaagcacggaaagggcaagcccuucacugccucccacccaaauaaaaagccaauuggccuuguacuacggagccggucauaccccuucucccuguuuccugccuaucauccaaaaaugcggaggaauaucaacuuaguguuauucuuaauaaguguauuucaauuuuguucagucaaacuuagccaggguuccaaagcccuacuuaaaauucaacuaggaagucaccuaccaagcacuaauuagcaucauaaagucagagccugcagcuccaggcuuuucaguuaguuguuuacuaggaaaagaaaagacagucuuagccagauacaguuuaccauaagaaaaguuagggaaucccauggggacagguuuuuuccuuagcccuagaauucaggcagaacuauuaagcauagauaaaaaauuuuuuuugccucaggccagcuuuuuucuuuuuuuaauccuuuucguuaaaaacaggggggaaauguagucuccccuccccccagccugaaaccugcuugcucagggguggagcuuccugcucauucauucugccacacccacugcuggaaccugcugcuuugcuguuggugccacugcguguucaccuugcuacuggaucugagauuauucggcaggaaucggguccccucccccuuccuucauaacuaguguuacaacaauaaaauuugagcuuugaucagaaggaaucugucuuagcuccguuucuucuucugccccgucuaaauuccucucuuacagcccaaguagccauaucagucaaaccguucacauugcgaacugcugacagccacaacacccaaggacugacccucucugaaacagacagcaagaagggcagagagguggaggaucugcagaugcagagacccuggggcugaaacauauuuaccaggguccaaagaggggggggggaaacacaguaaugaugucccaaaaguguaagucuuaacagaaggucagaaaugccauucgggauguuggggagagugaccauggagucugagaaauccgcccccaaggaguggugggauguuuguguuuuaacaggcugcagggugugaguaggagcuuccugggugacuggagugggugugacccagaugagccuagcuuagugaggagagucacccacauggcucccuuccuguuacaguagcaguuucuguuaagaaaaaaguucuuggggauuuccuguucuuuucuccaccuccucugguuccguaacuccuguggggccucucaggcuuggaaaagagcagagggagagaggucuggcagugcaggguggggcuuuccaugcagccuugccagcugccccucuuucuccuuuuacauugcacuuuuaccuuguugcuuaaguuuuaugcauauggauuaguuugugugugguggccaagugauccaaugaauguaggucagaggacacagccucugggauucaguucucuccuccuaccaugugaguucucaggcuuaaacucaagucaccaggcuuaggaccuggugccuuuacccagggagucauuucaauggcucugcuuccuuuuuuuuuaaacagucauugaggcucuggggaauugggagugugcgcuccuggaacguggcuugggagucaggaugguuuugcagugacuaguaccuugacaugggaucuaugguucagauggcaggcugagauugcaguaacacucuagucucccucccauagaucucacuggguggcuggcugcugucccacucagaagaggauaucucucucacuguagccucugcaucccuggcuggacucaggcuucugguaccuuauagcuagcuucuccagagagguacaguagcccugcaggauaggucuguagaucugaggaggacugugggaugagaacacauugucuugaacuccugguaucagugaguaacgugaucaccagaugccauaggaugguaacugcugugaauaggaucccugugugguggcaucaacuccagaguccuugcacugcccagcacuguccaagaaauaggaugacauucauauauaauaugagauuuuccuacaaccacauggaacaaggaaagagaaacggggugaacaauguccacagccuguuggauuuaacccauuguauucuaaacaggcccaauaacuguguauuuuacccuaaggacuuacuuagcuuggacuauugguucucaaacuucuaaugcugugacccuuuaauacacuuccucaugucauggucaccccaaccaaaauauuuuuuuuuugcuacuucauaacuguaaguuuuguuaucguuacaaaucauaauauagauaugugccuucugauaguuuuaggcaaccccuaugaagaguccugcaauccccaaggaauugggauccacccauugagaagcucugguuuagaccuacuaugcuuucuugccuaguuuagaaauugaaaggggugugugcagagaucuagggaaucugccagccugcgcccucuaguguucaugcagacucagugcagcuuguguggcuccaggugcaucuccugcagcugauggccauucugcagagggcugcacugaaguggaggcuaaggcuguuugaguuucaccuacagcggauggaggaggaugagggagaggacgaagacgagaacaaggacaaggaagacgaggaugaggaugaggacgaggaacaauauucugcuggucaccguaaggaagagcauaguugaagcugauuucccccugccaccuucuguuccaccuggcauggaacaggcucuccaccauccaagugcagauggucuguugaaguucaacuucacagaggaugcacccagucucuccugaguccaggacuuccuagggauuagguacccaccucucccaccaccuucccuccagggucggugucuagcaguccuugagguuuggcagucugacugaugauauugcugcguggugggcugaacuguaccaugcauguuccuagccagcacugagcugugguuaaugggacauuggagcucccaagggccuuucccagugacggcacaacugugcuguuagcaaagcuuuuuacucgcaguaccaagcucggguuaaauauuuccacagagcuuuccagcuacuuguuugcucuuuccuuaauuuacaauucagugugcuaaggacaauaagagcauaacagacccuggagcuguuagcucccucccccaauucccauuacuaugaaaucacauguccugaucuccaaggcuguugucugucagaucuaaucccugcuagaaugugaagugcuuuaaacaagugggagguggcugugugauccagggacccucauuccccacccccuaaaaagaugaaaguagggcugucugaucaaugaagccuggguuaguuucauggccagggcuagguauguauuucuucaggggagcacacagugacuuuucuguaacuguauaagcauuccuuuuuuuggucagguuuuuucccccagacaucacuaaggcuggcucgguugcuuaaugaaugacagagggguaacggaguguguaccacugagcccgucacacgucuuugcugcugucucagugccuccaggagagcuaaaaugaggucccucauauuaauuuuuuuauccaggucucuguuaggcaucuaugggcaagugcccggaagcaucuaugaggcugccagcauuugugggcuccacuuagcagguucaugaaagugagcauuaagagaucguggcuuugacagccacuuuauuggccagcagcuuuuuuggguaccagcuaaacacaccuuggaaacucauugccucucaggauguuagcagggaaggggcccaggauagaucaaaacccaaaggacagagcccagcucuaaccugggucuuuucuuucucaaugggacucauucugcuaacuccuaggugagacacgugagacugcuuaccacucccuggaggcucugucauccuccaccauccccucugggccuacauuuuuuacucuaaauuccaucuucuuggccagugcaccuaguucuccugccuaggaaugugccauuguagugcagggcacucgagaguagggaccucaauccagcaugacucaagcaucuauacuucaagaacccaagagacuggaaaacacuggaaaaagguccugacugccugcucaaguaugggcuucucuggugauccacucucccaggugauggggugaaucugucaagaaugaggcuaagguggguguggggggcuuucugcugcugggagccugcuuucuuuuccucccuggugguucuuuggcuagcuugcucuaugacuguugguccucugucccaauugucuguacugaauccuuguccccuuuggagaggaaguggggggucacugucacugacugcacugucugaggguuccuauggcucagggcuagcugcuggauauucaagagucucagcagcacuuagcauuguaaagguguguuuucccgucuggguguaguggaacauggcagggcaggaggacuaugauccauggagucccuccaggacuaaggcuucuuuacauagagccuuucuuuacuggaguuucagaaaagggucaauucuacccucucuuccuccuuaucucauacugcuuaugccauuggucucaggugcuuaagauggccagacacauucccauugucaccacccuuucuuuaaaugacauugcaugcaggagcagaucuucaagccauugcuccucagaaccagguccugaggcucggacccuuccuuuucccuuuucuacaucccaugaauccucaaugccucagggauagcccugaaacauggauugaaggcuccuggguggucuccauccuccugaugcuuacaccuuguucugugcauccaaagagggucacuugggaucuguuuggaugugagcuaugucaaaguucuuccugccuccaaauaguuuuaguacaucuugggaacaagggcauguguguguguguguguguguauguguguguguguguguguguguguguguguguguguguguguuuacacuauagccacaacagcaagaauguccuaaaccaaugcaaagcaugaauucuaauuagcagcuugauaccagggaggaggcaaaggcugggcagaggcacagcccuguguucuggagcucccuccucugaaauauuugguaaggagcagaucuucaagccauugggaagggaaugggaaauaagggaaacgaagccucuccuccaacaccuccaaggcugucugcacugcagccuccucccggcagauaucugcagagcagguaccaggaguuuggcauuuuaguagcaucuguuggaugauaaaucacagacacagcagugauguguguucaaugaggugaguggaugcugcgugcaugagcuggaaaccaagggucuguggcaaggcuguggggugcagggcuguugaucaugaagaggagccacaagcacagggcaggcugggguggcaguguagcuguuuccacauugcccucucugggacugucauaccagcacaaucccauagcuggguaucuuggagucagguccuggcucacauaggagagguucugcagcucucugauggucaguucucugguuagcacaauguauuuguucggugacauuucuaaguggacuccaggccagagacacguuguaagauucccugugugaaugguucagugguaagggccuuggagcuacauggcuucaccgggucuaggucuuuucucuccaauacuaguauuugagcaggggacacccuccccccacagcuugguccaaccuggcuucucuaccuuucaccuccuaccaccccaaacucugcccucauuucuguggucuccugcucaccuuguuucacaguuuuuucuccugccugagggccucccgagggccugccucugacaguaacauccuaguagccaccuccugggcucagcucauugucccuuccucuagguucuccaguucccuucucccuccccugccccccuuuuaccucucccuuccuuccuuccuuccuuccuuccuuccuuccuuccuuccuuccuuccuuccuuccuuccuuccucccuucuuccuuccuucuucauugccuccuuccuccuuccuuuuuuccuuccuuccuuccuuucucucuuuuucccuucuuccuuccuuccuuccuuccuuccuuccucccuuccuuccccaucaauauuccuggauuguccccagacaucucuuuuugcaccucuuguccugcuccacuaagggauucuuuggaccaaacaucaccagguguaccacccucccacuguuggcugcccuauucuuaccuccacuucuguguucccaggguggcuucaauuuuacaugugucugguuaauugaguuuccaaaaugaauuaccuacaauaaaacuagggcauuucuaucccuucccaaagagucaugauauggucuuacucuauguugggguguggauuagagcccugggucaugggcuccauggagagcagcucaucuguaugcuuguccuaggccuguggugaccccucagccaccagcagucacauuuguccucuuacggcagacucucuguggauggagaaguugguauuaggugcuccuguucugagguggauguagguagcuucuggggguacuuccagccaguacuggcuacccugucaagcucaauguucagugagcaagggagagguuggcugacucaugguugaagcccaggcuguaggugauaaggaaagaggacccuaaaccuugguagaagcaaggcugugagguaggaagugaguguaacaagaaaacagaggaucuggcagucagccaucacugggggacuuaagagagccugcgcccuucuaugcagguccuccaggaccuuaguucuguguuucaguuguuuuuuuuguuuuuguuuuuguuuuugagacaggguccgcucucuguaaaccaggcuugcauggagcucaaaguuuucuggcugccucugccuuuugacugcugggauuagagccuugugccagcaucaaggcucugucucuauuucuuguuccugaagccccgcccagacagggcuuagccuauaguguucuaucaacucggauguucuuagacaugccaccagucaagagauagaggcugggacacugugauuuggggaugcuucuucuuugaguagaaaauaaaagcuaaggggacugggauccuggagagagggcucuugcuguucuugcagaggaccccaguucaguccuguucccuacacccacaugguggcucacaacuucuguaacuccaguuccagggaucugacauacuauucaggccucugcagguaccaggcaaccucacaauguauuauauaagaagaaaaacauuuguaacaaacuauguaagaaaauauuuuuaaagcuuugaaagagaaaaaaagaaaagaacacauggacacauuuugacaacuuaaaacugcaaaugaccuuuaaucccagcacucggagagggaguaggagagucagggggauuucugaguucaaggccagcuuggucuacaaaguuaguuccaggagccaggguuauacagagaaacccugucucaaaaaccauaaauaaauaaauaaauaaauaaauaaauaaauaaauaaauagaacaacaacaacaacaacaacaauacaaaauaaaaaaccugcaaaugagccagucauuguggcucacaccugugacugcuagacaggggaggcaggaagguaaggguacaggucguccucagcuacauaguaaguuuaaagccagccugagcuacaugagacccuaucucagaaaacaaauaaacaaaauuucaaaggaaaacaugacaaaagguccuacaagauaccuguccauccagccaauuccccacuucagucaacuuuaccuuuccaguagguccuuccacaggaggccucaacucacaaacccaugugaccaguucucacagauggcagcaauggccacaugcccuugugcauaaucuucuuccauuuguagaucucucugucucucugucucugucucucucugucucugucugucucucuguguguuuguguguguguguggggggcgggggguguuuguauguaugucucugagagagagccaggguuucucuguguaguccuggcuauccuagaacuugcucuguagcccaggguagccuuccuugaacucuaaucugucugcacugucacugcguucugggguuaaaggcaugcacuacuacuggccuuccuguucucuuucuuuuaauauaacuuuuuuagacagguucucauguagcucaggcuggccaugaacuuguuauauagucauagaugaccuugaacuccugauccugcugcccucacccucugauucuggaauuacagauguguggcacccggcuaccugacuugaugauuauuucugaucaagauacuguggacauuugaguugguaguuuguacaggggaggacguguuuacauaaguaauugugugcuuugaaaggcaauagccauaugucuguuuuggacaaggaacuuuaaauaucuccuagucaucuagauaaguaaauaaaauauguacauagaacguuaacagccugggaaagaggugaagaagacaggggcgguagcagguaauauugagugcaugucucaccuuccuuagcaggaucuagcaccuagugcuuagaauucauaagcuucugagcaguucagagugguuuccuuugggacuuggguagaggagacucacccacacuaguucuacacauuucaaaaauaacagagcuauugcagguguguuacugugaaagaaagaaaccaaaacugagguagggaagugaacgagcauuaauguccaguggccaaucacugcaggaucucacacuugggcauugugggagacugcaguggggugugcuggccaaugaagcacaguccugaauuuccaugggggcuguuucagcuguuaacauucacauugacggggcuggugaaauggcucaguggguaagagcacccgacugcucuuccgaaggucuggaguucaaaucccagcaaccacaugguggcucacaaccaucuguaacgagaucugacgcccucuucuggagugucugaagacagcuacaguguacuuacauauaaugaauaaauaaaucuuuaaaaaaaaaaaaaaaaacauucacauugacauucaccgaccaauugaugccaauucuagaucucccuggcagaacaauaucucauaggcauaauaaagaguggggacucccauaagguucccaggugucucuucuaggguuaaaacagcauggcaugugcugguaacuucucccaauauuauguggagggggauagggaggucuuggggggggucuagaagccuccugucaacaugcuucaaagcuuuaauaccuggguccccaugaaacccuacuuacccagauuaacccagaaaucuggauaagaauuggguuuuugaaugucauuuauaaaauuaggguugcugacaaaugaaguugaacuuugaagggucaaagccauguuccuguucucugguaucaucccugaguccacucaggaugggagucaaccuaguucuaaauuuacccuagcuguguuagguaggaaugugaaccacuagcauccaccuacacaggcaugauuuauuuacuaugcagcaucagcaaauguaucugugacaaggaaacaaacacacacaccgggucccccacgagaaaaagaacuagcuguucaaagcgaagagucaggauuggguccaugagaccccuuugccccaagcugaugagcugagggguuugucucgauccugucucuuguuuaacccuuacaggacauuugacaaagcuucauuccacugauuuuagguugccucucccuguccccuuauaccacgauucugcaugcaugcuccaaguagacuguauuuagccauaaaaagauauucuuucugucuuuccuagaguguucuggguuuugccauguaauauagaaccauuuuguaccuccugaggagagcuauccuggaaaugcuaaaagucagagcuugcacuaucauggucuagaguucuucuggcccagaagaucucaaccuguguuaucauaaccccuuugagaucgaaugacccuuucacagggagucaccuaagauccucuugcauaucacauauuuacauuaugauucauaaccauagcaaaauuacaguuaugaaguagcaacgaaaauuacuuuauagcuggguguucaccacaauaugaggaacuguauuaagggguugcagcuuuaggaaggcugagaaccacugcuguaauagauggcacugaacauacagaggauauugcuuagccagcauggugguagggugugauaggaagccagacuugggguuucagguauccacagcucaccuugugucuuggccuugcagguuuagucuccacugccagcugccaugagcaagcagaacagcaagcuguguccugaggugcuggaggaccuguggaaacacagggaguucaccaaccaugagcuucaggagugauacaagggcuuccucaaugacugucccacuggccaccugacuguggacaauuucaagaucuaggccaacuuuuuccccuacagagacgccuccaaguucacugaacaugucuuccacaccuuugacaccaacagcaacagcaccaucgacuuccgaguguucaucauugcucugagcaugaccucucgggacaagcuggaacagaagcugaagugggccuuagcaaguccgaccuagacagcacuggcuacaucagcugcagugaaaugcuggagauagugcagguaccugcacuuaacagggccuggagcauggggagugcagggauccaggacccccauccccgaccccauacaccaggucauucuucugcccacuugcuaccugcuguauuaaaggacugcaugucuuugcagugaguaacgauaaaagccaagc

SEQ ID NO: 6600 - RNA, 43598 nt, Mus musculus
cuuuccgcgggaggcgucccggagaguggcuugguggcgcgcaguucccccugacugugcgcccucgcgucuggucuccuuugcagaggacuugguagcugcagcucccggagaacagcgggcagagcugcgggcugggcgcgccccugcugccaccgggcgucccgcgauggcucccgcgccccgcggcgacuuccgcgcccgcgcuccccuuuguucaaguccccgagcggcggcggggucggagcccgcgcccugggcgacugaggcgcccgcaauccgcgccccggcgcccuggcgaugccggaccagaucuccgugucggaauucguggccgagacccuugaggacuacaaggcgcccacggccucuagcuucaccacgcgcacggcccagugccgggacaccguggaggccaucgaggaggugagcgguagcguagcccgcgccgggcaggaggcuagggucgcggggaucgcgcugcgcccugggcaccuguuaggcuuccgcgcuuggugcccgauacccagugcccuccggcugcgcccacaccugggaaaaguuucugguaccccaaagccggacgcagccgggccagcagugcccgacacagaagcccuuuggucccugcucuagggagaggcugcuuggccaccuugggccuuuuuuugggaacgcuccucuauucccauuuccagcgcaggguuucagguucuuugcucccauccucggagaggucaacuucagcugcagagucuguggcggcuucgagccggggaccccugcgagcucugcggcccgggagugaugggucucccugcgcggaccucuccaacuuguuccggaaguagcccggcggggggcagcuguggcuucugagccaacauguagagcagauccagggaccccaagcugcuuaggcacgggugcccaucccaucuugggaggccuggcagucccacaaugugccacagagcagcgcuguagagggauguggagaaugguaucuuugagguccaaaaguucuuugguggccacuucugggcuaccuguguggugccuguugacaguaugaucagcuccuuugcccuuaaccuggggaaguuauccaccuggauaacugcguagucauuguauugaguggcuaagcagugagcucuccagacccuggggaagagggacugcaagaauaagcaguuuugguugaaaauugaagcaggcuuggaagaggcugugugaguccagagacuacggcuguccacagcuugggaaagccucacuuacaucauuuucuuuaccuccccaacagaauuuagaguuuuguguuuucagcucuguaggcuuugugcguccagcuggacucacaaaagguagcuggagaacgagacacacauguguagcaguagugaaccgaugacuacauuucuuuuggucagaauuuuaagaucaagguagacauuuuaaaauacuugugccagagguugguguucggagagcuuuuaaauuaagcuaugucauuacauccuuuccccuugcuugaacaaagcauucgcuauuagccuuugccugggcaggggguggggguggggugggggggacuagacuacuauucuuucguguaaaauauuugucuuuguagaucuacacagucaggacuagacucaaugaaaaauacuagguucaguauccugcucuuggaagugagcuaggguauccguucuucuccuucacccucauccccuuucuuuucucucuccugucuucccaaagaucugcuuguaaaucuuuuguagcaaauucagugagagcagauugcuuuaguccacuuuucucaaccuggccuuuaggugccacugaugccuuuaaugaggcagguggaggaugagagccccuuccccaugagggcccuugaaaagcacuaggaagauagucacaguguuuugaaaauacaucauuaaugcuuaugaaaauaauuauauccaaaaagguaggauucccucuguggaaaggacacuugugugugauguccuuaaaagacagcccaugcggccgcccagucuuccgccgcacgugccuuugccgugaugcccaaauccaagcgagacaagaaaguuucuuuaacaaaaacugccaagaaaggcuuggaacugaagcagaaccugauagaagagcuucggaaauguguggacaccuacaaguaccuuuucaucuucucuguggccaacaugaggaacagcaaacugaaggacauccggaacgccuggaagcacagccggauguucuuuggcaaaaacaaggugaugaugguggccuugggucgaagcccaucugaugaauacaaagacgaccuacaucaggucagcaagaaguugagaggugaaguugggcugcuguuuaccaaccgcacgaaggaggaggugaaugagugguucacaaaguauacagaaauggauuuugcucgagcggggaacaaagcaacucuaacugugagccuggauccagggccccugaagcaauucccucacuccauggagcuacaacugaggcagcuggggcugcccacugcccucgagaaagguguggugacccugcugucugacuaugaaguaugcaaagagggugacgugcugaccccagagcaggcccggauccugaagcuguuuggggaugagauggcugaauucaaagugaccaucaaauacaugugggacgcccagucgggacgauuccagcagauggacgaugaccugccugagagcgcgccugagucugagggagagucugaggaggaggaugacagcugacucugagagccaggacuauggccuuccagcaaguucuucaucucugcuggacaccccaccccaccucacccugcccccggacugcugucacccucuagagggaacagcuauuuauuuugcuauggacaaagacaagggagggugcuaauggaaugacuuuguuucuauaaagaauaaaauuguguccgcaggguguucccgggagacagcaaaaaaaaaaaaaagacagcccauguuuauaaaguuaggacgcuucucucauuguauugaaucaguuagguaucaguaauacuggcagauguuggaaagcccggcaaauaggaguugcaauuaaaguuggcguggacucucucugauuaauuuuaguuuauuuuggaugaacccaaagcugcuuuuccaugcaguguaggagauuacccaagagcucaguuacugaguagauuaaagagagacuggauuuggucauucugucaaauugcaggcuggauucacucagccuccaaagcagaaaauggauuugaguuagaaacagggaaaaccugaacucuuugcaggcuuaucucauuuuaagugaggccagcauccacucuaagcuaauaguguguaugaacugauuugaagggugaaaggacucaguguggauuacuuaaaauaaugcuuucuuucuccuccuacauuauuuaauguuuacuuccaaaacaaaaaguuguucucugucuaguguaauaacacaccauguuuacaauacuuagauuuuaagcaaaugucuuuuuauggucagaugagacauuaggguagguuuugugauauacaaaaaguuacacauuucauagaaauacaacuaaaauaauaagucucuggucuucuacuuaaaugaguuauggaauuaguaaacuuaucugauuaacuuuggcaaaccugauugcuuccaauggagaauauuucuagcuguugucauuuucugacugaaauaggcuuucuugacuugcacaccuguagcuagaaugucaguaguugccagugcguggccuguauuacagguaucaaacuguuguguuuaaucucuaucccugcucugcagaugacgaauuugaggcuaggagauuaguucagguuauagauacagcaaguggaguuuaaacuuggcuggaugcugcuuucucaaacugcauggcguuaucuaaugauuaguuauugugcauucucaaaacugcccauagcuagaucagccaccuccaagucaggcuccaucacuuuccaguuguaugaauugggaugagacccuaaccgcccauauauacuuuuaccguuuucaguccaguucacagucuagauaaucaugucuauuucugaagguucugguacaguacccaguagacuuaguaaaugguagcugcuuuaccagauuucacuguaguuacuguauagacccuggaaugagaauggaggaggggagaagaaaauggaugaauggaugaaagugugcauauaaauggaaauugucccuuccacuaggugugccugugugugugugugugugugugugugauggcuccugugcucaccgagcacagaggcugaacuugcaaugcuuugcugaaucaguuccccacagccugucucugcuuccccugaauccuggggauccccaugcagguucacaagcuuaugcagcaagcaccugacccccuaagcugccuucccagcccccaugcauucucucuaaggagcuuauugucuugguaacaggugagaguguagcugguuugaaacuuuugacuuccuguugacuuucucugggugacuuacuuugcacaguuugcaaagugcagagugcaacuggugucagcuuugugcuuugaaaauaagggagaaaauaaguaguuguggcauaaaucugaaaaaugagcugugccaccccccacccucuucccagcuuugauuuuuguaucuuacuuuuuuuuuuaagccucugguuacuucaaaauacucuggaaauagagaaacauugugugcauucuugggacaguccuguuguuuguuagggcuucuucauagcuccauucauuccuacccuucuuauuuugcauuguuguaguuuuaaaaauaaauuugauauugacucuuaaguauuaaaauuuaacuuuuuccuuccauggccaugagucucuuauucuguuguccuugguuaccuuggaaaugcuuugcuguucuaacugcaaaaggagaaugaacaucuggacuguacagacucccagggggaugcuguucauggggccaggcuccgcccagcauuuacagugggaacuggccuugcauuugauucugaguuguaguccuuugugacuuguuuguaaaccagcuccuucagaaucccaggcuaacagauuuugaaucuauggucagaaggaugcccccuuuuucucaguguauccuuggaagggaguagguuaacaggcgaucauuuuaugcuguccugaaaucugaauuggugucucuggaaugucuugaaucaguuaggguggaauugguuucccuccagcugaauucaauuucucuuuuaugauuaguaguguaguuacuaugauaccacuccuugugcaucccagcucuugcugugguucauuugggaccugcugcuguguguuaggugaagggauuagacaucucuucucuuugaaagaaucugugguuccguggggagaaaccgauucuccaggcagaucagugacauuaggucaugucugcgagagcaucuauggagaugauauagagaacaggaagacuggaccacuuacaugugaucagagcaucuauggugaugauauagagaacaggaagacuggaccacuuacaugugaucagagcaucuauggugaugauauagagaacaggaagacuggacugcuuacauguggucagggauguggaugaaagggccuugaauggaagccugguguaagaggcuccaaggugguuuaauccagucuuccauaucugugucccuaccuuagggaaauauuuauccacucuugggcuggugaucaacuaggccuuugguggaauuuuccuauccauccagacugcagaaggcuccuuaggccaagaauuuacagaggccuuucaugguggggaacugcacuucuggcuuuuggucagaauuguagcccaagaaugaagucagcucuuugcuaacauuacucugucucagaugcuugguggccacauugguugguggccacucuguugcaagauguagauucaggacuuuguucuccauacuuguaggaagucuuguugaugagcacaguuuuaggcccuugcaacugcaaaaugcuucaccugacaguaccagucagugagguguggaacuugcagagccucagguuccauggcagagcuguggaaauagagggugcauuuuaauagcacucucaagagcagugugugcaccaggguuugaaaguacuguuguaggcugcccugaguccuggcuguguucagaguugccuggugggggagggggugucuguugccuggaagaaccugguucugcucuccugaauucugauuucauaagauuugggugaggccuggagcucuuauauuuguaaaaggcuccucccuaguugauaaucacugauagacaggugauuaugucauguugugugccagguagugaugaaucaagguuaugcauaacuuggggauaggaugugguuuuggaagggaggaaacugaagucaagaccggcaucucugcagaggugaccuuugagcagucuggaauguagaggcugccugcuugcaaagaccuaggcauagaggaguccugaaaaagggcugagacguuaguaucagggcagacagaaggccugugaucagaggugagggagagcagaggggccuguguggagggguggcuuagguccagauagcacugggcuuuaccuuggggagagaauuugcacuuuggcuguggagugaugugaagcuguuagaggguuuggggcucagacucccauggucugauuuccuccuuaggauuuacuuuuuauugauuuguaucugugugugacacucagaaugcagauguccuuagagcuuaugcagcuggaguuguaggcagcugugauuugcuugguugugagugcugggaaugaaacuuguuaccuccagaagagcaggaaguucucuuacaauaaaccauuucuccagccacugcuucacaguuuaaagacauuucggugcuuguuccuagucccaagagagagguggggagaccagcaagggaguagggguucauuuggaugcugcggugguggcagugcagaaguguccuuugaacugggugucauucccugguacuugaagcacgggucuccuaucauccccaagguaaaaugacacuguccagcaugccuuagugguagagaccagcucuacugugaagauuggcuggcuggaggacuuguauugaaacagucuuuuuuuguuuguuuuuguuuuuuguuuguuugguugguugauuuugguuuuggguuuuuuuggggguggcuggguuuuuucgagacagguuuucucuguauagcccuggguguccuggaacucacuuaguagaucagucuggccucgaacucaggaauccaccugccucugccucuugagugcugggauuaaagacgugcaccaccacaccuggcuauaacuagcauuuuuaugagcuuuaauucuauguuaagaaaaugugcuuuugccaguugguugccuaauaccaaauggucagcaccgaagccagacauauaaauaauauuauacagauugugcaggcuguguuuacauguuuagggaauauacauguauguauaaaauaacaaaggaaaagagagguuauaaauuugaaagagaguaagcagggauauguggguugguuuugagaauagaaacgaugagauuauauuacaauuucaaaaaauaaagaaaaguaauuguaaaguaagaaagcauuuaaugggcucauuuaagauuauuucuuuuugagagaggucauauuggcaccauggagucaugugacucuggguuucagcaguugacaaaacaggaguucugaccacucugguugguucuucaaugcccuuucauuguacagagguggguuuacuuagugcaagcugguguccauugagucucugcaggccagcuuccauuguugucaacuuagaagagccaagacugacaacuccagagauaucaagugcuaaccccuggggagacagguagcauuagaggcccuuuuuuagaggcuuuucuuuucuuguuuuacuuuuuagucagggcuucaggguugccuugaacucuauguaccaaauauaacuuuggauuucagauccuccugccucugccuccaccuucgaaggcugcaauuacagcauguguuaucauguuuguuuuauguggugccaaggaucaaacccugggccucuugaaugccaggcaaacauucuaccaacugagcugccuccguagccucuagaggcguuuacugagaggccuucacugcuacagagugaguugucuaauaauauaccuggucccuuagggcuguggguuccagaaaaccaucuggguuguguacauaaaggccucauagugaacggacucaggcugggucuucuaggccaggagaucugugugugguggcugcugcuucuuagaggggcacaagcuaaaccauggcaauuaagguaacaguuaggaacagaccuuccaccuaggguuuuccuaaucaucaggauauauucuucucagaucaaaaaaaaaaaaacaaaagucuccaaaacuaaugcccacaggaacauggcagaagagcagaagaggggcuaaaaagagcaucagaggacacauuugguaaaacacuuguuuucuggauauaaugcgaccauugcacccugggcagugccauuccauuuauaugcacaagauccagccuaacagauauugaguaauauuccaucaggcagcacuaagugaccuuaguaaugauggugauggugaugaagaaggagaggaggaggaagagaagaagaggaggaggaggagggggauggagggggaggagaaauggggaaacuaggaggaaaaagaagacacaauggagacaugacgguggaagugucagagaggauguaguaaagggaggaaugagagauagaaacaaucaagauauauuuugugcacauaugaaauggucaaagaauaaauuaauaacaaauaaauaauaaaccuuccaguucagcucacccccgcuuccugaccauugcuuugccucuaaaaacccuaacacuaagaacccuaauccuaaccguaacccucuaauagccuaacccuaagucuaacccugcuuacugugagggaaaugucuucaguauaccuuuugaagugagaaaccauuucuuaaucuugaucuuuugagaucaucagauccaccuccaaucuaggcaauagauucuuuuggcauccuacauacauaaaagacaaugaacaggguuguucuuucauuuuuuauacuugcccuauuuuuguauguuagaaaaggugauuugcuaguuugauuuuuaaaauuggcauugaaaaauacuuauuucuucagaauucuaguacauagugaauaucagcuguaauauccugcaacaugagauaacccguccuugauuuuucuaaguucccuuggcagagagccuuucuauauuaggcauuagagagacauucuauuaaauuuccuuucuguauccacagagaaauucauucuuauuugagauauguucaucuagagaaccuguccuaauacaacuguggcuuuucucuacuuugccacugauggcgaugugcuggcuaacaagauggcucaacagucuuucccuuacauuucugucuuucuucccaggguugguugguaccuaucaucugggaaagggagcugcagucucccugagcccagcacugagccacaaacaaaacucuuguuuguuaaauucccucuuuaauguucauugccugggcacccucccacucagauugauaaccccacugcaccuuggguaaugggcuaugcaugcucuuccccuggauuucaggaagaagaagacaagugcugugaggcaagcucaggcaaggucugaagucagguccugguaaugcaggaucauugcucacagaaaacaggagcaggcagcugacuagccugagcuggaauguguugggaacuaaaagggggcccuggggaagaaaggaaaggggaggaaggcccacacacugccagaguuccaccuaugcucuggacagagaugugggagagcugccauacauucaacucagccccaggucggcaucuaagccuuugacccacucuuugggucugaacaaggagcagcccaaccugggagccccggggcuccuuuccuaaagcccugggguuaugggagagagggaugagggaugagagguucccacaccggugagagagcacaguggaucuggacuggagcacaagaaggccuuccaucuggagaguagaaagggcucauuacgagaaagccuaucccauccuccaagcacagugggccuugaugaacagagacauucuaugguuuuagagcuuuauuauagaaaggcagggagaaagagagaagguagaagagagagagaggccccccuagaagccuagaaggggggaggcuagauagaaagagaguaagagggagagaggagaggagacgaggagaggagaggagaggagaggagaggagaggagaggagaggagaggagaggagaggagaggagaggagaacacaaagagaaaggaaagaggagagaggagugcaagaagugagagguaagagauugaaggagugagagcaggagagauaggcggggcugaacaacccuuuuuauggucuuuacuguugcuagguaacuggggaggaguuuagccugaaggucagaagcuugggacauugccuacaugacuuguagccaggcuucucuuguggugguuggggguggcggugggggacaguaacuuaggcaggagccugaguuccagaagcaugagggaauugaugccuuccuugucacauaggugaauuaucacccucccggguucagaccuccacucaacuguagaccaaccugucgucugugcauagcccaaugccccaccugaauggugaguucucccccagagcugggaggaguaaaaguccucuuggggaacuggcucaaaugcuaauguagugcaaaccacaccugagaucuggaaaagguguggcccuggacuugaagcacacuuuaaccuugaggaagggugagacccacuggccaaucaagaucuccacaggcagaccugccagucagacaaggaggcgggaucuuaugggugccuuuccccaaguucacuuuggcucugcaggcuugaaugguucuguguccugcucugacucugcuguuggguguugugagaggaccucagggaagcucugaauucgagacauggugagcacaggguuacugcccacagaggguaggggcagggugcugagcaguggaagcugggguggugaguccucucuggggcuggaugggaaguauaagccauaugugagcaccugugaggucucucguguugcuccucacuugcuccaucagggauugaccucugauaacuuccauaucauugcccauaucguuuggaccuuaguuaggcuggcuugugaaaacaagggugguuucuuugagucuguagcacacauguccaaaccccuuugucuuuuaguauacauuaagaagacagguaaaaaucuaauaggucugauuucauacauuauacuuguuuuuguuuuguuuaaguuuuguuaauuuuuguucuguugcaguuuuuucauaucuuuuacuucauauguuuagugauuugauuauuauuuggcaaagggacuuuaauaauuucagaauuuuuuaugguuuuauugaaaaauuauagaccucugagaggauauucuucuauuucgacuguuuguaauuucaccuucacauauuuuacagaagucccaauuguuuguugccaugaaacuuuuagaauccacauuuuuuaacugagauaucaauuuuuucucuucaucuugaaucccugagauucugucuucuuuuccuguucugugggugaaccuugccucuguaguugucaguguacagguaaucucauguccugcucuuagggacuuagcaacagcuuaugucauuuccugccuccauccccugugucuguugucaggcgugcuuuauauacauggaccaccagcuauagcagcucucuauuuuuguucccugucucuguucucugcacaugcacacucucugucaucucuccccucauggcucucuuucuccucccugucugugugucugucugcagguccucuuguguacuucuaucccuuccccagguucucacuccucucccuucccccaaacaaccucuuuugcacuuuaucuguugcaugcuuuaauuucucagaccugcugugaugagauagcuuggauuucuugguugcaauuguuccuggcuguuacucucuauguugcuaugcugguguguagccaucucuguuugggugauuauugaccuagguacuggccucuggguuugucuuuuugggugggaguuuuguuccuggguuacuguuugaugcauggauuugaagaguguguucacugacaguuuccuaucuuacugaccuauuuuguggguauggucaacagggggaugcuuugugauauuaaaagcugggagaagagacaggcaggaacagaagaucuuaguaauccacaaggagacauagucaggagagaggucaagcagcccaugguguuucauacaauguuggaacaacugggaaaauugaaucuggguuaagaaaccaaucaugaaguugaucuaaggaaccuuaccuuguguccuuucaggcauggaaugugguagaacagggaguaucugcccaagugggggcugagacacagggaucaggcaggaauggauaggcagguggggauugucuaugguguuuauaggaggcuugcacaggaggagaggaaauuuccacugcuccucuguuccagugguaacggcagcugauaauagugucugcaguaacagauagugagguaggucuuuggacaaagucuagucuacagacaggcaugguugugguuaaccaggaguuucugucuauaaucaggggcuuaggaacagagaugaguuuguaaaucccaaagaguuugcuuuuugagaauguacauuuguacauuccagcaaaaaucccaugacaacauccccuuaucaacagccaguuaagguacaucagcagggucagcuacauagagauaacuaagaccuccuauagaaaacaaaaacagaaacagcuuacccauuaugguugucagauuuuuuuuuuuuuuccucccuugcuugguuccugcacauuaugccagacgauuuguaugcaaacuccccacucuuguuguaacuacaauaaauacucaaaaccucuagacuugaucucucaguuuguaccuaaugggaguuugacugcugagaguccuuguuacugagcuuauaaaaaagaccucuguguguuugcuuugcaaucggcucugugcuggucauugcaguuucugugaguugggcauaaaaccuugaugcuuugacuggaaccccaagacccucaggacucccauuggaaggguugaaagaccgcuguuaggaugugucauugcuguucuuugugucagugaccugucugucagaaauguguccguguacauggagcuuaaucaguuguucccauagggucuggaagauuggaguguugauaguaaugcagccacacgaaguugaggucauacuauuucaguggaaaauagacugaaaaacuuuaggaagaggucauuucugugauauuuuggccaaaaaaaaaaaaaaacagaaaacuuuuguacuuggcuuauguccugagauauugaguaggucaaacaaacaaacaaaaauauugccugauuuguauauuuuuaugcgauugauaaguauuuguucaaucuuccuauuucuuuuuuuuuuuuccucugagacagaguuucucugugucucccuggcuguccaggaacucacuuuguagaccaggcugucuuugaacucagaaaucccccugccucugccucuugagugcugggauuaaagucgugcuccaccaugacccgacuuccccuauuucuuuauucaauuuacauugaaaacuuuaggaagaagucauuugugugauauuuuggccaaaaaaaaaaaaucuuuguacuuggcuuauucccugaaauauugaguauugauuaaaaauuauugcuugauuuucauauuuuuauucuauugauauguuuuuguucaaucuuccuauuucuuuacucaauuuacauucuaaucgguacaaccaccccauuccaccuuccacagucccucaucacugacucccuuuuaucuccccaugggggguggggaccacuugaguaucccccaacuauggcauaucaagucucugcaggguuagacacauccuuucccacugaggucagacaaggcagcccaguuauggaaacaguuuucacagacaggaacaguuuaagggacaugcccugcucuggauguuggggaccccaugaagacugagcaucauauccacuacauauauggugggggccuccaucccagccugugugugcucguugguugguggcuccaucucugagagucuccuagguucuggguuaguugacucagagggucuucucauggacuuccuuuuccuucagaggccaucaauucuuucgagaacucuuuuaaaauaaucccugagcccuguccaauguuaggcugugggucucugcauauguuucagucagaugcuagauggagacgcucagaggacaaugaugcuaagcuacuaucugcaaguauaacaaauuauccucaguaaugcaagccuuggugcuugcccaugggauggguuaccaguuggucaggguauaguuuggccauucccucagucucuguuucaacuuugugccugccuuacuugcagacagaacaaauuuugggaggaacgguuuuugguuuucuugguguacugaacacuucacugcugguucugccugacugcaagaugucaccccuucugguccauaacucagugcuaucuaucucaguuaagaucaccucucuagcugcauuugugcccucccauucauauucucaggcacauucuacagaugccuccacccuaacccugcucccucccagcaugugcugauuucauuucauuuuccuggcucucuggccuucccuugucucuuaccacaccuguuccuaacacuccccuucuuucuuaacuacugucccauccaguucucucccuuccgucugccucuucugucucuuucauauccccuucugagugagauucaaccaugcucauuugugccuugucuuguuuacugucuuuaggucuaugaagugcaguguggguauccuguacuuaugguuauuauucacuuguaagugaguauguacaugcaugaccuuuugggccugaguuaccucguuccagauauuaguuucuaauuguacccauuucucugcaaaauucaugauguccuuguuuuuuacaccugaauagcacuccauuuuguaaaugaaacaugguuuuuguguccacauuuuaguugaggaacaucugcauucuuuccuguuucuaacuguuaugaauaaaguggcuaugaacuuaguggagcaaaugccuuuguggggaugcgccuaugaagguacccuaaguguagcacuuccuccugcuuguauguuuuaaauuaaugggaggaguauucacaguguuuccucaucccaggauggaaccuuaaacaaaaccugcugcaaaugugguccaagcgaggcaggguccauuaauuuagaagccaaacuucacaggaucauccacauugugccacuucuggaaacugaaagaugaaaauaccauggucauagauucuuucucuaugguuucaguuuagcaccacuccagccaucuuuugacagagucaggaucccagggaagacucugugagaguuccuugcauuuaaguggugagguugaugcuugaguugcauuuugugaccacagguuguggagaaaaauaaugcauugagaaaucugccuuggagagaugcuacagggagaugaaguacccaaacugagagauguaugagaaguuacaggaagagcaccaucuaugccuuuaggaauugaaguccaauguguuugagacaaaacuaggauuuguuguuugcccugcuguuuuucuugccuuuguccaaucuucucucccugugugcacauuccuaucgauuggaaugggaaggcguauucagugccauuuuauguuggaaagauacaucuugcuuucugauuuugcaagauguggcugucaagauauugccuugagugucagcagagacguuagacauuugaacagugcaggagccuuucuagauucaucuuggggaagaugaaaguguauauucacucaaaauuuuccuuuuucuuucuuuccuuuuuuuuguuuaucuuaucauuuagauauucauuaucaccuugaucacugucccuacucuaggucccugcccucacagacucccuccucccaaucuccucuguuucuccuuugagcaggguuggggcccucugucuacccccugggcacauagguuauagucuauuuuuuaggauggcauaugcucaugacaucaauacugacuguggcuucagagucauuggauucaggguguugauguuucccuaaacucuuguguuuguuuugaaauuuuuuaauaaauaggaguguuuugccugugugcgugaauaugaauaucaugugugccucaucguuaguguuguuggaagguggacucagaacuccuguucauaaagacaugggucacgugaaugcuaguauugaccacuguuaucuggaagaccagcaagagcuuuccacggcugaguuaucgcucucuccugccuuaugcugcuuuuuauguucuacacuuacauuacuaauauuuucaucuguccauugguccauuaaaugugccuugauugcuaguaaaguuuuacuaauguugcauuuuaaagcgguacacuuccuguuucugcuagauuaguacagaagugcagggaauguauucuucuuuguaggaacuguaguaaacaacugaguucuuucuaucauuuuugucuccgugguugauuuuugcaguggaguaagggucuuaauauguaacuuuugcuguccuggaauguguuacauagaacagacagggauccagcucaaugacguauaccugcccgugacucugggauuaaagacaugaacaaauacacccugcuuguccaugauuuuucuccuuagugauucuucuuacaauuucugggauguguccucaguacuguugaucuguuucacccuacaucucccucucaauuggaauuccucucgaaagacuuuacccuauuuauuuaaaauguucauaagcaacacaggugaaccuucaacucaauuuccuuuaaaauguuaugguacuuagauuauaacuucugugucaggaagucaguggaggaagcaccacaauuacaugaauauauggucaaggaagcguacauuuacuuuacagugauuucaguaccaugcuuugugauguacacauguaugggauauuuuaggaugcagugacuuaugaugaugugcaugugaacuucacuggggaagaguggaaguugcuggauccuucccagaagagucucuacaaagaugugaugcuggagaccuacuggaaccucacgguuauagguaugacugugaauuuucuuuugcuuuucaaaauagugggaagacaugucucuuggugaaugauggugcucuguuauuucaaucgagaacaaggaagauugaguugaauaaauaguguccagugaugugaaaauucacaguaccuugaauuuuaccuuauuuccaauacuauaucauucauuuuucugguacugucuuuuaggcuacacuugggaaaaccaucaaauugaaggacauugucaaaguucaagaagaaaugaaagguaauuuucaugugcaagcugaugcaauuaugccucugaagaaauuuuacuauguuauggaagcuauagaaaagcaggaguguaaaaugucaauaauucaaguguaacuauaauuacaauauucuuuuuuuuuaagauuuauuuauuuauuauauguaaguacacuguagcuguccucagauacuccagaagugggcaucagauuucguuacugaugguugugagccacuaugugguugcugcgauuugaacucaggaccuucagaagagcauucucugcucuuaaccacugaaccauuucgguagcccuaauuauaauauucuuaacaaaauguugugccucgauguaguuaucugauuuaucuaucaaagcauuccuccuuuuuaaaaaaagacaaggaaacauugccuuaagagauaccuuuauucaauuuguaccuccauuagagcuauacugaucugacaauguguauagacuuacaagacuuagauauugcacaucgaauagugauaaauauauauccaaaaccuucagauuagcaaauaauccaugggaaaguuggugauacucauauucuuauagugaaauugaucauuuguuuaggguacuguuuaugagagucaagaguauugucauaggagaaaccuuaauucauauauuacaugucuaugaggaacaaaaagucaaacagugugaaugcaauguggaaaccuuucaucuguuauuuuucuuuuaauauauauaucaugugucacaauggauaaaagccauuugagcauagggauauugaaagaagcaauguacugcuuucuaucccagaaaagugagaaaauaugucagauucugccuuugguagacauucuuaauaugauaaaguuuguaaucaauugguuuucuaauuuuccugggaacuuccccaagcucacacuguagaaaaucuuuauggguacuaggaauuuggaaauucuuuuguuuguccugguucacagucaaaugugguauaauuacgcuacaggaaaaauuaugaaaguaauuaguguuauaaagcucugagguguuccauuuuccacauauagaugaaauacaucauguaaauaucccauacaaaaaggauguuauaaauaucagucauguaauaaccaucacagauaucucgaagaugcaaaacaacccauaaugagggagaaccccaugaacauauaaagugauaaaaccagaugaucugguacaucuuuaucauuagaccaacuuguaaacuuuauuuaucuugaugaaaugauugaacagggaaauuaauguaguaaacauaucacaugugccaauuuucauugcagguauguaaauaaucauaguggagagaaacucuaugaauguaaugaacguucuaaagccuuuucaugucccagucaucuccaaugucauaaaagaagacaaauuggagagaaaacacaugaacauaaccaaugugauaaagccuuuccaacacccagucaucuucaauaucauaaaagaacccauacuggagagaaacccuaugaaugucaucaauguggucaagccuuuaaaaaaugcaaucaucuccaacgucauaaaagaacccauacuggagagaaacccuaugaaugucaucaaugugguaaagccuuuaaaaaaugcagucuucuccaacgucauaaaagaacacauacuggagagaaaccauaugaauguaaucauugugguaaagccuuugcacaacucaguaguuuaaaaugucaucacagaucacauacuggagagaaacccuaugaauguaaucaaugugguaaagccuuuuuacaacacagucaucucaaaugucauaaaagaacacauacuggagagaaacccuaugaauguaaucaaugugguaaagccuuugcacaacacaguaguuuaaaaugucauuacagaacacauauuggagagaaacccuaugaauguaaucaaugugguaaagccuuuucaaaacacagucaucuccaaugucauaaaagaacacauacuggagagaaacccuaugaauguaaucaaugugguaaagcauuuucacaacacagucuucuccaacgucauaaaagaacacauacuggagagaaacccuaugaauguaaucaaugugguaaagccuuugcacaacucaguagucuaaaaugucaucacagaacacauacuggagagaaacccuaugaauguaaucaauguaguaaagccuuugcacgucacaguugucuccaauaucauaaaagaacacauacuggagagaaacccuaugaauguaaucaaugugguaaagccuuuucaggucacagucaucuccaauaucauaaaagaacacauacuggagagaaacccuaugaauguaaucaaugugguaaagccuuugcaauucacaaaguucuccaauaucauaaaagaacacauaccggagagaaacccuaugaauguaaucaaugugguaaagccuuugcacgacucaguaguuuaaaaugucaucacagaucacauacuggagagaaacccuaugaauguaaucauugugguaaagccuuugcaggucacaguaaucuccaacgucauaaaagaacacauacaggacagaaacccuaugaauguaaucaauaugguaaauaaagccuuugcaggucacaguugucuccaauaucauaaaagaacccauaauggagagaaaccuuugaaacguaaucaaugugauaaaagacuuuucacaaaguuauugucucuauaaucauaaaagaacccauauucgauagaaaccuuacgaaugucgucagugugcuaaagccugugcauaucccacucaucuucaaaacguuaaagauuccacacuggaaagaaaccucauaaaagcaaucaaugugguaaauaaagacuuuuuacaacucuauagucuccauuauuuuuaaugaacacauagaagacagaaaccuuaggaagguaaucgguguaguaaagcauuugaugucacggucaucuaaggugacaaaagaucacauacaagugagaaaccacgugaauguuaugaacguaguaaagccuuuguaugucauaguucuuuaggcacucacaagacaaacugcacagcagagaaaccccaauuuaaauguuugcuuuucucagaguugguuuggucaugagaucugucccuagccauugaaaggcuguuggagaaacccucugauuauacuuaauguggcaaagccuuugcacaauuuuguagucaucuucaucauggaagaauuugaacuggguagaaacauugugaaucuauuuaguauggugaagcuuuuucauugaacuucuuuuuauguauauucuucuuuuuaugagacuauucauacuggaacagaugcuaugaaugucagcagugugguaaagcuuuuaaguuguugggcccagucagguucaacacaacucacacuccacgacaaugcaaaggauaagaauuuauugggcuggguggugguggugcacuccuuuaauccuagcacucgggaggcggaugcaggcagauugcugaguuagaggcccaacaagucuagagugcguuccaggacagccagggcuacacagugaaacccagucugggaaaaaaaauuaaaaaaaaaaagaauuuauuggaauuaagucacuacugaucagugagagacacaaaaguauacucagaaguuuaucuucaaaaccccaccgcccacacccaaccugagacagaaaguuguauagcuuucagacacaaaaaccucaaaguccugggccaauuuacagcuacauuuucucccaaaucaaaacuuauuuuuauugaaugagucaauaaauggugauugcuaacuccuuguauuuuuuuguuguugcagcugugggugguguugguguugggcugugugugugcuuucccuucuuuuguagacaguaagagauuauuuacuacccguguauccuuaacuuccucaguuagauucuaccucuaucucuuuguguaggucuguauguuugcuuaaauuugaguuuaucauggacuaucuuaauuuuuucuauuuacaguguagucauuuuuuuacauauuaaaauccaggcaucuguuguuucugcggcacauguguauaaacccuucuggcaucuacagacuccaaggagaagacaucugugaucuuaauagaucuuccuuuauguuuuuccuggcuuuuuaccuuugcagcuuuuaguauucuuuccuugaacgguauguuuugauuauuacacagagaagagacuuuauuuuuuggucccuucuguuugguguuuugaugauucuuguguuuucuuuauguuaggaaguuuuucuucuaggauuugguugucaauacuuucugaaacuuugagcgaggauucuccuuccucucauccuaaguauucuuauguuuaguccuuuuacaauguccuggauuuccaugauauuuuauaucaggaagauuuagacuuaucauuuucacugucugauuuacccauuccuucuauugcuuauccaaugauugagauuuuucuuccaugucuguguucugugguugaaccuugccucuguaguuccuuuuugcaguccuaaauuuuuauuuccacuauuuccuaaguuuugguuuucuuuuuuccuucuauuuccacuuuuauguauugaauaguuuuguuuacuucacccguuggugucuucuuucuuggcuuuauuuauaggaauuuuggcuuccucuacauuuuguuuuguguuuucuuggccuucuuuguggcauucauugauuuucuacauuuuuuuuucuguuuuccuggauuucucuaagugauuuggucauuuccucuuuaaggaacucugucaucuccauacauuugggguuagaguguuuuucuuguaauguagcuuuguuggaauauuuaagacuuucuuugacaguauaaaugagcucagagucauuaaccagagagugauaaauguugguccuuauuacauuaucgaguaccaaggucauggaauggaauggcgcuaagcuaaguauucagcuuagauuuaacccgaugugugguuuaucccaagguuauucuuucuccuuacacuggauggguagccaauugaggcacuuuuugugagacaccuguuuuuaucacuacccuuggagucaucauuaauaaaaaaaagacgugauggugacaggguaagcgacuuuguaauuuuccagcauguauuuauucaugucuuaugaaugaagacagaccagauugauagauauguaaauuggggacuuuagcuuggucuaagcaauauugaauuucuuacuuuggagauauguccaaugcaccuucaggcuuuagucagcucagaugauugugacacaggccauuggcuguaguugugugucauguuacgucaguacagugaccuguccuuauguaacauuucaaccuacaacaauauauugauauaucgaucuacauauuucuauaucuauucaucuauauauguauauaccaucuauauaucuucaucaguacagucaguacagugaucuguccuuauguaacauuucaaccuacaacaauauaucgauauaucgaucuacauauuucuauaucuaucuauucaucuauauaucuauauaucaucuauauaucuucaaucuauacaccuauauaucaccuauuaaucuauauauguacauaucuauauguacauaucuauacaucuauauaucuauccauauaucaauaaauauauaucaauauauuaucuauaaaucuuuauauaaaaucuacauuucuuaaauuuauauauauacauaguauuauuauuucauauuauuucuuauuauuagauuauuaucauuucuuuuucucuucauauuauuauuauuauuauuugauacaucuauaauuuauguggugguaagaaauccacaaguaauauuuaccacaaaaaguuggcuguaaaaacagcuugugcccaaugacugaaauguaauugaaaguaagauuugguuuuacaaacuuguaaccacagaacccaacagacaaaacagaaacauggccaacagucauuuucuugggauacaggaagaaaguccuuuugagucucugcuaauaaggucacacacacacauacuacauacguacauuaacacauauacacacacaccacacguauaaacauacacgcaccacacauacaccaagcacacacacauaaacacaauauacacaccauacacaugcccccaccaaaacacgcacacgcacguauaccacauacuuauauucacacacauacacaugcacacacaccacacauacccccacacagucacauacauaccacauagauacauucgcacauauaaacauacaccacacauacacuugcacacauacuuacauucacacacauacacacacacacauacaccacacagcacauguacacacacaccauauacaaacauucacacgccuacacacaccucccuuuuugauucucguucauuuugcuuaacaaugauuucuaguuccuucuguuucugugcaaguaucaugauuucacuuuucuuccugacugcaugaaaucaugucauuuguacucugugaucaauuugguuaacaaggguuaacgcauaaguagggccugggcugaggaauuugcauuguggguguuccacauagccaagagugacaaggcaugucccagagucucuucucccucagugagccccuuggagcauggcucuugaccaagguuguggggaaggcagaaugaagaaaucacuagcugacauuguauaccuacuugccuggugauugcugcugcaaccaccagguugugugucugaugaccuuccacagguuccaccauuugccugcacuuugaccccaugagugucaaaucagaacuccuggaagcuauugaaucugggggcuuugagacacuuugagaaaauauggacaagguggagcacgggguauccgaggucagugaagcuggucuguauacauuguagaggacauggaucugugaacccagaacaugcagcucaaagcaugaaugcuguguaggcuguagacugagugaagacaaugauuguccaugcuacauucugguggaggguguugaccagaugggaccagggaaugucuuugugccucucucucaaugucucuaugaaucuaaaacugcccuaaaauaaagucaguuaaaaauacauaugggacccaaggagcuaaagggguuugcagccccauaggagaaacaauaugaaccaaccaguacccccagagcucccugagacuaaaccaccaaccaaaaagaaucccauggcuccagcugcauauguagcagaggauggccuagucagucaucaaugggaggagaggcccuugguccugugauggugcuaugcccuaguauaggggaaugccugggccaggaagcuggaguguguggguuggggagcauagggaaugggggaagugauaggugauuuucaaaggggaaacaggaaaggugauaauuuugaaaugaaauaaugaaaauaucuaauaaaaaauacauauggggacuggugggguggauccaugcauaagaguucuuacuuuucuuugagcagacccuaguucauuuccucccauguugagaggcucacaaucacugguaacuccagcucugggggaucuggugaccucuucaggccuccacgggcaccugcacuaacgugcauauucccacacuaaugugcacauaucuguuagggaagugcauggcuuuucuaguccagaucuuggauuuuuggucugagucugaauucagggguaguccuuuguaaagcacuggguauugagugccugcuuuguuuauagcuccuggcuaggcacugaugcaagguaaugaaugaagugaugcccucuugacuucauggugcccagucaaccuggcugugugggaggggggcagacacacaguccucaccccuacccccagucugcagagcaagggaaauccuagguccuccugcucuuuaaaacaggcucuggggcaaaccaguacuugguucaggaagaacauugcaaguaugaccacugcugugaauggagagacucugcaccauaaggggaaacugagacaaugcuguagccuaggaagagaaguugugcucgggugaaaggacuuuucugucccauucugacugccacuuagcucuugagucaauuacuagccucccugugagccccauuuucccucucaaggaaauggagguaacagagggccucccuccuuguucuguccugaggaucucaggggacaaugacagcuuugagugagguacaagacuauuuaggaacagucccauaauacuguucacugggaagaggccuccaguccccauguguagagcagacagggaagagagauggccuucagagcuggcucuacaggggggcuaaguuauauucaugaugcugacuguguaucuuugcccagaguggugaaggcuggugugcugucugaguugggauauauuuuuacuccauguguacauuuucuaugugccauuuucugagccagggaagcaugucugggcaauaugggcuuugaggaaaaggccuggcucgggucacucccaauaagguccagagcaggacccuugggugcuccuuugagccuuccuaagcucagccaggaugcuccaucaagcauccuaaugaccacaagggaaaaagguccaggagccacacacagcugcaucuggauagcccagucaccaguugaguuauaauuaauauuccgaguccagagagccauggcuaugacugucacccacacuggcuuugugacaauguuauugcagcugagggugagcaguaucucaccaggcuucucaucuuccuauggaggaucauaggaauuauaugcacacacacacacauagaacaugcauacacaaaugcacacaugguacacacgugcauacacauguaaacacacacacauucaguuuugcuuggguacuuggggcaagugaagggauguugugagcucacccuggugccagugcccuaugugaccuguggucuucuuuuacggguauggucuagcagcuugucgagccugugcaucaucccccagugguucugaucccugcucugccuuggccuccacuugguccuagaaaagucaaccugaggccaaagggccugcagagcauuagagcuauggaugaaaggggugccauuuacagagacuguggggacagccucuucagugaucucagaggacaggucuggaaacugaggcugagagguaagaagaaccuuguaaguaccaggaugaaccaggccuacuuaaccaugaggccagcaucaccaccauuguuucagagcuugugcaugugucaugguucuuucuaaucccaauggcugcuaccucaagaggucugcaagaugcagaggcaaaugucaagcagcacuucugucccuggcucugguaaaugcaacuaauucccuagagacuuagaccagcacuucccagcagaccugggaguggcugggucucccucaccccuacccccagcccaagacacccaagcuccuacagcauucaaagagggauuuucauggcacaggguguccucaggacuuccuguggauggaguuccuuucuggccuucaccuucuggagggagaggauaucuccugcugccuuuuucuucacucccccacauuccauagacacucuguccagguugucagugagucugaaggagauacccagaaagaggcccuuguccucggaaagagggucuuugggccuccucaaucaaaaauagacacgauggaauaucgugugcagugcuggggcuaaagagagcaguuucugagucuauaugacugaaugucaccugcauacaugccuccaggccccaggguccucgacuccagaugccauccaugcacaauuauaucguaggguccagucaagccuggaaacugaugucuggaagcuggagcagacaaagaggucagaggaguacaaguucuagccuauagugacucuucuuauccugaggaccuuagaugcuuugguguacacccagugacuccucuguagccaaacacaccucgccacugaaugaggagagucugggucagauaguucuuaaucuuaugucagaacuuugcuauggggucagaagucagaggaugaucaguagaaagaucccucugaugauuggcaccuccuccauucccacccaccugccuguguaugaaagcauguacaagucugggucacagccuguugccagcuguccacuuugguaggccauauggcugugcucagcguguauuaagaauaugcucugucccuagugagcuugagggcucuggcuucuaauggcaaagaaaagcaaaguaaagccugggcauugaacucauuauaauauuggaaaaaguaaagcuggaaagagguuaggcuucggagguuguguguagagucuucccauuuugacaaaguauuccaggagguaagagaugugagcagggagagagccugaagaaggugugggagcaaaaggcccaguggcagccauagggcuggagacagaagcaguggagauauucguggccagagaggaugggaagaugggucauucugaugggguugcaaugagucacagccuauagcucagagcucagcauguacugagugacaacucagugguuguagguaaugaccuguucccucccucccuaauuuccccacauguucgugcucucucugugucauagugacucaccucugagcacauugaggcuuucucugagcauccaucuuucccguccacccgucagcaucuucuccaucugcccaagguuagggucauucgcucagcacaccuucaggccaaguccaugcauacuugguggcuggaugaaugaaugagcaaaggacucauauuccuguguguaagaauagcgagcucccaggggggauaucuuccggaguccuaugugguacucuaaggaguccuccuucuaacagcuuuuccuccugggcucucacuggagccagaagggaugggagccucugaguagucagugagguaacacaucucuguguugggggagggguguuggugugugugugugugucuguaaacuuugcaacauguauggaaugaagugugagccacucccugagggucccuaacccucacacuccuguucccaagcaguaggcauggacuucccaggauaccugcugccaugagagaagguaccuuccuccuccugaaaccccaccccugugucuagcaagcccuuggugcuugggccccuguacuagaccugccccucagcaacaggagaucugcggucccugcccugaugucugccuggcuacauccuuccuucccuccccucauuuccuuuuuuuuuuuuuuuuuuuuuuuauuuucuuuuuuuuuuuaauuagguauuuuccucguuuacauuuucuuuuuuuuuuuuuccauuuuuuauuagguauuuagcucauuuacauuuccaaugcuauaccaaaaaucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagaguccagagcucagggguacugguuaguucauaauguuguuccaccuauaggguugaagaucccuuuagcuccuuggguacuuucucuagcuccuccauugggagcccugugauacauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucuuggguauccuagguuuugggcuaguauccacuuaucagugaguacauauugugugaguuccuuugugaauguguuaccucacucaggaugaugcucuccagguccauccauuuggcuaggaauuucauaaauucauucuuuuuaauagcugaauaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggaucccuccccucauuuccucuuugaaguacaggaguuaggaagucacuggaccuaccuaggaaugcuuccagaucacagugaccccaggcucuuuaccagcacagaacacgguuuuuaaugccacugcgcuaggugugaccuguaagagaagcuuuucaggucgguggcuucccuccucacagggugcuguacucagauggagcucauugaggaagccuguggucuuucacaguaaaaguccuccaauguccccaccgagcauuugccuggugguucaguuucucugucuccucauagcuucuguuucccuuucuuucauagaaauaggcuguaaacgccacacagagggaccuucacucuugguuuacagcuaaggagacaggacucagagaaaucaagguaucaagaacauauggguagaagggaaggcuguaggcagggauugacccagggaccaccaaaucugcaugucccauugcagccugacacagugaacugcagcuccuuuuagagagggacacacauaggcucagucaggaacaaugagagauauucuaccuuguucuuuucgaggccuggcucagcaccccuggguuacugcuggacccucccaggaguguugggugcuggccacuggccagggcaaccucugucauugaccaugcagaaccaguccuagaggccccaugccauuccccuggcuacuggggaaaggccguugcuggcuucuuggccugcagcaucagagcacaguuguuaugaccugucaucccagccaaucaggagcccaugugugagucauuccauagcugguucagggaccccaaagaaccugcugccuccagccugggacaacgugccaaccugagccugagugcugagcagcaaggcagagaagccuauucugacucaaucccaccaggacugacugcacaagacguccaucuguagagggacugggggaacgaauuggaggccucugcccucuccugcuugcagcaaugucuuacauauccuucaaaagagcacuuaaggcgugcugugcuccaguaauuucagcagacugaggagugucuugaguucaaggcuggacugggcugaauagaaagacuaucauagccagaugguggugagguucuccuuuaaugccaguacucaugaggcagagguagauggaucugugugaguuccaagccagccuggucuacagagcgaguuucaggacagccaggguuacacagacaaaccuuguuuuaaaaaaaaaaaagacucugucacaugaaaaugggagggggagggagaggagggaggauaggcuggaguuaguuaugacuguugguagaaugcuugccuaagauucacugaagucuaaagucuaucccuaagugcaccacaaaaugcaugcgguggugcauggcucuaaccucagcccuugggaaaucgaggcaggaggaucaggaguucaaggucaucguccuuuacauaaugaguucaguguccagccugggauacaugggacccugucucaaaaccacagguguggacucagcccacaggaagaagacuguuuguauaacacaggugccuguuccucuggcucagccuugagcuucuacugugcaguugagcauagauuguauccugagauguuugacuugcuaauucccuaagguuuccauaaagcuggacauuaggugaggaacgugaggaccuggaucugcccugccuuucaugucuuuccagcuauccccauugccaguuccuagucugcuuggguuggucaucuugguugugcuccauguuagcuggccaaccucugucccuguggggauacuaucacuuccucauugggcagcuguugugugcugcagggcagugaguucuccuuagcucuggcccuggcacacacccacacauugcuuuuugcuuuccccuccuccaccgcagggaacuagcugcccagauguccugcuggucccauacagaagcagaggccuguaaaaggucuggucuggugaugagcaucuuugaugauaaugaccucuugggaagaacaagaagccuuacuugggaccccauagcuggauugcuguccaaaaggagggacaucagcaucuggcaagugaacagccccuagugugacacauuccugaguguguauucuacugucacuauugugccagaauggagcuuucuagaagacuaauucacccacaucccucacauuccuuccugagucccuaacccuggaggucacaaaguguuugagccuucaggguaggaagagucuugugggccucugcagagccuuugaaaugucaugcagcccugacucacaguuauaaaccguuuauguacccucucuuguuuggggguacugugggggccucacggugguaaacuauuaaauacagaaaugcaagaagccacagucugagaaguggagugcucccuguauguaaaacugccacauauguccuuguuugcugagacccuggcacugugggauagagacaacaggaaccaauucuaggguaguucuggccagcuagucuagacaaaauggugaauaguacucucuggguuaauugagaggcccugacucaaaaauaggggcaagacucugaggccuguagaccuggcucugcgcuuacaaccaacuaguacugugaauucaguucacagcacccacaucugucucugugagccaccaguaacuucaguuccagagcccugacuucuucccuacucucuaagcauagauaaacacagacguacaugugaauagaaauuuaaaaaucuuuuuuaaaacgaaaaagauagcuggguaguggcagcacacaauuucaaucauagcauucgugaagcagacgcaggugggucucugugaguuugaggccagccuggucuacagagugaguuccaggauagccagggcuacacagagaaacccugucuugagagaagugcagaguaaagaaagcaaaaagaaggaaaaaacauucucauguugacuucuauauccugcaugggaaagcaggccuguguguaugugcauaagggugcaugugugugugcaugagggugcauguguguguguuuaugagggugugugugaugguuuguuuaugcucagccaagugauuggcaauauuagaagguuuggcacuuuuggaguaaguguggccuuguaggaauaggcaugucacugugggugugggcuuuaagacccucauccuagcugccuggaagucaguauucugcuagcagcuuucagaugaagacguagaacucucaguuccuccugcgccaugccugccuggaugaggcccuguucccuccuugaugauaauggacuaaaccucugaaccuguaugccagccccaaugaaaugcuguccuuuguaagaguugccauguucauggugucuguucauagcuguaaaacucuaacuaauauagugugcaacauacacacacacauaccugcacacaaacacacacacgaaaagagaagagaagagaagaguucagugucugaucugaggaagugcucugaacaaagcaggaccagaguaugaagguugaugcuaauccuagaggccucuuccaagagaaagcacauauacccaaggacugacccugucugaaacagacagcaagaagggcagagagguggaggaucuucaggugcagagacccuggggcugaaacagacuuaccaggguccaaagaggggaaaaacacaguaaugaugucccaaaaguguaagucuuagcagaaggucagaaaugccuuucaggauguuggggagcgugaucauggaguaugagaaauccucccccaaggagugaugggauguuugugucugaacaggcugcagggugugaguagggugacuggagugggugugacccagaugagccuagcuuagugaggagagucacccacauggcucccuuccuguuacaguagcaguuucuguuaagaaaaaaguucuuggggauuuccuguucuuuucuccaccuucucugguuccccaacucuuguggggccucucaggcuugggaaagagcagagggagagaggucugucaguguaggguggggcuuuccaagcagcuuugccaacuuccucuuuuucuccuuuuacaucgcacuuuuaccuuguugcuuaagguuuaugcauauggauugguuugugugugaugggcaagugauccagugauguaggucaggggacacaaccucugggauucaguucucuccuccuaccacaugaguucucaggcuuaaacucaagucaucaggcuugguggcuugugccuuuacccaaggagucauuucaauggcucugcugccuuuuuuuuaaacagucauugaggcucuggggagcucagagugugcgcuccuggaauguggcuugggagucaggaugguuuugcagugacuaguaccgugacaugggaucuaugguucagauggcaggcugagguugcaguaacacucuagucucccucccauagaucucacuggguggcuggcugcugucccacucagaagaggauaucucucucacuguaaccucugcaucccuggcuggacucaggcuucugguaccuuauagcuggcuucuccagauagguccaagguagcccuucaggauaggucucuggacuugaggaggacugugggauggcaacacauuaucucucacucccaguaucagugaguaacgugaucaucggaugccauaggaugcuaacugcugugaauaggaucccugugugguggcaucagcuacagaguccuugguacugcccagcgcuguccaagaaauaugauaacauucauauauaauaugagauuuucccacaaccacauggaaagaggaaagagaaacgggggugaacaauguccacagccuguuggauuuaacccauuguauuccaagcgggcccaauaacuguguauuuuacccuaaggacuuacuuaguuuggacuagugguucucaaacuucuaaugcugugacccuuuaauacaguuccucaugucauggucaccccaaccaaaauauuauuuuuuugcuacuucauaacuguaaguuuuguuaucguuuuaaucguaauauagauaugugcuuucugauaguuuuaggcaacccuuaugaagaguccugcaauccccaaggaauugggacccacccauugagaagcucucguuuagaccuacuaugcuuucuugccuaguuuagaaauugaaagggguguguucagagggcuagggaaucugccauccugcgcccucuaguguccgugcagacucagugcagcuuguguggcuccaggugcaucuccugcagcugauggccauucugcagagggcugcacugaaguggaggcuaaggcuguuugaguuucaccuacagcggauggaggaggacgagggggaggacgaggacgaggacgaggacaaggaagacuaggaugaggaugaggaggacaaggaacaauauucugccggucacuguaaggaagagcacaguugaggcugauuucccccugccaccgucuguuccaccugacauggaacaggcucuccaucugccaggacuucauagcgauuugguacccacaucucccaccaccuucccuccagggucuauguuuagcaguccuugagguuuggcaaucugacugaugagauugcugcguggugggaugaacuguaccaugcguguuccuagccaacacugagcugugguuaaugggacauuggagcucccaagggccuuucccagugacagcacaacugugcuguuagcaaagcuuauuacucgcaguaccaagcucugguuaaauauuuucccagaguuucccagcaauguguuugcucuuuccuuaauuuacaauucaguguguuaaggacaauaagagcauaacagacccugggagaagagguaggagcuguuagcccccucccccaauucccauuacuguaaaaucauauguccuugaugccccaaggcuguugucugucagaucuaaucccugcuagaaugugaagugcuuuaaacaagugggagguggcugugugauccagggacccucauuccuccccccuaaaaagaugaaaguauggcugucugaaugaagccuggguuaguuucagggccagggcuagguagguauuucuucaggggagcacacagugauuuuucuguaacuguguaagcauuccuuuuuuuuggucagguuuuuucccccagacagcuaaacaucacuaaggcugccucgguugcuuaaugaaugacagcuguaacgggguguguaccacugagcccaucacgcaucuuugcugcugucucagugccuccaggagagcuaaaaugaggucccucauauuaaauauuuuauccaggucucuguuaggcaucuacgggggcaagucccaggaagcaucuaugaggccgccagcauuugugggcuccacuuagcagguucaugaaagugagcauuaagagaacacggcuuugacagccacuuuauuggccaggagcuucuuuggguaccaguuaaacucaacuuggaaucucauugccucucaggauguuagcagggaaggggcccaggauagaucaaaacccaaaggacagagcccagcucuaaccugggucuuuucauucuugaugggacucauucugcuaacuccuagcugagccacgugagaccacuuaccaugcccuggaggcucugucaucuucuaccaugcccucuaggccuacaguuuugacucuaaauuccaucuauuggccagagcaccuaguucuccugccuaggaaugugccauuguagugcagggcacucgaaguagggaccucaauccagcaugacucaagcaucuauacuucaagaacccaagagacuggaaaacacuggaaauagguccugacugccugcucaaguaugggcuucucuggugauccucucucccaggugaugggguguaucugucaagaaggaggcuaagguggggguggggggcuuucugcugcugggagccugcuuucuuguccucccuggcgguuuuuuggcuagcuugcucuaugacuguugguccucugucccaagcgucuguacugaauccuugucccguuuggaggggaaggggugucacuggcacugauugcacugucugaggguuccuauggcucagggcuagcugcuggauauucaagagucucagcagcacuuagcauuguaaagguguguuuucccgucuggguguaauggaacauggcagggugggaggacuaugauccauggagucccuccaggacugaggcuucuuuacauagagcccuucuuuacuggaguuucagaaaagggucaauccuacccucucuuccuccuuaucucauacugcuugugccauuggucccaguugcuuaagauggccagacacauucccauugucaccacccuuuauuugaaugacauugcaugcaggagcagaucuucaagccauugcuccucagaaccagguccugaggcucagacccuuccuuuucccuuuucuacuucccaugaucccucaacgccucagggguagcccugaaacauggauugaaggcucccgggugguuuccauccuccugaugcuuacgccuuguucuuugcacagugacccagagggucugcggcacaaucccguagcuggguauccuggagucauguccuggcugacuuaggagagguucaggagcucucugauggucagugcucugguuagcaagauguaacugaugggugacauuucuaagugaacuccaggccagagacacauuguaaguuucccugugugaauguuucaguggugagggccuuggagcuacauggcuucaccaguucuaggucuuuucccuccaauacuaguauuugaacaggggacccaacaccucccaucuugguccaaccuggcuucucuaccuuuuaacugcuaccaccccaaacucugcccucuuuucugggaucuccugcucaccuuguuucacaguuuugucuccugccugagggucucccgaggaccugccucugacaguaacauccuaguagccaccuccugggcucaacucauugucccuuccucuagguacuccaguucccuucucccuccccugcccuccuuuucccucucccuuccuuccuuccuucuuuccuuucucccuuucucccuucuuccuuccuucuucauugcuuccuuccucccuuccuuccccaucaauauuccuggauuauccccagacaucucuuuuugcaccucuuguccugcuccacuaagggauucuuuggaccaaacaucaccagguguaccacccucccacuguuggccacccuauucuuaccuacacuuccguguuaccaggguggcuucaauuuuacauguguuuuguuaauugaguuuccaaaaugaauuaccuacaauaaaacuagggcauuucuaucccuucccaaagagucaugauaugcuccuacucuguguugggguuugaaugagagcccuggguaguggacuccauggagagcagcuagcucuucaucuguaugcuuauccuaggccuguggugaccccucagccaccagcaguugcauuuguccucuuagggcagacucuguggaugcagaaguugguauugagggcuucucuucagagauggauguagguagcuucggggguacuuccggccagcacugaccacccugucaagcuuaauguccagugagugagggagagguuggcugacucgugguugaagcccaggcuguaggugauaaggaaagaggacacuaaaccuugguagaagcaaggcugugagauaggaaguguguguagcaaaaaaaggcaaggaucuggcagucagccaugacugagggacuuaagagagccugggccccucuaugcaggcccuccaggacuucaauucugcauuucaguugguuuuuguuuuugagacagaguccucucucuguaaacgagucuggcauggagcucaaaguuaucuggcugccucugccuucugacugcugggauuagaacugugugccagcgccaaggcucugugucuauuucuuguuccugaagccccucccagacagggcuuagccaacauuguucuaucaacucggagguucuuagacaugccaucagucaagagauugaggcugggacacuaugauugguggaugcuucuucuuugaguagaaaauaaaaucuaaggagaaugggauccugcagagagggcucuugcuguucuugcagaggaucccaguucaguccuguucccuacauccacaugguggcucacaacauguguaacuccaguuccagggauccgacauacuauucaggccucagcagguaccaggcaaccucucaauguauuauauaacaagaaaaacaguuguaacauacuauauaaguaaauauucuuaaagcuuugaaagagaaaaaaggaaaagaacauauggacacauuucgacaucuuaaaacuguaaaugaccuuuaaucccagcacuugggaggcagagucagguagguuucugaguucgaggccagcuuggucuacaaagugaguuccaggacagccagggcuauacagagaaauccugucucuaaaauaaaacaaaacaaacaaacaaacaaacaaacccugcaaaugagccaggcuuuguggcuaauagcugugacugcuagacaggggaagcaggaagguaaggguacaggucguccucagcuacauaguaaguuugaagccagcaugagcuacaugagacccugucucagaaaacaaauaaacaaauaaaauuacaaaggaaaacacgacaaaagguccuacaagauaccuguccauccagccaauuccccacuucagucaacuuuaccuuuccaguaaguucuuccacaggaggccuccacucacaaacccaugugaccaguucucacagauggcagcaauggccacaugcccuaguguauaaucuuuguccauuuguagauaucucucugucucucugucuuuuucucucucugugucucucucucucugucucucugucucugucugucugucugucugucugucucuguguguguguguguguguauguguguguguuuguguguaugucuaugagagaaagacaggguuucucuguguaguccuggcuauccuagaacuugcucuguagcccaggcuagccuuccuugaauuccuaucugucuguucugucaaugagugcuagaguuaaaggcaugcaccacuacuugccugcuuguucucuuucuuuucauauaauuuuuugagacagugucuaguguagcccaggcuagcccugaauugcuauauagucaaggaugaccuugaacuccugauccugcugccuccacccuccaguucuagaauuacagauguuuggcaccuggcuaccugaguugaugauuauuucugaucaagauacuguggacauuugaguugguuguuuguacaggggaggacauguuuagauaaguaaaugugugcuuugaaaggcaauaucaaguugccauaugucuguuuuggacaaggaacuuuaaauaucuccuaguccuguagauaaguaauuaaaauauguacauugaacgcuaacagccugagaaagaugugaagaacacaggagagguagcagguaauacugagugcauguuucaucuuccuuaacaggaccuagcaccuagugcuuagaauucauaagccucugagcaguucagaguggauuccuuugggacuuggguagaggagacucacccacacuaguucuucuucacauuucaaaaauaacugagcuaugcagguguguuauugugaaggaaagaaaccaaaauugagguagggaagugaacgagcauuaacguccaguggccaaucacugcaggaucucacacuugggccuugugggagacugcaguggggugugcuggacaaugaagcacaguccugaauuuccaagggggcuguuucagcugguaacauucacaucgacauuuaccgacaauugaugcaauucuagaugucccuggcagaacaauaucucagaggcauaauaaagaguggggacucccauaagguucccaggugucucuucuagggcuaaaacagcauggcaugugcugguaacuucucccaguauuauguggagggggacagggaggucuugggggaucuagaagcccccugucaacaugcuucaaagcuuuaauaccuggguccccaugaaacccuacuuacccagauuaacccaggaaucuggguaagaaugggguuuuuaaaugucauuuauaaaauuaggguugcugacaaaugaaguugaacuuugaagggccaaagccauguuccuguucucugguaucaucccugaauccacucaggaugggagucaaccuaguucuaaauuuacccuagcuguguuagguaggaaugugaaccacuagcaucugccuaugcaggcaagauuuauuuacuaugcagcaucagcaaauguaucugugacaaggaaacaaacacaccgggucccccacgagaaaaagaauuagcuuuucaaagcgaagagucagcauuggguccaugagaccccuuugccccaagcagaugagcugagggguuugucucaauccugacucuuguuuaacccuuacaggacauuugacaaagcuuccuuccacugauuuaggcuugccucucccugucccuuuuaccacgauucugcaugcaugcuccuaguagacuguauuuagccauaaaaagauaucuuuucugucuuuccuagaguguucuggguuuugacauguuauauagaaccauuuuguaccuccugaggagagccauccuggaaaugcuaaaagucagagcuugcacuaucauggucuugaguucuucuggcccagaagaucucaaccuguguuaucauaaccccuuugaggaucgaaugccccuuucacagggagucaccuaagacccuccugcauaucacauauuuacauuaugauucauaaccauagcaaaauuacaguuaugaaguaacaacaaaaaugacuuuauagcuggggguucaccacaacaugaggaacuguuuuaagggguugcagcuuuaggaaggcugagaaccacugcuguaauggauggcacuggacauacagaggauauugcuuagccaccauggugguagggugugauaggaagccagaccugggguuucagguauccacagcucaccugugucuuggccuugcagguuuagucuccacugccagcugccaugggcaagcagaacagccagcuguguccugaggugcugcaggaccugcagaaacacagggaguucaccgaccaugagcuucaggagugguacaagggcuuccucaaugacugucccacuggccaccugaccguggacaauuucaagaucuagcccaacuucuuccccuacagagaugccuccaaguucgcugaacaugucuuccacaccuuugacaccaacggcgacagcaccaucaacuuccaaguguucaucauugcugugagcaugaccucuugggacaagcuggaacagaagcugaagugggccuucagcaugucugaccuagacagcaauggcuacaucagcugcagugaaaugcuggagauagugcagguaccugcacuugacagggccuuaagcauggggagugcagggauccaggacccccauccccggccccauacaccaggucauuccucugcccacuugcuaccugguguacuaaaggacugcaugucuuugcagagaguaacgauaaaagccaagcaucuaucgauugcuugcuggacaucaggucccagcugagcucauccaucagguuuauucacacaauucuauaaaacgggucuuuuuuuaaaagaaaagaaaagaaaagaaaagaaaagaaaagaaaagg

SEQ ID NO: 6601 - RNA, 55666 nt, Mus musculus
ggaggcgucccggacaguggcuugguggcgcgcaguuccccuugacugugcgcgcccccgucugggcuccuuugcagaggacucgguagcugcagcucccggagcacagcggacagagcugcgggcugcgugcgccccugcugccaccgggccugccgcgguggcucccgcgccccgcggcgacuuccgcucccgcgcuucucuuuguucaaguccccgagcggcggcggggucggagcccgcgccuugggcgacugaggcggccgcaguccgcgccccggcgcccuggcgaugccggaccagaucuccgugucggaauucguggccgaggcccuugaggacuacaaggcacccacugccucuagcuucaccaugggcacggcccagugccggaacaccgcggcggccaucgaggaggugagcgguagcuuagccggcgccgggcgggaggcuagggucgcggggaucgcgcugcgcccugggcacccgcuaggcuuccgcgccuggugcccgauacccagugcucuccggcugcgcccacacccgggaaaaguuucugguaccccaaagccggacgcagccggaccagcagugcccgacacagaaacccuuuguucccugcucuagggagaggcugcuuggccaccuugggccuuuuuugggaacgcuccugucuguucccauuucccucgcaggguuucagguucuuugcucccauccucagagaggucaacuucggcuguagagucugugguggcuucgagccggggaccccugcgagcucugcuucccggagugauggcucucccugcguggaccucuccaacuuguuccggacguagcccggcgggggcagcuguggcuucugagccaccauguagagcagauccagggaccccaagcugcuuaggcacgggugcccaucccaucuugggaggccuggcaguucccacuacuugcaacagagcagagcuguagagggauguggagaauggucucuuugagguccaaaaggucuuugguggccgcuucugggcuaccuguguggugucuguugacagugugaucagcuccugugcccuuaaccuggaaagggccugcauagucauuguauugaguggcuaagcagaaagcucuccagauccuggggaagagggacugcgagaaggaagcaguuuggguugaaaauugaagcaggcuuggaagaggcugugugaguccagggaccacggcuguccacagcuugggaaagccucacuuacaucauuuucuuuaccuccccaacagaauuuagaguuuuguguuuucggcucuguaggcauugugcguccagcuggacucacaaaagguagcuggagaacgagacacacauguguaguaguagugaaccgaugacuacauuuccuuugcucagaauuuuaacaucaagguacauauuuuaaaauacuugugucagaggcugguguucagagagcuuuuaaauuaagcuaugucauuacauccuuuccccuugcuugaacaaagcauuugcuauuaggcuuugccugggcagggggugggguggggugggggacuagacuauuguucuuucguguaaaauauuugucuuuguagaccuacacagucaggacuagacucaaugaaaaauacuagguucagcauccugcucuuggaagugagcuaggguauccguucuucuccuucauccucgucuccuuucuuuccucucaccccucuucccaaagaucugcuuguaaaucuuuuguagugaguucagugagagcagauugcuuuaguccacuuuucucagccuggccuuuaggugccacugaugccuuuaaugaggcaggugggggaugagggggaugagagccccucccccuugagggcccuugaaaagcacuaggaagauagucacaguguuuugaaaauacaucauuaaugcuuaugaaaaugauuacauccaaaaagguaggauucccucuguggaaaggacacuugugugugauguccuuaaaagacagcccauauuuauaaaguuaggacgcuucuuucauuguauugaaucaguuagguaucaguaauacuggcagauguuggaaagccuggcaaauaggaguugcaauuaaaguuggcauggccucucucugauuaauuuuaguuuauuuuggaugaacccaaagcugcuuuugcaugcagugcaggagauuacccaagagcucaguuacugaguagauuaaagagagacucgauuuggucauucugucaaauugcaggcuggcuucacucagccuccaaagcagaaaauggauuugaguuggaaacagugaaaaccugaacucuuugcaggcuuaucucauuuuaagugaggccagcauccacucuaagauaauaguguguaugaacugauuugaagggugaaaggacucaguguggauuacuuaaaauaaugcuuucuuucuccuccuacauuauuuaauauuuacuuccaaaacaaaaaguuguucuuugucuaguguaauaacacaccauguuuacaauacuuagacuuuaagcaaaugucuuuuuauggucagaugagacauuaggguagguuuugugacauacaaaaaguuacgcauuucauagaaauacaacuaaaaaaauaagucccuggccuucuacuuaaaugaguuauggaauuaguaaacuuaucugauuaacuuuggcaaaccugauugcucccaauggagaauaugucuagcuguugucauuuucugauugaaauaggcuuucuuucuuuuuuuuuuuuuuaagauuuauuuauuuuuauuauauguaaguacacuguaguugucuucagacacuccagaagagggagucagaucucauuaaggaugguugugggccaccaugugguugcugggauugaacuucagaccuucacaagagcaguugggugcucuuacccacugagccaucucaccagccccugaaauaggcuuucuugacuugcacaccuguagcuagaaugucaguaguuagccagugccugacuuguauuacagguaucaaacuguuguguuuaaucucuaucccugcugugcagauaaggaauuugaggcuaggagauuaguucagguuauagacacagcaaguggaguuuaaacuuggcuggaugcugcuuucucaaacugcauggcguuaucuaaugcuuaguuauggugcuuucucaaaacugcccauagcuagaucagccaccuccaagucaggcuccaucacuuuccaguuguaugaauugggaugagaccguaacagcccauagauacuuuuaccguuuucaguccaguucacagucuagauaaucaugucuacuucugaagauucugguacaguacccaguagacuuaguaaaugguagcugcuuuaccagauuucacuguaguuacuguauagacccuggaaugagaauggagcaggggagaaaaaaauggaugaauggaugaaggugugcauauaaauggaaauuguugucccucccccuaggugugccugugugugugugugugugugauggcuccuaugcugacugaggccagaggcugaacuugcaaugcuuugcugagucaguuccccacagccugucucugcuuccccugaauccuggggauccccagcagguucacaagcuugugcagcaagcaccugacccccuaagcugucuucccagcccccaugcauucucucuaaggagcuuauugucuugguaacaggugagaguguagcugguuugaaacuuuucacuuccugaugacuuucucugggugacuuacuuugcacaguuugcaaagugcagagugcaacuggugucagcuuugugcuuuggaaauaagggaggaaauuaguaguuguggcauaaaucugaaaaccgagcugcgccaccccccacccucuucccagcuuugauuuuguaucuuaguuuuuuuaagccucugguuacuucaaaauacucuggaaauagagaaacauugugugcauucuugggacaguccuuuuguuucuuagggcuucuucauagcuccauucauuccuacccugcuuauuuggcauugauguaguuuuaaaaauaaauuugauauugacucuuaaguauuaaaauuuaacuuuuuccuuccauggccaugagucucuuauucuguuguccuugguuaucuuggaaauugcuuugcuguucuaacugccaaaggagaaugaacaucuagacuguacagacucccaagggaugcuguucauuggcccaggcucugcccagcaguuccagugggaacuggccuugcauuugauucugaguuguaguccuuugugacuuguuuguaaaccagcuccuucagaaucccaggcuaacagauuuugaaucuauggucagaaggaugcccccuuuuucucaguguauccuuagaagggaguagguuaacaggcgaucauuuuaugcugcccggaaaucugaauuggugucucuggaacgucuugaaucacuuaggguguaauugguuucccuccagcugaauucaguuucucuuuuaugauuaguagugcaguuacuaugauaccacuccuugugcaucccagcucuugcugugguucauuugggaccugcugcuguguguuaggugaagggauuagacaucucuucucuuugaaagaaucugugguuccguggggagaaaccgauucuccaggcagaucagugacgugaggucaugucugcgagagcaucuauggugaugauguagagaacaggaagacuggaccacuuacaugugaucagagcaucuguggugaugauguagagaacaggaagacugggaccacuuacaugugaucagggauguggaugaaagggccuugaauggaagccugguguaagaggcuccaaggugguuuaauccagucuuccauaucugugucccuaccuuagagaaauauuuauccacucuuggguuggugaucaacuaggccuuugguggaauuucccuauccauccagacugcagaaggcuccuuaggccaagaauuuacagaggccuuucaugguggggaacugcacuucuggcuuuuggucagcauuguagcccaagaaugaagucagcucuuugcuaacauuacucugucucagaugcuugguggccacauggguugguggccacucuguugugugauguagauucaggacuuuguucuccauacuuguaggaagucuuguugaugagcacaguuuuaggcccuugcaacugcaaaaugcuucaccugacagcaccagucaguguggugugcaacuugcagagccucagguuccauggcagagcuguggaaauagagugugcauuuuaauagcacucucaggagcagugugugcaccaggguuugaaaguacuguuguaggcugcccagaguccuggcuguguucagaguugccuggugagggagggggugucuguggacuggaagaaccugguucugcucuccugaauucugauuugauaagauuugggugaggccuggagcuuuuauauuuguaaaaggcuccucccuaguugauaaucacugauagacaggugauuaugucauguugugugccagguagugaugaaucaagguuaugcauaacuuggggauaggaugugguuuuggaggggaggaaacugaagucaagacaggcaucucugcagaggugaccuuugagcagucuggaauguagaggcugccugcuugcaaagaccugggcauagaggaguccuggaaaagggcugagaugugaguaucagggcagagagaaggucugugaucagagggagggagagcagaggggccuguguggagggguggcuuagguccagauagcacugggcuuucuuuaccuuggggagagaauuugcacuuugguuguggaguggugggaagcuguuuagaggguuuggggcucagacucccauggucugauuuccucuuuagaauuuacuuuuuauuuauuuguaucugugugugacacucagaaugcagauguccuuagagcuuaugcagcuggaguuguaggcagcugugaauugcuugguugugggugcugggcaugaaacuugguaccuccagaagagcucuuacaauaaaccauuucuccagucacugcuucacaguuuaaagacauuucagugcuuguuccuaggccuaggagaaaaguggggagaccagcaaaggaguagggguucauuuggaugcugcggugaugucagugcagaaguguccuuugaacugggugucauucccugguacuugaagcaugggucuccuaucauccccaagguaaaaguggcacuguccagcaugccuuagugguagagaccaggucuacacugcagauuggcuggcuggaggacuuguauugaaagcagucuuuuuuguuuuuguuuuuuguuuguuuguuuguuuuugguuugggguuuuuuuggggggggguuggagaugggguuucucuguauagcccuggguguccuggaacucacuuaguagaccagucuggccucgaacccaggaauccaccugccucugccuccugagugcuguuauuaaagacgugcaccaccacaccuggcuauaacuagcauuuuuaugagcuuuaauucuauguuaagaaaaugugcuuuugccaguugguugccuaauaccaaauggucagcaccgaagccagacauauaaauaauauuauacagauugugcaggcuguguuuacauguuuagggaauauacauauauguauaaaauaacaaaggaaaagagagguuaugaauuugaaagagaggaagcagggauauguggguugguuuggagaauagaaaugaugagauuauauuacaauuucaaagaauaaagaaaaguaauuguaaaguaagaaagcauuaaaugggcucauuuaagauuauuucuuuuugagagaggucauauaggcaccauggagucaugugacucuggguuucagcaguugacaaaacaggaguucugaccacucugguugguucuucaauguccuuucacuguacagagguggguuuccuuagugcaagcugguguucauugagucucugcaggccagcuuccauuguugucaacuuagagcgccaagacugacaacuccagagauaucaaguucuaaccccuggggaggcaucagaggcccuuuuuuagaggcuuuucuucucuuguuuuacuuuuuagucagggcuucaggguugccuugaacucuauguaccaaauauaacuuuggauuucagacccuccugccucugccuucaccuuggaaggcugcaauuacagcauguguuaucauauuuguuuuaugugugccagggaucaaacccugggccucuugaaugccaggcaaacauucuaccaacugagcugccuccguagccucuagaggcguuuacugagaggccuucacugccacagagugaguugucuaauaauauaccuggucccuuagugcuguggguuccagaaaaccaucuggguuguguacauaaaggccucauagugaauggacucagacugggucuuccaggccaggagaucuguguaugguggcugcugcuucuuagaggggcacaagcuaaaccaugccaauuaagguaacuguuaggaacauaccuuccaccuagggcuguccuaaucaucaggauccauucuucucagaucaaagaaaaagucucuaaaacuaauacccacaggaacauggcagaagaggggguauaaagagcaucaagggacacauuugguaaaacacuuguuuucuggguauuaugcggcaauugcacccugggcagugccauuccauuuauaugcacaagauccagccuaacagauauugaguaauauuccaucaggcagcacuaagugaacuuaguaacgaugaugauugugaugaagaaggagaaggaggaggaggaggaagaagagaagagaaagaggaggaggaggaagggauggagagggaggagaaaugggggaacuaggaggaaaaagaagucauaauggagacaugaaggcgcaagugucagagaggauguagguagagguaggaaugagagauagaaacaaucaagauauacugugugcacauaugaaauugucaaagaauaaauuacuaacaaauaaguaauaaaccuuccaguucagcucaccccugcuuccugaccauugccuugccucuaacaacccuaacacuaagaacccuaauccuaacuguaacccucuaauagccuaacccuaagucuaacccugcuuacuaugagggaaaugucuucaguauaccuuuugaagugagaaaccauuucuuaaucuugaucuuuugagauggucagauccaccuucaaucuaggcaauagauucuuuuggcauccuacacacauaaaagacaaugaacaggguuguucuuucauuuuuuauacuugcccuauuuuuguauuuuagaaaaggugauuugcuaguuugauuuuuaaaauuggcauuggaaaguacuuauuucuucagaauucugguacauagugaauaucagcuguaauaaccugcaacaugagauaacccauccuugauuuuucuaaguucccuuggccaagaaccuuucuauauuagacaguagagagacauucuauuaaauuuccuuucuguauccacagagaaauuuauucugauuugagauauguuuaucuagagaaccuguccuaauacaacuguggcuuuucucuacuuugccacugauggugaugugcuggcuaacaagauggcucaacaguguuucccuuauguuucuggcuuuccucccaggguugguugguacuuaucaucugggaaagggagcugcagucucccugagcccagcacugagccacaaacagaacucuuguuuccuaaaaucccucuuuaauguucauugccugggcucccucccacucagauugauaaccccacugcaccuuggguaaugggcuaugcaugcucuuccccuggauuucaggaagaagaaggcaagugaugugaggcaagcucaggcaaggucucaagacagguccugguaaugcaggaucauugcucacagagaacaggggcaggcagcugacuagccugagcuggaauguguugggaacuaaaagggggcccugggcaagaaaggaaagagggggaaggcucacguccugccagaguuccaccuaugcucuggacagagaugugggagagcugccauacacucucugcucagcccugggugggcaucuaagccuuugacccacucuuugggucugaacaaggggcagcccaaccugggagccccggggcuacuuuccuaaaggccugggguuaugggagagagggaugaggaaugagagguucccacaccggugagagagcacaguggaucuggacgggagcacaugaaggccuuucaucuggagaguagaaucggcucauuacgagaaagccuaucccauccuccaagcucagugggccuugaugaauggagacauccuaugguuuuagagcuuuauuauagaaaggcaggaagaaagagagaagguagaagagagagaguccccccuagaagacuagaagggggaaggcuagauagaaagagaguaagagggagagaggagaggagaggagaggagaggaggggaggggaggggaggggaggggaggggaggggagaggagaggaggggagaggauaaagagaaaggaaagcggagagaacagugcaaaaagugagagguaagagauagaaggagugagagcaagagagauaggcagggcugaacagcccuuuuuauggucuuuacuguugcuagguaacuguggaggaguuuagccugaaggucagaagcuugggauauugccuaccugacuuuuagccaggcuucucuugugguggcuggggugggggugggggagggggacgguaacuuaggcaggagccugaguuccagaagcaugagggaauugaugcguuccuugucaagugaauuaucacccucccaggguucagaccucagcucaacugaagaccaaccugucugugcauagcccaaugccccacaugaauguugaguucucccccagagcugggaggggugagaguccucuuggggggcuggcucaaaugcuaauguagugcaaaccacacccgagaucuggaaaagguguggcccuggaccugaagcacacuuuaaccuugaagaagggugagacccacuggccaaucaaggucuccacaggcagaccugccagucagacaaggaggcaggaucuuaugggugccuuuccccaaguucacuuuggcugugcaggcuugaaugguucuguguccugcucugagcucugcuguugggugcugugagaggaccucagggaagcucugaauuccaggcauggugagcacaggguuacugcccacagaggguaggggcagggugcugagcaguggaagcugggguggugaguccucucuggggcuggaugggaaguauaagccauaugugagcaccugugaggucucuccuguugcuccucacuugcuccaucaggggugaccucuaauaacuugccuaucauugcccaaaucguuuggaccuuaguuaagcuggcuugugaaaacaagggugguuucuuugagucuguagcacagguguccaaaccccuuugucuuuuaguauacauuacaaagacagguaaaaaucuaauaggucugauuucauacauuauacuuguuuuuguuuuguuaauuuuuuuucuguugcaguuuuuuucauauuuuuuuuugcaucacauguuuaaugaguugauuauuauuugggaaagggacuuuaauaauuucagaauauuuuugugguuuuauugaaaaauuauagaccucugagcugauauucuucuauuccaauuguuuguaauuuucgccuucacauauuuugcagaagucacaguugguuauugccgugaaacuuuuagaauccacauuuuuaacugagauaucaauuuuuucucuuagucuugaaucccugagauucugucuuccuuuccuguucugugggugaaccuugccucuguagcugucaguguacagguaaucucauguccugcucuuagggacuuagcaacagcuuaugucauuuccugccuccauccccugugucuguugucaggcgugcuuuauauacauggaccaccagcuauagcagcucucuauuuuuguuucugucucuguucucugcacaugcacacucucugucaucucuccccucauggcucucuuucuccucccugucugugugccugucugcagguccucuuguguacuucuaucccuuccccagguucucacuccucucccuucccccaaacaaccucuuuugcacuuuaucuguuggaugcuuuaauuuaucagaccugcugugauggcauagcuuggauuucuugguugcaauuguuccuggcuguuacucucuauguugcuaugcugguguguagccaucucuguuugggugauuauugaccuagguacuggccucuggguuugucuuuuugggugggaguuuuguuccuggguuacuguuugaugcauggauuugaagagaguguucacugacaguuuccuauuuuacugaccuguuuuguggguauacucaacaggggaugcuuugugauauuaaaaucugggagaagcaacaggcaggaacagaagaucuuaguaauccacaaggagacauagucaggagagaggucaagcagcccaugguguuuaauauaauguuggaacaacagggaaaauugaaucugggguaaaucaaucaaucaugaaguugaucuauggaagcuuaccuuguguccuuucaggcauggaugugguugaacagggaguaucagcccaagugggggcugagacacagggaugaggcaggaauggaugggcagguggggauugucuaugguaucuauaggaggcuugcccaggaggagaggaaauuuccacugcuacucuuuuccaguguuaagggcagcugauauuagggucugcaguaacagauagugagguaggucuuuggacaaagucuagucuacagacaggcaugguugugguuaaccaggaguuucugucuauaaucaggggguuaggaacagagaugaguuuguaaaucccaaacaguuugcuuuuugagaauguacauuuguacauuccagcaaaaaucccaugacaaaauccccuuaucaacagccaguuaagguacaucagcagggucaagcuacauagagauaacuaagaccuccuauagaaaacaaaaacagaaacagcuuacccaucaugguugucagauuuuuuuuguccucccuugcuugguuccugcacauuaugccagacauacaauuuuuaaaauauuaacaaugcugauuuguaugcaaacuccccaaucuugguguaacuacaauaaauucacaaaaccucuagacuugaucucucaguuuguaccuaaugaaaguuugacugcugagaguccuuguuacugagcucauaaaaacgaccucuguguguuugcuuugcaaucggcucugugcugaucauugcaguuucugugaguugggcauaaaaccuugaugcuuugacuggaaccccaagacccucaggacucccauuggaaggguugaaagaccgcuguuaggaugugucauugcuguucuuugugucagugaccugucugucagaaauguguccguguacauggagcuuaaucaguuguucccauagggucuggaagauuggaguguugauaguaaugcagccacacgaaguugaggucauacuauuucaguggaaaguagacugaaaaacuuuaggaagaggucauuuccgugauauuuuggccaaaaaaaaaaaaaaaccagaaaacuuuuguacuuggcuuaugcccugagauauugaguaggucaaacaaacaaacaaaaauauugccugauuuguauauuuuuaugugauugauaaguauuuguucaaucuuccuauuucuuuuuuuuuuuuuuuuuuuuuccucugagacagaguuucucugugucucccuggcuguccaggaacuuacuuuguagaccaggcuguccucgaacucagaaaucccccugccucugccuccagagugcugggauuaaagucgugcuccaccaggaccagacuuccccuauuucuuuauucaauuuacauucuaauuguuacacccaucccauuccaccuuccucaaucccucaucacugacucccuuuuaucuccccagggagggugggaaccacuugaguaucccccaacuauggcaugucaugucucugcaggguuagacacauccuuuaccacugaggucagacaaggcagcccaguuagggaaacaguuugcacagacaggaacagcuuaagggacaugucccgcucugaauguuggggaccccaugaagacugagcagcacauccacuacauauauggugggggccuccaucccagccugugugugcucuuugguugguggcuccaucucugagagucuccuagguuccggguuaguugagucugagggucuccucauggacuuccuauuccuucagaggcugucaauucuuuccccaaucuuuuaaaauacucccugagcccuguccaauguuaggcugugggucucugcauuuguuucagugagaugcuggauggagacucucagaggacaaugaugcuaagcuacuaucugcaaguauaacaaauuauccucaguaaugccagccuuggugcuugcccaugggauggguuaccaguugggcaggguauaguuuggccauucccucagucucuguuucaacuuugugccugccuuacuugcagcagaacaaauuuugggagaaaagguuuuugguuuuuuugguguacugaacacuucacuggugguucugccugacugcaagaugucaccucuucaugguccauaacucaaugcuaucuaucucagcuaagaucaacucccuagcugcauuugugcccucccauucauagucucaggcacauucuacaggugcccccacccuaaccccgcucccucccaccaucugcugauuucauuucauuuuccuggcucucuggcauucucuugucucuuaccacaauuguuccuaacacuccccuucuuauuucuuuuuuuuuuuuuuuuuuuuuuuccauuuuuuauuagguauuuagcucauuuacauuuccaaugcuauaccaaaaguccccccuacccacccacccccacuccccuacccacccacucccccccuuuggcccuggcauuccccuguaccggggcacacaaagucugcguguccaaugggccucucuuuccagugauggccgacuaggccaucuuuugauacauaugcagcuagaguccagagcucagggguacugguuaguucauaauguuguuccaccuauaggguugaagauuccuuuagcuccuuggguagaggagcccugugauccauccauuagcugacugugagcauccacuucuguguuugcuaggccccggcauagucucacaagagacagcuaccagguacgaaaguuaaaucuggaucaaguuaaugaucuaaacagucccauauccccuaaagaaauagaagcaguuauuaauagucucccagccaaaaaaagcccaggaccagacggguuuagugcagaguucuaucagaccuucaaagaagaucuaauuccaguucugcacaaacuuuuucacaagauagaaguagaagguauucuacccaacucauuuuaugaagccacgauuacucugauaccuaaaccacagaaagauccaacaaagauagagaacuucagaccaauuucucuuaugaacaucgaugcaaaaauccuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuucgcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcggagaaagaaauuagggaaacaacacccuucucaauagccacaaauaauauaaaauaucucggcgugacucuaacgaaggaagugaaagaucuguaugauaaaaaccccuucuuauuucuuaacuacugucccauccaguucucucccuugcaucugccucuucugucucuuucauacccuguucugagugagauucaaccaugcucauuugugccuugucuuguuuacugucuuuaggucuaugaagugcaguguggguauucuguacuuaugguuauuauucacuuguaagugaguauguacaugcaugaccuuuugggccugaguuaccucauuccagauauuaguuucuaauuguacccauuucucugcaaaauucaugacguccuuguuuuuuauaccugaauugcaucccauuuuguaaaugaaacaugguuuuuguguccgcauuuuaguugaggaacaucugcauucuuuccuguuucuaacuguuauaaauaaaguggcuaugaacuuaguggagcaaaugcccuuguggguauauaccuaugaagguacccugaguguaguacuuccuccugcuugccauguuuuaaauuaauggaaggaguauucaacguguuuccucaucccagaauggaaccuuaaacaaaaccuacugcaaaugugauccaagguaggcaggguccauuaauuuagaagccaaacuucacaggaucauccauaccgugcugcuucuggaaacugaaagaugaaaauagcacggucauagauuuuuuuucucuaugguuucaguuuagcaccacuccagccaucuuuugacaaagucaggaucccagggaagacucugugagaguuccuugcauuuaaguggugagguugaugcuugaguugcauuuggugaccacagguuguggagaaaacuaacacauugagaagucugccauggagagaugcuuacagggagaugaaguacccaaacugagagauguaugagaaguuacaggaagaguaccaucuaugccuuuagcaauugaaguccaauguguuugagacaaagcuauaggauuugguguuugcccugcugguuuucuugccuuuguccaaucuucucucccugugugcacauuccuaucgauuggauugggaagggguauucagugccauuuuauguuggaaagauauaacuugcuguuugauuuugcaacuuugcuuacugauguggcugucaagauauuguauugagugucagcagagacuuuagacauuugaacagugcaggagccuuucuagauucaucuuagggaagaugaaaguguauauacacucaaaauuuccuuuuucuuucuuuccuuuuuuuuguuuaucuuauaauuuagauauuaauuaucacccugaucacuguccuuacucuagaucccugcccucacagacuccuuccucccaaucuccucuguuucuccuuugagcagcauuggggcccccugucuaaccccugggcacauagguuauauucuauccuuuuagcauggcauaugcucaugacaucaguacugccugaggcuucagagucauuggauucuggguguugauguuuccccaaacucuuguguuuguuuugaaauuuuuaaauaaauaggaguguuuuggcugugugccuuuuaaaugaauaucaugugugccucaucguuaguguuguuggaacguggacucagaacuccuguucauaaaaccaugggucacguaaaggcuaguaauugaccacuguuaucuggaagaccagcaagagcuuuccacggcugaguuaucgcccucuccugcuuuauguugcuuuuuauguucaacacuuauauuacuaauauuuucaucuguccauugguccacuaaaugugccuugauugccaguaaaguuuuacuaauggugcaguuuaaacugguacacuuccuguuucugcuagaugaauacagaagugcagggaauguauacuucuuuguaggaacuguaguacacaacugaguucuuucuaucauuuuugucucccugguugacuuuugcaguggaguaagggucuuaauauguaacuuuugcuguccuggaauguguuacauagaacagacagggauccagcucaaugacguauaccuacccgugacucugggauugaagacaugaacaaauacacccugcuuuuccaugauuuuucuaguuacugauucgucauacaauuucuaggauguguccucaguacuguugaucuguuucacccuacaucucacucucaauuggaauuccucucgaaagacuuuacccuauuuauuuaaaauuuucuuaagcaacacaggugaaccuucaacucaauuuccuuuaaaauguuaugguacuuacauuaugacgucuauguccagaagucaguggaggaagcaccagaauuacaugaauauauggugaaggaagcgcacauuuacuuuacagugaugucaguaccauguuuugugauguacacauguaugggauauuuuaggaugcagugacuuaugaugaugugcaugugaacuucacuggggaagaguggaauuugcuggauccuucccagaagagucucuacaaagaugugaugcuggagaccuacuggaaccucaccguuauagguaugacugugaauuuucuuuugcuuuucaaaauaaugggaagacaugucucuugguuagugauggugcucuguuauuacaauugagaacaaggaagacugagcugaauaaauaguguccagugaugugaaaauucacaguaccuugaauuuugccuuauuuccaauacuauaucauucauuuuucugguacugucuuuuaggcuacacuugggaaacccaucauauugaaggacauugucaaaguucgagaagaaaugaaagguaauuuucaugugcaagcugaugcaauuaugccucugaggaaauauuacuauuuuauguaagcucuaaagaaaagcagaaguguaaaaugucaauacuucguguaacuauaauuacaauauauuuuuuaaagauuuauuuauuuggggcuggcgagauggcucagugguuaagagcacugacugcucuuccgaagguccugaguucaaaucccagcaaccacaugguggcucacaaccauccauaacgaaaucugaugcccucuucuuggagcaucugaggacagcuacaguguacuuacauauaauaaauaaaucuuuaaaaaaagagagagagagagauggcucuucuuugucugacaggaugagccaggacccaugguccugccaaacacguggcaggcuagugucuuucucucucucucucucuuucaaaaaaaaaaaaaagauuuauuuauuuauuauauguaaguacacuguagcuguccucagauacuccagaagagggcaucagauuucguuacggaugguugugagccacuaugugguugccggguuuugaacucaggaucuucggaagagcagucugcucucuuaaccacugagccaucucgccagcccuaauuauaauauucuuaaaaaaaguucugccucaauguaguuaucugauuuaucuaucaaagaauuccuccuuuuuaaaaaaaaaaaaacaaggaaacauugccuuaagagauaccuuuauucaauuuguaccucuauuagaccuauacugaucugacaauguguauagacuuacaagacuuagauauugcacaucgaauagugauaaauauguauccaaaaccuuccaauaauuaaauaauccaugggaaaguuggugauacucauauucuuauacugaaauugaucauuuguuuaggguacaguuuaugagagucaagaguguugucauaggagaaaccuuaauucauauauuacacgucuaugaggaacaaaaggucaaacagugugaaugcaauguggaaaccuuucaucuguuauucuucuuuuuauauguaugucaugugucacaauggauaaaagccaugugagcauaggaauauugaaagaagcaauguucugcuuucuaucacagaauaaugagaaaauaugucagauucugucuuugguagacaaucugaauaugauaaaaguuugcaaugaauugguuuucuaauuuuacugggaacuuccccaagcucacacuguagaaaaucuuuauggguacuaggaauuuggaaauucuuuuguuuguccugguucacagucaaaugugguauaauucaugguauaggaaaaauuaugaaagcaauuaguuuuauaaagcucugagguguuccauuuuccucauauagaugaaauacaucauauaaauaucccauauaaaaaggauguuauaaauaugagccauguaauaaccaucacagauaucucgaaagaugcaaaacaacccauaaugagggagaacaccaugaacauaugaagugauaaaaccagaugaucugguccaccuuuaucaguagaccaauuuguaaacuuuauucaucuugaugaaaugacugaacagggaaauuaauguaguaaacauaucacaugugccaauuuucauugcagguauguaaguaaucauaguggagagaaacucuaugaauguaaugaacguucuaaagccuuuucaugucccagucaucuccaaaguaauauaagaagacaaauuggagagaaaacaugugaacauaaccaaugugguaaagccuuugcaagacccagucaucuucaauaucaugaaagaacccauacuggagagaaaucuuaugaaugucaucaaugugguaaagccuuuacacaacgcaguaguuuaaaaugucauaagagaacacauaauggagagaaacccuaugaauguaaucaaugugguaaaggcuuugcucuacacaguaguuuccaacgucauaaaagaauacauacuggagagaaacccuaugaauguaaucaaugugguaaaggcuuugcucuacgcaguaguuuccaacgucauaaaagaauacauaccggagagaaacccuaugaaugugaucaaugugguaaagccuuugcagaacucagucaucuccaacgucauaaaagaacacauacuggagagaaacccuaugaauguaaucaaugugguaaaggcuuugcucuacgcaguaguuuccaacgucauaaaagaauacauacuggagagaaacccuaugaauguaaucaaugugguaaagccuuugcacaacucagucaucuccaacgucauaaaagaauacauacuggagagaaacccuaugaauguaaucaaugugggaaagccuuugcacgucacagucaucuccaaugucauaaaagaacacauacuggagagaaacccuaugaauguaaucaaugugguaaagccuuugcacaauucaguaaucuccaaugucauaaaaagaacacauauuggagagaaacccuaugaauguaaucaaugugguaaagccuuugcacaauucaguaaucuccaaugucauaaaagaacacauauuggagagaaacccuaugaauguaaucaaugugguaaaggcuuugcuguacgcaguagucuccaaugucaugaaagaacacauacuggagagaaacccuaugaauguaaucaaugugguaaagccuuugcacaacucaguagucuccaguaucauaaaagaacacauacuuuccugauauagcugucucuugugaggcuguuccagugccuggcaaauacauaaguggaugcccacagacaucuauuggauagaacacagggcccucaauggaggagccugagaaaguacccaagaagcugaaggggucuacaacccuguaggcagaacaacaauauaaacuaaccaguacccccagagcucaugucucuagcugcauauguagcagaggauggccuagucugccaucauugggaagagaggccccuuggucuugcaaacuuuauaugccccaguacaggggaacgccagggcccagaagugggaguggguggguaggggagcaguguggggggacuguauagggggacuuucaggauagcuuuuuaaauguaaaugaagaaaauaucuaauaaaaaauugaaauguaaaaaaaaacacacacacuggagagaaacccuaugaauguaaucaaugugguaaagacuuugcaggucacaguugucuccaauaucauaaaagaacgcauaauggaaagaaaccuuagaaauauaaucaaugugauaaagccuuuucacaaauuuauugucucuauaaucauaaaaguacccauauuagauagaaacucaugaaugucgucagugugcuaaaaccugugcauaucccacuugucuucaaaacguaaaagauuccacacuggaaagaaaccucauaaaagcaaucaaugugguaaagacuuuuuacaacucuauagucuccauuauuuuuaaagaacacauagaagacagaaaccuuuggaagguaaucgguguuguaaagcauuugaugucacagucaucuacgaugacauaaaagaucacauacaagugagaacccaugucaauguuaugaauguaguagaaccuuugcaugucagaguucuuuaggcauacacaagacaaaccacacugcagagaaaccccaauuuaaauguuugcuuuucucagaguugguuuggucaugagaucuguucccagccauugaaaggcugagggagaaacccucugaguauauuuaauguggcaaagccuuugcacaauuuuguagucaucuucaucauggaagaauuugaacuggguagaaacauugugaaucuauuuaguauggugaagcuuuuucacugaacuucuuuuuauguauauucuucuuuuuaugagacuauucauacuggagacagaugcuaugaaugucagcagugugguaaagcuuuuaaguuguuggguccacugagguucaacacaacucacacaccaggacaaugcaaaugauaagaauuuauugggcuggguggugguggugcacuccuuuaauccuagcacucuggaggcggaugcaggcagauuucugaguuagaggcccaacaacucuagaguguguuccaggacagccagggcuacacagagaaacccugucuggggaaaaacaaaaaagggaaaaaaaagaauuuauuggaauuaagucacuacugaucagugagagacacaaaaguauacucagaaguuuaucuucaaaaccccaccgcccacacccaaccugagacagaaaguuguauaacuuucagacacaaaaaccucaaaguccugggccaacuuacagcuacauuuucucccaaaucaaaacuuauuuuuauugaaugagucaauaaauagugauugcuaacuccuuguauuuuguuguuguuguugcagcugcgggugguguugguguugggcugugugugugcuuucccuucuuuuguagacaguaagagauuauuuacuacccguguuuucauguguauccuuaacuuccucgguuagauucuaccucuaucucuuuguguuggucaguauguuuagagagagguuguuuaaauuugaguuuaucguggacuaucuuaauuuuuuccauuaaugguguaguccuuuuuuuacauauuaaaauccaggcaucugauguuucugcggcacauauguacaaacccuucuggcgucuacagacuccaagaagacauccgugaucuuuuuuuguuuuguuugguuuggauuuuuuuguuuguuuguuuguuuuugagacaggauuuuucucuguauagcucuggcuauccuggaacucacuucguagaccaggcuggccucgaacucagaaauccgcuugccucugccucccaagugcugggauuaaaggcgugcaccaugacgcccggccugaagacaucugugaucuuuuuuuuuuuuuuuuuuuuuuuauguuuuaagucaccaauauuuaaucuuuuuuuuucuccauuuuuuauuagguauuuagcucauuuacauuuccaaugcuauaccaaaagucccccauauccacccacccccacuccccugcccacccacucccccuuuuuggcccugguguuccccuguacuggggcauauaaaguuugcaaguccaaugggccuuucuuuccagugauggccgacuagcccaucuuuugauauauaugcaucuagagucaagagcuccgggguacugguuaguucauaauguuguuccaccuauaggguugcagaucccuuuagcuccuuggcuacuuucucuagcuccuccauugggagcccuaugauccauccauuagcugacugugagcauccacuucuguguuugcuaggccccggcauagucucacaagagacagcuacaucuggguccuuucaauaaaauauugcuaguguaugcaauggugucagcguuuggaugcugauuaugggguggaucccugggacaucugugaucuuaauagaucuuccuuuauguuuuuccuggcauuuuaccuuugcacuuuuaguauucuuuccuugaacuguguguuuugauuauuacacagggaagagacuuuauuuuauagucccuucuguuugguguuuugaugauucuuguguuuucuuuauguuaggaaguuuuucuucuaggauuugguugucaauacguucugagacuuugagcaaggauucuccuuccucucuuccuaaguauucuuauguuuaguccuuuuacaauguccuggauuuccaugauauuuuauaucaggaagauuuagacuuaccguuuuugucugauuuacccauuccuucuauugcuuauucaaugauugagauuuuucuuccguaucucuguucucugggugaacuuugccucuguaguuccuuuuugcaguucuaaauuuuuauuuccacuauuuccuaagauuuaguuuucuuuuuugcuucuauuuccacuuuuauguauugaauaguuuuguuuacuucacccguugguguguucuuucuuggcuuuauuuauaggaauuuuggcuuccucuacuuuuugguuuguguguuccuggccuucuuuguggaauuuauugauuuccuccaauuuuguucuguuuuccuggauuucucuaagugauuuauggucauuuccucuuuaaggaacucuguuaucuucauacauuuggguuagaguguuuucuuguaauuucgcuuuguuggaauauuuaagaccuucuuugacaauauaaaugagcucagagucauuagccagagagugauaaaugcugguccuuauuacauuaucaaguaccaacaucauggaauggaauggcgcuaucuaagcuaagcauucagcuuagauuuaacccgauguuugauuaaucccaaggcuguccuuucccuuuacacuggacggguagccaagugaggcacuuuuugaaagaguuacuuuuugugagacaccuguuuuuaucacuaaacuuggggucaccauuuaaaaaaaaaaaagaccugauguugacagggugagcgacuuuguaauuuuccagcauguauuuauucaugucuugugaaugaagacagaccagauugauagauauguaaauuggggacuuuagcuugauucaagcaauauugaauuucugacuuuggaaauauguccaaugcacuuucaggcuuuagucagcucagaugauugugacacaggccauuggcuguaguuaugugucauguuacagaucacagcaacugauacugcacacaggagccaggucaaagaguauuguauuaaugccauuguuuucugccagauaacuucucucucucucucucuguguguguguguguguguguguguauauauauauauauguauauauauacauauauauauauauauauguguguguguguguguuuguguguguguauauauauguguguguauaaauauauauauuuauuuauuuauauauauuuauauauaauuauguuucauuuuuucuuuuuuaauuaauuaauuuauguacauccuguucuugucccauuguggauagagagacaaggcaguccucugguacauaugugccuggggcaaugagccagucccuggaugcuccuugguuuuugcuuggaggucugaaguguccagguuagcucaaaguuuuguucuuaucggguugccaucuucuucacccccuuaagugaguacaguuuccugcccuuauguaacauuucaaccuacaacaauauaucgauauaucgaucuacauauuucuauaucuauccaucuauauaucuauauaucuuuaaucuacacaucuauauaucuauauaucaccuauuaaucuauauaucuacauaucuauauguauauaucuauacaccuauauaucuauaugucuauccauauaucaauaaauauauaaucucucuauauauuaucuauaaaucuauauauaaaaaucuauauaucuaauauauauauacacauauauguauauuuuuaaaucuauccauccaucuauguaucuauaagucuauccauauguuuagcuugauguagcuuuuuucuuuuucugccagauaacauauacauauauauacauguauguguauauauauauucaauuauguuucaauuuuucuuuuuuuaauuaauuuuuuuauuuauuuaaguacauccuguuccugucccauuguggacagagagacaaggcaguccucugcugcacaugugccuggggcaaugagccagccccuggaugcuccuugguuuuuggcugggaggucugaaguguccagauuagcucacaguuuuguucuuccuaucggguugccauucucuucacccccugaagucaguacacugaccuguccuuauguaacauuucaaccuacaacaauauaucaguauauugaccuacauauuucuauaucuacuaucuauucuucuauuuaucuauuuaucaucuauauaucuucaaucuauacauauauauaucaccuacaaaucuauauaucuacauaucuauacauauauauuuauauaucuauauauuuauacaccuauacaucuauauaucuguccauauaucaauaaaucuagauagauagauacaucuaucuauauauauuaucuauaaaucuauauaucuauauauauauaauuauauauauaauucuauccaucugucuaucuauaagucuauauguuuagcuugauguagccuugucuaaaaggacuguuauauucuagguuuuagacguucaggcugagaggaaacaguaugaguaacauuugaucuaauaccagauccucgacucuggacccauauuuuaugauaauuuggggauuaugauuacaucauuccuaccuccugugaucaauuaguaaacacaucuaaugccugcagcuggcaagaagaaagguugauggcauuucaguucucggccucggugucuuuggaagagaccaugacugagagggaagaagaagcaggaauaagguccuauggguggaugaauugggagagcauggccaggagggugagccugagaguaugagcagccugggcagaauaugucaagugagccgggcgugguggcacucgccuucaaucccagcacuugggaggcagaggcaggcggauuucugaguucuaggccagcuuggucuacaaaguugaguuccaggacagccagggcuauacagagaaacccugucucaaaaaaaaaaaaaaaaaaaagaauaugucgagugauaucucacaguucuuuguaaagaaguagagaaauuagcauaggggaaugguaucugccccaugcuggugcuuuaaugcuuauaauaauuauuauuauuucuuauuuuauuuuuucacauuaucauuuacuacauuauuauaucauauuauuuaauauuacuucuuuuuauuauuucauauuauuuauuauuuuauuauuugauagcauuguuucuuauucuuauuauuucuuauuaguuuauuaucauuucuuuuucucuucuucguauuauuauuauuauuucauaccucuauaauuuauguggugguaagaaauccacaaguaauauuuaccacaacaaguuggaugcaaaucagcuugugaccaaugacuuuuugaaaugcaauugaaaguaagaugugguuuuuacacacuuguaaccucagaaaccaacagacaaagcagaaauauggccaacaauuauuuccuugggauacaggaagaaagaccucuggggucucugcuaauaaggccacacacagacauacccccacacaaacaugcacacacacacauacuacauacauacaugaacacauauacacacacaccacacacauaaacauacaugcaccacacauacaccaaacacacacacauaaccaugaccccacaaaaacacgcacacguacauauaccacauacuuacauucacacccauacacacacacauacaccacagauacacaugcacacacaucauguacaguaacacacacaccacaauagccucacacagucacauacauaccacauacauacauucacaccuacacacauacaccacacauacaccacagcacaugcacacacauaccauauacauacauucacacgcauaccucccuuuuugauucugcuucauuuugcguaacaaugauuucuaguuccuucuguuucugugcaaguaucaugauuucacuuuucuuccugacugcaugaaaucaugucauguguacacucugugaucaauuugguuaacaagaaugaaugcauaaagcagggccugggcugaggaauuugcauuguggguguuccacauagccaagagugacaaggcaugucccagaggaucuucucccucagugagccccuuggagcauggcauaucuccaaauaauaucaaucccacccauucuuuaaagaaggaaaaugcugaggagauccaauuggguaauccuuuggucagggacagguccaagugcguggaguugaccugaaugauggcaagucucaauucccgaagggucuguucaaauuuagccguccaauucuguaacauauacugagaaagacuuuuugacaaauuagcugcccuaguaaaauuucucauacugaauggaaguaacgcacaaucuuggaaaauuuguuuacaucccagcugagcuauuugccauaauacaucuaguuguuucuggacaagcucuaugaguugauucauuuuugcccauggagcauuuuugggauuggaggauggcggccgcuaagccugcauuggugagaggucccccaagcucccgacaaacccugagccagucuuguaaaccuuuguucuuucuuggggcuauggccgcucggcacuccuguguggcuugcucauaaaugagcuguuuuaccagaggugcggcuugcucugaaucuccaaaaauacgcucugcugccucugucauuuuggccacaaaaucugagaacucuugaggucccuggacgaucuuuguuaguuguccaguggcuucaccugcucgggagagcgccuuccaggcccuaauagccuuuucaucugauuuagaacuacuaagaacuggcuccuugagcucaucuagugaugaguauaggcuccuucuucuagagaccuccgcuaauugaucuuuuuuuuucuuuuuuuuuuccuuccuucuaaucucucuccagguauuuuuaccugaccuaaacuuuucuucggguucaagacccguggaaaggccuguauacuuauuuuguguaccauauuuucucuuuguuccuacucucucuccccgcuuuacuucugauagauugcccugaauuucauccagaauuuuuagcccuaccuuaaccacuugauaacaugugaaaaggaacaaaaaggcuccuaacacuagaaaaaguuuaaggccaaacauaccuuguaaagcuauuuuccacuuuacuucugauagacugucuugaauuucguuagaaaguucaaggccagacguaccuuguaaagcuauaccccacuuuacuucugauagacugucuugaauuucauuagaaaguucaagaccagacuuaccuuuuaaagcuauacuuacggguacccuguaccccagcugaagaguucugaauucacgcaguugaauccuucucaacagucuguguugugggaacacuuuauuaucaccguugcccagcugaagaguuuugaauccacacuggauccuucucaacagucuguuuuacgggaaccuuuaugaccgugacccgcaguucugguuccggaaugagggaucuuccuugugccggugaugguaaccgucccagguuuucuugucucaggauuucucgucucggguuuucucguccuggguuucggcaucaacucuuacuugcguucacgaccggccaggaagaacacagcaaaccagaauguucugcggcaaaacuuuauuguuuacaucuucaggagcaagagugcaagagagcaagagcucuauugcuuacaucuuuaggagcuagagcaagagagcaagagcucuauugcuuacaucuuuaggagccagagcgcaagagagcaugagcucuauugcuuacaucuuuaggagccagagcaagagcucuauugcuuacaucuuuaggagccagagcaagagagcaagagcucuauugcuuacaucuuuaggagccagagcaagagagaaaauggugaaaccccguccccuuuaaggagaauuaucuuccgccuaggacaugucacucccugauuggcugcagcccaucggccgaguugucgucacggggaaggcagagcacauggaguggaaaacuacccuuggcacaugcgcagauuauuuguuuaccacuuagaacacaggaugucagcgccaucuugcaacggccaaugugagggcggcuucccacaugacugaaugucaccuggauacaugccuccaggccccaggguccucgacuccaggugccauccaugcacaaguguaugguaggguucagucaagccuggaaacugaugucuggaagcuggagcagacaaacaggucagaggaguacaaguucuagucuauagugucucuucucauccugaggcccuuggaugcuuugguguacacccagugacuacucuguagccaaacacaccucggcacugaaugagaagagucugggucagauagcucuuaaucuuaugucagaacuuugcuauggggucagaagucagaggaugaccaguagaaagaucccucugaugaugggcaccaccuccauucccacccaccugccuguggaugaaagcauguacaagucuggggcacagccuugcugccagcugucuaccuuagcagucaguauggcugugcucagcaugcauuaagaauaugcucuguccccagugagcuugagggcucuggcuucuauuggcaaagaaaagcaaauuaaagccugggccuuguacucauauuauuggaaaaaguaaagcuggaaagagguuaggcuuagaagauuguguguagaggcuucuauuuucgacaaaguauuccaggaaggcuaagagaugugagcauggagagagccuggagaaggugugggagcaaaggcccaguggcagccauaggaauggagacagaagcaguggagauauucguggcuagagaggaugggaagaugauucaggcugaugggggugcaaugaaucacagacugcaucucagagcucaauguguacugagugacagcugcgguuauauauaaugaccuguucccucccucccuaauuuccccacauguuccugcucucucugugucguagugacucaccucugagcacacugaggcuuccucugagcaucauucucuccuguccaccaguaagcaucuucuccaucugcccaggguuagagucauucgcucagcacaucuucaggccaaguucaugcauacuagguaaagguggcuggauaaaugaaugagcaaaugacucauauugcuguguguaagaauagcgagaucccaaggaggauaucuucuggaguccuguguguugcucugaggaguccucccucuaacagcuuuuccucaugggcuaucacuggagccaggagggaugggagccucugaguaguuggugagguaacacaucaccauguugggagagggguguuggugugugugugugucuguaaacuuugcaacguauaugguaugaagugugagccacugccugaggguccccaacccucacacuccuauucccaagcaguaggcauggacuucucaggacaccugcugccaugagagaaggggccuuccuccuccugaaaccccaccccugugucuagcaagcccguggugcuugggccccuguacuagaccugccccucagcaacaggagccucugcggucccugcccugauguuugccuggcuacauccuuccuucccuccccucauuuccucuuugaaguacaggaguuaggaugucacuggcccuacccagggaugcuuuuacaucacagugaccccaggcucuuuaccagcacagaacacgguuuuuaaugccacugcacuaggugugaccugcaagagaagcuuuucaggucgguggcuucuauccucacagggugcuguacucagauggagcucauugaggaagccuguggucuuucacaguaaaaguccuccaauguccccaccgagcauuugccuggugguucaguuugucucugucuccucauagcuucuguuucccuuccuuucauagaaauaggcuguaaacuccacacacagggaccuucacucuugguuuaaaacuaaggagacaggacucagaaaucaagguagcaagaacauauggcuagaagggaaggcuguaggcagggauugacccagggaccaccaaaucugcaugucccauugcauacugaccaguaaacugcagcuccuuuuagggacacacauaggcucagucagggcagugagagauauucuacccugcacuaugcuacgccuggcucauaacccuuggguuacugcuggacccucccaauaguaguguugggugcuggccauuggccagggcagccugagacauugaccaugcagaaccaguccuagaggccccaugccauuccccucacuacuggggaaaggccauugcuggcuacuugaccuccagcaucagaguacaguugauauaaacagucaucccagccaaucaggagcccauguguuagucauuccauagcugguucagggaccccaaagaaccugcugccuccagccugggacaacaugccaaccugagccugggugcugagcagcaaagcagagaagccuauucugacuccaucccaccuggacugauugcacaagacauccaucuguagagggacugggggaacgaauuggaggccucugcccucuccugcuugcagcaaugucuuucauguccuucaaaagagcacuuaaggccugcugugcccaguaauuucagcagacugaggagugucuugaguucaaggcuggccugggccuuacagaaugacucuaucauagacagaugguggugagguucuccuuuaaucccacuacucaugaggcagagguagauggaucugugugaauuccaagcuagccugaucuacagagcaaguuucaggacagccagugcuacacagagaaaccuuguuuaaaaaaaaaaaaagacucugucacaugaaaaugggagggggagaauaggcuggaguuggcuacgacuguugguagaaugcuugccaagauucacugaagucuaaagucugucccuaagugcaccacaaaaugcaugcgguggugcauggcucuaaccccagcccuugggaaauugaggcaggaggaucaggaguucaaggucaucauccuuuacauaaugaguucaguguccagccugggauacaugagacccugucucaaaaccaccggguguggacucagcccacaggaagaagacuauauaacacaggugucugucccucuggcucagccuugagcgucuacugugcaguugagcauugauuguguccugagauuuuugacuugcuaauucccaaagguuuccguaaagcuggacauuaggugaggaacgugagggccuggaucugcccugccuuucaugucuuuccagcuauccccauugccaguuccuagucugcuuggguugguccucuugauugugcuccauguuagcuggccgaccucugucccuguggggauacuaucacuuccucauugggcagcuguugugugcugcagggcagugaguucuccuuagcucuggcccuggcacacacccacacauugcuuuuugcuuuccccuucaccgcagggaacuagcugcccagauguccugcugaucccauacagaagcagaggccuguaaaaggucuggucuggugaugagcaucuuugaugauaaugaccucuugggaaggaacaagaagccuuacuugggaccccauagcuggauugcuguccaaaaggagggacaucagcaucuggcaagugaacagccccuagugugacacauuccugagugccuauucuacugucacuauugugccagaauggagcuuucuagaagacuaauucacccacaucccucacauuccuuccugagucccuaacccuggaggucacaaaguguuugagccuucaggauaggaagaggcucuugggccucaugcugagccuuugaaaugucauacagccugauucacaguuauaaacaguguguguacccugcccuuuuuugggacacuguggggguucacaguggcaaaguauuaaauacagaaaugcaggaccccgcagucugagagguggagugcucccuuuguguaagcauauggaccuggguucagauccccagcaccuguguaaagugccacauauguccuuguuugcugugauccuggcagugugggauagaaacaacaggaaccaauucuaggguauuucuggccggcuagucuagacaaaaugaugaauaguacucucuggguucagagagaagcccugacucaaaaacaggggcaggacucugaggccuguagaccuggcucuguucuuacaaacaacuacuacuguuucagaggaccugaauucaguucacagcacacacaucuggcucugugagccaucaguaacuucaguuccagagcccuggcuucuucccgcuucucuaagcaugucucauacauacauacauacauacagacagacauacaugugaauagaaauuuaaaaaccuuuuuuaaaacgaaaaagcuagcugggcagugacagcacaaaacuucaaucacagcauucgugaagcagaggcaggugggucucugugaguuugaggccagccuggucuacagagugaguuccaggauagccagggcuacacagagagacccugucuugggagaagugcagaauaaagaaaagcaaaaagaaggaaaaaacauucucaugucgaccucuauauccugcaugggaaagcaugccuguguauauguauauaagggugcaugugugugugcaugagggugcauugugugugcaugaggguguguguggugguuuguauaugcucggccaagggauuggcaauauuaaaauauguggcacuuuuggaguaaguguggccuuguaggaguaggcaugucacugugggugugggcuuugaaacccucauccuagcugccuggaagucaguauucugcuagcagcuuucagaugaagacguagaacccucaguuccuccuguggcaugccugccuggaugaugccuuguucccuccuugaugauaauggacugaaccucugaaccuguaagccagccccaaugaaaugcuguccuuuguaagaguagccaugguuggucaugguaucuuuucacagcaguaaaacucuaauuaauagaguauguaacacacacacaugagcgcuugcgcgcacacgcacacacucacacacacacaugcacacacucacacacacacaagggaguucagugucugaucugaggaagugcucugaacaaagcaggaccagagucugaagguagaugagaauugaugcuaauccuagaggccucuuccaagagaaagcacauacacccaaggacugacccucucuuaaacagacagcaagaagggcagagagguggaggaucugcaggugcagagacccuggggcugaaacagacuuaucaggguccaaagaggggaaaaacacaguagugauguccacaaguguaagucuuaacagaaggucagaaaugccauucaggauguuggggagagugaccauggagucugagaaaucugccccaaggaguggugggauguuugugucugaacaggcugcagggugugaguaggagcuuccucagugacuggagugggugugacccagaugagccuagcuuagugaggagagucacccacucgucucccauccuguuauaguagcaguuuuuauuuagaaaaaguucuuggggauuuccuguucuuuucuccaccuucucugguucuguaauuccuguggggccucucaggcuugggaaagagcagagggagagaggucugucagugcaggguggggcuuuccaugcagccuugccagcugccccucuuucuccuuuuacauugcacuuuuaccuuguugcuuaaguuuuaugcauauggauuaguuugugugugaugggcaugugauccagugaauguaggucagaggacacaaccucugggauucaguucucuccuccuaccaugugaguucucaggcuuaaacuccagucaucaggcuuggugccuggugccuuuucccagggagucauuucaauggcucugaugccuuuuuuuauuuaaaaaaaaaacugaaaaaaaccaaaaaacaaaaaaaaaaaaacagucguugaugcucuggggauuugggaguuugagcucuuggcguauggcuugggagucaggaagguuuugcagugacagugccuugacaugggacuguggcucagauggcaggcugagguugcaugcugguacccaguaauacccuauccucccucccauagaucucacuggguggcuguguguugucccacucagaagaggagggaacucccucacuguagccuucgcccucccuggcuugggucagaauaucuucuccagagagguccaagguagcccugcagcuuaugucuguggaccugaggaggacugugggaugggaacucauuaucucucacucaugguaucagugaguaaagugaucaccggaugccauaggaugcuaacugcugugaauaggaucccugugugguggcaucagcuccagaguccuugguacugcccagcacuguccaagaaauaggauaacauucauauauaauaugagauuuuccuacaaccacauggaaagaggaaagaagaacggggugaacaguauccacagccuguuggauuuaacgcuuuguauaccaagcaggaaacaacaacuguguauuuuacccugaggacuuacuuaguuuggacuagugguucucaaacuucuaaugcugugacccuuuaauacaguuccucaugucauggucaccccaaccaaaaaauuauuuuuauugcuacuucauaacuauaaauuuuguuaucguuacaaaucauaauauagauaugugcuuucugauaguuuuaggcaaccccuaugaagaguccugcaauccccaaggaguugggacccacccauugagaagcucugguuuagaccuacugugcuuucuugccuaguuuagaaauugaaaggggugugugcagagggcaagggaauccgccauccuucgcccucuaguguccgggcagccucauuguagcuuguguggcuccaggugcaucuccuguagcugauggccauucugcagagggcugccugaaguggaggcuaaggcuguuugcguuucaccuacagcggguagaggaggacgagggggaggacuaggaggaggacaaggaagacgaggaugaggaugaggaggaagaggaacaauauucugccggucaccguaaggaagagcauaguugaggcugauuccugccugccaccuucuguuccaccugacauggaacaggcucuccaucagccaagcccagauggucuguugaaguucaacuucacagaggaugcacccagucucuccugaguccaggacuuccuagggauuugguaaccacgucucccaccaccuucccuccagggucuaugucuagcaguccuugaaguuuggcagucugacugaugagauugcugcguggugggaugaacuguaccaugcguguuccuagccagcacugagcuuugguuaaugggacauuggagcucccaagggccuuucccagagacagcacaucugugcuguuagcaaagcuuuuuacucgcaguacaaagcucggguuaaauauuuucacagagcuucccagcuacuuaauuuaaaauucaguguguuaaggacaauaagagcauaacagacccugggagaagggguaggggcuguuagcucccucccccaauuccuauuacugugaagucacauguccuugaugcuccaaggcuguugucugucagaucuaagcccugcuagaauaugaagugagagguggccaucugaaaccaagagauccucauuccuucccccuaaaaagaugaaaguaggguucuaugaucagugaagccuggguuagucugauggccggagcuagguagguauuuuucuucuggggagcaggcacagugauuuuucagucccugcauaaaagcguucuuuuuuuugucaagcguuuucccagacagcuaaacaucacuaaggcuggcucgguugcuuaaugaaugacagaggauuaaagggguguguacuacugaaccuguaacacaucuuugcugcugucucagugccuccaggagagguaaaaugaguucucucauauuaaauauuuuauccaggucuuuguuaggcaucuacgggcgacucccaggaagcaucuaugaggccgccagcauuucuggguuccacuuagcagguucaugaaugugagcauuaagauaucauggcuuugacagccacuuuauuggccaggaucuucuuuggguaccagcuaaacucaccuuggaaacucauugccucucaggauguuagcagggaaggggcccaggauagaucaaaacccaaaggacagagcccagcucuaaccuaggucuuuucuuucucaaugggacucauucugcuaacuccuagcugagccacgagauaccgcuuaccacucccuggaggcucugucaucuucuaccauccccucugggccuucaguuuugacucuaaauuccaucuucuuggccagagcaccuaguucuccugccuaggaagaugccauugaaguacagggcacucgagaguagggaccacacuccagcaugacucaagcaucuauacuucaagaacccaagagacuggaaaacacuggagcagguccugacugccugcucaaguaugggcuucucuggugauccacucucccaggugacggaguguaucugucaagaaagaggcuaagguggggguagggggcuuucugcugcugggagcuugcuuucuuguccuccuuggaggguacuuuggcuagcuugcucuaugacuguuggucaucugucccaagugucuguccugaauccuuguccccuuuggaggguaaggggggucacugucacugacugcacuggcugagaguuccuauggcucaaggcuagcugcuggauauucaagagucucagcagcacuuagcauuguaaagguguguuuucccaucuggguguaguggaacauggcagggcgggaggacuaugcuccauggagucccuccaagacuaaggcuucuuuacauagagcccuucuuuacuggaguuuccgaaaagggucaauccuacccucucuuccuccuuaucucauacugcuugugccauuggucccaggugcuuaagauggccagacacauuccuauugucacaacccuuucuuuaaaugacauugcaugcaggagcagaucuucaagccauugcuccucagaaccaggucccgaggcucagacccuuccuuuucccuuuucuacaucccaugaacccucaacaccucagggauagcccugaaacauggauugaaggcucccggguggucuccauccuccugaugcuuacgccuuguucuuuuuauccacagagggucacuugggaucugcuuggaggcuaacuaugucaaaguucuuccugccuccaaaucaguaugaguacauccugggaacaagggccucugcgcgcgcgcgcgcgcguguguguguguguguguguguguguguguguguguguguguguguacuauagcuacaacagcaagaauguccaaaaccaaugcaaagcaugcauucuaauuagcagccugauaccaggaaggaggcaaaggcugggcagaggcacagcccuguguucuggagcucccaccuccgaaauauuugguaaggagcagaucuucaagccacugggaagggaaugggaaauaagggaaacgaagccucuccuccaacaccuccaaggcugucugcacugcagccuccucccggcagguuuuugcagagaggguacaaggaguuuggcauucuaguagcaucuguuagaugauaaaucacagacacagcaaugauguguguucaaugaggugaguggaugcugcgugcgugagcuggaaaccaagggucuguggcaaggcuuuggggugcagggcuguugaucaugaagaggagccacacacagggcuggcuaugguggcaaugcagcuguuuccacauugcccucucugggacuuucauaccagcccaauccugccaugcucuccagucgagucagcuugacaggcggaggcuuggaaguugcucaugaggaaaaaagaguuucaaggaagcucuccuccuggagucuggcguucucucuaacccauacauuaauuuuccauucccacauuagucuaguguauggauccaugugcucucuauuaguauuacccuauuauaagugccuuuuaagauugaauucugacauagcuaaagccuuccccaguguuccaagaucccagaaaauccugugagaaaacagcaaggaaguuuaagcuauuagguaacuaauuaagcauuacaauggaugaagccaguggcucaacuggucugcagaaagagccugggaauuucacugagauagaaaucuuuaguacaggcuacguuccauaccuaaagcaaaccgguauacucuccugacaaauggagauucuccagauaagauacgaauuagcaaggccuagaaauuuagggguccgugacauuacauuauuuuugaggccugccaagaggaaaacccccuggugcuauuaacacuaaagagugaaauucuugccugucucuaggcugauccuaggcaggacugcuaaucucuauugugaacauuuacuugguuccugcaauuccuuucgaagucauuccuuuguaucugguaaacuucaauguaccuuggcugaugugacuugcaaccccugguauucucuguacuauaaaaaagucugaugcucgaccugacaauacauucagauucaacacaaccucuccugugugcaucugucugucuauucauccgacgcuucgcccaccugccccagagacccguuccacgcagacacaaugacccagaggcucugcggcacaaucccauagcuggguauccuggaguccuguccuggcugacuuaggagagguucagaagcucucugauggucagugcucugguuagcaagauguaacugaugggugacauuucuaaguuaacuccaggccagagacacauuguaaguuucccugugugaaugguucaguggugagggccuuggagcuacauggcuucaccaguucuaggucuuuucucuccaauacuaguauuugagcaggggaccccacaccuccuaucuugguccaaccuggcuucucuaccuuuuaacugcuaccaccccaaacucugcccucuuuucuggggucuccugcuuaccuuguuucacaguuuuuucuccugccugagggccuccagagggccugucucugacaguaacauccuaguagccaccuccugggcucagcucauugucucuuccucuauguacuccaguucccuucucccuccccugcccucuuuuucccucucccucauuucuuccucccuuccucccucccuuccuuccuuccuuccuuccuuccuuccuucuuuccuucuuuccuccuucccuccuuccccccuuccuucuccaucaauauuccuggauaauccccagacaucucuuuuugcaccucuugucuugcuccacuaagggauucuuuggaccaaacaucaccagguguaccgcccucccacuguuggcuauccuauucuuaccuccacuuccgaguucccagaguuccuuuaacuuuacauguguuuuguuaauugaguuuccaaaaugaauuaccuacaauaaaacuagggcauuucuaucccuucccaaagagucaugauauggucuuacucuauguugggguguggauuagagcccuggguagugggcuccauggagagcagcucaucuguaugcuuauccuaggucuguguugaccccucagccaccagcagucgcauuuguccucuuagggcagacucucuguggcuggagaaguugguauugugugcuccuguucagagcuggauguagguagcuucuggggguacuuccagccagcacuggccacccuggcaagcucaacuuguguuugaagcccaggcuguuggugauaaggaaagaggacacuaaaccaugguagaagcaaggcugugagauaggaagugcauguagcaagaaaagagaggaucuggcagucagccaucaccaggggacucaagagagccugcaccccucuaugcagguccuccaagaccuuaguucuguguuucaguuguauuuugauuucgagacaggguccucucucuguaaaccaggcuggccuggagcucaaagucaucuggcugucucugcuuucugacugcugggauuagagcugugugccagcaccaaggcucugucucuauuucuuguuccugaagccccucccagacagggcuuagcuuauaguguucuaucaacucggagguucuuagacaugccaccagucaagagauagaggcugggcaacuaugauuuggggaugcuucuucuuugaguagaaaauaaaagcuaaggggacugggauccuggagagagggcucuuguuguucuugcagagaaccucaguucaguccuguucccuauacccacauguuggcucacaacuucuguaacuccaguuccagagauccgacauaauacucaggccucugcagguaccaggcaaccucagaaaguauuauauaacaagaaaaacauuuguaacauacuauauaaauaaauauucuuaaagcuuugaaagagaaaaaaggaaaagaacacauggacacauuucaacaucuuaaaacugcaaaugacauuuaaucacagcacuagggaggcagagucagggggauuucugaguuugagaccagccuggucuacuaagugaguuucaggacagccagggauauacagagaaccccugucuaagaaaaaaaaaaaaagaaaccugcaaaagagccaggcuuuguggcucacacugugacugcuagacaggggaggcaggaagguaagggugcagguuguccucagcuacauaguaaguuugaagacaggcugagguacuguggggagcguguguggcagcagucccaagauggcgcccagaacugcaaccaagucuuaugacuugcaccugacuuccucauacaccugaaaauaagccacgaacauugugagaacugcacagguacaccaugaugcaagaucagaccauauguagagugaugauucuggccaauggacuacuguuauguggacugggcugauggggcgugguugagggguuauauaagggauugcgauuggggguggagagauacacaagagacuauuccuggagagagauucaugcauguauguugaaagguuccugaauaaacugcuuugagaagaacguagugucauugcuccuuucugcugguuggaauuggaggcgacaaaugguggccuguacggggauguucagaacucaucagucagggcagcuagcuggcaagguucucggguaaguuggacaauuuaaguucuuggauugagacuauaagguucccgguuuugggacaaguaaagguucccgguuuugggacaaguugccccaagcaccauggggaauucaaccucaggucaaacaguuagccaagcccuuaaggacuugcugaaagugaaaggaaucaggcugaaaaaggagacccuggagaacuuuuuaaaaguagugaaucaggucacuccuugguucuccguaucaggacuucuuacagggcucaggugggagaaguuagggaaggacuugaaguuugcagaagaacagggaguucuugcuaaaaaggggugcugccaguguggaagcuaauacgggauuauaucgaggauaaggaaagauguggagcagaacuccaaaagggcaaugaggcacugaaucgggugagagaggagcgaucccaaaagucagaggcagaaggaaguucuagugauggggauaugucugaggacaaucuggauagcauagccgacagucuagagaaaguaaaaaugaagguagaaccuucagggcuagggccaccauggccgccuucguaagucccugacagagcauuggggcguagucugcauucagaaaccuggagggaacugggagccaagugcuuuccuguauuucaggauguacagggaggucauuaucaugagcugcuugauuggaagauuguucaaagauuagcggaagggguuuuuuacuuaaggugucagcgcagcuuuuguaagagugcaauuagagaaccugaaccucuacuacaugacuccaagcaauuggcagaaucuggcucaugccugauugucaccaggccaauaucuagacuggaaggcauuuuucauugaguuugcugccgagcaagcagcaauaaaugcuggcaacggccagccagccugggaucaagacaugcugcugggacaagggagauuuguagcagcucaaacucauuaucccauccaaguguacgucuugacugguuguuggaagggcacugacccaguguagguuugggagagagggucuguuuguguguuuccccaggaucacugacaacugcugugggucccagagcugcugacaagagcaauucagggcaagcagagcgaugaggacguggauauuccuguggcugggaaugcucccgcuagugagaacugaagagcuacauuggggaauuaagucuguguucccgaaaaccauggcguugacgcauucggcacaaguguuuccuagauucuuuacaucuaaugcuucacuacaauugccuuuuuuaucaugagauggagagguagcuccagugcaggaaucuaugcugcuugagcuaaggggauuguuguguuuucagaugauucaaaauauuucacagaugagugauuguguucagcuguaucuacuaaagcuaaugcuaccuguauucgagggguguguccugcuaguauauccaagggcaauagcacuauaaccuacuaaccuagauggacccuuuuuuguaggaguguuugugauucccuuccaccuuggaccggcugucaaucuagaaaauuaccuugggcagugaagaauuauuuuucauuuuccccuuauauagguacaguccauaauaguuccuuuucaggguauaauuggacauuucaaaaucuagcucaaguaggagcuagcaauccuuuuaauguaugguuguuagguggggugaaugguaguugcacugaucuuccccccuuaaucaugguggugggaggggccugggacaaugcaaauuuuuauuggaaugguucuaauauguuuaaaacuucuguauuccaauuugcuggagggaggaauguuucuuuucaggcuaggccuguuuguauguggcuuccuuuuguguuuauuguuuauaaugguaguuaugagaauaauguuguuaauuguaguagugauauuuguuaugauaguaugugcuggaaugcaucugaauaucauuuagcuguugugacuaggaugccucgcuuuguaccuuguccuguucaggcuccuucuccuaugacuuuguuuggaccuaagagggauuuuuggcauugcugcagccauugucacugcuguagcaaucucugccaccgcagccacagguguggccauaucccuuacaaacugccgcggcugugaauaauuuauccauggguguugcaggagcuuuggauugcugacagcugucuccugcuugaaagagugcaccggaauugauggacuugcccugugucugauauuaaucagcauccuggcuuucuggugcaccugcugcauacagagucaucagugcagagcccaaaccuugaugauacaggcuuuuggggcagcaaaaacaggacaaucuccucauguggcuuggcaugcuagagaaauagucaaugacagguaagacucccugggcgugucaccaaccuaagacagggaucaaaccaaugcuguuugucuccccaugauggguaaggggcauugcugcagggggcaaccuaagacagacaugcucucugcaaauaaguaaagaagggggagauguggggaguggguguggcagcagucccaagauggcgccccagacuacagccaagucuuaugacuugcaccucacuuccucauacaccugaaaauaagccacaaccaucgugagaacugcgcaggugcacaaugaugcaagaucggaccauaugaugagugaugauucuggccaauggacugcuguuacauggacugggcugaugcggcaugguugagagguuauauaagggauugcgauagggggcaaggagauacacaagagacuauuccuggagagagauucaugcaugcauguugaaagguuccugaauaaacugcuuugagaagaacguaguaucuucguuccuuucuagcuacaugagacccuaucucagaaaacaaauaaacaaauaaaauuacaaaggaaacaugacaaaagguccuacaagguaccuguccauucagccaauuccccaugucagucaacuuuaccuuuccaguaaguucuuccacaggaggccuccacucacaaacccauugaccuuauucucacggauggcaucaaucaccacauguccuuguacauaaucuucuuccauuuguagaucucucucucucucucugucugucugucucucucucuucccccaauguguguguguuucuuuguuuaugucugugugugugugugugugugucugugugucuguaugagagagagacaggguuucucuguguaguccuggcuauccuagaacuugcucuguagcccaggguagccuuccuugaacuccuaucugucuguacugucacugagugcugggguuaaaggcaugcaccacaacuggauuuccuguucucucucuuuuaaaauaacuguguuagacagggucucauguagcucaggcuggccaugaaguuacuguauagucauagaugaccuugaacuccugauaauccugccucuaccguccgguucuagaauuacagauguguagcaccuggcuaccugaguugaugauuauuucugaucaagauacuguggacauuugaguugguuguuuguacaggggaagacauguuuagauaaguaaaugugugcuuugaaaggcaauaucaagcugccauaugucucuguuggacaaggaacuuuaaauaucuccuagucauguagauaaguaaauaaaauauguacauaagccgggcgugguggcacacgccuuuaaucccagcacgcgggaggcagaggcaggcggauuucugaguucgaggccagccuggucuacaaagugaguuccaggacagccagggcuacacagagaaacccuguuucaaaaaaccaaaaaaaaaaaaaaauguacauagaacgcuaacagccugggaaagaggugaagaagaugggcgguagcagguaauacugagugcaugucucaucuuccuuaacaggaccuagcaccuagugcuuagaauucauaagccucugagcaguucagagugguuuccuuugggacuuggguagaggagacucacccacacuaguucuucuacacauuucaaaaauaacugagcuaugcagauguguuacugugaaagaaagaaaucaaaauugagguagggaagugaacaaauauuaauggccaauggccaaucacugcaggaucucacacuugggccuuguaggagacugcaguggggugugcuggccaaugaagcacaguccugaauugccaugggggcuguuucagcuguuaacauucauaucgacauucaccaaccgauugaugccaauucuagaucucccuggcagaacaauaucucauaggcauaauaaagaguggggacucccauaagguucccaggugucucuucuagcguuaaaaacagcauggcaugugcugguaacuucucccaguauuauauggagggggacagggaggucuuggagggucuagaagcacucugucaacaugcuucaaagcuuuaauaccuggguccacaugaaaccauacuuacucagaucaacccagaaaucuggguaggaaugggguuuuuaaaugucauuuuuaaaauuaggguugcugaugaaugaaguugaacuuugaagggccaaagccauguuacuauucucugguaucaucccugaguccacucaggaugggugucaaccuaguucaaaauuuacccuagcuguguuagcuaagaaugugaaccacuaacaucugccuaugcaggcgugauuuauuuacuaugcagcaucagcaaauguaucugugacaaggaaagaaacaaacacacugggucccccacaagaaaaagaacuagcuguucaaagcgaagagucaggauuggguccaugagaccucuuugaaccaagcugaugagcugagggguuugucucaauccugacucuuguguaacccuuacaggacauuugacaaagcuucauuccacugauuuuagguugccucucccuguccccuuauaccacgauucugcaugcaugcuccaaggagacuguauuuagccauaaaaagauauucuuucugucuuuccuagaguguucuggguuuugccaugucauauagaaccauuuuguaccuccugaggcgagccauccuggaaaugcuaaaagucagagcuugcacuaucauggucuugaguucuucuggcccagaagaucucaaccuguguuaucauaacccauuugacgauggaaugacccuuucacagggagucacccaagacacuccugcauaucagauauuuacauuauguuacaugaccauaaaaauuuacaauuaugaaguagcaacaaaaugacuuuauaccuggggguucaaaacaacaugaggaacuguauuaagggauugcagcuuuaggaaggcugagaaccacuguuguaauggauggcacuggacauacagagaauauugcuuagccagcauggugguagggugugauuggaagccacacuugggguuucagguauccacagcucaccuugugucuuggccuugcagguuuagucuccacugccagcugccaugggcaagcagaacagcaagcuggauccugaggugcugcaggacuugcagaaacacagggaguucgcugaccaugaguuucaggaaugguagaagggcucccucaaugagugucccaauggccacuugaaaaaauuucaagaucuaggccaacuucuuccccuacagagacaccuccaaguucgcugaauaugucuuccacauguuugacaccaacagugacagcaccaucgacuugggaguguucaucauugcucugaguguaaccucccugggcaagcuggaacagaagcucaagugggccuucagcauguccgaccuagacagcaaugucuacgucaucugcagugaaauucuggagauacugcagguagcugcacuugacagagccuggcacauggggagugcagugauccagaacccccaucccuggccccauacaccaggucauucaucugcccacuugcuaccuguuguacuaaaggacuguaugucuuugcagaaaguaacgauaaaagccaagcaucuaucgauugcuugcuggacaucaggccccaggugagcucaucuaucagguuuauucacacaauucuaucaaaugggucuuuuuuuuuaacauuuaaugagaucugaggcucagauaggugauuaagaauugucaaagcaagaacugggaaaauggcucagugaggaagaacacuugauacccaacaugaggaccugaguucugaucccagcaccuauggaaaagccaguaguggcugagcauaccugauacccuagaacuaggggacaagugagucccaaaagcuugcugagcaggcagccuagcuaauaugguaggcccuggccagauucacugagagagaaaagggaauauuuugaacaccgguauuccuguuuggccuuugcauggguggguguucaucugcacacacauguauaacauacacacacauuagcugucuauagggcuuccuauagaaauaaaaugacacaguaaaggaugagucagcagucaguucuucacaggagcguugcuuauguguacccugcauccuuccugcuccauccucuaaaccaucucuguauuugguccagugggcugacucuguggguaaaggugcuugcuaccaagccuggcagccuggguucuaucccuaagacccacaugguaggaaaagagaaccagcuuccacaaguugcccacugaauuccacguuaaaucaucucccccaaauaaauaauuacauacauccauaaaauaaguaaaguaguuauauacaguuccuaauacaauggcuauagauguuaauaauaauuuguauuauuugggaaauaacaagaaacuguguaccuccaguuucauuuucuagacuauuucccaccuguaguuuguugaaucugcagauucaggacccaugggugggcagggaucaauauauuuccccuuugaccuucccuccaggauuucccagauccccaccaaagaaccuccuuuuaaacagacgcuuucccccacaaccuccccucuacucugaaccaaggagcccuccauucuuccaugccccagcuguauccugugcucuugaacgucacuuaaacuuuccuggaucccuuugcccagcaccuugucugugagucuuguucugaugagagaaggguccugacucugcccuguccaugcuucuugguuagcugagugaggaccaauacccacccuccgucuuccagagcacacucacagaugcuccuuugcaggccaucuacaagaugguguccucugugaugaagaugcccgaggacaaguccaugccugagaagcaaauagacaagauauucaggcagauggacacaaacaaugaagguaggaaacauggcaggagugagcaggugggaugggaagaggggauugggagaggggguggggguggggagagagguugaggguugggagaggggaguaggugagccugugaaacuguugauggcacagagcuguuugggauacacucucuucccuaugcaggacugcccuuuuccagcccaauugauucagcucugauugagggagggagacuagaauucagggucagguacaccuagccugcauccugcacccuuccuagggcucuauaaccaugggcauugucaguagacccucugagcuguaggcuucaucugcguugucugaguuaggguuuccauugcucugaugacacaccauggccacaagcaacuuggggaggaaacgguuuauucacucacaguuuccauauaacaguucaucaucaaaagcagugagggcaggacucaaacagggcagcaaccugaaggcaagagcugauacagagaccaugaaaggguugcuacuuacuggcuugcuccccauggcuugcucagccugcuuucuuauagaaaucaggaucacuagcccaggguuguaccaccuacaaugggcuggacucugcuccaucaaucacuaguuaagaaaauacccccuggucaggcaugguagcacaugucuuuaaugagagcucauaggagacaggaggcucucugugaguucaaggcuaacguggucuaaaaggugaguucuaggacagccagggcuguuauuuguuucaauaaucaaaacaggguagaggagggagggagggagguacacacacacacacacacacacacacacagagagagagagagagagagagauagagagagagagaacgcccuacagguuuuccugcaaacauuuuauacagacauuuucgaaacuggggcucccucuuuccugauaacuauaacuuguaccaaacugacauaaaauuagcuagcacacauguugacagaaacaguggucuuacuauuuccacaaguauauauucggaggggagcaaggucauacuaguggcugaaggacgagacacugaaucaaggggcuuugagucuugagauucugaaugccugcaaggccaucauccugggaugugaggcuccccagauacucauggggcucaucaaacauagaagccacugagccucguuguaccuaggacucugagguucuaccacagaucaaaaaggcaggucucaggaggaggugauguggugagagguccugcugugccuuggcugaguuucucacaggaccucagcaagggugagguagcugcguggugaguuaauucugccagucuguggcuuuguagagccaagacugguugggaacaggaaaugcagcauuaaggcaugaaaggcuccccagaucgcacuuagauugaauguaagcuaaugcacaggaaagagcauugaacagccuccagugcucugugcagaugaacugaggaccgggcucaaugggacucaaggcucccauggaacuguagacagcaaaagcuuuccagacaucaaggaaaugcuuuucaaugcacacaaaccaaugcagccucuugccugguacugccuuucagccauuuucuaaaguguucuuuacucuuuuguguacucugacacggaggcuuguguuccaacagaccauacugaggcuuguccacuucccagguuuggcuuucuucuccgugaaauggggauaagcccaguggcgugguugugaggcuaaaguagcacuauguugguggcauacuuaacauggagggccauuguuucggauugucaaagccaggaccuuuaccaauuucagaguggagaccccguacgcacugugcacuuguccaauuguuugugucucacgauggaggccauugagcacauacucugcccuguaagccaggggccacuugcuagcacucaagagaugagaagucuaggcugucagagaaacugguacagaauaccacaagaauaggacagcaaagguggauaguucucaacacccgaaguuggcaagagucuacacuagggggcacugugauaguuuuaacugucaacaugacucaguuuagaaucaccucagaagucuuuuuuuuuaauucuuauuuuuauauuauuuuagauuuaguauuuauuuucuacaugagcguuuagcugaauguauguuugugucaugugagaggccaggaaagggcacugugucacccuggaacuggaguaacaaaugauugggaaccacucuauggaugcuggggacuuuauccaggacccucugcaaaagcagcaacugcuuuuaacuccugagccaucucaccagccauaaaggagagucuuuuuuuuuuuuuuuuugcuuguugguuuguuuuuuagagacaagguuucucuguguaucccuggcuguccuggaacuuguuguuuagaccauguuggcuucaaacucagagauccacaagucugccuccugaguacugggauuaaagaugugugccaccacugcucagcucagaagaaucuuaaugaagaauuaucuaaaucagugguucucaaacuauggguuccaaccccuuucagggaucaaauaaacuuuucacagagguggcauaagaccaacagaaaacacagauauucauauucagauucauaacaauaguguaauuaugguuaugaaguagcagugaaaauaaucuuaugguugagggucacuacaacacaaggaacugcauuaaagggucacagcauuaggaaggcugagaaccauccaucuagaucauggcagccuauaagcaugccuguuggggguugugcuggugguuaauugaugugggaaaccccacuacuauugucuagacagggggccugaacaguguaauaaagggaaaagaagaguaucagaaaaaagugcagagucucauuaugagccaagugcugauaccucuauucucccugcccugugagguuuuaaagccuugacuuccugaagugaugaauuguaaccuagaaguaaaccaaagaaaacuuccucccuuaaguugcuuuuaguuaggggauuuuuaucacaguaacagaaaugcaauuugaccugcagucauaauuuguccugucuccccagcugccccagaucgugguggcucuccaggccucuagguggggcuauccgcuuacuucaggccacagaguucauuccucugaccacuugugugacucaaaauggcauagguccacauaugugugugugugugugugugugugugugugugugugugugugugugagagagagagagagagagagagagagagagagagagagagagagagagagagagagagagagagaggagacuggacauuguccauuuuccagaggguuccagacuuuaaccagagaacuggcuaauccuaagucucccucuuccauuccucaggcaaaaugucccuggaagaauucaacaaaggugccaagagggaccauccauugucugauugcugcagugugaccccagcagugcuagccaguucugaggggaauaggcuuuacacaguugugagaaacacaggcuugaccugccaucuuaaguuuugcuugcaaaagugguuuucucugugauuucuccugcucucuagggaccuggguccaaacagcacaucacacucuccuggucuggcuggaugcagcucccuccucuaucugacccaauagaugucccuccccauccaguccaggcugguuccuuccaagguuucaaguguucucggcuguagggcuccuucccuccccacagagggccuggaggcccuuaaggauaccagacaggacuuuucaguaucuuaccuagaccagcugauuuauuugaugaucccagcugacuuugugaggaugaagaagauggagagcagacaggcaagcccuuccugugcauggcuacaccucccuuguucauuuucucugaccaaagcugcuugcauguauauaccaugguauccuuacuuuuaauauauaaguuuuguauaaaaugagaagguucagccccuguauuuaaagccucugacugccauuaaagcaugguccacuguguccugugauucuccccauccccaagucuggcuguugugugguauuuauguauucauuugccuaauuacacaggagauacaugcauucccaaggcuguggacaucugcccuccguccugcaaacacagguguuccugugugcuccguccuuccuuucuauuggucuggcauauuaaaauaaucuaauaaaccaa

SEQ ID NO: 6602 - RNA, 6501 nt, Mus musculus
ugggcucccccaaagggcuggcaucauuucuccagcacugcccucuguagcacucuaagcacagguuguccacuccucugccucugcuguucuugauggucaucccauggcacuggcaucugcaaugcacuggggucuucugcugcaacuaggcuuugccaauggccucucauaggcucucuccauaaugccaagccucagauccuuugcaugaccccuuaaguccugggcuguuaacuacaacugaggcugcaccuucaccucaggagggcuugggauggugugccugcagggaaugaugcaaaaugaagcagauagaagaagaaagggucagggcucucagccagcaagcaaacaccuguguuugagcagcaugucagcagaaggaaacuagaauagaguagagagaacagaauagaaaguuuuacagucuauaagccagaccacauuucacugggcuaggccugaaauugaguuaugaaguauaugacgacaaaauauucagacccauaaaaacaaauaaaucuuuuuuuaaaaacuagcaagauuccuuaugaaauuuggcaucuguuuguuugagggacaguugauucuagaaaugaauaccaccucucaacaccugggcucagugaguucugaggcacacacacacaccuugacacuucucacaaggaaguuuauacucucuuuucucagaaaugaggguggauggcuauugcaggggcgacaagccucucacagucauucuucugaagguaagauaaacugcgugagcaggcacggugguucauggcuguaaucccugcaauggcaagguugaggcaggaggauuuugcauuuggagcuagucuggacuauacagugaauucuagguuaaccugggacacauaguuaguucaaacuagccuggguggcauagggagacccuuagucuggcuccucgcacccaaauaaaagaaaaaaauguguugcgugacugugugccggcagcugccacuuucguguaacacuccaucacacuuuacgauauacuuggguuuucacacauuguucugcaaauugcauuucacucauuuucuguauuugcccccacagcguguugcuuguaguggcuccguaaauauuuaauggcucaacaaaucacauaaauagccccagcucuaugucugcuucauucagugaacauuuuauuucuagauuugauugaaugagcugcuugcagcuuggaguaagcacacaccaucuuuaaccauaugcugaaggggaaaccaaaggcacccucugauggccuaugaagccccaguugggaguggaggcagagagcauguguggcugggccacccagaggccacauagcaucugcucauagaggagacagucucugaagaagcagcagggagcccuccacccccaacaacgccagauggauccgucuguggucccccauugcuuuucuccacacaucucagucuauacauuuaaaaaaagcugagaccacacuaaauggcacagucugucucgaugcaaccaggggucagaguggguuacagaggucugccccauguuuggguuggaaccaccuucaagggacucagagcccaggacagaugaauauccauuuaaaacaacagcaacaaacccacaaaaagaaaaagaaagaauaaucacaucacuuuagaagcugaagcaggaaaauugaaaauuugaggccagccuggguuauaaagcaagacucuuuaaauaaaaaacaaaacaaacaaacaaaaaacagagcuuagggcuggugagaugguucauugguuaggagugcauacugcucuugcaggugaccugaguugagaucucagcaccuauauauuggcucccaggcuauacuuuuaguuccagggcauccaaagcccuuguccuaucuuuuaggcagcaggcaugcguacauguaggcuaaacacccauacacauaaaacaaaguaggucuuaaaaacaagagcuggcugggcugugguggcgcacgucuuuaaucccagcacuugggaggcagaggcaggcggauuucugaguucgaggacagccagggcuauacagagaaacccugucuagaaaaaccaaaaaaaaaaaaaaaaaaaaaaaaaaaaaaccaagagcugaagauguccuuccagugauagcuuguaccuaacaaggcccuagguucaguccccgcccccaaauaaauagcuaaguaagggaacucagcugugucuaccacacccuuguucauuagaagucacagagauugccccacauugguuauugaaagugcauacaacuugacaacuauccugucaccagagcccacagaguuuaaggcaucgcguaagcuccccaugaaggaugucccacucugguuugguaauucuugaaagucccacacuggaaaaguucuccagcucugagcugggccggccagggccuuugccagugggcucaggaaguuacccauuuuuccucugacggcuucagugugcuuaucuguacuucggggaucagugaaucagacugucuccauggcgauuaguaccuuguagacagguugaugugcuacaucaaggcuugagccucaaggcagacuuggacucucugcagauuggaacuacacgugagcagcaugaacacugauugaagugacuuaguauguccugcccuccugcuggggccuguucuagaggagaagccagggauccccauccuagguugaaugacugucuccaggguccccccccaccccacccccguuaaacaagcuucaguucuguguauucuguucccagagagucagggagauugucuaacauagacugaaggcagguuuaggaagucuacagcugcuacugcaagaacaggcuucccuccaggguagcugggacagcaggcagagagcgugugggaauuguaccuagagcagguacaauccagauuggugaaguaugggccuggguguuucccuuucugguuccugucccccugggggugagaggccacuugggcaguggcucuuggcuugguuagcucacuugccucuuaaugccagcuucuaagagugugguugucugcaucuuaccgugccuguguugcaggcccuggcuuagagaaaugccaucugcaggcaccagcaggaugauagagaggugcggaccccauccauuuuuugcuaagaaggacaggaugucaguauuguguuucaaaaugcugaguagacccacacacuccugaaccucagugucugucacauaggaccccugcaauuugaggauaucacuucauuuacucugauucccugccaccacugagugugucccuuuuaaggcacccaugaagacuacaaaggacagggugcagauguggcuuucagguaauaagaagacagacaaaguacuagggagagccagaacagagagcagcaggucaggguggccagccuuucugaagagggcacucgggaccugcaggaggaacucaggugacagcagagaaagacuugagcauguggguagagggaugugagcaggccaggcaaauacagggauggguuaggugugggaacugcagcaugcugagggggcgcucagggcuauggaaggagacaacagcaggcaggcaccugagagaauguaaaaaagcugugcaucuggccuuuguccuuauaauuguguaaggcccaggacugcugggagggcagugccucugauacuggaaccuagacacuccucuccuuaaggaaggcacccccagggccccaagaggccuaggcaggguuguagaccauggacugcauggauggacagaggcccucaagguuugacccauccaucgugucugguuucaggauugcaaggaaggacuacaucacagccaaguacauggagaggagauaugcacggaaaaagcaugccgacaccgcggcgaagcuccacagccuuugcgaggccgucaagaccagagacauuuuuggguuacuccaagcuuaugcugaugguguggaccugacagagaaaaucccacuggccaaugggcauguaagaggggcugcaaaggaugggaaaugcgggguaggacaagggaggugugcagcgaguuacucuccauguccuaucacucccuggggaggaguagguggcaugcuuuccuuuaauggguaagcaaaugcauagguugagcauacaguaucauaacugcuuggaccacaaguguuuucauucgggguggauuuuuagguguugaaauacuugagagcuuagagaugggagacagcuggcuuguaucgcccauaggcauauaugcguguguguguguguguguguauaggaagagagacauagaaguaaauuuguacaguaucaucauugugccuccauuuuaacuguuagccgucaucugagcucggauguggaauuuucugcuugucaaaacauuuuggguugugucgaauuuaggauuuaugaccugcauucagggugcccgacccauucauaugcaacacuauuaugauaugcagcacagcauuuugauauauauucacauugcagaauguccacaguacagguuaccucguauacagaucuuuugucauggacacauuucaaaucuacucaguuuuuuuggauguaugauucaaauacacgauuaacuacaaccacugcuauacaacaggaccuacuaccuaccccuaucccguguuugaaaaagucuuacuuggcuagcaauccuccugccucagcuugcuggguacugagauuauccuguacaccaucacaccuagacugacuccuuucaaacugaaccuuuguauuuugguuuguuccuuuaaaaaauauuaauuuaauuuuguguguauguacuugaguguauauguguaccacaugcaagugugcauccucagaggacaaaggagggggucagaucccuuagagcuggaguuacaggugguggcgagccucccaguguggaugcuggcaaccaaacaugagucucuguaagagcagcaagucucuuaccugcugaacugucucuuuagcccuguugguuuagucuuacgccaaaaguguaaugccagauguugaagagaagcccaucugaaguggaaguguaaugccagauguugaagagaagcccaucugagguggaaggguauacauccccagaugccugaaacccugagaagacugucccuaccauaaacagguuuagccuccuguuaugugugaagcugguccuagagcaucucugaggccaugcugagggaugcuguggcaaggaccaucuuguaauucacacucugaguguccucccaaagggaugaguagagcaucuccuccagucuccagauuuugcucuugggaucaugucuguguuauacuguuguuaccuaaggagcuguguagucuccuggucuuccugauugagucuccaugggcacauagucuagguccaaagaaccucccaguuuuggaaugagguucaacaucuuguauggugggguacuaggugggguuucauguuuggauccagaauucuaggcuaagcuggaucccuugagugggacauuguaaggugacaccauuuucuccuggugacacaggcuauuccuaaguauuagccagugucacuuccauucucaggagaaagcuccaaccccaugacuagagcagcacgugcccacuacugccagaggacugagcaggcaggacaagugaagaacgaggcagccacccuguucgugccuucugcauuuugacuguuugcuucuauguuuugacccacucaccugguggugauguagagacggggacacaauugaaauggcuuggaauccccagcauuccucacuuccugcgaguagggagggauaggaaaguuaugaugucuuaauuacuuuaccauuucugugaugaggcaccaugaccaagacuacuuguagaagaaagcauuuauuuggggauuauuguuuugguggguuagaguucaugaccaucaugguggggagcauggcagcaggcagccaggccuggugcugggaaguggcugagaucuuacaucuucugacacauccauaauacagagacagacagacagacagaaaggcaggcagacagacuggacugagaaugucacaaaucuuucuaaaccucaaagcccacccccaguaacacacuuccuccaccaaagccacacccucuaaugcuuuccaguaacugggaacccagucaaaccagcauccucaaaccuaugaacccguggaggucauucucaucagaccaccacacaugccuuuugcuauggagauuaaagagugagcucucugcaucauagagaaauguuuugggggaaagguggaaaggcuuucagaagggacacuugcuauuuuaccuuggugguccugggguugaaagaugccacuggaauuccaaaugucuugguuugaauuucaggagccagaugagacagcccuccaucuugcagucagau

SEQ ID NO: 6603 - RNA, 50349 nt, Mus musculus
ggcugcggccggaaacgaguuaagccgcucucagcgagcgccgccugcacuuccggggacgugagccuagcuucccuguaggcggcgcgggagggagaaguuugcagggccgugcugggaagaucaccuccgcucccaaugugagcaguuucccgaacgcucuuucggagaagguuucccagagaggugguggacgggaacaugaggcggcgucuccucauccugaccacuuuggugccuuucguccuggcaccccgaccuccggaggaagcaggcucuggcucccauccgcgacuugguaaagaguucggggagcaaacugacuuaucugaccccagagugauuggagggacgcgccggggugcuaggggcgggauauugggcucccguggcgcgucccgaaguuuucaagugaaggaagggggguguggcucucgguguuuagagagagaaaaagagaugggcuugucucucagugaggagggaaauccuggaggggucucccauagggaccgagggccugggacgggcaaguucucccagguuuauuucuggaauauuuagaaaagagguguuggcacauggaugguucguuuguggagugugagauuuggucgagguccuuuacuugcuaacaagugaaucuaagguguuagguguuucugcugaaagcaagacccugggaagaaaggacagucccaaagcucuccaccacuuguuggcucucagaggcuaacuugaaguuauauguaggagguacugaaugcaguaccugguuggaagguggcgacugauguaguuucauuugcauuuuucgacuguauuuggaaucuugcauuggauuucgagaucauccgucuuguuggagaggugcuuagcugagagagcgaggcucaaacuuccaagccaauucuugaauuggcuugucaagaugaauguuuuccuugcaauuuuuaacagaucaccagggauaacccauuuaaauugccuagaaacuuaggguuucuacuuuaauuuuuuuagagauuggauuuuaaggaaaggcaugcuuuagaaguuuugaauugaaauuggcgauaggcaauuuacucgcuauccuaggauccuuuagcuugcaaaaguggcuaagacauuucaguuaaucaguaacaaagugucaaauaguuuugaugauagggaacuuagcaagugucuuagaaucuuuuagcuugcaaauguugccaucuaaggcauuucagcuaaucaauaacaaagugugaaacagcguguucccaauugugugaaguuacgaucaugucauuauaguauuuuauuauucagauugaaacccuauggguuuuuuuuucuaagauguauguauguauguauguauguauguauguauguauguaugugaguacacuguagcugucagacacaccagaagagggcaucagaucgcauuacaaaugguugugagccaccaccaugugguugcugggaauugaacucaggaccuuuggaagagcaguuggugcucuuaacugcugagccaucucuccagccccgccucccccccccccccuuucuuuuaaaugucuguuuugagacagggucucacuauguaucucuaguuggccuggaacucacaaugcagaccaggcugguuuugaacucauagagaucuaucuaccucugacccaagagguggauuaaagaccuugcaccaucacucccagucuuguguugguuuuuuuaccuuguguuuucgucuuauuuacuaaacaggguugugguugacuggaguagacacugaauguguuuuauguuuguauccaaauaacuuucuuguguguuugcauuuuaaaugguuauguaugugacaaauuuagagaacggcaaaggagcuaguuagaaagugcugaaaucuaaguugauagaaucugaaggaagaaauuucaggauggauagagauaaggacauacuucauuuuaaggaugcuauaaagaauuuauucucuugcauuugagacaguaaagugauuuuuuuuuuuuugcaccguucugacacaccuucuuaccauucuccugaccaggaguaggaagaaaaacaugaauccuagggagucauaccaguguagaggaaaacuacauuaucucuagacugauucucagcaauguaaacaaaucauaaaaauuuaaaaauauuuauuuauuuauuuauuuauuuuucuuuugguuuuucgagacaggguuucucugucuagcccuggcuguccuggaacucacucuguagaccaggcuggccuugaacucagaaauccgccugccucugccucccaagugcugggauuacaggcgugcgccaccacgcccgguaaaaauauuuauuuuuaaaacagucugacuugauaggccuggcuauccuggaacuuucuaugcagaccaggcuggcuuugaacucauggaucagccuuucccuccagaaugcuugcauggauugucuucuuucuuucuuuauaaauuuuuaaagaauuuuuuuuuuaaacccacauccugaaccuugaagaaauccccucuacgucaggucugcucucucucucucucucucucucucucuuuuuuuaaagguuuauuuauuuauuacauguaaguacacuguaguugucuucagacacaccacaagagggcgucagaucuccuuacagaugguugugagccaccaugugguugcugggauuugaacucuggaccuuuggaagagcagucgggugcucuuaccacugagccaucucaccagccuucuuuuuaaauuuuaauagcaaaguauagcacauucuaccagaaaacaaaacccaagcccauaguauaaucuauugaccuaagauuugaagaacucauauuggggcuggggcugccaggaauuaugccuggcauuaagauauaaagaugaaauuauauucaucuuugaagguuuauggcuuaagggagacucauucagagaucuaaaucgaaugguuguguguaugcuaaccugaagguaaauuucaaaauguuucaaauacaaaaucugugaccuacuuuuuuucucuuccacccaccacaucuucuuuuauuaaaaguaacacaaaggaaaaacaguuuugaaaccaaagugugacuucuacacuccagcugcaacuucacuaugauaucaugacuaagcucaugugacucauaacuuuccuaaauuaugcaauucauaacaguuccugaagucaguuuuggugauccacagaauacccuaaaagccaaguuucuguuuauuaugaacuuuuugcccuucagaaaauuauauacauaaucaaucuuuaguacauuuauagucuuagaaucaaguaaguuaaugaaaaccaaaaccaaacccccccgcuggguucuuaaauuaaacugcuuguuggucuugaacaaccaagucuaauaguaggguugggugaagcaacaaacaauauagugaacugccaaacaccaggaguccuccuucagaaguccacaaggccugcucaucacuucaugcucuugacaacucacugaauccuucugagaccacuguuuuucuacccaauuaagaaaccuagguaaugcagcucagugcuuggcuagcguuuaugugcaaggcucugaguuugagccccauuucacagcucauucuuaggagcaccauugcacucaguguuuagauguuuggccucuucauacuaaaguugcuauuuauaagcugcaauccuauaaaaucaaaacacuucacacaaauggcuccaagggaggcuuaagguaacuuuguucugcagucauagucagagaugagcuauuucugugauacaagaaagaauggagcgccgaaauggggaaaucggagaagugcuagacuguuaugugugaacggccuccacgacccggugcgauugauuucuucaccauuuuuguuguuggagauagcaccuguauacaaguggaaguguaauuugaagagagcgugagggcuggagagauggaucagugguuaagagcauugacugcucuuccagagguccugaguucaauucccagcaaccacaugguggcucacaaccaucuguaauagaguccaaugcacucuucugcagugugccugaagucagcuacaguguacucacauuaaauaaauaaauaaauaaauaaauaaauaaauaauuaaaaaagagagagagcgugaacuagcuugauagggaaggaguaacaagacagucuucaccguggugagaagugaugaaugaaugaaagaaagaaagaaagaaugaaauguuucuauuuugccucuuugccuuaaugucagccgagagagcgggcacgucuuucccuaacuuccucuuugugccccacaaacaggaauuauagacucugaagagucucagccauuacucugauuucgcuuccucucugacuguguagagacacaugucugucugucugucugucuaucugaucuugucuuguucucugaagccccauucuuauccagcugauguucacaucuccauguucaaaaguguaguguguccaaaaucauuugucauuuguuuuucugguuagaggagugagcgugagcugguguguaugugguguaugcucuuaaucccaggcagaggcaggucagccugguuuagacagccagggccacacagagaaacccuauuucaccccugcugccuccccuccccucuucccccaaaagcaugagcaugaaaacaguguuggaguuggacuagggggagugcuggggacuauugacgaugauugucuuacuugaguuugcaccaguguacugcagagccucaugucucuggcuuucuucagggguucacuugaacggcugaaccggccaacuuauuuagguugagcagcuauugguuagguaacuugcuagucuugaccuagguuaguuucagcuuuggugagcacucacuauauacagaauuaguugaagcagcugacuaguguaaacccaugaagucacaguuuuaguugugagguuccgguucccaggcccggucgagagcacugcuuuccuuuucucaugccuuagucccaaagaggaauucacccuuuccuagggcuccccgcacugacugccuggccagacugcaucucucuguguguuccaggagugcugaccuugagucuucagcgcagacacaguaaucaguggcucaguccaagcuuugccuuuuccauuuguguuguuguuguuguuguuguugggacaaaggguaucacuuuguaacccaggcuggcacgugccaggggcuugcauuuacacuuagaaacuauauucuagggaaauguaauucuauacaaaaaagcaaaauaauguaaaagguccauagcuauuucuagacccuucuuccuuuguucauauuuuccccacauacaugaauauauuauauauaauuauacgugugcauacauaugcuuaguauaaacacaaaaauguagacauaauuuuuaaacuuuaaaauuagguguagcuuuaaaaugcugugaguuugaugggagaaauuugauuuuaccugagaugauuucacuaaauucaauagcuguaaaaacguacugagagagagcaauucuuguguaagaggaggguaagguggaaaguuuaucaagucuccuaaaggcaucaccacauggacaccaggagaaccaguuuguggccuaaugguccagcuuuuucuucuuccuugagaaauuuauaaggaacaaaguauaagcugcuuuugccauugacuucaguuugagacagguuuucucuguucuugccuaaaaucauugucuggcuuaucagcagaguguguucguguguguguguguauguguguguguaagcauacauacauacauacauacauacauacauacauaugaauguuuauguagguagccaagccagaaucccaggagucuuucagugaugagucuuuuagugauacucucuuugaucauucagcagcaauuuagcuacucauuuuccagauuccagucuuguuuguuccacacugaagcucauugagauuuuuacuuaauaguaccuuacccaaaguccuugauacuucauucucugucuaucaacugaccuccaucugccuauucaagagacucauauuuuguuuguuucuuuuuguuuuagaaacaguauguagaccuggcuaugaaggccaaguuggccuuagcucugucugccucugugguuugagugcuagaauuaauagcuggcuucauggccucacagguauucuugcuaugauguuuacaguuuagcugaggugccuuuucacuucuccugcaguaugugauaugccuucucuuagaugucaccucauacuugguacaaaaacauuuuuauuuucuguguguuuugccuguauauaugucugcgccaagaacauguaucaaaggauucuguagaacuggaguuacaugcagucaugcaaccauguggguucugggaaucaagcccaggucuucuggaaggagaaacuagugcuuuuaacuacugagccaucucuccaguccugaccucauccucuugauacagauccuuccauccauccuuccuuccuuccuuccuuccuuccuuccuuccuuccuuccuuccuuccuuccuuccuuucuuucucuuuugguuuuucgagacaggguuucucuguguagcccuggcuguccuggaacucacucuguagaccaggcuggccucgaacucagaaauccacccgagugcugggaucaaagguguacgccaccaccuacuuucaagaaaaucauccuuggcuuuccaggcaaggaugcuaauccugcuauguucuuccacaguugccugcucccuccccagcaggugauacauuuuaugauaauuucgugugauuguuccuccucacuauacuaagaauauauguguuuguuuuaagucucugucacauugccagugccaggggguucuuuucuuuuucuuuuuuucucuuuuccagagcuaaggaccuaaccuggggccuuacgcuugcuaagcaagcgcucuaccacugagcuaaauccccaacccccaggcgguuuuuaauauaguugaauaaaugaguccuaguuugaaaagagcaaaaauauguagaauauguauucaggaaaguugagacaaagguaggaagauagagaaguuggaaggcaguaaggaaaauaggaucccugaguccaguagguagugccagguggggaacuaaacuuacagcacuugguggagaagagcagggcagaguggacuuagagaacauucucccgcugacccgccucugcuuccagagugcugggagucagcugugcagcuccaugccaggcaccaguuaccacuuauuuauuuuuuauugagagauuuggguaggaaugcaaccucuguugcagagguuguaggagaaugugcccacuaagggcuaaagaucuggaggugagcugcagugggaugcugaggagcugaggagcacuugcuaagaagacaguauuaggagcaguaaguggcuccaguuugccuuccaagagggagcuguuuuuuauugaguuguuuguaauggcucuaggacaucuaauuuguaauauccaguuauuaagaagaagauaauugcaguggaaacacaguagcuauuuuaaaguuauuuuaaauguagcaagcuucauuuaaaaggcacauauuauagaccauauauauauaucccuuauuuuucuucuagccccauuuuuauacauuaagcuauuggaauagguuuugaaauccucccguugcucaacuuuguagauaagcuuuucacuuguucuuaaaaaccugcccugaccaggcuuuuaaauacuaaguaguauuuaaaacuguccuuuggaaguucugcugcuuaucuguuuuccaguuuagcuuaccuuguuugguuguuuuuaaaagcaaugaagcugaauaagagugagcugggugagcuggaucuuaaauauaugaguguuagcuguaaaaaggagccaguacaccugucuacuaugccuuacuguaccguaauuaagguggaaugcaaaaagagcccuaaguugaguguccccacacguuugcuauauaucagcugguuggucuccagcagggagcauuauuuuuaguuguuugcuuacuugaacuuaaguaagcaaacagcuaaaaagaguuacuuuaaauaauuaaaaauaauucucuuccucuuucccuuuuuuuuucccucuuaaugguauggugccaggggccuuugagggcaggugguucucuuucuugccuaggguagccuugaacuccagccauucucuuucuugccucagcuuucagugacuaagauuaccgguagaagccguccugcugccaaacuuguuuagugguuuucagauuugaauucacaugagacacaccuguauggcaacauaaauugcuggaccccacagugggaauuuuugaauguuuguguuucuaacaagcuccuagcugcuccugcugcugguguggggagggccacacucugaggagccaugguccuugucacugacagugaaaguacaauguugacguuaggucucuaagucagcaggugcgauugugacacuaaugacacugagcucaugcagcagccuggaucaaggcagcggccagcuaaaggacuguauuggcauuucagcauugaaaaguccugucgucuguggacggcagccugauggcucaagcugccuugcugaguauguuguggugagauaguauaaugagagccaggugugguggcccucacuugggaggcggauuccggauuagaaauucaaggccagccuagggccccgugagauaaugccacaagaaaaagaugcugugaugaguaaaacauggcuccuuuuuggucauuuucugaucuaugugauaagacauguccuaaccaaaaguauccaggaaaaaaagauacagagagcugucaacuucagagggaagaaaugccauguuuguuugaaaugcuaggaagucaaagaccagagguagacagucccaggagggcgagacuauuuucacagguguuccaaagcauuauuucaguaaagcuugaguauuucagccugcauggaauuuuaaaaacccagggcuguguugcacuuggcuuuauuuuuccuuugguucuuuggcacacuaguggcaucaggguuugugauaguagacacauuauuuagucuucucucagccuguuugccuucauuuggagaauuacagucuugggauggucuguguagauaguguaguagagaaagcuugggauuuuuguuguuguuguuguuguuuuuuguuuuucgagacaggguuucucuguauagcccuggcuguccuggaacucacuuuguagaccaggcuggccuugaacucagaaaucugccugccuuugccuccugagugcugggacuaaaagcgugugccaccacgcccggcccaaauguuuacuuuuuuacuguguaacaauaaacacuaguaugggcugcugcuguucugaggaauuccagguccauuggaaugauuugaauauccuugaucguggaaaggaaaggagaauaucaacucagguauuuuagguagcuauuauuuauuuuuguuauauguguuugaguguucacauggauauaugugcaucaaauguguaccugcugucuguguaggccaggagagggugucagauccccaugaacuggagggacacacucuugugagucaccauguggugcugggaacagaaccuggguccucugcaagaacaguaagcacugggucaccucuccaguccccuuucagacaguuuuaaacgagacuagaggcaguauuuuuaaguggaaaaccuuuuaaaaagaaagaaagaaagaaagaaagaaagaaagaaagaaagaaagaaagaaagaaagaaagaaagaaagaaagaaagaaagaaagaaaaguucuuauuuuggaggggccagggagucuguugguugaagcaugaagaggaauggcauguacuuacuauaguagucuaguuuugaaucucauuugugcuuuuucucagcuggggucagugcaucuuuguuuucuugaguggugacuuggucugguaaagcaguugguguugguuuccuucugaggaaucaguccguucccucugccugcaccuacugagcaggcggaugccaaugcaccuguuggggcagcagugguaguagugcuccucccagcucuggguuuggaggaugagucuugcugacaagccuaaacuggucuggaacucaggcuuucugcggaagcuuuacuuuccuggcucugguuugcaagaaaccagaggcuguugauacauacauuuguuacucuucuuacuaacaguccccugaaaaaggguugaccaugaaaguguuagcucagcuaauuuuaucuuggacacuuuaaacaugcacacuagaaaugccuuuuauuuuaaagucuaaguguauauaugguagucuuuagcgacaccaaauuguuaguuucuaaccccaguccaugcuuaggucucugaauguuuaaguauguucccccagcuagauuguuugccacgauucagagugauuccuuagugcagcuauuucuguauucuuaagucuguuacuccuugccccucccuucuucccggagaaacugggucauuuguucugcaggaaucuaacuuucuagguguggcugaugcuuucuucacuaguuauuuaacuuggcaguaucugaaccucuuauguacuaagacucugaacuuacaucuccauuaaguucagguucagauuuuuuuuuuuguaagaaugugauuguugugcugugcaauuaagcacuucagcuuauuguuugagauaguugacuauuagauuuaagugcuaauaccuuuuaaaauuauuuguuuacuuuuuauguguaugaauguuuugccuauauguaaguaugugugguuuguguguuuuguguguguguguguguguuuuaugccaguggaagucagaagagagugucagauuuccuggaacuagauuuacagaugguuguuagcugccauauggaugcuaggaacugaaccuggguccucuuucucuguaagaacaagugcucuuaacugcugauggagcucuucagccucugacaaccuuuaguaaagaucuauuuacuuuuaugcuaugaauauuuuaccuguauguauaccauguacaugucuggugcccaugggggucagaggagggccuuggauuccccuccuugaagugcagcuacagaugguugugagcugccaugugagagcugggaucugaacccagauccucuggaagaacagcaagugcucuucacugcugagcuaccuuuucagccuucguaaucucucccccuccccaccaguaugugugugugugaaagagagagggaguaggugggaaggcuguucaugugggugcccacagaggccagaagauggcuuuagaucccauggagcuggaguuaauagguauuuuugaacugucugaugugggugcugggauuugaacucaggaccucaggacugagcagcgaguuaaugcucuuaaaugacugagcuauguaucuagccacuaauacuuuuuuuuuuuguuuuuuugagacaggguuucucuauguagccuuggcuguccuggaaaucacucuguagaccaggcuguccuugaacucagaaauccgccugccucugccucccaagugcugggacuaaaggcgugcaccaucaccgcccggcuuuacuaauacuuuuuuaccuuuauuucagagaagcuugauucuuugcucucagacuacgacauccucuccuuagcuaauauucagcagcacuccauaaggaaaagggaucuacagucugcgacacacuuagaaacauuacuaacuuuuucagcuuugaaaagguaauuagaauuaugcauugaguaauaugggacaauguggggguggguuuuguuuuggcaaaagcaguaaaaaaagguauuuacagaaaucuuaaaauacuucguaaagauuuguacuugaugaaauaacaugucaugugugauuguaacaucauuuaaugccuauuuuaaauuccauacuuaaaacauuuuauuuuuuaucaauauuuuaaaggaaaugaauaucccaagaguauuacugaugguaacaauguuuauugauugaaugcuuauaauacuuuauauuuuaaaguuuuuuauucauuguuauguauaugaguguuuugccuuaauauaugucuguauacacuauugugucuagugcccucagaggccagaaggggguauuguagucccugggacuggaguuacagagguuugugaacugggaugcugggaauccaaccuggguucucuggaagagcaacccauguucuuaacugcugagcuaucucucgagugccuauuuaaaaauuaaaaaaaaaaauacuuuauuuuuacuguuuacguuugugucugugugaguauaugugcauuggugugugcuagggaaggaaguguauguacccgaggaagccagaagagugauccauuagagcugggguuacaggaucuugugagccacucgaugugggugcugacucugaacugacaguugguccuuaugacaguuaaaaaagcaguaaguaagaugggacaggagagguagcucugguccagagcucugaaugcucuugcagggcauccaguucgauucucagcagccccaucagguacaaguauacauacauaagaaagaauacauaaaaaucuuacuuaaaaagcaguagaaguagccuggugguggugcacaccuuuaaucuuaguacuugcgaggcagaggcaggcaaucucucugaguuuguggcuagccuggucuacagagugaguucuaggacaaccagggguacacagagaaacucugucuuggggaagcaaaguuguaggagaauauaaauaggcuauuuuuuuuuuaauucaguggauaagauuuucucaaauaaaaauaaacacacaaguaauguuaccaguguuuuuuagggcaaaacccccagcuuaagcagcugcaaaaggaucaauccacuuaguacuccaguuaaacagacaguggugagacucacacaguaggaagaagggguccagagacccucaaguucaucuucuagguucuagcaugaaguuuaagucuaagcagagaaaaaaauugggucacaggaaagagauacuuagauuaagcaguccuggucaagguguggcucucccgucauugucucaguucuuguucauuguggggugguccauagaaguccuuaucaguuguuauuacuuugauucuuuuuuuuuuuaagauauauuuacuuauuuuauauaugugaguacauuguagcuguacagaugguugugagccuucaugugguuguugggaauugaauuauuaggaccucugcucgcuccgacccaaggauuuuuuauuauuauacauaaguacacuguaguugucuucaguacacaaaagagagcaucagaucucauuacagaugguugugagucaccauguaguugcugggauuugaacucaggacucggaagagcagucaguguucuaaccugcugagccaucucacuagcccacucuuacuggaucaugccccaguguauaauaauaauccuucuggauuauuguuuucaucuugucuggugaagguaggcaucugucuugugagguuuuguauuucugguaauacagaguacuugugggcccagaugaagugcaaagauucauaagugccuauuuuaguaauaaaugcaucuaaucuaaaaaccauguugucacagagaaacagggauauaguuuacuuuguagaguguuuuuguaacauaaauagggucccauguuuuauccccaguaccugcucuaaaccuacaaaaaacccaaaccaaacaacaacaaaaccugaaggaaguauaguuaaguuuuucauuuccuaaguuucccagauucaaagagcuuucuuguuuguaaauuccuuuuuuuuuuaagauuuauuuauuauuauaucuaaguacacuguagcugucuucagaugcaccagaagagggcaucagagcucauuacaggugguugugagccaccauaugguugcuggaauuugaacucaggaccuuuggaagagcagucagugcucuuacccacugagccaucucaccagcccgaaaauuucuaaaaaauuuuauuuuuagugcauuaagauuuuuuuaaccuauuuauuuauugguggcaagggcauuuauguuacagcuauacuacagcacauguguagcgaucagaggacaacuuguaggaguuguucuuaccuucagugugugggucccagggaucaaauuggggccaucagacuuggcagcaagcaccuugccuacuaagccccuucagugcauaguuuuugcacagauuaaaauguauauacagagcagcauuccuucacuguguuaaugaguucaaucaacagcagaauaaauuuucuccugauaugaacauguauagaauuugucuuguuauuacucccuaaaaaauaguguuuuaaauuuaaccagauuuuuaauuuauuuuugagacaagucuugcuguguagccagcccucucugggcuagaacuaucuguguagaccauacuggucuaccauuucuuuaacuugcagaaaucuugugccuccuaggcacuaggauuacaagccugugucucugcaccugguucugugugggacuggggaacccaggcccuugucccgccaggcaggcucucugccagccaugcuguguccccagccuagugcuagguuuuuaccagcacauagcuuucauuuuuuccaaaggcaaauaucucagaauuugaacaucauuucauuuguuuucuguaaaucuugcuuucacaggcuuucaccauuuuuuucuauuugaguuuguccuuuuagcuacugaauuguaguauugcuuaggacauuaagaaauuggucagggcaggagagauggcucacugguuaagaguauugacugcucuauagguccugaguucaauucccagcaacuacaugguggcucacaaccaucugugaaggggauccgaugcccucuucuagugugucugaaggcagugacaguguacucacaugcaugaaauaaauaaaucuuaaaaaaaaaaaaaaagaauuggucaguuguuggcauauauauuuugugcaagaaauuuuuaauaguauuuuucuaguugccauauucauguuauuuuaaauaacuuuuagaauuuaaaugcagauaguaaaauagugauuacaaauaguguaauauugacuaucuagcuuccacccaaccucaaaauugaguguauuguuuaccaggcacugacguggcuuaucucuaauucucacuauucucuucauggcuguuucuuaugugaagguacaugcuuauggcucauagaaaugagauagugugcccacaguacagagcuguuugugcacagauuggacaaccugagcuccuaccacauguacacugugguuguuguaugcccauauauauacacauaauaaauaaaugcaguaaaauguguuuaguauguaggagcaagagaggagguacaaaacaagaagugaaaauugaguuuccucucuuaacauaaaucugagguggcuugugaaguccucaccugugauggggcagauacuucugugggccugugcguuucucucuuguguuucacaaaugacauuagaaaauguuaccguaagcuuugcguuguggugcacucuuagucccggcacugagaggcagaggcaggcaggaucugggugagguggggugauccuuguuuccauagggaauuccagggcggccagggcuacacucugggguuauaggcaugcaucaccacugucaugcuaaaauucuuauuuucaaauagcaguggaagaccaaagaauuuaagccagacugcaguagauuuggauguagcuguaagaggcugaaaagcauggaaugaguccuaaagggaugcgucaugaaaaagggaacucauuuaaaguuugccuucugaauuuuguuuccuuguuguucagaaaugccuagucuaaagaaaugaaaaagcugcaaaagggguuuuaauugccauccugucuggagguuuuauaaaacucaguguucagauuagaaaacguaaaaaacauaaguuuuaccauuacuugggccuuauuuuuaccauauaacagauuugucuuuuuauaaaaguuguguguguucaugguuaugaauguggauguaugagcucaaaaggcaaucugaggcaucagcccucaccagccacuuuuuaaaaacaaauugguccucacauuggcaugacaagugcucugucccugagccaggcuccccaguccugacagcagcagaaaacccagaaugcaguuccugggacuuuccuaggaagaacauuagagacacuauuccagcucauggggcucuuuaauacugaauagggcauuuguaauaggggugcuuuucuuuucaaaguuccauuauaagcaaaguggaaagaacauuaacguuaaugccugauguaggaggacccgacuguggacagcagaggaaugaacgagccaaagguuuaugaaaugguguauuguguuucuuucugaccaucaaaaauaccuaagcaaaacuaaaauuaccuuguaugcucaaaaaguuaauauacuuguuguucagccgggagugguggcacaugccuuuaaaucccagcacuugggaggcagaggcaggcggauuucugaguucgggaggcagaggcaggcggauuucugaguucgaggccagccuggucuacaaagugaguuccaggacagccagggcuacacagagaaacccugucucgaaaaaccaaaaccaaccaaacaaaaccccaaacaaacaaacaaacaaacaaaaagauaccuuguuguucuggagacagccccagucuggauuucuuccuggcaguuuaaagauuuaugcagacccacagggaaguaacauuucauauuuucaacaucauagcugacaaaauuuguuccuauggcugagaugaauaacauuucuugcuuugcuucaguauuagugggcacauuaaaaggucucuguuaauauugacaaagucuggcucaccaccccuaguuuuauuuuagaaugcuuuaaaguggggcuggcgagauggcucagugguuaagagcgccgacugcucuucugaaggucccgaguucaaaucccagcaaccacaugguggcucacaaccauccauaacgaaaucugaugcccucuucuggagugucugaagacagcuacaguguacuuacauauaauaaauaaauaaaucuuaaaaaaaaaaaaagaauguuuuaaaguauuaagccauauaaagaacuggaaugcauauauuuuaacaucugcauuuagaagcuuugggucuauuuccccaguaguaauuaugcauuacuguuuuucaagguagauuuuaauugaggaaaaaaagaccaugagcacuuuaaaauaaacacagcagcagcauuuuagucauuguacacugaugucagaguucuuccauaggacaccagguggagugcuggcaaugguagaauacacaucccuggguuuugaacacucaagaccacuguugaccuucacaguuuacuagcuguguaaccugaguguguaacuucugagccuauaaauagagcagguagauguaauuaauggcauauaacauagucuuuaauagugaauuucugagauaagcaggacgcccagcuucagcguucagcuguucacauguguuuccuuauuaaucaguuuccaggacagaucaaggcagaagguuuuacccucauuccccaagcaucaguaagcgaccuugcucccucccuccacgcccccauacagaauaugaagguuuguuuuuuuuuuuuuaaguacacucuuuaaacuaggauacacagaaucauuuaauguagcaguacuuuuugcaaaaguagauuauauaguacuugggaaaugcagggaauaaucuuacucuuuaaaaauuagacagcgggugccugaagcucaagcagccuucagaauggaggcagggaauguugugugacaccagagagcuuugcuguaaaagaaaugacuuggcugcaagcugucccugugucaguccuuucaagugggucucagaugcuacaagaaaaaugguuggguggacucucaagcaaccagaggcccgcuuccuagucucuuucauucuuuauguguguacauaugugggcacaugugccauggcauacauauggaggucagaggacaacuugaggaaauuauguaggucccacagauggaacucagguagucaugcuugggaacgagcaucuuuacuuaugagcuaucuugucagccucaaugccuccuuuaaagacuguuuuaaaaugaguucugcuaagguuuuauaacuaaaccaauuagggcacuugucugucugucugucucucucucuuuuuuuuuuuuuucaagacagggucucucuguguagcccuggcuguucuggaacucacucuguagacaaggcuggccucgaacuuagaagucugccugccucugccuuccuagugcugggauuaaaggcgugcgccaccacacccggcugccucccacuuuuuguuuguuuguuuguuuuuuguuuuuuguuuuguuuuucgagacaggguuucucaguguagcucuggcuguccuggaauucacuccguagaccaggcuggccuugaacucagaaaucugccugccucugccucccagggcacuugucuuuaugggaagaauagugcuguaugugagugcuagcugcugugggucugcagaggugacuugguggcuagaguacuugcugcuuuugcaggaggcuggaguuucccagcacccacguuggacagcucacaacuaccugugacucuggcuucaagggagccaacgcacucuucuggccacccugggcacucauucguguggacacagcccacacacagacacauagaguagugggauaagucuuuuuuuuuuucccugagagaaaauauggaauguuucagauuugcauacccacugugcagaagccaugccaaucuucucugugucguccuaaauuuagugugugugcugacaaagugcgcauguuauaaaucuugaaaaagaaaagaugaauuugggcuggagaaauggcucaacgguugagagcacugauugcucuuccagagguccagaguucaaauuccagcaaccacaugguggcucacaaccaucuguaaugagaucugacacccucuucuggugugucugaagacagcuacaguguacuuauaaauaauaaauaaguaaaucuuuaaaaaaaaagagaugaguuauaacuuggguggcuauuguucaucuccucuccuguaaaucuuaaagauugaagugaaaauuaguccucuauuuucuguuauuaacugugagugcauucuuuccucagacauuuuaaauuauacuugacaucaaguaccgaacgcuuuucacaaaacuugagagucguggugguggacgggaaagaagaaagcgaguacagcgugaaguggcagaacuucuucaguggucacgugguuggugaguguggaagcuguucugugauucuuuccggcuguugugucugucacuuucugcaaugauggaaaaccuggcauaaacagaggcaagaggauuuaugucagugagugguuugugagguuuugguucaugaggcucuggaucugaggugagaugaaccauggcagaguccuaugauggaggagguggcucaccucacaggccaggaaguguggagagaagagaggacauagggacaaggcacauccuucaaaggcaugccccccaagaccucuuccaaggaggucccacauguaguuagccugcucaguugugaauucaucagugggucaauuccuugaugaagucuggaggcauuuuuagguccagaccauccauaggucucuagcuuuaauguaauuacagucuuuuuuauacauaaaguuaugauauauaagaaaauucuagggcuggcaagacggcucagcagguaagagcacugacuguucuuccaaagguccugaguucaaaucccagcaaccacaugguggcucacaaccacccauaaugagaucugacgccuucuucugguaugucugaagacagcuacaguguacuuauauauaauaauaaagaaaucuuuaccaaaaaaagaaagaaagaaaauucuagugggaggaaguauguaucauuuagcauguuguuuagcuagccccccuuccuuuuucccucucuuccuccuucucuccuuccuuaccucuuacaguagcccaagcuggccuccagugcacuguugucuuauccugcaugaaucccaugugaaguucugcaccuggcuaaguuugauuuuuacuuuguuucuauaagaaggaaaaggaaauugccuugccuugccuugccuugccuuuccuuuccuuuuuccuugccuuuccuuuuuccuugccuuuccuuuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuuuccuuuccuuuucuuuuuccuuuccuuuugccuugccuugccuugccuugccuuccccuuccccuuccuuuccuugagauaggguuucucuguguagccccagcugcccuggaacucauucuguagaccaggcuggccuagagcucacauaucugccugauucccaguugcugggauuaauguguaugccaccaugcucagcuaacuuuccuuaguuauuuguuuuuugagacagggucucacuagguagccuaggcugacccacaacucaugacaguucucuugucucaguugccugaccacagagauuauagacucuugcuucuuuccuaaacaaauuuagguuaaauuaugcagaggggaaguggguguuagguuaccugaccuguuucuccucuugggaagacugaagagcuuggccuuuucaggauuguuucuuguuugcagagcucucaucuaacaagguaaaggcuaugcugaugaagggucugauuuuuuuuuuuauugucaaccaugcauagguuauuauuugauaaucuuucuuuuguauuuauguauugguauguguguaugcauccuauacacacauggaagucagaagauaaccuaugggaguuggugcucaccaugugugggucacagggcucuaguucaagucaucaggcuuggugacgaggcucuuuaggcugaaagacccacaaagugagaacuccccuacguucugacucaggagaggccacaccccaaaucacucacaagaaaugguuuggccuugaugcaaaccacaagagaacuuuuuauuccaggcgcgcucuggggcccacaguuguacaauacguggguagaguaccauagaccccgaguagcugggaaaggggauauuuaaaggaaaaaaaccacaacccaaggggguagggagggcauuauucgaaaauaucagugaauaccagugaaaaaucacaaggggguacuaaaaaucacaaguggagacucccugcuucucaagauuguucucaagauuuuaaucuaacuuuuguggucagccagguccuggaacaggguaaccugcauucuuggugcuagggggucugaauuuuuccuggucuuucaaggccugcugauucauuuuccuggcccugaaacauauuuuugauaauaaaaacacuuuucuuuucccccaaggugagccugacucuaggguucuagcccacauaggagaugaugauguuacagugagaaucaacacagauggggcagaauauaacguagagguaagucuacaaauacaggguuguauuuggggguaugaguuugagagagggucucuuauagcccaugcugaccuuuaacuggcguuguagcuaagguuggccuugaacuccagaucuucugcuucuuuuuggaguugucuuucacucagcagcuugucuuucuaguugauacagagcuucuuaguuguuuaagaugcaaaggcuaauuuguacagcaggucagcccugcagucccaccugggaggcucaggcagggagauugcugugaguucucugcuuagcacucaggaaggaucacuguaagguccaggccaaccugggccacauagugagcucugaaccaguuugagcuacauagggagaccccagggugcuuuaagaaaccugauccuaaaugcugcaauuaugccuugguuccgugccagugagugagcccugggccucuucaugcucccugagagcuuagcaugcacucauugcuauacacaccaaguauggguagccauauuguucuuccugcagaacuggguucagaaaauacauaguuugucaucauauguuuuucagcuaacaauauaacuaugaaaaucuuuucggguuaauaaauauagaucuaaauggagguuuuuuuuuuuuuuuagugaaggcucccuaguagaucauuguuuagccaguccucuguuauaugaucaauuauugugcuuuaauuucuugaaauagaaaugucuagcaugaacagcguugaacacacuuuuggguagauauguuuaauugggauggucugggugaccagucuuaggucuccauuguuguguuguuuccuuuuguuuuugagauugagucuuucuguggcucuguaggaggccacuuugccuuuguuaggguuuaagcauucucagcagcuugugugaggguucauuugucuacagucucacauuaaugggcaugaaguagugacuuauucauuuucuuauacaucauaacucuauggauaaaauccuucuuacguucuucacagcugagaccaguauauuuacagaaaccuuugacuugugagcccuuuggagcacauggguuguauuucugugaccuggucccguguucugaaugcagacucuucuagcaucauuguuucuguggugcuggggcuuggcaucacggauuagaacaaacaaagggcugcuuucuuagaaaccaauagaaggcuuaggcguaguguuaggaguucucagucaucucuuuuaaagaaaguuuuugcuguauguaaagcccgucaagucacugcagcgugaccacugcagcaacacuggaguagaggaggcauuacagaaacauuuuaaaugggcuuauggaaaaggaaagacuuuuuguucuuuaguaguuuuuacagaaauaugcauaaaauaaugaauaguuguaaauuuauuugcaguauagaaacuguaagauuaaacaagcacuuuauucuauaagaaacaauauuauccaagaacaaagaauguugugagaauuuuauuuaauguuuagaagguggucuuggguuuuuuuguuuuuguuuuucauuucaucaucuguguuucccuuuuuagccacuuuggagguuugucaaugauacuaaagauaaacgaaugcugguguauaagucugaagauaucaaggauuuuucacguuugcagucuccaaaaguaugugguuauuuaaaugcagauagugaagagcugcuuccaaaagggcucauagacagagagccaucugaagguaagacuuacaaauauauuucagguaugacauaugcacaucauacuguuucuggcaagguguuuguuaauuguuaaaaauagcaugauuauuaaauguauuuuuuaaaaagauuuauuuauuuauuuuauguaucugaguacacuguagcuaucuucagacacaccagaagagggugucagaucucauuauggauaguugugagccaucaugugguuacugggaaucgaacacaggaccucuggaagagcagucaaugcucuuaacuacugagccaucucuccagccccaugauaaauaaaucaaauguuuggucugaaaauacaguuuuguuacagaaauucuuaauucuauuucugaucauaauaguugaaaauaugccgggugugguggugcccgccuuuaaucccagcacuugggaggcagaggcagaggcagaggcagaggcaggcgaauuucugagucaaagccagccuggucuacagaaugaguuccaggacagccagggcuacacagcaaaacccugucucgguggcgcaggcauuuaaccagcacuugggaggcagaagcagguggauuucugaguucgaggccagccuggucuacaaagugaguuccaggacagccagggauauacagaaacccugucuggaaaaaaaaaaagaaaagaaaaaaaaaguugaaaauacuagaaaauaauaggugcaacauaauugucuuaaaagagacuaaggaaggaaacagggaaauggucuaagggaaauucuguacuuuguagaccuucaaaaacagcaaaaugcuauuucuguaaagugaucuuagagcuuguaagagauuagucaaguggcaagagaacccugugguguuuuuguuuuuguuuuuauacaauccaagaacaccuuuguaggggugauaccacucacaguggccuggguccucucauauaaauuguuaauuaaaaaaaaaaugcuccacauacuugccuacaagccagucucauggaaguaguuuuucaguugaaguuuccucuucucauaugauucucuagugugugucaaguugacagaguggcuagcccacuguacgugaguaugucugugaauguuucuguauauagcuauuuauagguauucacauggguaugugugcauaucugcacacuccauaaacacacuuuugcuugugaguagagguaaacauuaaauagccuauuuguaucagggagcugagaagauugcgacccuauguugaugaucuuagagaugccuccaaauacccuggguugcuuauauuuugauuauuuuaaacaaggucugcucugcagcucacuauggccuucaacucuccaccucuugccucagcuucugaagugcugggauuaccugugccaucacacuuggcucccuauuacugaaguuuuaauguacaauuaccuucauuuuuuuuuuaauuuuauuuuucuaacuuuauuuuuuauuaacuuauagacuucuaaaagaaaugaucaguggcuuuauugccuagugaugauuauauuacuauauuaaacauauaugaaaaauucuuuccuuuugugguaguggguuuaaacuggguucuugcauaucccaagccccauugguuuuggauucagcaauuuuaaaccuuauauuacuuuuuuuuaaaaaagacuuauuuauuauuauaucuaaguacacuguagcugucuucaaaugcaccagaagagggcgucagaucucauuacggaugguuguuagccaccaugugguugcugggauuugaacucaggaccuuuggaagagcagucagugcucuuaaccacugagccaucucucuagccccuuauauuacuuuuuacuuccugucuuuuucccaaaauuuuuuuuuuuuuaaaauugagacaggguuucucuguauagcccuggcuguccuggaacucacuuuguagaccaggcuggccuccaacucagaaaucugcuugccucugccucccaagugcugggauuaaaggcguguaccaccaugccuggcucucccaauuuuuuauuacuccuccuccuccuccucuucaagauaccacuaaggacagauguuaugaguauugucuucguucuugggaggcagaggcaguaggaucagaaguugaaggacauccuugacuacauagggauuugagaucagccaaggcuguaauagacccugucuccauccuuccccuugaaaaaaaagaagauacuuuuaauaauauuacgcuuaaauaauguuucagaaaaauauuagaacuaaguguuacuauaaaaaacccuccuuguuuugaugaauuuuaauuuaauagugcauacaaauucauauagaguuuguucgucgagugaagagacgagcugaaccuaaccccuugaagaauacuuguaaauuacuggugguagcagaucaucgauuuuauaaauacaugggccguggagaagagagcaccacuacaaauuacuuaguaaguauuugauuauguacagguuaauuuagcaagucauuuauguggguaaaugaauccuauuaagagaaggcugcagagauuuacauacaagcaggccggccccagauacuguuaauccccguugcuuucagggccauucgcuaggaucuuucguuucuauacagaaacuauaguuucaaaacuaugaggaaguguucugguuuaaaauuacuauuuucuauaauuagacaugagcucuuuacaaacguuaguaucacaugcacagauuuauauuugaggauaaaaaaauguauauuugugagaacuugugugugguuucugcuuguaucuauuccacagauauuuguuauugucaaguuacagagauaaccuuaggauagaauaugaaauaagugagacccucauagccacaguuaacacuggggcagagauaggaaggaaagauuaaagaaguuuaauaucugucguucuggggagcaagggcucuugcacugagcuauauccccagccugacagggaacuuuuagcaucagcaacuaaaaauuuaaagucaaggaaaugauuuucccuggaauuguuuuguuucucaguaugacaccauucaucuugguaacuuggcacugauuaaaauguugucauugagggaauagaagugaaggcagcuauucauguacagcagccugaugcagcaaagacagcuuucuuauugccgucuuuccauucucuccauuuuauuccagcucucccacagccuucuuuccucuccuucugucuuggaugaauaggagaauagugggagucauuguaauucuuguucauaagcaagagagucuuucuuaaaaaucuuuaucugggguuuguauuaaaggacuccuuguauuuuacuucuuauuguauaccaugaaugugagcauacugugagguucacuuuuucaaagugcauuucucacugcuacuuaaagcaaggaacucuuccuucauagcuggagcacgccugcuaacccguuguuuugaauagauacucuucuuugagaaaagauaaguaguuuauuuuucugauguaguaauuaugcucugccucuaucaugggaacauaaaugauuaugcacacacacacaugcccccauacauaugaagaccaugcacauacauacacguguuccccccaggcaaaaagauggaaaauaaaaaggcagucaucaccauuuucccuguucuagggcuacauuucaggcacucgggacagagugacgaccgacugcuuuuuagaguuuuugguaaaucagugacuuuauuuucuucuuuucuuuucuuuuuugguuuuucaagagacuauuuucauaguuggcugggaugucaguauuuaagaugccugagguuaagguagacaguaacagucuuuuuguagcaguguuuggcucuagggguaacuucuugauauaccccucagugguaaagauugguuucucaaugccaguuuucauaaucuuggauuuuucuccacuagaugccuauucuaguagguuuuacuacauugcaaagagugguagaguucugcauaacuucaccuuuucuauccacagauagagcuaauugaccgaguugaugacauauaccggaacacgucgugggauaaugcaggguuuaaaggguauggagugcagauagagcagguacucaucagccguaggccuugugcugauccaugaggucacauguguaaagauauuucuuccaaaaccuuccugaacauuaaccauagacauucucauuuugugaaacuuuuuuuuuuaugguauauuguguuguguuuugguauuuaacacuaguugauaaaguuucugucuugaggguuauuuuaggaaugaaaccucuuaaugcuguuauauuccuguuuauuauuauuauuauuuuuuaaagauuuauuuauuuauuauauguaaguacacuauagcugucuucagauacuccagaagagggcgucagaucucauuacagaugguugugagcuacauugugguugcugggauuugaacucaggaccuucagaagagcagucagugcucuuacucacugagcuaucucaccagcccuccuguuaauuauugucuguuaacauuaucuguuaauuaucgucuuucauguccuguaguguguucuuuuucuucugaucaugugucagacuuugguuagaauucuaguacauaaaccagcagugacaggauauucccauuaaagggguucugauggaauccuacaguuuugaaccuguagaaauuuacucaagaacacaacgcaggggaacugcuuauauacggcaguagaugucuucucuccuucugauccucaguggauauggaugcuguuagugcuacacuagaaccaucacaguuauucuagguagaaauugacuuuggugguuuggaaauugaugacugcuuuggaaaauaaauacuuugauauaauuuucagguucuuuguauuaaaacauauagucuuacaggcuauauuguauagaauugauagauuaaaaaaaaaggauuuaucuuuccaaagaugauaugucauggguguauauugugcauguguauguaagccuguauuuaacauucuugcaguaacaauaugcaauauacuguacacucuuggcccuguggcuuuuuauuuuauguuuuguuagauacuauucccuauugauaaugcaaagcagacuuagugguuuaaaaucacuacacuauguucagguuuuuagggaucaguaaauaguuccuuuuugucuuaggaaguuggaaauaauggaagaacaugguaauauaggaaacagaaaugccaguuucuuuaauccacugaggaugaauuggagggugugauuuaggugugcagucguguugggcuuccaguuacuucuuaccagaauuaaccuugaccuucugcuuacacuuaccauaaugucagugcagacagaagggcagcucuaaccccuuccccaaggacugugaucagaaaccuuuguuccuuuuuucuuaauuaaacuaacuuaguuccuuaguuuaauaggaauuugucuuaaacacacaugcaaggggaaacuccauuuuuuuuguuuuuuuccgagacaggguuucucuguauagcccuggcuguccuggaacucacucuguagaccaggcuggccucgaacucagaaauucgccugccucugccuccugagugcugggauuaaaggcaugagccaccacgcccggccauuuuuuuuuuuuuaaauagucuccuauaguaugguacaaaagugguguucaucccaacccuucguuuuuaaauuauuggcuauaauuguaauaaagaucuuagguucauauaauccaaguucucgguuuuuuuuucaaauguggagguugugagaauauaguauauuuauaacuuuauugacauguauguauguauguauguauguauguauguauguauguauguauguauuuauuauauguaaguacacuguagcuguccucagauacuccagaagagggcaucagauuucauuacggaugguugugagccaucaugugguugcugggauuugaacucuggaccuucggaagaacugucggcgcucuuaaccacugagccacugagccaucucgccagccccugacauguuuuuuuauaucauguuuuucaguuuguuuuggccaauaaauauuugagcuaaacaauuucaguugcaaaauauuuuuuaugggaguagaugugugugugugugugugugcgugcgugcgugcgcgagcgugugugcuugcauguguauguauuauggcuuguguguuuaguuuuugaaucaggcuuuggcaauguagcccagauugcucuugaacuguagugaugucccgucuccaccuacuaagugcuagaguuauauagaugcugauuuauuuaguuuuagauauaaaguuauggaagguuaugaacuugcauacugaaugcugggaaucagaccuggguccugcguaggaacaugugcuccuaguugcugagaucucuugagcucucagaugccgggcuuugauaaaguuuuugguggugguuuuuagucaggaucuuuccacacagcccuggccauccugaaacacacuaguacaucaggcuagccuuaaacucaggucuaccucccucuggcuuuggaguucugggcuagagguguguggcaccauaccuggccagaugaguuugucuguuuguuuguaaugaugaaauaauguagucagugucuuaggauguuuuggaauuguucuaaguauguucucucuuaaguauagauucgaauucucaagucuccacaagagguaaaaccuggugaaagacacuucaauauggcaaaaaguuucccaaacgaagagaaggaugcuugggaugugaagaugcuauuagagguaggucauguucugcacaguucuuuuaauauuugacacauacauguaucuauacuagugaaagaacaugguagaaaccuuaaugucuuuuagcaucuaauuaggcacaauggcccuucucuggaaauggacaugaaucaucauuauguagacuuuuauacuguuuuguaccucagaucucugaaacuuaaccacaagucuuucagggcaauacuuaccaaagaacauguauuggccagcacaaauauaacuugcgaucuauagagauuuaaauguaaacauuuuauuuucauucuggucaugaauuuguuagcauccuugugugccuucuuacuuuaguguacugcuacacaauuucagagucuguacauauuacugcuuuauaugacuacacagcauauaauauauauauauagcagcuugaaauauuucaguggguguuuuguuuuuuaauuuuguaguuucaauguauugguccaggugaguguauaugaauuucuugcuuaugcacacacaagaacaagauuaagucucaaacuugaauggaauuaaaggcuguuaucauuuucccccagauggagaugguguggaauguuuauaauacuggugugugugauucugucugccugcugcccagagggaggcugagauagauaguaucuuuuugcuucauuuuguaggugaagcuugguuuuugagacaagguuucuuuguguagcccuggcuguccuggaacuugcucuguagaccagacuggccuugaacucagagauccuccugccucugccucccgagugcugggauuaaaggccugcauaucauuugcuuuugagauaagucucagcaaacugcuguuagcagagugccgcagccugagaggcacuuauuuugagaagccacuggcacuuauuuugucucaggccucucuuuagcaucugaugucuuccuuugugagugucuguguccugaucuuaugaagacacagguggugcuggaaaugcaguucuaguguggcacauccugagguugugggccuggauuuggauccuagcagugcaaacaaaugaauuaacaagcauucccccagccgggcaugguggugcacgccuuuaaucccagcacuugggaggcagaggcaggcggauuucugaguucaaggacagccuggucuacagagugaguuccaggacagccagggcuacacagagaaacccugucucaaaaaaauaaaaaaaacaaaaaacaaaaaaaccccaaaaaacaaaaaacaagcauucccccaaaguagcuuucauaagggaacaggugguugccuuaauauagggccugugaauaugaccuuaguugcuuugguaaagacucugucuuuacagcugcauucuaaguuacagggccagaacaucaauguaugugagcuuugauaugacuacaguuuggcgagaguaggguaagccugagcaaccagaccuccugaguucugagacgucuauucagccacaccucugcuuccugugggcccaaacgugcugcuaacauuuucuucccuuggccccagguuguggggauaaaauagauuuaaauuuuuuauuuuguuaccauaaaaucaagaaugugcacuuuuuuuuuuuagaaacuuauuuacaacuuucuuggauuauaaagaauuuuaaauucaaacaaaaaucuuucccugcccaaauaauuaaaaauaaccccuacauagcacucuuaaacucuugaaauacuuugacauacuguagcauggggcugcagucuuuuuggaauuggggcugcucaaguccugaugcggucucugugggagagcaguccuuucauucugaguagaugaauggugccugagugcugcccaccaccgcaugagcacugugcuucuaccugcccggucaggugugagccccagggaaagcauugguguagccagcuauugcaggugcuagugcugagcugcagcuguucuguaauguugaggugcccuugaauguggcaugaugacaagcuaacuaagaccucccucuuuuuaaagcaauuuagcuuugauauagcugaagaagcaucuaaagucugccuggcucaucuuuucacguaccaggauuuugauaugggaacucuuggauuagcuuacguugguucucccagagcaaacagucauggagggguuuguccaaaagguaaguauaucauugcacugucaugacacugagagacggaagagaaagcugacuggguuauguuucaguucugaguuuaaaagucaguuuuugucuguuuccuuuuucuuuuagcuuauuacaacccaacugugaagaaaaacaucuauuuaaauaguggucugacuaguacuaaaaauuauggcaaaacuauucucacaaagguauguuuuuuugauuuucuuuaaaaacuuuauuaaaaaauaguguguguacacaccacaugcacauaagcaugggucccgacagauaccagaagaggauguuggaauugcuggagcuggaguuagaguagaugguugugaaccaucugauaccaguccugggauugaccaugcagccucugcaagaguagcaagggcuuuuaacugcugagccaacucuucagccucuguucuuguuuugaaacaggacagauuuggaaucuauugcauuaguauguugguuacauaguuacaguggugucuuuguaaauaguaacguguacuuggugggcaaugugacugugugcucugcccuuagcaguuaaggcacugcucucuugucugcugcucuucauaggcuguuaaaaggguaugagucccuagccuuuguuugugaccccuuuuuccucaaagauuguucuaucuuguuuuagagucuggagauguagcuccguuaguagaaugcuggccuagcauauaccauguaaaaccaaggagagugaugcacgcuuauaaucccacccuugggaggguggaggcagggggaucaacauuucaagauuguucucagcuccauaguaaguucaaggccagcucaggauacuugagaccuaucucaaaaaacaaaacaaagaaaacaagaaaccuuguuuuuguguagauagaucuguucaaguguauuuugcuauaaauaauagaaaauacaguaaccauuaguggccuaaauaggggcauauuuuucugaguuauggaggcugagccagccuucuccaggcauacacugggacauucagaguucucucagucuggggcucccuguuuuuccuuuagccuuucucagcacaagcccucuguccucaugcugcagccucaaauggacaaggugcuucuccucucugaugaggaaagcaggaagaagagacuagagcuucuguagguuguccuucuaccaacgcuugucuccaagccucgcccauugguuccugguuaugccucccuaggcgcuaguuggcaacaugagugcccauagcaccagggcaggaagguuccuacuuuagcugaauauguugcugcucaguacagaauuagggcacuuuaggaauaagagagcugggcaugaugaugcacaccuuuaaucugagcauucuggagcuggucuagugaguuucugcuaggacuauguagagaccuuguuucaaaaaaccaaguaaguauugguaggaaaaaauaguauaugauacacugguauguugacucugagcuuagaauugacuacguggggcuggaaagcuggcuugacaguuaagacugcuuccuggucuucacggggccuuuguuugguucccagcaccagggauccaacacccucuucuagccuccccaggcacuggacucacuaacauauccaaccagagacugagugcacauaacuaaaaucaauccucucuucuauuacuauuauuauuauuacuauuguuuuguuuauuugcuuguuuguuuuucgagacaagguuucucuaugugguccuuccugucuguccuggaucuugcucuauagaccaggcuggccucaaacucagaaauccacugggaucaaaggcacgugccaccaccaccugccuuuuuaaauuuuuuucccuccuuuguggagcaguugggacucuuuaaucgagauacguuugcccuuaugcaaaaugcuuacuuuuuuguucgaugugcuuauuuuggugagacagagucucacuugacuuugagauugacuugucucagucuccugagugcuggaauugcaggcacauaucaagaagcccaguuuaaaaguauucuuauggggcuggagagaugccucaguguuuucagagcaaugacugcucuuccagagguccagaguucaagucccagcagccacaugguggcuuacaaccaucuguaaugggauccaauguccucuucuggugugucugaagacagccacaguguacucgaauacauaaaguaaauaaauaaaaaggauucauuaaaaaaaaauuacccaaauuguuuuuuuaaaaaaguguucuuuguucuuggccggccgugguggcgcacgucuuuaaucccagcacucgggaggcagaggcagguggauuucugaguucaaggccagccuggucuacaaagugaguuccaggacagccaggguuauacagagaaacccugucucgaaaaaccaaaaaaaaaaaaaaaaaaaaaaaaguguucuuguguuauuuccuagauaacuuuguguguguguguguuucucauccucuacugugugucacucgagguagccuuaauguccuaagccagugcaguccuucugccucccaaguaucugguacuguaggguaggcuggauagcuugucuguucuguuuggggcuuaguuaagccagguauuugauccaaggguuauaauucuuagcaaauuaucuguugcuucuuaaugcuuugucuugcuuuccauuugucuucuuguuguuuccuacauauguauuuuaacuuguucauuguccuugaccuuugguuuugcuuauaguagucucuucuuucacauccccauucuguauagcucuguucuuccaugcuuguaguaacuuuuuuuuuaagauuuaauuauuuuauguauaugagugcauuauugcugucuucagacauaacagaagaggacauuggaucccauuacagaugguugggagcuaccaugugguugcugggacuugaggucuuaaccacugagccaucucuccagccccuuaacuuuuuuuuuuuuaaguauaaaaacuuauauauuuuuuguucuacuuuaaaaguuuuguuggcaucugucagcucuugcccucuacccuuguucucuguccuccuuauuccugaaggaggagaaguaagggugguauucguucuugaacugaagcacccuguuacuguuuuccacucccaagaaauguuaaaggccuugggacaguugagauggcucagaaggugaaacagccuaagcuggaucccugcaaggcguggguuugcguauugggaggcgaguugccacuguugauggaagauggaaacagaaaccauacagguguuuggcuucuagccccccacccugcacccucuuaccucccccucccuauuugugcaucaggaagucaggggucaacuuugggugugguuucucaugcuucauccaccuuauuuuuguuuuuuaacuaaugaacguauuguuuauaugugugcauaugugcccacgugaguuuaugggcacagaagagccuucauuuuugaucucuuggaacuggaguuaacaggugguugcucuuaaacucugcaagugcagugacacucuuaaacagugcgucauuccacuccaaccccgaauuauauuuauugaggacagggagauggcuuagcagguagauaccguacagaacaacucugaccucacauucauugugccgcacgccccccgcccccaauaaguguaaaaaguuuuuuaugugggguaugugauagguguaauguggccauuuaugggaauaauucuucuuccauuuggucugaaaaauauagccugggcccaacuggcaaaaauaacugaugauuacauacguucuuucccugauccuuaaggaagcugaccugguuacaacucaugaauugggacauaauuuuggagcagaacaugacccugaugggcuagcagaaugugccccaaaugaggaccaaggaggaaaguaugucauguaucccauagcugugagcggugaccacgagaauaauaagguauguguguuuggauuguuuucagugguaggaaagaaggcgaugccauguuaacagaaaggggaaaguauuuaucccuaaguguuucccuagagguggaacugucaaauacugaagcucaucuuaagggugcuuuuagcugucauuuggaaguuuuguaaagauuaaucacauguaaguuugggucccuacacuagugauuuugucagagucuuacuuuugaggguguuuagcucagccuuaaaaaugaccugacaguuuuauuuacaauaugacucauuuaauuuagcaguacuucacagugugcugccaccacccuuccuucuaguccccuuccucuuccuccccccuucuguacuagggauuaaaugugccuuaauaaaacucuuaaaaacaacuaauaaagauggacaagaaaauggguaaauacagaaaaccgugaagccacguggaagcuggugaggggcgugagcaucagugagacuguugacucuucacugcaugcuugggcacuucuccaguagacuauacaacacccagugaggggaaagucccacguggcuuccacacuggaucgcucugguugugaggacacuggcagauggggacuguguaacuuuacagucugcugcaagggaaagcacauggugcuacuuccucuucugcggaaauccccauggcugugagagccugcuagugggaguggagcguggguagaacugguuuuuugggggaugcugagcugucagugaagcacaguuuguuuuguccugcaucuaucacauuuaguacauaguuucuccuaacaguuuaguuuucccaacugguaucucccucuccuuaugaaaaaauacuaugcaucuucuaugcuuuaaaugguuuucaaauacuuuuuuuacauuuauuuauuuguggacaucauguguaugccaugacauguguggagcucagaggacagcuuuuggggggggggcgucuuuccuuuuaucugggaauugugcuuaucagguuuggcagcaggguccuuuuaccugcagaggcccuuaauuaauuaaucucuuccuuucuuguuuugucuguccucccccccccucccacuccccuccccucccaacagggucucuguauagaguccuggaugaccuggaacuugcuguguagaucaggcuugaauucacagagaucuuccugccucuguguccugaguacugggauuaaagucguacaccacccugcccaguucaugaguuucuuaaacauuuuuuaacuaggugaaaagagcuauaggauuauagaaauaaggugguucuuucauuucaccuggacaaauagcccucucugcuacuagaugggccaacaagcagcugcccuauggugaugcaugagcugugaaugcugauauuaguggaaggaagaagggaugcuaagggcugugauccccuugagaaggacacugaaagaaaagcaagguuguagaucaauacaagacuagggcuuagagaugguggacacaaagccagugacagcuuggucauuauugcucagcacagucuaugcccuggagagccauuguuugagaguuuaacugcuaaggaagagcuuuucuugcuggcuguggugguuuagguccucaucuaaggccacugaccauuuugaccuguggggcacagaggugcacuucuuuaaccccagcacuggggagcagaggcaggugguucagggcaaaucuggucuagagaguuccaggccagaagucaggcuguuuugagacccuugucuuaaaacaaaaaaugaagcaaacacuauagcuguuuuguauugacuagagggaaauaauguuuuagcaaucucucugaaauuagcacguugacaccaaagucagugguagaccgaagucagauaguucaguuugaguucuucauuuuauauucuagacaagguguugccuuccuagugaugcaguccuuucauacaguccuuauguuguagugacccccaaccauaaaauuauuuucauuacuacuucauaacuguaauuuugcuacuguuaugaauuauaauauaaauaucugauaugcaggguuacaacccacagguugagaaccacuuuucuaaaagcacagggugagcugggcaagcaagcaagauuuucuagaaggguaggugacaaucuacaacgcccauucuuugagcuauucuucccggucauucuguuccagacagcaagugaggucaugcuuagcaauaggaaguacagacagugcugucaguaaaucacucaguaaccaaugucugauaauuggucucuucuaucuaacuuuauuucagcaauuucuuacuguggaauuugcaggugacugcuugacacagugguggcauugaugggggcuuugcaguuagguuugucuguagaguagcacugccugcgaaugcauucaucuuggucuuuuccacucucauggcccuguuuucuuuuaagauguuuucaaacugcaguaaacaguccaucuacaagaccauagaaaguaaggcucaagagugcuuccaggagcgcagcaacaagguguguggcaacuccaggguggaugaaggagaggagugugacccggguauuauguaccugaacaacgacaccugcugcaauagugacugcacacugaagccgggugugcagugcaggugagaguguucccaccggggcaggggauagugaagguccagauaacaggagauugcaaaugcaggcaacuuggcacuuucucuggauagacuaggcucuccuggaacucaaagagauccaucuacuuccaccucccuagugcuuuaagauuuauguuuaucuuaaaauuagcuuggugacaacugccuguacuagcuguucacuggagcuuuaaaaaugucuuuuuaaagccaggcacggugaggcauacuuuuaaucccaguacuccaaaggcaggggaggcagaucuucgugaauuggaguccaaccugauguacauaguaagcuccaggccagccaaggccacacagugagacuguauguagaaaacccaaaaucuuuuuaaaauaaauaaaguugauuuaacaagccuacucauggcuccaucuguuacaguagcaaaauaucggaguaaucaaagguaaugcuauuagaagacaaauuguuauuguauacccauguaauagaauaauguggaggugcuguuuaaugauuauuaagcaaauuccaaaucggaagguaccgacauuucuauuuuuaaguacccuaagagagcaguguuuggugaauaaaucaccuguauugcaccuucugacuuguggguucucucggcagugcuauggaacucaugcugcuuuguuucuuagccacuggugcaucccccacauccccaagucugggucucucuuuguagcgguggcuauccuggaacucgcucuuuagaccaggguggccuccagcucagaggaccugccugccucugcuucucugcuucuaagugcugagauuaaaggcgugcacuuucacugucuggcuucccugacuuuuuuucuuaacuaguuaaugaaaacaaagaauaccaaguuacuguaacggugacugcugcauguacuuacuuuuucacauuaagggauggacacacacauaugcacacguauaugcacauguauauguauauauacauauauguguauauacauauauauauauauauauauauauacacacauacacacacacacacacacacacacacacacacacacacacacacacacacacacacacacacacacacauauauauauauggauauggugcagcuaacuccagaggagucagacugcaguagugacuuggcccuagggucuugcuuuaguuuucaggucacuaacacaaccauagcauuugauguugggcugucauuggaauugaaugguguuugucugcucuuccauagugauaggaacaguccuugcuguaaaaacugucaguuugagacggcgcagaagaagugccaggaggcuauuaaugcuacaugcaaaggagugucuuacugcacagguaugcauuucccuugcuucuccaggcccuguggccugugaagauguauuugaaaccagggucaaguuuccuucaggugaaagcagcccuugaggcuuugcuguuugcugguccgcauuuuuguuguuguuguuuuguuauuucaagacaggguuucucuguuguaguccuggcuguccuggaacucacucuguagagcagguuggcuucgaacucagcgauccaccugccucugccucccgagugcugggauuaaagacgugcgccaccaucacccggcuggguccacauuuuuaugagaagcagcgugugacaacuauugugccuuggacugagugugaauggguguuugccuccagggaauagcagugagugccccccacccggagaugcugaagaugacacugugugcuuggaccuuggcaagugcaaggcugggaaaugcaucccuuucugcaagagggagcaggagcuggaguccugcgcaugcguuggugaguauuuucuaaguccugcagcugcauaacacaugcuuuuugucuguugcucaucaagagugaggaagccaaauagggauaaggaaagcagcaaggcaugugagggauagccuggagacagauagcccugggauagccuggugauggauagccccgugcucagaucccggcucccucccaccugcugagcucauuuccuacuccauuucagacccgagucaggcaggcuccauggaaacauggagaggcauugagaggaugguggaggacuguccucgcccuccccacacaucaucuaaagcaaaagcagcaguagcuuugucccacuggcacuaauggagggaacucuggaacuuaaccaaagccauuuccuguagauuagaucucuaaaacugcguuugugugugugcucaugugcaugcauuuuuacuuguggaccuuccuccaugcacacaugcucagagggucacauguagggcucaggaaucaaacucagguuuucaagcuuggcagccagugccuuuaccugcuuugcccucugggugggaauuuugaugaugccaccaaagucugccacccucucaucccugcuggggcggcaugagaaagcagccuuuuaaugcuagccuccguuuuccuuggguucccaugcucuuauuuuuggaaucacuaggucugaagggaggauauucagggccuggcuucacuccacgguggagcugguggaugcugccagcucucuguuccauauagggacaucaguguuaaaucaugagggcggcggccgggggugggguucacccauaggcuggagugagugguccuccaggugggucacuguaagaacagcacaugcuggggacaguucagcaggagagcaucugacuagcaggcaugcagaggcaagacagcagccaguaaacgggggaccgagugaauggcaacaggcuugcaugccuuggacagacacagucuaggucgcaguaagccucuguguaauaaacguuugguuugcauugugcucugcuuggcuuuuccccugaaguaaauguagcucccccuagagcaaaccuuacacuggacaggcagguuuucauucugagugucugcacaucuggugcugacugcugacuuugacccuagauggugucagagcuccucuugaguaggguccugucaaguccaggcugugguucucauaucauuggcccaggguaggguagaccuuacgugagaagccagggaugggagcuggcagggugauaagcauguugggcagagggcacauuugaagaacauuaggcagcuuaggcagagaguauaauuugacuuaaucuauuaagguuuucuguugauaauuuuuuuuuucuguuuuugagacaggauuucacuuugugcccugauuguccuggaacguacaauaucgaccagauugucuugguauucauagagaucugccugucucugauccccaagugcugggauuaaaaguuugugccagccgggcaucaaucccagcacuugggagacggaggcaggcggauuucugaguuugaggccagcguggucuacaaagugaguuccaggacagccagggcuacacagagaaacucugucuugaaaaaccaaaaaaaaaaaaaaaaaaaaguuugugccaccaugcccggcaaauaguuguuuaaugugagggaagagcugagagcuauuaacuuggaaguguugggccauuuucuuuuuguggugcuggaccuggaacccaagcccucacaaugaccaugcaggcacucugccugaagcccucagcccuggauaguaucagcuuuugacaucugggaguaaggccaaagacuagaugucgaggaagcugguggugaggacucucaugucagcuggcaugcuucucuuucagacacugacaacucgugcaaggugugcugcaggaaccuuucuggcccgugugugccguacgucgaugcagagcaaaagaacuuguuuuugaggaaagggaagccauguacaguaggguuuugcgacaugaauguaaguaucuguccuguuguggaauuaugcaucuguagagaggcacagggccugacucgggccacuuaagcagccuuggucuuuccuacucauucugugccuccuucagaaucacagccugcacaguuucacauucuguccagucuccaggccaggaaauuaggacuuggugucugaauccagcuaagacaguaaagaguaccacacagcccugccccagccugccgucacauagaauuccaggccagacaggguuacuaguaagaucugguuucaaaaaagaaacaacaaaaaguaaguuuccuccccaggucugcugucuuugagcucaguuuugaauuccacuaacccuagaauaucugccuacuucaucuuacauagaccuugucugugcauacucagugaaagcacuggguaaaaaggcaaaaagauagcauuuguguuuggauugccuuuguuugcaaaaccaaguacuuaauguucuaaagcccucuuguccacuguguauauaauuacugucauucugacugagguauuccugggguuauagcuuucuugagucuuguccuggucauucuaaaaauagacuucuuugcuagaugugacaacacacuccugaauucuuagccauuagaaacagacagacaagcccaguuugagauauacaggacacugucugaauacacccagccccaccacugcaccagauauuuuuuaagggauguauugugacagugcuagugagaggaccugcuuucuuggguagcuucauaucggaauuacuacccuguguccaggugggccaccaggcagagcugguuacuugcccauuguuuuuccgaggcuccaguagcucuaagcaugcuguuuggcauagugcgauuucuuuucuccuuauagggcaaaugugagaaacgaguacaggacguaauugagcgauuuugggauuucauugaccagcugagcaucaacacuuuugguaagugaaauauuuccuggauuauuuaccaagaucuaagcugauucccguuaugacgcgggugugguuucgccccauauuuguuauggaauaacucugguuagcucagggucaagagcacuguuguucuucuagaggaccugguuucaauuuccuagcauccacaugguggcucauaauuaccuguaacucuagcuucagggacuccagcauuuguuucuagucucucagggcacugcauucauauuguacacagacauauguguaugcagaacacagaagagugaagguuaagggaggggaaacuggaaagggaggcaacauucagaauguaaaaaaacaauuuuaaagaaacagagccgggugugguggugcacaccuuuaaucccagcacucgggaggcagaggcagagguagguggauuucugaguucgaggcaagccuggucuacaaagugaguuccaggacagccagggcuauacagagaaacccugucucaaccccaacccccacccccccaaaaaaaagaaaacaguuaaaaauuuaaacaacuuuguuguugaagacaaagugaacucauuccaggucuguugcugugagucuuguaugcaugaguuuucagaagagagugguccaccugaaccugguucagucccuugacccugguuaaucuaagaguuacuucccaguagagcucaaauuuauagaaggcaaaaccccauagauuuuagcuuuaauaaaacaauuuucaggcaaucaaagcagugucuugcuaagcaugcuggcuugaucggcugguacgguccacacaggaaggcaggcugcucauccccuagcacagccggccaggagacucaggagagguuuuuaguaggcuugggaaaugugauugaggcguuuaccuuuugaauuauucacagggaaguuucuggcagauaacaucguugggucuguucugguuuucuccuugauauuuuggauuccuuucagcauucuuguccacugugugguaagucaccaaaguuuaagugaucaaauguuuuacagaaaugccgagcaacuucagauugaaagauugaaaaaaaaaaaaaaguugccauagcuauuuugaguguucaagacagcuucucuagaaaccuacuggugguguguggacagaauagcagcugagugccuagcucagcuaguagagggugucccuggggcacaggacugcgcuccuccuagcacugcauaaucgauaucauagggcaugcaccuaggaaauagaggcaggagaaccaggagcucaaaguuacacucggguacauagugagcagccucaugaggccaugucucacacaacagccaguagacacucacugccacacucgacugcuggguucuuuccuuaggacuuaagugguggaaggagaggguugacucuccagaguccucccauguccccaugcacaucccagcuuguaggccauggcacacucacaugcaaaauaacauaaugaaggcuuuaaaauauauuucuguauguauauuuugcuauuuaacuuauuuuggaacuuuaaacaauuuaaacauuuagcuggacuugcuuggggcuuaugacuuguaaagucucucaacaagagcacuuuuaggcugacuugguuauagaggaacaaagucaacauuuccaagacauucccuaugaacuauguagcuuguugacauuguguauaguguucauaucuuuauaaauuuuuaggguuucaaaacuuugccuugugugagugagggguggguaaagagucucugaggcugucccacugcccuccuggcuuguccuguaguguggaacacagcacugagugguagaaaggcucuggggcucuugugccgggcagggcugccacggcgacuguuaaaagaugugucucagggcagcaggaccagugcucuugagugcuuugcuacagaguuggguagauuuuguguacauugaauguguacauagggaccacgaagcugauccgugauuucagagcagagccacugacuggcgguuugugucuagccacagaaugcguuuauggcaccaggcagaaguugugacgcaguucuugcaguugucuuucaacuuucuaaccuuugucaguuagaaugcagccgccugcauagauacaacaugaggaucaagacucaaugccucuagaaguguggugucugugaaaucagcuaaggggcuguggguugggguggugaagucggaacccagggaugcugugaauagucaccuuugccaacacugucucaggguaugaguguuguggacaugggcagaaccuguuguacauaaacccucuuguucuccugcacagucuaagcuagcuuugaaaaauaggccuuaaaguacccuuucguuuuguaugcauguuacuauuagcacuucuugcuggguguguaugugucaggcuacauaaauguguucucagcuaguaaaccugcugucccuuggguuucuucuuggcaguguguggaggauuggcagauagacccaaggcucaaguguguuaggcgacugcuccaguguugagccacauccugcgucacugugcaguugaggucuaaguucacucagccuuaggagcagugaucaggaagcacucaccauuugauggcuggguuccuuuaaaauuaaaagaauuuuaggaagaaugacauuuuuugcugggugugguggugcacaccuuuaaucccagcacucgggagacagaggcagguagauuucugaguucgaggccagccuggucuauagagugagcuccaggacagccagggcuacacagagaaacccugucucggggggggggaaaaaaagaaugacauuuuuacuuccuaugcuuucuaggauaagaaacuggacaagcaguaugaaucccugucucuguuucaucacaguguaaguauacauauaaaacaaaagaacagucuccaguuguacgucagccccauuaacaaaagucucagcaagagcucuucccuccugggcuaguggaaguuaaaaggaucugauuggauguggcagauccugagaaauugacuguggcacacuugacuuaguugcaugggaggaaagcuagcagaggggaacccgguuccccaaaccacagguggugacuuagccucuuagcacugaaaauuuuuuaaagauuuauuaauuauuauauguaagugcacuguagcugucuuuagacacaccagaagagggcgucagaucucauuacggguggcugcacugaauucuugccauggaucuuaauaggcacaaguugucagcaucucacuccagagcuccugcucagguggcagccagcaccagguuuagcaugagcauagcccaggguuacuguacaguguaaugaccugauucauuuccccucauccuucccagaacauugagaugcugagcagcauggacucagcaucuguucgcaucaucaagcccuuuccugcaccccagacuccaggucgucugcaggcccugcagccagcugccaugaugccgccaguaccugcagcuccaaaacuggaccaccagaggauggacaccauccaggaagaccccagcacagacucacaugcagaugaugacgguuuugagaaggaccccuuccccaacagcagcacagcugccaaguccuuugaggaucucacagaccacccagucaccaggagcgaaaaggcggccucauucaagcugcagcgucagagccgaguugacagcaaagagacagagugcuaguggggaaccuuggccugcucuaggacauauaccugcagauguuccauagagcugaccugaaucaaaacauagauuauaaugaucugagaaacggggaagcaacuuagcagaugcuggucaugugcuaugaccuucacaugacauccuauguauguaggcccuuugaagaggugagguaaaucuggcuuauguaaggcuuucagguuuuggguuuuucuuuuauaaucuaaaaucuccuuugaccuguggugcagaagcagaaaguaaggcuggaccccguuccuggugacagugcuguuaagucuucagucuguuuuucuguacccucugacuacagugaagcacuuaacagugaggauaacuggaacacagacauacuuguuuguuuguuuuguuuuuguuuuuguuuuuuuuuuuuugacccucaacuaaaagaggagcaagagaaaccugcuuguauguugucuccaaaugcggccugucuuggcacugaauucuuuguagauggagagaccugccuacacuuagggccaucuacauuaagagcaguccuuuccaagaggaacaguuuauagaaacagccacaugaacuucgagauggccuauuaacuguucagccccagauucacugggcaguuuuuccauuuuacaaaugugucgucuuuaaacuguuugccuuaaaaaaaaaaaucaauauugggcuggagaguuggccccacaguuaagagcaguuggucucauucucagcacccacaugguggcucucaacucuguaacuccaaucccagaggagaugacaucuucugaacucuaggacacgaggcauacauuggugcaggcaaaacaaagccaagugcuguaaaauguggcaauaaccacaaaaccuauagugccucacaguauggacugaguggugaauagacacucuucccagaaccacuucuggacaggccgggaugugcuggcuggcuaggaagagggggugggagugggagaguggugcugccaucggggcccagcccuagaagaacugaccuucagucucggcaaguagacacccacgugaccucuggcucuggugcuucaagauguucuguacuuacugugugaggaauaaaugccauuagccugaauucugauuucuauaaauucuaguuauaaaugcucuuuucuucuaagaauugcagugugcucacaagccaacacauuuuaaccaagauaauuuguaaacucugaggacaguuaaccaagccugugccuugucucuccugaggacgccuguuacacuaauacuugaauauauaccuugugguauuugcucuuuuuacuagucaugauagucuuguauuuuaauuacacuuugaugauuugcuauagggagagugggguguguggguauauguaugaaugaaacaguuggcagaauauaagaaaaccauuuuuauaaaauugugacuuuuuaaaccaaaauugucuuaauuguauuacuuuuuuuuucuuuggcauguacagaauuaauaagaugcucagggcauauucuauagcuguggcauugaugauaccugccucagucaauaaauacugaauaucaaagcaguggauugcguauauaacauuucccugaaaaauaaguuaguagguuuuuugaucaauaaucaugaacagaaguuaagcuuggaaaagacauuuaaucaaucucuugaugucugugaauuacuaauaaagcuacgcacauguucacagaauguuuguggcuaccaacaugaaugauacgagccauuaauuuuugggaacaucucccaagcuaauagucuccaucucccagcagacucagcucgggcuuugcuuccuccacauccuuccaguaaggaagcagccacggcagagaugagaccuucuuguccagcaguggacagagguuuaagaacagaaacucauuucccauuggugauaaaugcaggccauccgauaaauaggaugagaaguccugu

SEQ ID NO: 6604 - RNA, 28173 nt, Mus musculus
ggaggcgccccggacagcggcuugguggcgcguaauucccaaugacugugcgcgcccgcuucugggcucguuugccaaggacucggaagcugcagcucccagagcacagcgggcagaccugcgggcugugcgcgccccugcugccccgggccuccagggguggcucccgcgccccgcggcgacuuccgcgcccgcgcuucccuuuguucaagucccggagcggcguugggguccgagcccgugcccugggcgacugaggcggccgcaguccgcgccccggcgcccuggcgaugccagaacagaucuccgugucggaauucauagccgagacccuugaggacuacaaggcgcccacggccuauagcuucaccacgcgcacggcccagugccgggacaccaugucggccaucgaggaggugagcgguagaguagcccgcgccgggcgggaggcuagggucgcggggaucgcgcugcgcccugggcacccgguacacuuccgcgccuggugccggauacccagugcccuccgccugcgcccacacccgggaaaaguuucugguaccccaaagccggacgcagccggaccagcagugcccgacacagaagcccuuuguucccugcucuagggagaggcugcuuggccaccuugggcauuuuuugggaacgcuccugacuguuuccauuucccucgcaggguuucagguucuuugcucccauccucggagaggucaacuuaggccgcagagucuguggcggcuuggagccggggaccccugcgagcucugcggcccuggagugauggcucucccugcguggaccucuccaacuuguuccggaagaauccccgcaggggcagcuguggcuucugagccaacauguagagcagagccagggacccuaagcugcuuaggcacgggugcccaucccaucuugggaggccuggcaguucccacuacuugccacagagcagcgcuguagagggauguggagaauggucucuuugagguccaaaaggucuuugguggccgcuucugggcuaccuguguggugccuguugacaguaugaucagcuccugugcccuuaaccuggaacaggccugcauagucauuguauugaguggcuaagcagcgaguucuccagauccuggggaagagggacaucgagaaggaagcaauuuggguugaaaauugaagcaggcuuggaagaggcugagugaguccagagaccacggcuguccacagcuugggaaagccucacuuacaucauuuucuuuaccuccccaacagaauuuagaguuucguguuuucagcucuguaggcuuugugcguccagcaggacucacaaaagguagcuggagaacgagacacacauguguagcaguagugaaccgaugacuacauuuccuuuguucagaauuuuaacaucaagguacauauuuuaaaauacuugugucagaggcugguguucacagagcuuuuaaauuaagcuaugucauuacauccuuuccccuugcuugaacaaaguauucgcuauuaggcuucuucugggcaggggguggggugggggacuagacuauuguucuuucguguaaaauauuugucuuuguagaccuacacagucaggacuagacucaaugaaaaauacuagguucagcauccugcucuuggaagugagcuaggguauccauucuucuccuucacccuaguccccuuucuuuccucucuccugucuucccaaagaucugcuuguaaaucuuuuguagcaaauucagugauagcagauugcuuuagugugauuuccucuuuaggauuuacuuuuuauugauuuguaucugugugugacacucggagugcagaugcccucagagcuuaugcauccagaauuguaggcagcugugaauugcuugguugugggugcugguaaugaaacuuggaaccuccagaagagcaggaaguucucuuacaacaaaccauuucuccagucacugcaucacaguuuaaagacauuucagugcuuguuccuaggccuuggagaaaagugaggagaccagcaaaggaguagggguucauuuguugaccuguccagcagguccaguuauuugagggucuggaggggaccuccuccuaagaaccaagugggggguagagagagaagagggccuugugcgaauaacgacagggaaaccguucuggaaugcaucaaagucccaauguauugagaaaggcccaaggcuuaaaugcacaagcaaaaggggaauuacagacacuuaucagugggagggauagggcaauacaagcaaaaggagaaguacuuaugggagagugggcaauagaaauuuuuucuuuuggcagcuacucggggaagcaggaacuuggugguaucaggguguggucaggacauaggcaaugacuuagggcuggaacaugccguaguucucggaauccauguguugguggcccgcuuuugacccccuuuucuucucggugggagaggcccaauucagagaucaagaguugucuuaauagcucccaacaucuccccuguauuaauauuuuuauaaaggcauauuguauaauaaauuuguagccacguuuuuaucgaucgccuaaacgucuguuugcucacugggugauucucuaaaaccacgaaggacacaaggacaagucaucuaugaggcuugaauuaauggucccagccuguuggguauaacuugggcuagccaagggauuuaggaacgaagcaagcuccguggguagagguagaggucugauccccaguguuuaauguuaggggccauguacaggauugacucucaagcccacagaucuuuacucagaguaaccccgaccugcuccugugccguuuuuuuuugggggggaaggacccuaggacacucaaccuucaugcaaucagacaugccucucagagacuaacagcuucuagucuaauaucugugcaguacuuagucuuacaacucucacgggcgacggcuucaaguuccaauuuuuugaugugucuagccugggaugacuguuuaguuucuaauguggugagaauguauauuaccaugucggaagcacagacuacggcaaucuauaaaugauuuguggcaugagacugauggccgaauuuauggggaggggaaugaucuuacuuaagcauuuuauggagauugagucuuucuccccgagacgagggugaugaagcagcaucuaagucugacucuuuucuaguaaccugcuuguuaucgccaacguccagccgaugguaaugaacugaaacaaaugcacuugaaagagaugaaucaauuugagauuuaacaaauugggucaauuucugaaauguccaaggaccgaaggaaaucaauaauaggaguccccauaggggcccuaaaagggagggcaacgaggucgaaagccagggggagguuaaaaaccaguuuuaguaguccaccuuuccccuaggccauuguaaguauggguguaacucagcuaucuauaguucuacguaucugguuccucuuuaggucuuaaacuuccuucuuccuagaugaugguaaauuccuguguaaggcagugaccuagcuuuuauucaaagugauaguguaaagccagagacaauuuugaaugucacugaauaggcaacuuucuuccugaauucuaagcccauggucagcucaaggacuuucuaggaugcuaucuuuugccuccaaauuuuuaucuauauaauauguugcucugacaaagcuauggaaauauuccuaugcuuaucauuaacaaaauggcaguauguagcugcugaucuaaagcugugguagauaccuuuuuaaaguuugcauuuucagauuauuaaaccaaggaugauuuucuaacucuaauagguagcaaaacauaagcaggucucuuacaaaaacauaacaguagauuucuuaucuaaauuaggaucuacacaauaaauugauugacaagaauuauaaugacuauaaagagacuugccaagauuggugaucuuaacucuuaaaauuaucuaacaauaagcauauagguaagguacacaaacuuucauagcuauaaggagcuggccugaauggccaaaaacagugucucugacgaaagcaucuuguacauucucuguaccagucuuuuugccucacgagucagcuuuuuuaguuguuuguauuuuaaguuggcaccagguugguacuccuugcugcagcccaugguggagauacgaaguuucuuuaucuguuuguaaguggcugcucuccgauuucuccucuuuugugcacucaacacagcuuucuggucaccacugucagggcacuuacaggucacauuggaagcuaguauacucuuguagcauucuguggaacaaacagaaacauucccccuuuuccccauauuaaguaucugaacaggaucauggcaugugccaauaaguggauccuuuuuuuuuuuuuuuacauuuuuuucccauuuuuuauuagguauuuagcucauuuacauuuccaaugcuauaccaaaagucccccauacccacccacccccacuccccuacccacccacucccccuuuuuggcccuggcguuccccuguacugaggcauauaaaguuugcguguccaaugggccucucuuuccagugauggccgacuaggccaucuuuugauacauaugcaacuagagucaagagcuccaggguacugguuaguucauaauguuguuccaccuaaaggguugcagaucccuuuagcuccuuggguacuuucucuagcuccuccauugggagcccugugauccauccauuagcugauugugagcauccacuucuguguuugcuaggccccggcauagucucacaagagacagcuacaucuggguccuuucgauaaaaucuugcuaguguaugcaauggugucagcguuuggauacugauuaugggguggaucccuggauauggcagucucuacaugguccauccuuucaucucagcuccaaacuuugucucuguaacuccuuccaugguuguuuuguucccacuucuaaggaggggcauaguguccacacuucagucuucauuuuucuugaguuucauguguuuaggaaauuguaucuuauaucuuggguauucuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauguccaauuuucugaggaaucgccaaacugauuuccagagugguuguacaagccugcaauccaacuaacaauggaggaguguuccucuuucuccacauccaugccagcaucugcugucaccugaauuuuugaucuuagccauucugacuggugugagguggaaucucagggucguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggaaauuaguccccuaucugauuuaggauagguaaagauccuuucccaaucuuuugguggucuaaaaagacggugucuuuugccuugcagaaacuuuggaguuucauuaggucccauuugucaauucuugaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaucaauuguugaaaaugcuguccaucuuccacuggaugguuuuagcucccuugucgaagaucaaguggauccuuuuuaucuguccuagacacuauuauauccaguuuuuccaaaaaugaagaugugauccaaauaaugugcacagggauauaauuucucacaaaaaugugauccaaauaaugugcauggggauauaauuucuccccuucuuuguuuuuaaagaagguauaauuuuuaaaguuuuagaauaccuugucuuugagaauuauaaaauaucucaguaacauguguaacauuaaauuguugacaaaacaucccaaaucuuuggcuguuauagccaguuuuaauuugauuuagaacaccaagcaagcaaaaaauaaaucaacacaggcaaugacuaacuauacuuuuaguugcuuuucuuguuaaaguaguuguaauuagaaagacuaaagagguaucacaucauaugugcuuauuuuaauuuuuuuaaaaucaaaaaugaguauccauuuguaauaauugauuaaguauaaguccccgagaauuagcaccaauguguggaacagguagaaacugaggacacugagagcaaaucuuuacaauauggcaugcacauuuauuuauuuauuuauuuuaaguacuaaauuauuauuuuaaguuacuaauuugaugauguaaagaaugagauuauauggccaauuauuuuuguauaagauccauaaucuaccugggauauaaaucuagcguggcauugccuuaagaggucuuuucuaggcaaucuuuaacauuuuaaaacaccaccuacagcacuuaauuuaauuaucugugcugaagcaggcagaaacucaaacgaauaaacaugugauccaauucacguauacuuuuuucucauagaaggguuguuuuuaauuacaguaaaugggaugcaugcaugcaugaauuuauaggagauacaaaagcaugcauauaaggauuuuuuaacuuauuuuuaggaugaguauccauuuuauuuaaaaugaugguauguaauaggucaaauaucaauauuuugcaguaaccaauugcuguuuggaacaaggaauucuuaauuagcaccacagcagcuuuauaauaggauguuaaaacuuugaggugaauaaggaugauuuuacauuaauguuuuuucuugccagagaauagcuguggacacauuuaauaacaauaacuagaauauguagcuaauauuugauuaccaccaauuauaaucgauaccaauagauuauagaaguuuccuauauuuucuguuaaauccuuuuugguucucaccaguuaauuugaaucucacuugauagcaccuaacaaaggcuuagguucucuugugguaaguuuaaggugaggucuuuagccaauuaacaucucuuggaagcuuuugaaaauaaaauuuugaagcaaauuuguaccacaauuuuuuaguauaauuaaaaacccuaaauauuaaaaauauugccucugaaucuuauggagcaacaacuauuuccuagaacuuuaaacuuuccuuuagaggcauuagcuaaaauauuuuuuacccaggaaacaauauacacugaaagauucaaagucuuagcuucuuguauugaagccuggacaaugacaauuuuuuacauauuguaaagcuauguuagccauaccuacaggcaaaauuaucuagugaucaccaguucauuaaaagcaaaacucuuugaauguaagcauuauuuuaaacaucugaauagauuugcagcaaagcuaaaaagaaauuuucuugaauacaggggaaacuuucuuaggcacuguuugcaaaauaaaagaagguuacaagcuuuucuggggcugccuuguauuaacucaaacguaaaauauuuuuuaaucugagcauuuuggccuuccuguaauaaggaccgauuuuagaggaacaauuuaacugucuguccacgccucugauuuuggacaaucuuucuuagaugacuuauaccuuaaacauuuucucuuauaaccuuuuaugguccuguaagaccgcaaccauagccaaacugauugugugagggucuaauuucugcacaaagaugaauauaucuaguuaacucugccuugcuuuguauggcugaauggccaaaaugagcugcauuagugcaucauaagaugauuacucuuguaauaaucuuaguuaacaauauaugggugaguuaaaaauccuaagcuuuuaaucaaauugcaaacuguagucaaugggacacuggcaauuuuaaccauaauuuuuaaguuucuguugcaauauuagaauauaucuauaacuuuuggaaagcaagaccuaauuuuaaacaauuuauuuucuuuaaaauuaauacuagaaacaucaguaucacuuuacgaaguuuggcugucaauucaugaaugcaugacagugcaaauuuuaauguuccauuaaggagacauuguuuuaaaaucuuaucucuauaagucuacuuuuuaggauaagaauuacauaaaauuuuaucucaauuuagaaguaucuuuagaggacuaguuuucugggcuggugcuuuuguuugaaaaugacucuagcccugaguuacuacuuaagcuacuuuguaaccaguguuauaacuuuuuaaucauacccaaauaacuuauaagccaauucucuaugaccaggauaugcagaucauauuuauaccuuuaagauuaaucaaaaaccagaugaaguggguacacuaaucuuauaaauuuagaucaaagaauuuuacuuuuuauagcuauacuuauaaaauaaaaacacacuuugucauuugcuaaacacaauaaucacaaaauugcagagaauuuuuuaggaaaaaacaacuaucagcuuauuugucuuagaacuaagagguuguagauucuaaguuuuucagcaggaccucuccugcugugcuugauuuuugcuaaagggaggggccucucagccucaguugugcaaacugagagugauucagcagguaaaguuuuaaccauuuauuuuuucuuuuuaacauaaaacauaaaacagucagucauucagacaacgaaacaaucauucagacgagacaaaaacauacaugaauugacacgugauuggugcaccaaacauagacaauagaaagaggguagugagcuuuuccuguaggggccagagagaauaaaacagggcgucccccgauuucucucugucccugggagaguucuaaaauccauuuuccuuuauuucuuccuuuccuuuccugcuuguaagagguagcuugucaaaccaagauuaaaaucuaaaauuuucuaacagcuucuggcaaguauccaaaacuucuaauuuauuuaaucugagggcaaauuuuugagaaaacacacaaucucuauacacuaaaugucucaaauagccuaaaaguuuaccaugcuaaagcuuuuuugaagccauuaucaguucacacuuagucaaauucugaggcauuaucucuuugugccuuauccaacaaggcuaaagcagaagcauuuaauauagaccacaauaaaucaguggaagagcgccccuccaccuuaguauaggcccaccgaggccucgguucaucuaggucugcgugcuuggccacgggcgggccugugauggcaaaguguucuugcucagacccgcugccuuaggccgcaggagccccgaaggcccagccuuggccuucacgccuagccgauggcugccucgagggcgagggcuccuggccuccgcaggguagggaccgaggccgaggcugugagggaacccgggcgaagaaggcccgcacuuucgagcucccugugcucuaugcugaaacccuacacaaucucccgugggggcuaagggguugucugcauuugcuauuaggggagacgggccucgcagggggucccucuagccguuucccuggaccgcaguuacuaggguguugucuuuguguagggcauucucuagcaaaauguccagguugguugcaucuauagcaaguuuuuucuccuauauuuaguuguagagcagucccaauggccagguuaauagacuuagaaacuuguugagaaaacacaucuaccucauuuuaaagcuugaucauaccauuuauaucuaaacucuugguuuuacuucucagggcagcccuaaauucugacuucuaaguuaaauauuggccucuagugaggacagacugaacaacguuauuucauucauuggcuaucaaguagccuuuuccugcuaaaccuucuaauauagauccaacuuuauuuuaaguuaaaggguguauuuuagaaccauucaauaccagccauggacaucucuuguccacaaaacaaaaauauuuuauuaaauuccccuuuuuuaaaacucuuaucccucucuccuuaagagaacccuuuaucucuuaacuaaauuccccaugguuaaugggacaacaacugaaugccuaggcuuaccuccugacgucuguacucgacacucgagcgaagugucgguggacugucccacuguuucucugucugcgugguaccucuuuaauccuuaauucguuguccggagggcagucguaccucgugccccacgucgggcgcuacuugacucguccagcagguccaguuauucgagggucucgaggggaccuccuccuaggaaccaagugggggguagagagagaagagggccuugugcgaauaacgacagggaaaccguucuggaaugcaucaaagucccaauguauugagaaaggcccaaggcuuaaaugcacaagcaaaaggggaauuacagacacuuaucagugggagggguagggcaauacaagcaaaaggagaaguacuuaugggagggugggcaauagaaauuuuuucuuuuggcagcuacucggggaagcaggaacuuggugguaucaggguguggucaggacaucggugaugacuuagggcuggaacauccugugguucucggaauccaugugucgguggcccgcuuuugacccuuuuucuucuggggggggagacucccaauucagagaucaagaguugucuuaauagcucccaacaauuugugucugcagugguggcaguguagaaauguccuuugaacuuggugucauucccucauacuugaagcaugggucuccugucaucuccaagguaaaaguggcacuguccagcaugccuuagugguagagaccaggucuacugugaagauuggcuggcuggaggacuuguauugaaagcaguccuauuuugcuuuuuuguuuuuugguuuuuuuuuuuuuguuuuugauuuuuuauaucuauuuauuuauuuauuuucaagacaggguuucucugcauagcccuguguguccuggaacucacuuagaccagacuggccucguucccagaaaaucugccugccucugccucccgagugcugggauuaaagacguguaccaccacgccuggcuauaaccaguauuuuuaugugcuuuaauucuauguuaagaaaaugugcuuuugccaguugguugccagccagacauauaaauaauaguauacagauugugcagacuguguuuauauuuuuagguaauauacauagauguauaaaauaacaaaugaaaagggagguaaugaauuugaaagagagcaagcagggauauauggguugguuuggaaaauagaaacgaugagauuauauuacacuuucaaaaauaaaaaaaaguaauuguaaaguaagaaagcauuaaaugggcuuauuuaagauuauuccuuuuugagauaggucauauaggcacaauggagucaugugaaucuggguuucagcaguugacaaaacaggaguucugaccacucugguugguucuucuauguccuuucacuauacagauguggguuuccuuagugcaaguacuaaguacuuauuucuucagaauucugguacauaguaaauaucagcuguaauauccugcaacaugagauaacccguccuugauuuuucuaaguucccuuggcugagagccuuucuauauuagacauuagagggacaaucuauuaaauuuccuuucuauauccauagagaaauucauucugaguugagauauguuuaccuagagaaccuguccuaauacaacuguggcuuuucucuacuuugccacugauggcgaugugcuggcuaccaagagggcucaacaguguuucccuuacguuccuggcuuuccucccaggguugcuugguaccuaucaucuggugaaagggagcuguagucucccugagcccagcacugagccacaaacagaacucuuguuuccuaaaaucccucuuuaauguucauugccugggcacccuuccacucagauuaauaaccucacugcaccuuggguaaugggcuaugcaugcucuuccgcuggauuucaggaagaagaaggcaagugggggcuaccuugccagcagagucucgcccaacacccgcaagggcccacacaggacuccccacgggauccaaagaccucuggugaguggaacacagcgccugccccaauccaaucgcgcggaaccugagacugcgguacauagggaagcaggcuacccgggccugaucuggggcacaagccccuuccgcuccacucaagccccgggcuaccuugccagcagagucgccugacacccgcaagggcccacacaggauuccacacgggauccuaagaccucuagugaguggaacacaacuucugccaggagucugguucgaacaccagauaucuggguaccugcccugcacgaagagagcuugccugcagagaauacucugcccacugaaacuaaggagagugcuacccuccaggucugcuuauagaggcuaacagagucaccugaagaacaagcucuuaacagugacaacuaaaauagcuagcuucagugacuaccagauggcgaaaggcaaacguaagaauccuacuaacagaaaucaagaccacucaccaucaucagaacgcagcacucccaccccaccuaguccugggcaucccaacacaaccgaaaaucuagacacagauuuaaaaacauuucucaugaugaugauagaggacaucaagaaggacuuucauaagucacuuaaagaauuacaggagagcacugcuaaagaguuacaggcccuuaaagaaaagcaggaaaacacagccaaacagguagaagucauuaaagaaaaacaggaaaacacauccaaacagguaauggaagugaacaaaaccauacuagaacuaaaaagggaaguagacacaauaaagaaaacccaaagcgaggcaacgcuggagauagaaacccuaggaaagagaucuggaaccauagaugcgagcaucagcaacagaauacaagaaauggaaaagagaaucucaggugcagaagauuccauagagaacaucgacacaacagucaaagaaaauacaaaaugcaaaaggauccuaacucaaaacauccagguaauccaggacacaaugagaagaccaaaccuacggauaauaggaauugaugaaaaugaagauuuucaacuuaaagggccagcuaauaucuucaacaaaauaauagaagaaaacuucccaaacauaaagaaagagaugcccaugaucauacaagaagccuacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaccaaauucacacaguaucuuuccacaaauccagcccuucaacggauaauaacagaaaagaagcaauacaaggacggaaaucacgcccuagaacaagcaagcaaguaaucccucaacaaaccaaaaagaagacagccacaagaacagaaugccaacuguaacaacaaaaauaaaaggaaguaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagagugaaaggcuggaaaacaauuuuccaagcaaauggacugaagaaacaagcuggaguagccauuuuaauaucggauaaaaucgacuuccaacccaaaguuaucaaaaaagacaaggagggacacuucauacucaucaaagguaaaauccuccaagaggaacucucaauucugaauaucuacgcaccaaaugcaagggcagccacauucauuaaagacacuuuaguaaagcucaaagcauacauugcaccucacacaauaauagugggagacuucaacacaccacuuucuucaauggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucacaaaacaggccucaacagauacaaaaauauugaaauugucccauguauccuaucagaccaccauggccuaagacugaucuucaauaacaacauaaauaauggaaagccaacauucacguggaaacugaauaacacucuucucaaugguacuuuggucaaggaaggaauaaagaaagaaauuaaagacuuuuuagaguuuaaugaaaaugaagccacaacguacccaaaccuaugggacacaaugaaagcauuucuaagagggaaacucauagcucugagugccuccaagaagaaacgggagagagcacauacuagcagcuugacaauacaucuaaaagcccuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacagucccauaucaccuaaagaaauaggagcaguuauuaauagucucccaacuaaaaaaagcccaggaccagacggguuuagugcagaguucuaucagaccuucaaagaagaucuaauuccaguucugcacaaacuauuucacaaaauagaaguagaagguacucuacccaacucauuuuaugaagccaccauuacucugauaccuaaaccacagaaagacccaaccaagauagagaacuucagaccaauuucucuuaugaauaucgaugcaaaaauccucaauaaaauucucgcuaaccgaauccaagaacacauuaaagcaaucauccauccugaccaaguagguuuuauuccagggaugcagggaugguuuaauauacgaaaauccaucaauguaacccauuauauaaacaaacucaaagacaaaaaccacaugaucaucuccuuagaugcagaaaaagcauuugauaagauccaacacccauucaugauaaaaguuuuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauucgucuggaauaacaaaaaaccuaggauagcaaaaagucuucucaaggauaaaagaacuucugguggaaucaccaugccagaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucguguagaagaauucgaaucaauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuuuagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagauucuggcguggauguggagaaagaggaacacuccuccauuguuggugggauugcaggcuuguacaaccacucuggaaaucagucuggcgguuccucagaaaauuggacauaguacuaccagaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagccccaaaccuaggauacccaagauauaaaauacaauuugcuaaacacaugaaacucaagaagaaugaagacugaaguguggacacuacgccccuccuuagaauugggaacaaaacacccauggaaggaguuucaaagacaaaguuuagagaugagaugaaaggauggaccauguagagacugccguauccaggcauccaccccauaaucaguauccaaacgcugacaccauugcauauacuagcaagauuuuaucgaaaggacccagauguagcugucucuugugagacuaugccggggccuagcaaacacagaaguggaugcucacaaucagcuaauggauggaucacagggcucccaauggaggagcuagagaaaguagccaaggagcuaaagggaucugcaacccuauagguggaacaacauuaugaacuaaccaguaccccggagcucuugacucuagcugcauauguaucaaaagauggccuagucggccaucacugcaaagagaggcccauuggacuugcaaacuuuauaugccccaguacaggggaacgccagggccaaaaagggggaguggguggguaggggaguggggguggguggguaugggggacuuuugguauagcauuggaaauguaaaugagcuaaauaccuaauaaaaauggaaaaaaaaaaagaaaaaaaaaaagaaggcaagugaugugaggcaagcucaggcaaggucugaagucagguccugguaaugcaggaucauugcucacagagaacaggagcaggcagcugacuagccugagcuggaauguguugggaacuaaaacggggcccuggguaagaaaggaaaggggagaagaccaacacccugccagaguuccaccuaugcucuggacagagaugugggagagcugccauacacuccccucucagccccaggugugcaucuaagccuuugacccacucuuugggucugaacaaggggcagcccagccugggagccccggggcugcuuuucuaaaggccugggguuaugggagagaggaaugagggaugagagguucccacaccggugagagugagcacaguggaucuugacuggagcacuugaaggccuuccauggguugauuagaaagggcucauuaggagaaagccuauccuuuccucgaagcgcagugggccuugaugagcagagacauucuaugguuuuagagcuuuauuauagaaagucagggagaaagagagaagguagaagagaaagagaggccccccuagaaggcuagaagggggaaggcuagauagaaagaaaguaagagggagagaggaggagaagagaggagaggacaaagagaaaggaaagaggagagaggagugagagaagugagagguaagagaacaaaggagagagaucaagagagauagguggggcugaacaguccuuuuuaugggcuuuacuguugcuagguaacuggggaggaguuuagccugaaggucagaagcuugggacauugccuacaugacuuuuaucgaagcuucucuuguucucuugugguggcugggguggggguuggggaagguaauuuaggcaggagcuugaguuccagaagcaugagguaauuaaugccuuccucaucaaguaagggaauuaucacccucccaguguucagaccuuagcucaaagggagaccaaccuguuuaugcuuagcccagugccccacaugaauguugaguucucccccagggcugggaggggugaguguccucuuggaggacaggcucaaaugcuaauguagugcaaaccacaccugagaucugaaaaagcucuggcccuggacaugaagcacacuuuaaccuugaggaagggugagacccacuggccaaucaaggaggcgggaucuucugggugccuuuccccaaguucacuguggcugugcaggcuugaaugguucucuguguccugcucugagcucugcuguugggugcugugagaggaccucagggaagcucugauuucgaggcauggugagcacagguuuacugcccacagaggguaggggcagggugcugagcaguggaagcugggguggugaguccucucuggggcuggaugggaaguauaagccauaugugagcaccugugaggucucuccuauugcuccucacuugcaccaucgggggugaccucugaauaacuucccuaucauugcccaaaucguuuggaccuuaggcuggcuugugaaaacaagggugguuucuuugagucuguagcacacguguccaaaccccuuugucuagggcuaggaagauguuccagggccuggaacagggguugugugccccuggucuuaauuucuggguaguuacagcagucuuggaacccugcuccauggcucccagcugccauuuucuccucuguacaagugguggaaucugcugcguagccuucacugcccccucguggcccucuauuauguguguggcacuuuaguauucccuuacugagagaggaagugagacuguuuccaucccaauugauauaguuacucaccuuccaacuuggguuaaguccuucuuaucaaaaggaccuguacccauuaaauugccccugacagagagcucuuuaugaccucauucagggcaaaaucagacucugcaaaacgguggaaaggacaaagacaucauuuuucccccuucuaaacaacccuguucucagucuauaugugacucuguauuuugaacuuggagcugucaguauaugggaaguuguuuuucaucccuuccagcaaaguuaacauaucuuccuuagaccagcagucuuauuuccgggucuguggggcaaucugcaccucuauucaccuuccagcuguuuggccaccucuuuggucucacugaacugggaauccaggguuaagaacaccuaaccacagggcagugcagccucucuucaccccauuucccuguaucuucccaugcucugaucaaggagcccuucccauuuuauccuggcucagacacuacuccaacucccugaugugguggcagggguccuguaauugauaugguuagaucguugguuuuggaauuuuacaacuuucucauuuauuauugucucugugacauaguuguuucaacucaacauaucagacuacagucaucugaaggagccucaguugcuggugugcccucaucagaauggcugguuucuaugucucugagauauaguguugauaauugauauaggaagacucuuccaugaaggguggcaauauugggaagcaaguggucuuggguuggaugagagagcuaggugagaauuguagcugccuguggccaugugaacuggguuccccagaaaggcagcccagggcugaaagagaucagagggcaacaagagaaugaggccaagacaauccuuuuuguucaaagccucugaaguuuacuaagagucccugcuuauaaagaggguaggcccauccucugccagcccauucuuugugccuggagccagcccauaggcgaucuacagggcuugucuccagauagucuccaggaucuuucagcaggaagcagaguauuggagaagagcaaauagagccaucaaggucagaaggcucuacccuagguguacuggcugguuuuaugugucaacuugacacagcuggaguuaucauagagaaagaagcuucaguugaggaaaugucuccaugagauccaacuguaaggcauuuucuccauuaaugaucaagggggaaaggccccuggugggugggaccaucucugggcugguagucuuggguucuauaagagagcaggcugagcaagccaggggaggcaagccaguaaguaacaucccuccuuggacucugcaucugcuccugcuuucugaccugcuugaguuccaguccugacuuccuuggugaugagcagcaguauggaaguguaagucgaaugaacccuuuccuccccaacuugcuucuuggucaugguguuuguuuaggaauagaaacccugaauaagacacuagguaaucuccuucuuaguggcagcaaggacaaagucuggaucagccugcuccaaggcugagggaggcuacagagcaugagagagugaccaagcaagaaagcaaagcaggaaguaguguuuguuaaauguuuuccccuucauuuucuagcuuuaguuucuagucugagcucccaguaugguggccugugaucugacagaaccauguaaaaacaaacauuuauuacccgaguugcuucugcucagaggaaaacaaucacaucagcagaguugcaauguagagcaacaacaauaacaacaacaauagcaauuguuucaaaagcuaauuuugcugcuggacagaaucuaugcccucuuuuaaaggaauauggaaaauaucagaaauugagaucccaaaagucauagaaagcuguacauggagcuuaaucaguuguucccauagggucuggaagauuggaguguugacaguaaugcagccacacgaaguugaggucauacucuuucaguggaaaauagccugaaaacuuuaggaagaggucauuugugugauauuuuggccaaaaaaaaaaaaucuuuuguacuuggcuuaugcccugagauauugaguauugaguaaaaauuauugccugauuuguauauuuuuauucuauugauaaguuuuuguucaaucuuccuauuucuuuauucaaauuacauucauaucgguacacccaucccauuccaccuuccacagucccucaucacugacucccuuuuaucuccccauggagggugggaaccacuugaguaucccucaacuauggcaugucaagucucuguaggguuaagucucugcaggguuagacacauccuuucccacugaggucagacaaggcagcccaguaagagaaacaguuugcacagacuggaacagcuuaagggauaugucccgcucuggauggugggggccuccgucccagccugcgugugcucuuugguugguggcuccaucucugagagucuccuagauuccagguuaguugacucugagggccuccuaauggcccuccuauucuuucagaggccaucaauucuuucgagaacucuuuuaaaauauucccugagcccuguccaauguuagguugugggucucugcauguuucagucagaugcuggauggagauucucaaaggacaaugauguuaagcuacuaucugcaaguauaacaaauuauucucaguaaugccagccuuggugcuugcccaugggauggguuaccaguuuggcaggguauaguuuggccauucccucagucucuguuucaucuuugugccugacuuacuugcagacauaacaaauuuugggaggaaagguauuugguuuucuugguguacugaaaacuucacugcugguucugccugacugcaagaugucaccucuucaugguccauaacucaaugcuauauaucucagcuaagaucaccucccuauccgcauuugugcccuccuauucauagucucaagcacauucgacagaugccuccacccuaacuccgcucccucccagcaucugcuaauuucauuucauuuuccuggcuuucuggcauucucuugucucuuaccacaccuguuccuaacacuccccuucuuucuugacuacagucccauccacuuuucucccuuuuaccugccucuucugucucuuuuauacccucuucugugugagauucaaccaugcucauuugugccuugucuuguuuacugucuuuaggucuaugaagugcaguguggguauccuguacuuaugguuauuauucacuuguaagugaguacauacaugcauguccuuuugggccugaguuaccgcauuccagauauuaguuucuaauuguacccauuucucuacaaaauucaugauguccuuguuuuuuauaucugaagaguaucccauuuuguaaaugaaacauuguuuuuuguguccacauuucaguugaggaacaucugccuucuuuccuguuucuaacuuuuauaaauaaaguggcuaugaacuuaguggagcaaaugcccugguguguauaugccuaugaagguacccuaaguguaguacuuccuccugcuuguacguuuuaaauuaaugggaggaguauucaacguguuuccucaucccaggauggaaccuuaaacaaaacuugcugcaaaugugguccaagggaggcaggguccauuaauuuagaagccaagcuucacagguucauccacauugugccgcuucuggaaacugaaagaugaaaauagcauggucauagauucuuucucuaugguuucaguuuagcaccacuccagccaucuuuuaacagagucaggaucccagggaauacucuguuugaguuccuugaauuuagguggugaaguugaugcuugaguugcauuuucugaccacagguuguggagaaaauuaacacauugagaaaucugccauggagagaugcuuacagggagaugaaguacccuaacugagagauguaugagagguuacaggaagagcaccaucuaugccuuuaggaauugaaguccaauguguuugagacaaagcuauaggauuugguguuugcccugcuguuugucuugccuuuguccaaucuucucucccugugugcacauuccuauugauuggaauggaaagggguauucagugccaguuuauguuggaaagauauaacuugcuguuugauuuugcaacuuugcuuucugauguggcugucaagauauugucuugagugucagcagagacuuuagacauuugaacaguucaggagccuuucuagauucaucuuggggaagaugaaaguguauauacacucaaaauuuuccuuuuucuuucuuucuuuccuuuuuuuuuuguuuauccuauaauuuagauauucauuaucacccugaucacugucccuacucuaggucccuguccucacagauucccuccucccaaucuccucuguuucuccuuugagugggguuggggcccccuaugugcuccauggguacauagauuuuuuaggauggcauaugcucaugacaucaauacugccugaggcuucagagucauuggauucuggguguugauguuuccccaaacucuuguguuuguuuugaaauuuuuaaauaaauaggaguguuuugcuuguaugcgugaauaugaauaucaugugugccucaucguuaguguuguuugaagguggacucagaacuccuguucauaaagccaugugucccgugaaugcuaguauugaccacuguuaucuggaagaccagcaagagcuuuccauggcugaguuaucauucucuccugccuuaugcugcuuuuuauguucuacacuuauauuaauaauauuuucaucuguccauugguccauuaaaugugccuugauugcuaguaaaguuuuacuaauguugcuguuuaaagcgguacacuuccuguuucugcuagauggguacagaagugcagggaauguauacuucuuuguaggaacuguaguaaacaacugaguucuuuucuaucauuuuugucuccaugguugauuuuuucaguggaguaagggucuuaauauguaaccuuugcuguccuggaauguguuacauagaacagacagggauccagcucaaugacguauaccugcccgugacucugggauuaaagacaugaacaaauacacccugcuuguccaugauuuuucuaguuagugauucgucauacaauuucuaggauguguccucaguacuguugaucuauuucacccuacaucucccucucaauuggaauuccucucgaaagucuuuacccuauuuauuuacaauguucauaagcaacacaggugaaccuucaacucaauuuccuuuaaaauguuaugguaguuagauuauaacuucuguguccagaagucaguggaggaagcaccacaauuacaugaauauauggucaaggaagcauacauuugcuucacagugaugucaguaccaugcuuugugauguacacauguaugugacauuuuaggaugcggugacuuaugaugaugugcaugugaacuucacuggggaagaguggaauuugcuggauccuucucagaagagucucuacaaagauaugaugcuggagaccuacuggaaccucacuguuauagguaugacugaauuuucuuuugcuuuucaaaauagugggaagacauuucucuugguuagugauucugcucuguuauuacaguugagaacaaggaagacugagcugaauaaauaguguccagugaugugaaaauucgcaguaccuuuaauuuugccuuauuuccaauacuguaucauucauuauuccgguauugucuuuuaggcuacacuugggaaaaccaucauauuaaaagacauugucaaaguucaagaagaaaugaaagguaauuuucacgugaaagcuuauggaauuaugccucuaaggaaauuuuacuaugauauggaagcucuaaaucaaagcaggaguguaaaauguuaauacuucaaguguaacuauaauuacaauauuuuuaauauuuauuaauuuauuguauauaaguacacuguagcuguccgcagauacuccagaagagggcaucaaauuuuguuacagauuguuaugagccaccaugugguugccggaauuugaacucaggaccuucagaagagcagucugugcucuuuaccacugagccaucacggcagcccuaauuauacuguucuuuaaaaaauguauugccuagauauaguuaucugauuuaucuaucaaagcauuccuuuuuaaaaaaaaaagacgaggaaacauugccuuaagggauaccuuuauucaauuuguaccucuacuagagcuauacugaucugacaauguguauagacuuauaagacuuagauauuacacauugaauagugauaaauauauauccaaaaccuuugaacaagcaaauaauccaugggaaaguuggugauacucauaucuuuauugugaaauugaucauuuguuuaggguacaguuuaugagagucaagaguguugucauaggagaaaccuuaauucauauauuacaggucuaugaggaacaaaaagucaaacagugugaaugcaguguggaaacuuuucaucuguuacucuucuauuaauauauauaucaugugucacaauugaugaaagccaugugagcauagggauauugaaacaagcaauguaccacuuucuaucccagaacugugagaaaauugucagauucugccuuugguagacauucugaauaugagaaaaguugcaaucaauugguuuucuaauuuuacugggaacuuccccaagcucacacuguagaaaaucuuuauggguacuaggaauuuggaaauucuuuuguuuguccugguucacauucaaaugugggacaauucacgcuacaggaaaauuuaugaaagcaauuaguguuauaaagcucuggguuguuccauuuuccucauauagaugaaauacaucauauaaauaucccguauaaaaggauguuaugaaugucagccauguaauaaccaucacagauaucucgaaagaugcaaaacaacccauaaugagggaaaaccccaugaacauauaaagugauaaaaccaguugaucugguacaucuuuaucaguagaccaauuuguaaacuuuauucaucuugaugaaaugauugaacagggaaauuaauguaguaaacauaucacaugugccaauuuucauugcagguauguaaguaaucauaguggaaaaaaacucuaugaauguaaugaacguucuaaagccuuuuucugucccagucaucuccaaaguaauauaagaagacaaauuggagagaaaacacaugaacauaaccaaugugguaaagccuuuccaacacccagucaucuucaauacuaugaaagaacccauacuggagagaaacccuaugaaugucaucaauguggucaagccuuuaaaaaaugcagucaucuccaaugucauaaaagaacacauacuggagagaaacccuaugaauguaaucaaugugguaaagccuuugcacaacucaguagucuccaucgucauaaa

SEQ ID NO: 6605 - RNA, 40893 nt, Mus musculus
ggaggcgucccggacagcggcuugguggcgcguaauucccaaugacugugcgcgcccgcgucugggcucguuugccaaggacucggaagcugcagcucccagagcacagcgggcagagcugcgggcugugcgcgccccugcugccccgggccuccagggguggcucccgcgccccgcggcgacuuccgcgcccgcgcuucccuuuguucaagucccggagcggcguugggguccgagcccgugcccugggcgacugaggcggccgcaguccgcgccccggcgcccuggcgaugccagaacagaucuccgugucggaauucauagccgagacccuugaggacuacaaggcgcccacggccuauagcuucaccacgcgcacggcccagugccgggacaccaugucggccaucgaggaggugagcgguagaguagcccgagccgggcgggagacuagggucgcggggaucgcgcugcgcccugggcacccgguacacuuccgcgccuggugccggauacccagugcccuccgccugcgcccacacccgggaaaaguuucugguaccccaaagccggacgcagccggaccagcagugcccgacacagaagcccuuuguucccugcucuagggagaggcugcuuggccaccuugggcauuuuuugggaacacuccugacuguuuccauuucccucgcaggguuucagguucuuugcucccauccucggagaggucaacuuaggccgcagagucuguggcggcuuggagccggggaccccugcgagcucugcggcccuggagugauggcucucccugcguggaccucuccaacuuguuccggaagaauccccgcaggggcagcuguggcuucugagccaacauguagagcagagccagggacccuaagcugcuuaggcacgggugcccaucccaucuugggaggccuggcaguucccacuacuugccacagagcagcgcuguagagggauguggagaauggucucuuugagguccaaaaggucuuugguggccgcuucugggcuaccuguguggugccuguugacaguaugaucagcuccugugcccuuaaccuggaacgggccugcauagucauuguauugaguggcuaagcagcgaguucuccagauccuggggaagagggacuucgagaaggaagcaauuuggguugaaaauugaagcaggcuuggaagaggcugagugaguccagagaccacggcuguccacagcuugggaaagccucacuuacaucauuuucuuuaccuccccaacagaauuuagaguuucguguuuucagcucuguaggcuuugugcguccagcaggacucacaaaagguagcuggagaacgagacacacauguguagcaguagugaaccgaugacuacauuuccuuuguucagaauuuuaacaucaagguacauauuuuaaaauacuugugucagaggcugguguucacagagcuuuuaaauuaagcuaugucauuacauccuuuccccuugcuugaacaaagcauucgcuauuaggcuucuucugggcaggggguggggugggggacuagacuauuguucuuucguguaaaauauuugucuuuguagaccuacacagucaggacuagacucaaugaaaaauacuagguucagcauccugcucuuggaagugagcuaggguauccauucuucuccuucacccuaguccccuuucuuuccucucuccugucuucccaaagaucugcuuguaaaucuuuuguagcaaauucagugauagcagauugcuuuagugugauuuccucuuuaggauuuacuuuuuauugauuuguaucugugugugacacucggagugcagaugcccucagagcuuaugcauccagaauuguaggcagcugugaauugcuugguugugggugcugguaaugaaacuuggaaccuccagaagagcaggaaguucucuuacaacaaaccauuucuccagucacugcaucacaguuuaaagacauuucagugcuuguuccuaggccuuggagaaaagugaggagaccagcaaaggaguagggguucauuuguugaccuguccagcagguccaguuauuugagggucuggaggggaccuccuccuaagaaccaagugggggguagagagagaaagggccuugugcgaauaacgacagggaaaccguucuggaaugcaucaaagucccaauguauugagaaaggcccaaggcuuaaaugcacaagcaaaaggggaauuacagacacuuaucagugggagggauagggcaauacaagcaaaaggagaaguacuuaugggagagugggcaauagaaauuuuuucuuuuggcagcuacucggggaagcaggaacuuggugguaucaggguguggucaggacauaggcgaugacuuagggcuggaacaugccguaguucucggaauccauguguugguggcccgcuuuugaccccuuuuucuucucggggggagaggcccaauucagagaucaagaguugucuuaauagcucccaacaucuccccuguauuaauauuuuuauaaaggcauauuguauaauaaauuuguagccacguuuuuaucgaucgccuaaacgucuguuugcucacugggugauucucuaaaaccacgaaggacacaaggacaagucaucuaugagucuugaauuaauggucccagccuguuggguauaacuugggcuagccaagggauuuaggaacgaagcaagcuccguggguagagguagaggucugauccccaguguuuaauguuaggggccauguacaggauugacucucaagcccacagaucuuuacucagaguaaccccgaccugcuccugugccguuuuuuuugggggggaaggacccuaggacacucaaccuucaugcaaucagacaugccucucagagacuaacagcuucuagucuaaucucugugcaguacuuagucuuacaacucucacgggcgacggcuucaagucccaauuuuuugaugugucuagccugggaugacuguuuaguuucuaauguggugagaauguauauuaccaugucggaagcacagacuacggcaaucuauaaaugauuuguggcaugagacugauggccgaauuuauggggugggaaugaucuuacuuaagcauuuuauggagauugagucuuucuccccgagacgagggugaugaagcagcaucuaagucugacucuuuucuaguaaccugcuuguuaucgccaacguccagccgaugguaaugaacugaaacaaaugcacuugaaagagaugaaucaauuugagauuuaacaaauugggucaauuucugaaauguccaaggaccgaaggaaaucaauaauaggaguccccauaggggcccuaaaagggagggcaacgaggucgaaagccagggggagguuaaaaaccaguuuuaguaguccaccuuuccccuaggccauuguaaguauggguguaacucagcuaucuauaguucuacguaucugguuccucuuuaggucuuaaacuuccuucuuccuagaugaugguaaauuccuguguaaggcagugaccuagcuuuuauucaaagugauaguguaaagccagagacaauuuugaaugucacugaauaggcaacuuucuuccugaauucuaagcccauggucagcucaaggacuuucuaggaugcuaucuuuugccuccaaauuuuuaucuauauaauauguugcucugacaaagcuauggaaauauuccuaugcuuaucauuaacaaaauggcaguauguagcugcugaucuaaagcugugguagauaccuuuuuaaaguuugcauuuucagauuauuaaaccaaggaugauuuucuaacucuaauagguagcaaaacauaagcaggucucuuacaaaaacauaacaguagauuucuuaucuaaauuaggaucuacacaauaaauugauugacaagaauuauaaugaauauaaagagacuugccaagauuggugaucuuaacucuuaaaauuaucuaacaauaagcauauagguaagguacacaaacuuucauagcuauaaggagcuggccugaauggccaaaaacagugucucugacgaaagcaucuuguacauucucuguaccagucuuuuugccucacgagucagcuuuuuuaguuguuuguauuuuaaguuggcaccagguugguacuccuugcugcagcccaugguggagauacgaaguuucuuuaucuguuuguaaguggcugcucuccgauuucuccucuuuugugcacucaacacagcuuucuggucaccacugucagggcacuuacaggucacauuggaagcuaguaugcucuuguagcauucuguggaacaaacagaaacauuccccccuuuccccauauuaaguaucugaacaggaucauggcaugugccaauaaguggauccuuuuuuuuuuuuuuuuuuuuuacauuuuuuucccauuuuuuauuagguauuuagcucauuuacauuuccaaugcuauaccaaaagucccccauacccacccacccccacuccccuacccacccacucccccuuuuuggcccuggcguuccccuguacugaggcauauaaaguuugcguguccaaugggccucucuuuccagugauggccgacuaggccaucuuuugauacauaugcaacuagagucaagagcuccaggguacugguuaguucauaauguuguuccaccuauaggguugcagaucccuuuagcuccuuggguacuuucucuagcuccuccauugggagcccugugauccauccauuagcugauugugagcauccacuucuguguuugcuaggccccggcauagucucacaagagacagcuacaucuggguccuuucgauaaaaucuugcuaguguaugcaauggugucagcguuuggauacugauuaugggguggaucccuggauauggcagucucuacaugguccauccuuucaucucagcuccaaacuuugucucuguaacuccuuccaugguuguuuuguucccacuucuaaggaggggcauaguguccacacuucagucuucauuuuucuugaguuucauguguuuaggaaauuguaucuuauaucuuggguauucuagguuuugggcuaauauccacuuaucagugaguacauauugugugaguuccuuugugaaugugauaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuuuugacuauuauaaauaaggcugcuaugaacauaguggagcauguguccuucuuaccaguuggggcaucuucuggauauaugcccaggagagguauugcuggauccucugguaguacuauguccaauuuucugaggaaucgccaaacugauuuccagagugguuguacaagccugcaauccaaccaacaauggaggaguguuccucuuucuccacauccaugccagcaucugcugucaccugaauuuuugaucuuagccauucugacuggugugagguggaaucuuaggguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuucuugaguucuuuauauauguuggaaauuaguccccuaucugauuuaggauagguaaagauccuuucccaaucuuuugguggucuaaaaagacggugucuuuugccuugcagaaacuuuggaguuucauuaggucccauuugucaauucuugaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaucaauuguugaaaaugcuguccaucuuccacuggaugguuuuagcucccuugucgaagaucaaguggauccuuuuuaucuguccuagacacuauuauauccaguuuuuccaaaaaugaagaugugauccaaauaaugugcacagggauauaauuucucacaaaaaugugauccaaauaaugugcauggggauauaauuucuccccuucuuuguuuuuaaagaagguauaauuuuuaaaguuuuagaauaccuugucuuugagaauuauaaaauaucucaguaacauguguaacauuaaauuguugacaaaacaucccaaaucuuuggcuguuauagccaguuuuaauuugauuuagaacaccaagcaagcaaaaaauaaaucaacacaggcaaugacuaacuauacuuuuaguugcuuuucuuguuaaaguaguuguaauuagaaagacuaaagagguaucacaucauaugugcuuauuuuaauuuuuuuaaaaucaaaaaugaguauccauuuguaauaauugauuaaguauaaguccccgagaauuagcaccaauguguggaacagguagaaacugaggacacugagagcaaaucuuuacaauauggcaugcacauuuauuuauuuauuuauuuuaaguacuaaauuauuauuuuaaguuacuaauuugaugauguaaagaaugagauuauauggccaauuauuuuuguauaagauccauaaucuaccugggauauaaaucuagcguggcauugccuuaagaggucuuuucuaggcaaucuuuaacauuuuaaaacaccaccuacagcacuuaauuuaauuaucugugcugaagcaggcagaaacucaaacgaauaaacaugugauccaauucacguauacuuuuuucucauagaaggguuguuuuuaauuacaguaaaugggaugcaugcaugcaugaauuuauaggagauacaaaagcaugcauauaaggauuuuuuaacuuauuuuuaggaugaguauccauuuuauuuaaaaugaugguauguaauaggucaaauaucaauauuuugcaguaaccaauugcuguuuggaacaaggaauucuuaauuagcaccacagcagcuuuauaauaggauguuaaaacuuugaggugaauaaggaugauuuuacauuaauguuuuuucuugccagagaauagcuguggacacauuuaauaacaauaacuagaauauguagcuaauauuugauuaccaccaauuauaaucgauaccaauagauuauagaaguuuccuauauuuucuguuaaauccuuuuugguucucaccaguuaauuugaaucucacuugauagcaccuaacaaaggcuuagguucucuugugguaaguuuaaggugaggucuuuagccaauuaacaucucuuggaagcuuuugaaaauaaaauuuugaagcaaauuuguaccacaauuuuuuaguauaauuaaaaacccuaaauauuaaaaauauugccucugaaucuuauggagcaacaacuauuuccuagaacuuuaaacuuuccuuuagaggcauuagcuaaaauauuuuuuacccaggaaacaauauacacugaaagauucaaagucuuagcuucuuguauugaagccuggacaaugacaauuuuuuacauauuguaaagcuauguuagccauaccuacaggcaaaauuaucuagugaucaccaguucauuaaaagcaaaacucuuugaauguaagcauuauuuuaaacaucugaauagauuugcagcaaagcuaaaaagaaauuuucuugaauacaggggaaacuuucuuaggcacuguuugcaaaauaaaagaagguuacaagcuuuucuggggcugccuuguauuaacucaaacguaaaauauuuuuuaaucugagcauuuuggccuuccuguaauaaggaccgauuuuagaggaacaauuuaacugucuguccacgccucugauuuuggacaaucuuucuuagaugacuuauaccuuaaacauuuucucuuauaaccuuuuaugguccuguaagaccgcaaccauagccaaacugauugugugagggucuaauuucugcacaaagaugaauauaucuaguuaacucugccuugcuuuguauggcugaauggccaaaaugagcugcauuagugcaucauaagaugauuacucuuguaauaaucuuaguuaacaauauaugggugaguuaaaaauccuaagcuuuuaaucaaauugcaaacuguagucaaugggacacuggcaauuuuaaccauaauuuuuaaguuucuguugcaauauuagaauauaucuauaacuuuuggaaagcaagaccuaauuuuaaacaauuuauuuucuuuaaaauuaauacuagaaacaucaguaucacuuuacgaaguuuggcugucaauucaugaaugcaugacagugcaaauuuuaauguuccauuaaggagacauuguuuuaaaaucuuaucucuauaagucuacuuuuuaggauaagaauuacauaaaauuuuaucucaauuuagaaguaucuuuagaggacuaguuuucugggcuggugcuuuuguuugaaaaugacucuagcccugaguuacuacuuaagcuacuuuguaaccaguguuauaacuuuuuaaucauacccaaauaacuuauaagccaauucucuaugaccaggauaugcagaucauauuuauaccuuuaagauuaaucaaaaaccagaugaaguggguacacuaaucuuauaaauuuagaucaaagaauuuuacuuuuuauagcuauacuuauaaaauaaaaacacacuuugucauuugcuaaacacaauaaucacaaaauugcagagaauuuuuuaggaaaaaacaacuaucagcuuauuugucuuagaacuaagagguuguagauucuaaguuuuucagcaggaccucuccugcugugcuugauuuuugcuaaagggaggggccucucagccucaguugugcaaacugagagugauucagcagguaaaguuuuaaccauuuauuuuuucuuuuuaacauaaaacauaaaacagucagucauucagacaacgaaacaaucauucagacgagacaaaaacauacaugaauugacacgugauuggugcaccaaacauagacaauagaaagaggguagugagcuuuuccuguaggggccagagagaauaaaacagggcgucccccgauuucucucugucccugggagaguucuaaaauccauuuuccuuuauuucuuccuuuccuuuccugcuuguaagagguagcuugucaaaccaagauuaaaaucuaaaauuuucuaacagcuucuggcaaguauccaaaacuucuaauuuauuuaaucugagggcaaauuuuugagaaaacacacaaucucuauacacuaaaugucucaaauagccuaaaaguuuaccaugcuaaagcuuuuuugaagccauuaucaguucacacuuagucaaauucugaggcauuaucucuuugugccuuauccaacaaggcuaaagcagaagcauuuaauauagaccacaauaaaucaguggaagagcgccccuccaccuuaguauaggcccaccgaggccucgguucaucuaggucugcgugcuuggccacgggcgggccugugauggcaaaguguucuugcucagacccgcugccuuaggccgcaggagccccgaaggcccagccuuggccuucacgccuagccgauggcugccucgagggcgagggcuccuggccuccgcaggguagggaccgaggccgaggcugugagggaacccgggcgaagaaggcccgcacuuucgagcucccugugcucuaugcugaaacccuacacaaucucccgugggggcuaagggguugucugcauuugcuauuaggggagacgggccucgcagggggucccucuagccguuucccuggaccgcaguuacuaggguguugucuuuguguagggcauucucuagcaaaauguccagguugguugcaucuauagcaaguuuuuucuccuauauuuaguuguagagcagucccaauggccagguuaauagacuuagaaacuuguugagaaaacacaucuaccucauuuuaaagcuugaucauaccauuuauaucuaaacucuugguuuuacuucucagggcagcccuaaauucugacuucuaaguuaaauauuggccucuagugaggacagacugaacaacguuauuucauucauuggcuaucaaguagccuuuuccugcuaaaccuucuaauauagauccaacuuuauuuuaaguuaaaggguguauuuuagaaccauucaauaccagccauggacaucucuuguccacaaaacaaaaauauuuuauuaaauuccccuuuuuuaaaacucuuaucccucucuccuuaagagaacccuuuaucucuuaacuaaauuccccaugguuaaugggacaacaacugaaugccuaggcuuaccuccugacgucuguacucgacacucgagcgaagugucgguggacugucccacuguuucucugucugcgugguaccucuuuaauccuuaauucguuguccggagggcagucguaccucgugccccacgucgggcgcuacuugacucguccagcagguccaguuauucgagggucucgaggggaccuccuccuaggaaccaagugggggguagagagagaagagggccuugugcgaauaacgacagggaaaccguucuggaaugcaucaaagucccaauguauugagaaaggcccaaggcuuaaaugcacaagcaaaaggggaauuacagacacuuaucagugggagggguagggcaauacaagcaaaaggagaaguacuuaugggagggugggcaauagaaauuuuuucuuuuggcagcuacucggggaagcaggaacuuggugguaucaggguguggucaggacaucggugaugacuuagggcuggaacauccugugguucucggaauccaugugucgguggcccgcuuuugacccuuuuucuucuggggggggagacucccaauucagagaucaagaguugucuuaauagcucccaacaauuugugucugcagugguggcaguguagaaauguccuuugaacuuggugucauucccucauacuugaagcaugggucuccugucaucuccaagguaaaaguggcacuguccagcaugccuuagugguagagaccaggucuacugugaagauuggcuggcuggaggacuuguauugaaagcaguccuauuuugcuuuuuuguuuuuugguuuuuuuuuuuuuguuuuugauuuuuuauaucuauuuauuuauuuauuuucaagacaggguuucucugcauagcccuguguguccuggaacucacuuagaccagacuggccucguucccagaaaaucugccugccucugccucccgagugcugggauuaaagacguguaccaccacgccuggcuauaaccaguauuuuuaugugcuuuaauucuauguuaagaaaaugugcuuuugccaguugguugccagccagacauauaaauaauaguauacagauugugcagacuguguuuauauuuuuagguaauauacauagauguauaaaauaacaaaugaaaagggagguaaugaauuugaaagagagcaagcagggauauauggguugguuuggaaaauagaaacgaugagauuauauuacacuuucaaaaauaaaaaaaaguaauuguaaaguaagaaagcauuaaaugggcuuauuuaagauuauuccuuuuugagauaggucauauaggcacaauggagucaugugaaucuggguuucagcaguugacaaaacaggaguucugaccacucugguugguucuucuauguccuuucacuauacagauguggguuuccuuagugcaaguacuaaguacuuauuucuucagaauucugguacauaguaaauaucagcuguaauauccugcaacaugagauaacccguccuugauuuuucuaaguucccuuggcugagagccuuucuauauuagacauuagagggacaaucuauuaaauuuccuuucuauauccauagagaaauucauucugaguugagauauguuuaccuagagaaccuguccuaauacaacuguggcuuuucucuacuuugccacugauggcgaugugcuggcuaccaagagggcucaacaguguuucccuuacguuccuggcuuuccucccaggguugcuugguaccuaucaucuggugaaagggagcuguagucucccugagcccagcacugagccacaaacagaacucuuguuuccuaaaaucccucuuuaauguucauugccugggcacccuuccacucagauuaauaaccucacugcaccuuggguaaugggcuaugcaugcucuuccgcuggauuucaggaagaagaaggcaagugggggcuaccuugccagcagagucucgcccaacacccgcaagggcccacacaggacuccccacgggauccaaagaccucuggugaguggaacacagcgccugccccaauccaaucgcgcggaaccugagacugcgguacauagggaagcaggcuacccgggccugaucuggggcacaagccccuuccgcuccacucaagccccgggcuaccuugccagcagagucgccugacacccgcaagggcccacacaggauuccacacgggauccuaagaccucuagugaguggaacacaacuucugccaggagucugguucgaacaccagauaucuggguaccugcccugcacgaagagagcuugccugcagagaauacucugcccacugaaacuaaggagagugcuacccuccaggucugcuuauagaggcuaacagagucaccugaagaacaagcucuuaacagugacaacuaaaauagcuagcuucagugacuaccagauggcgaaaggcaaacguaagaauccuacuaacagaaaucaagaccacucaccaucaucagaacgcagcacucccaccccaccuaguccugggcaucccaacacaaccgaaaaucuagacacagauuuaaaaacauuucucaugaugaugauagaggacaucaagaaggacuuucauaagucacuuaaagaauuacaggagagcacugcuaaagaguuacaggcccuuaaagaaaagcaggaaaacacagccaaacagguagaagucauuaaagaaaaacaggaaaacacauccaaacagguaauggaagugaacaaaaccauacuagaacuaaaaagggaaguagacacaauaaagaaaacccaaagcgaggcaacgcuggagauagaaacccuaggaaagagaucuggaaccauagaugcgagcaucagcaacagaauacaagaaauggaaaagagaaucucaggugcagaagauuccauagagaacaucgacacaacagucaaagaaaauacaaaaugcaaaaggauccuaacucaaaacauccagguaauccaggacacaaugagaagaccaaaccuacggauaauaggaauugaugaaaaugaagauuuucaacuuaaagggccagcuaauaucuucaacaaaauaauagaagaaaacuucccaaacauaaagaaagagaugcccaugaucauacaagaagccuacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaccaaauucacacaguaucuuuccacaaauccagcccuucaacggauaauaacagaaaagaagcaauacaaggacggaaaucacgcccuagaacaagcaagcaaguaaucccucaacaaaccaaaaagaagacagccacaagaacagaaugccaacuguaacaacaaaaauaaaaggaaguaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagagugaaaggcuggaaaacaauuuuccaagcaaauggacugaagaaacaagcuggaguagccauuuuaauaucggauaaaaucgacuuccaacccaaaguuaucaaaaaagacaaggagggacacuucauacucaucaaagguaaaauccuccaagaggaacucucaauucugaauaucuacgcaccaaaugcaagggcagccacauucauuaaagacacuuuaguaaagcucaaagcauacauugcaccucacacaauaauagugggagacuucaacacaccacuuucuucaauggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucacaaaacaggccucaacagauacaaaaauauugaaauugucccauguauccuaucagaccaccauggccuaagacugaucuucaauaacaacauaaauaauggaaagccaacauucacguggaaacugaauaacacucuucucaaugguacuuuggucaaggaaggaauaaagaaagaaauuaaagacuuuuuagaguuuaaugaaaaugaagccacaacguacccaaaccuaugggacacaaugaaagcauuucuaagagggaaacucauagcucugagugccuccaagaagaaacgggagagagcacauacuagcagcuugacaauacaucuaaaagcccuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacagucccauaucaccuaaagaaauaggagcaguuauuaauagucucccaacuaaaaaaagcccaggaccagacggguuuagugcagaguucuaucagaccuucaaagaagaucuaauuccaguucugcacaaacuauuucacaaaauagaaguagaagguacucuacccaacucauuuuaugaagccaccauuacucugauaccuaaaccacagaaagacccaaccaagauagagaacuucagaccaauuucucuuaugaauaucgaugcaaaaauccucaauaaaauucucgcuaaccgaauccaagaacacauuaaagcaaucauccauccugaccaaguagguuuuauuccagggaugcagggaugguuuaauauacgaaaauccaucaauguaacccauuauauaaacaaacucaaagacaaaaaccacaugaucaucuccuuagaugcagaaaaagcauuugauaagauccaacacccauucaugauaaaaguuuuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaagaaauuagggaaacaacacccuucucaauagucacaaauaauauaaaauaucuuggcgugacucuaacuaaggaagugaaagaucuguaugauaaaaacuucaaaucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuggaaggagcaauuugcaaauucgucuggaauaacaaaaaaccuaggauagcaaaaagucuucucaaggauaaaagaacuucugguggaaucaccaugccagaccuaaagcuuuacuacagagcaauugugauaaaaacugcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucguguagaagaauucgaaucaauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuuuagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagauucuggcguggauguggagaaagaggaacacuccuccauuguuggugggauugcaggcuuguacaaccacucuggaaaucagucuggcgguuccucagaaaauuggacauaguacuaccagaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagccccaaaccuaggauacccaagauauaaaauacaauuugcuaaacacaugaaacucaagaagaaugaagacugaaguguggacacuacgccccuccuuagaauugggaacaaaacacccauggaaggaguuucaaagacaaaguuuagagaugagaugaaaggauggaccauguagagacugccguauccaggcauccaccccauaaucaguauccaaacgcugacaccauugcauauacuagcaagauuuuaucgaaaggacccagauguagcugucucuugugagacuaugccggggccuagcaaacacagaaguggaugcucacaaucagcuaauggauggaucacagggcucccaauggaggagcuagagaaaguagccaaggagcuaaagggaucugcaacccuauagguggaacaacauuaugaacuaaccaguaccccggagcucuugacucuagcugcauauguaucaaaagauggccuagucggccaucacugcaaagagaggcccauuggacuugcaaacuuuauaugccccaguacaggggaacgccagggccaaaaagggggaguggguggguaggggaguggggguggguggguaugggggacuuuugguauagcauuggaaauguaaaugagcuaaauaccuaauaaaaauggaaaaaaaaaaagaaaaaaaaaaagaaggcaagugaugugaggcaagcucaggcaaggucugaagucagguccugguaaugcaggaucauugcucacagagaacaggagcaggcagcugacuagccugagcuggaauguguugggaacuaaaacggggcccuggguaagaaaggaaaggggagaagaccaacacccugccagaguuccaccuaugcucuggacagagaugugggagagcugccauacacuccccucucagccccaggugugcaucuaagccuuugacccacucuuugggucugaacaaggggcagcccagccugggagccccggggcugcuuuucuaaaggccugggguuaugggagagaggaaugagggaugagagguucccacaccggugagagugagcacaguggaucuugacuggagcacuugaaggccuuccauggguugauuagaaagggcucauuaggagaaagccuauccuuuccucgaagcgcagugggccuugaugagcagagacauucuaugguuuuagagcuuuauuauagaaagucagggagaaagagagaagguagaagagaaagagaggccccccuagaaggcuagaagggggaaggcuagauagaaagaaaguaagagggagagaggaggagaagagaggagaggacaaagagaaaggaaagaggagagaggagugagagaagugagagguaagagaacaaaggagagagaucaagagagauagguggggcugaacaguccuuuuuaugggcuuuacuguugcuagguaacuggggaggaguuuagccugaaggucagaagcuugggacauugccuacaugacuuuuaucgaagcuucucuuguucucuugugguggcugggguggggguuggggaagguaauuuaggcaggagcuugaguuccagaagcaugagguaauuaaugccuuccucaucaaguaagggaauuaucacccucccaguguucagaccuuagcucaaagggagaccaaccuguuuaugcuuagcccagugccccacaugaauguugaguucucccccagggcugggaggggugaguguccucuuggaggacaggcucaaaugcuaauguagugcaaaccacaccugagaucugaaaaagcucuggcccuggacaugaagcacacuuuaaccuugaggaagggugagacccacuggccaaucaaggaggcgggaucuucugggugccuuuccccaaguucacuguggcugugcaggcuugaaugguucucuguguccugcucugagcucugcuguugggugcugugagaggaccucagggaagcucugauuucgaggcauggugagcacagguuuacugcccacagaggguaggggcagggugcugagcaguggaagcugggguggugaguccucucuggggcuggaugggaaguauaagccauaugugagcaccugugaggucucuccuauugcuccucacuugcaccaucgggggugaccucugaauaacuucccuaucauugcccaaaucguuuggaccuuaggcuggcuugugaaaacaagggugguuucuuugagucuguagcacacguguccaaaccccuuugucuagggcuaggaagauguuccagggccuggaacagggguugugugccccuggucuuaauuucuggguaguuacagcagucuuggaacccugcuccauggcucccagcugccauuuucuccucuguacaagugguggaaucugcugcguagccuucacugcccccucguggcccucuauuauguguguggcacuuuaguauucccuuacugagagaggaagugagacuguuuccaucccaauugauauaguuacucaccuuccaacuuggguuaaguccuucuuaucaaaaggaccuguacccauuaaauugccccugacagagagcucuuuaugaccucauucagggcaaaaucagacucugcaaaacgguggaaaggacaaagacaucauuuuucccccuucuaaacaacccuguucucagucuauaugugacucuguauuuugaacuuggagcugucaguauaugggaaguuguuuuucaucccuuccagcaaaguuaacauaucuuccuuagaccagcagucuuauuuccgggucuguggggcaaucugcaccucuauucaccuuccagcuguuuggccaccucuuuggucucacugaacugggaauccaggguuaagaacaccuaaccacagggcagugcagccucucuucaccccauuucccuguaucuucccaugcucugaucaaggagcccuucccauuuuauccuggcucagacacuacuccaacucccugaugugguggcagggguccuguaauugauaugguuagaucguugguuuuggaauuuuacaacuuucucauuuauuauugucucugugacauaguuguuucaacucaacauaucagacuacagucaucugaaggagccucaguugcuggugugcccucaucagaauggcugguuucuaugucucugagauauaguguugauaauugauauaggaagacucuuccaugaaggguggcaauauugggaagcaaguggucuuggguuggaugagagagcuaggugagaauuguagcugccuguggccaugugaacuggguuccccagaaaggcagcccagggcugaaagagaucagagggcaacaagagaaugaggccaagacaauccuuuuuguucaaagccucugaaguuuacuaagagucccugcuuauaaagaggguaggcccauccucugccagcccauucuuugugccuggagccagcccauaggcgaucuacagggcuugucuccagauagucuccaggaucuuucagcaggaagcagaguauuggagaagagcaaauagagccaucaaggucagaaggcucuacccuagguguacuggcugguuuuaugugucaacuugacacagcuggaguuaucauagagaaagaagcuucaguugaggaaaugucuccaugagauccaacuguaaggcauuuucuccauuaaugaucaagggggaaaggccccuggugggugggaccaucucugggcugguagucuuggguucuauaagagagcaggcugagcaagccaggggaggcaagccaguaaguaacaucccuccuuggacucugcaucugcuccugcuuucugaccugcuugaguuccaguccugacuuccuuggugaugagcagcaguauggaaguguaagucgaaugaacccuuuccuccccaacuugcuucuuggucaugguguuuguuuaggaauagaaacccugaauaagacacuagguaaucuccuucuuaguggcagcaaggacaaagucuggaucagccugcuccaaggcugagggaggcuacagagcaugagagagugaccaagcaagaaagcaaagcaggaaguaguguuuguuaaauguuuuccccuucauuuucuagcuuuaguuucuagucugagcucccaguaugguggccugugaucugacagaaccauguaaaaacaaacauuuauuacccgaguugcuucugcucagaggaaaacaaucacaucagcagaguugcaauguagagcaacaacaauaacaacaacaauagcaauuguuucaaaagcuaauuuugcugcuggacagaaucuaugcccucuuuuaaaggaauauggaaaauaucagaaauugagaucccaaaagucauagaaagcuguacauggagcuuaaucaguuguucccauagggucuggaagauuggaguguugacaguaaugcagccacacgaaguugaggucauacucuuucaguggaaaauagccugaaaacuuuaggaagaggucauuugugugauauuuuggccaaaaaaaaaaaaucuuuuguacuuggcuuaugcccugagauauugaguauugaguaaaaauuauugccugauuuguauauuuuuauucuauugauaaguuuuuguucaaucuuccuauuucuuuauucaaauuacauucauaucgguacacccaucccauuccaccuuccacagucccucaucacugacucccuuuuaucuccccauggagggugggaaccacuugaguaucccucaacuauggcaugucaagucucuguaggguuaagucucugcaggguuagacacauccuuucccacugaggucagacaaggcagcccaguaagagaaacaguuugcacagacuggaacagcuuaagggauaugucccgcucuggauggugggggccuccgucccagccugcgugugcucuuugguugguggcuccaucucugagagucuccuagauuccagguuaguugacucugagggccuccuaauggcccuccuauucuuucagaggccaucaauucuuucgagaacucuuuuaaaauauucccugagcccuguccaauguuagguugugggucucugcauguuucagucagaugcuggauggagauucucaaaggacaaugauguuaagcuacuaucugcaaguauaacaaauuauucucaguaaugccagccuuggugcuugcccaugggauggguuaccaguuuggcaggguauaguuuggccauucccucagucucuguuucaucuuugugccugacuuacuugcagacauaacaaauuuugggaggaaagguauuugguuuucuugguguacugaaaacuucacugcugguucugccugacugcaagaugucaccucuucaugguccauaacucaaugcuauauaucucagcuaagaucaccucccuauccgcauuugugcccuccuauucauagucucaagcacauucgacagaugccuccacccuaacuccgcucccucccagcaucugcuaauuucauuucauuuuccuggcuuucuggcauucucuugucucuuaccacaccuguuccuaacacuccccuucuuucuugacuacagucccauccacuuuucucccuuuuaccugccucuucugucucuuuuauacccucuucugugugagauucaaccaugcucauuugugccuugucuuguuuacugucuuuaggucuaugaagugcaguguggguauccuguacuuaugguuauuauucacuuguaagugaguacauacaugcauguccuuuugggccugaguuaccgcauuccagauauuaguuucuaauuguacccauuucucuacaaaauucaugauguccuuguuuuuuauaucugaagaguaucccauuuuguaaaugaaacauuguuuuuuguguccacauuucaguugaggaacaucugccuucuuuccuguuucuaacuuuuauaaauaaaguggcuaugaacuuaguggagcaaaugcccugguguguauaugccuaugaagguacccuaaguguaguacuuccuccugcuuguacguuuuaaauuaaugggaggaguauucaacguguuuccucaucccaggauggaaccuuaaacaaaacuugcugcaaaugugguccaagggaggcaggguccauuaauuuagaagccaagcuucacagguucauccacauugugccgcuucuggaaacugaaagaugaaaauagcauggucauagauucuuucucuaugguuucaguuuagcaccacuccagccaucuuuuaacagagucaggaucccagggaauacucuguuugaguuccuugaauuuagguggugaaguugaugcuugaguugcauuuucugaccacagguuguggagaaaauuaacacauugagaaaucugccauggagagaugcuuacagggagaugaaguacccuaacugagagauguaugagagguuacaggaagagcaccaucuaugccuuuaggaauugaaguccaauguguuugagacaaagcuauaggauuugguguuugcccugcuguuugucuugccuuuguccaaucuucucucccugugugcacauuccuauugauuggaauggaaagggguauucagugccaguuuauguuggaaagauauaacuugcuguuugauuuugcaacuuugcuuucugauguggcugucaagauauugucuugagugucagcagagacuuuagacauuugaacaguucaggagccuuucuagauucaucuuggggaagaugaaaguguauauacacucaaaauuuuccuuuuucuuucuuucuuuccuuuuuuuuuuguuuauccuauaauuuagauauucauuaucacccugaucacugucccuacucuaggucccuguccucacagauucccuccucccaaucuccucuguuucuccuuugagugggguuggggcccccuaugugcuccauggguacauagauuuuuuaggauggcauaugcucaugacaucaauacugccugaggcuucagagucauuggauucuggguguugauguuuccccaaacucuuguguuuguuuugaaauuuuuaaauaaauaggaguguuuugcuuguaugcgugaauaugaauaucaugugugccucaucguuaguguuguuugaagguggacucagaacuccuguucauaaagccaugugucccgugaaugcuaguauugaccacuguuaucuggaagaccagcaagagcuuuccauggcugaguuaucauucucuccugccuuaugcugcuuuuuauguucuacacuuauauuaauaauauuuucaucuguccauugguccauuaaaugugccuugauugcuaguaaaguuuuacuaauguugcuguuuaaagcgguacacuuccuguuucugcuagauggguacagaagugcagggaauguauacuucuuuguaggaacuguaguaaacaacugaguucuuuucuaucauuuuugucuccaugguugauuuuuucaguggaguaagggucuuaauauguaaccuuugcuguccuggaauguguuacauagaacagacagggauccagcucaaugacguauaccugcccgugacucugggauuaaagacaugaacaaauacacccugcuuguccaugauuuuucuaguuagugauucgucauacaauuucuaggauguguccucaguacuguugaucuauuucacccuacaucucccucucaauuggaauuccucucgaaagucuuuacccuauuuauuuacaauguucauaagcaacacaggugaaccuucaacucaauuuccuuuaaaauguuaugguaguuagauuauaacuucuguguccagaagucaguggaggaagcaccacaauuacaugaauauauggucaaggaagcauacauuugcuucacagugaugucaguaccaugcuuugugauguacacauguaugugacauuuuaggaugcggugacuuaugaugaugugcaugugaacuucacuggggaagaguggaauuugcuggauccuucucagaagagucucuacaaagauaugaugcuggagaccuacuggaaccucacuguuauagguaugacugaauuuucuuuugcuuuucaaaauagugggaagacauuucucuugguuagugauucugcucuguuauuacaguugagaacaaggaagacugagcugaauaaauaguguccagugaugugaaaauucgcaguaccuuuaauuuugccuuauuuccaauacuguaucauucauuauuccgguauugucuuuuaggcuacacuugggaaaaccaucauauuaaaagacauugucaaaguucaagaagaaaugaaagguaauuuucacgugaaagcuuauggaauuaugccucuaaggaaauuuuacuaugauauggaagcucuaaaucaaagcaggaguguaaaauguuaauacuucaaguguaacuauaauuacaauauuuuuaauauuuauuaauuuauuguauauaaguacacuguagcuguccgcagauacuccagaagagggcaucaaauuuuguuacagauuguuaugagccaccaugugguugccggaauuugaacucaggaccuucagaagagcagucugugcucuuuaccacugagccaucacggcagcccuaauuauacuguucuuuaaaaaauguauugccuagauauaguuaucugauuuaucuaucaaagcauuccuuuuuaaaaaaaaaagacgaggaaacauugccuuaagggauaccuuuauucaauuuguaccucuacuagagcuauacugaucugacaauguguauagacuuauaagacuuagauauuacacauugaauagugauaaauauauauccaaaaccuuugaacaagcaaauaauccaugggaaaguuggugauacucauaucuuuauugugaaauugaucauuuguuuaggguacaguuuaugagagucaagaguguugucauaggagaaaccuuaauucauauauuacaggucuaugaggaacaaaaagucaaacagugugaaugcaguguggaaacuuuucaucuguuacucuucuauuaauauauauaucaugugucacaauugaugaaagccaugugagcauagggauauugaaacaagcaauguaccacuuucuaucccagaacugugagaaaauugucagauucugccuuugguagacauucugaauaugagaaaaguugcaaucaauugguuuucuaauuuuacugggaacuuccccaagcucacacuguagaaaaucuuuauggguacuaggaauuuggaaauucuuuuguuuguccugguucacauucaaaugugggacaauucacgcuacaggaaaauuuaugaaagcaauuaguguuauaaagcucuggguuguuccauuuuccucauauagaugaaauacaucauauaaauaucccguauaaaaggauguuaugaaugucagccauguaauaaccaucacagauaucucgaaagaugcaaaacaacccauaaugagggaaaaccccaugaacauauaaagugauaaaaccaguugaucugguacaucuuuaucaguagaccaauuuguaaacuuuauucaucuugaugaaaugauugaacagggaaauuaauguaguaaacauaucacaugugccaauuuucauugcagguauguaaguaaucauaguggaaaaaaacucuaugaauguaaugaacguucuaaagccuuuuucugucccagucaucuccaaaguaauauaagaagacaaauuggagagaaaacacaugaacauaaccaaugugguaaagccuuuccaacacccagucaucuucaauacuaugaaagaacccauacuggagagaaacccuaugaaugucaucaauguggucaagccuuuaaaaaaugcagucaucuccaaugucauaaaagaacacauacuggagagaaacccuaugaauguaaucaaugugguaaagccuuugcacaacucaguagucuccaucgucauaaaagaacacauacuggagagaaacccuaugaauguaaucaaugugguaaagccuuuacaagucaaaauggucuccaauaucauaaaagaacccauacuggagagaaacccuaugaaugucaucaauguggucaagccuuuaaaaaaugcagucaucuccaaugucauaaaagaacacauacuggagagaaacccuaugaauguaaucaaugugguaaagccuuugcacaacucaguagucuccaucgucauaaaagaacgcauacuggagagaaacccuaugaauguaaucaaugugguaaagccuuugcacaauacagauaucuccagugucauaaaagaacacauacuggagagaaacccuaugaauguaauaaaugugguaaagccuuuacaagucaaaauggucuccaauaucauaaaagaacacauacuggagagaaacccuaugaauguaaucaaugugguaaagccuuuucacaauacauuuaucuccaauaucauaaaagaacccauacuggagagaaaccuuauaaaugucaucaauguggucaagccuuuaaaaaaugcagucaucuccacugucauaaaagaacacauacuggagagaaacccuaagaauguaauugguaaagccuuugcacgucacagucaucuccaacaucagaaaacuaaacguacuggagagaagcccuaugaauguuaucaaugugguaaagccuuugcaggucacagucauuuccaauaucauaaaagaacacauacuuuccugauauagcugucucuugugaggcuauuccaauaccuggcaaacacagaaguggaugcucacagucaucuauuggauggaacacagggccaucauuggaggagcuagagaaaguccccaaggagcugaaggggucuacaucccuguagguagaacaacaauagaaacuaaccaguacccccagagcucaugucucuagcugcauauauagcagaagauggccuagucugccaucauugggaagagaggcccccuggucuugcaaauuuuuuaagccccaguacaggggaaugccagggcccagaagugggaauggguggguaggggagcaguguugggggaguguaugggggacuuucaggacagcuuuuuaaauguaaaugaagaaaauaucuaauaaaagauugaaauguaaaaaaaaaaaaaaaaaccauacuggagagaaacucuaugaauguaaucaaugugguaaagccuuugcaggucacaguugucuccaguaucauaaaagaacccauaaugucgagaaaccuuagaaauguaaucaauaugauaaagccuuuucucaaaguuauugucucuauaaucaaugugguaaagacuuuuuacuacuuuauagucuccauuauuuuuaaagaacacauagaaaacagaaaccuuaggaagguaaucgguguuguaaagcauuugaugucacggucaucuacgaugacauaaaagaucacauacaagugagaauccaugucaauguuaugaauguaguaaagccuuugcaugccauaguucuuuaggcauacacaagacaaaccacauugcagagaaaccccaauuuaaauguuugcuuuucugagaguugguuuggucaugagaucuguuccuagccauugaaaggcugagggagaaaccugagaauauuuaguaaaguguuugcacaauuuuguagucauguucaucauggaagaauuugaacuggguagaaacauugugaaucuauuuaguauggugaagcuuuuucauugagcuucuuuuuauguacauucuucuuuauauaagacuauucguauuggugacagaugcuaugaaugucagcagugugguaaagccuuuacauuguuggguccagucagguucaucacaacucacacuccacgacagugcaaaggauaagaauuuauugggcuggguggugguggugcacuccuauaauccuagcacucgggaggcggaugcaggcagauugcugaguucgaagcccgacuagucuagagugcauuccaggacagccagggcuacacagugaaacccuguuugggaaagcaaaaaaaggagaaaaaaaaaaagaauuuauuggaauuaagucacuacugaucagugagagacacaaaaguauacucagaaguuuaucuucaaaaccccaccgcccacaccaaaccugaaacagaaaguuguauagcuuucaaacacaaaaaucucaaaguccugggccaacuuacaacuacauuuucuccaaaaucaaaacuuauuuuuauugaaugagucaauaaauggugauugcgaacuccuuguauuuuguuguuguuguugcagcugcgggugguguuggugucgggcugugucugugcuuucccuucuuuuguagacaguaagagauuauuuacuaccucuguuuucauguguauccuuaacuuucucgguuagauucuaucucuaucucuuuguguuggucaguauauuuagagagagguuguuuaaauuugaguuuaucguggacuaucuuaauuuuuuccauucacgguguagucauuuuuuuacauauuaaaauccaggcaucuguuguuucuguggcacauguguggaaacccuucuggcgucuacagacuccaagcagaagacaucugugaucuuaauagaucuuccuuuauguuuuuccuggcuuuguaccuuugcagcuuuuaguauucuuuccuugaacuguguguuuugauuauuacacaaggaagagacuuuauuuuauagucccuucuguuugguguuuugaugauucuuguguuuucuuuauguuaggaaguuuuucuucuagaauucgguuuucaauacuuucugagacuuugagcgaggauucuccuuccucucuuccuaaguauucuuauguuuaguccuuuuacaguguccuggauuuccaugauauuuuauaucaggaagauuuagacuuaccguuuucauugucugauuuacccauuccuucuauugcuuauucuaugauugagauuuuuccuccaugucuguguucugugggugaaccuugccucuguaguuccuuuuugcaguccuaaauuuuuauuuccacuauuuccuaagauuuaguuuucuuuuuuguuuauauuuccacuuuuauguauugaauaguuuuguuuacuucacccuuugguguguucuuucuuggcuuuauuuauaggaauuuuggcuuccucuacuuuuugguuuguguuuuccuggccuucuuuguggaauuuaucaauuuccuccaauuuuuuucuguuuuccuggauuucucuaagugauuuggucauuuccucuuuaaggaacuaugucaucuccauacacuugggguuauaguguuuuucuuguaauuuagcuuuguugcaauauuuaagaccuucuuugacaauauaaaugagcucagagucauuagucagagagugauaaaugcugguccuuauuacauuaucaaguaccaaugucauggaauggaauggcgcuaucuaagcuaaguauucagcuuagauuuaaucagaugugugauuaauuccgaguuuuuucuuucuccuuauacuggacagguagccaagugaggcacuuuuugaaagaguuacuuuuugugagacaccuguuuuuaucaguauccuuggagucaucauuaaaaagaaagagcugauggugacagguugagcaacuuuauguuuuuuauguuuaauuuuccagcguguauuuauucauaucaggugaaugaagacagaccagauugauagauaugcaaacuggggacuuuagcuugacccaagcaacauugaauuucugauuuuggagauauguccaauguaccuucaggguuuagucagcucagauaauuaugacacaggccauuggcuguaguugugugucaugugacagaucacaguaacugauauugcacacaggagccaggucaaagaguauugaauuaaugccauuuuuuucugccggauaacacacacacacacacacacauauauauguauauguauguauauguauauauauauauauguauauauauauauauauauauauauauauauucaauuauguuucaauuuuuccuuuuuuaauuaauuuucuuauuuauuuaaguacauccuguuccugucccauuguggacagagagacaaggcaguccucugcuacacaugugccugggguaaugagccaccccuggaugcuccuugguuuuuggcugggaguucugacguguccagguuagcucacaguuuuguucuuccuaucugguugccauccucuucacccccugaagucaguacacugaccuguccuuaugugacauuucccccuacaacaauauaucaauauauagauauauauggaucuauauauuucuauaucuauucaucuccauaucuauauaucaccuauaaaucuauauaucuacauaucuauacaucuauauguauauaucuaucuauacaccuauguauacacuauacacuauacauauauauauacauauaucacuaaaucuauacauauaucaucuauauauucauauagauauaaaucuauauauaaaagucuaucuuuaaauuuauauauauauuaaucuaucuauccaucuauaagucugucuauauguguagucuccccucccccagccugaaaccugcuugcucaggggugaagcuucccacucaaucguucugccacgcccacugcuggaaccugccgcuuugcuguucagagccgugcacguggucacccugcuauuggaaccaaagauuaauuggcgggaaucgggccccuuccccugcuucauaacugcguaaggaacaguaaaauugagcuuugaucagaaugccugucuuagcugcauuuccuucucucuccgccuagccccucuucucuuccagguuuccaaaaugccuuucuagguuagaacccaggcugugaucugcuggccagacacaacauuuggcgaaccagugggggacugagaaauggcaaaggaauuuuggaagaggcacugcugguuuggagcuccauggaauaauuaaaggauaaaggaaauucauacaggagaagguaugggcuaagcugaaacagcguuaaacccgaacgcugguucacuuagguucagcagugaagcuuaagaggagcugggaacuauaacaggcggugcgcuguggcucuccgaagcuacauuuuuaggcgugagaaaagaaaggguuuauuaaaaggaaauuaauaaucagguggauugcaucaugagggaggaaauugucccaaaaagcagagaguaauuucaggagugccaugcuuuguucucucugggccuuauagcaaaagcaguacucaguucccuuuugugucuugucuaaugucuggugcaccaaucuguucucguguucaauucauguauguuuguguccagucuguaugaaugaauguucuauguuuuauguuggauaauaaagaugguauaaaaaacuuuaucuacaaagccgagagcugccaagugcuucagccaggaaucagacacauggcaggagggccccugcuggaaaaacuguuccguuuuaggagaaaagggcgaguguauagucucuuaguuucggaguaaaaaagcugauaaaugguuugugacuaauguguuugacaaaugguaaaguuccuuuuauucuaugauuguagcuacaaaaauuaauauucucugauuggucuaaauguaacugcuucauuugguucuuuuuuuauugauaaugugcucuguauguuuucacauucagcucauaaguuguugguaaagauuaauaauuguuacauugcuacagauguuuaguguuaaauuuaauaacucaaguuuagaguccuuccaacacguggcauaaggcaggccaagaggcugggucucuaaagauauuucuaguuuagauaauaauuaaugugguuccuauccuaaauaguaaaauuuaagauaagauuuaaagcaaugccucuuuauuaaagcguuaaaacuugcuuuaauagguauucauagguauuaauuggcauccaaacuucauaauaugauaguaaugcuucuaauauuaauuuuaaagaugauaaauuguuuuaaacuuggguuuugcuuucccaagguuuuagguauuauccuaaccuugcacaagaaacuuaaaaauuaugguuaaaacugccauuguuccauugacugcagcuugcaguuugauugcaaauuuaagauuuucuacucacccauauauuguuaauuaagauaauuauaagaguaaucaucuuuugaaagcgcuaauacagcucacuucauacaaaacugugacaaaguuaucuaguuauguuugucuuugugaauagauuagacccucaaacaaucaguuuggcuauagucgcugccuggcaggaaacugagguacgggcaauuuuuucacaacacugaaguuguaaagaacguuuuaacuguaagucgucuuaagauagaauaucaaaaguuagaggcauagacaguuauauuguuccuccagaaucaguccuauuacaggagggccaagaugcucagauuaaaaaauauuuuauguuugagucaaugcaggguucugggcagccccagagcagcuuguggccuuucuuuguuuugcaaacagugccugagaaaguuuuucccuguguucaagaaaauuucuuuuuaacaguguuacagaucuauucagauguuuaauaaugcuuaaauucaaagaguuuugcuucuagugaacuguaaucacuagaaaauuuugccucuagguauggcuaauauaacuuuacauuauauaagaaaauuuuuuauuguuucugcuucuauacaagaagccaagaguuuuaaucuuucaguguauauuguuuccuaaguggaaaguauuuuauuaacuaaugcuucucaaaggaagcuguuuuccugcuacucucugagccagcucccccacuggaggcuggagacuagccuuagcuuuacaauuugcaacugaauaaaguaccuagacuuccccaaaagaagaucuacuuuccuauuuucucauugucuagaucuuguguuuuucaagcagguuaaucaacauucuccagccagaccagcgggcaugcauccccgcccccaagaacacacagguggcaacugcuaucuucauuccaaggacauuccagcacguugcuuucagucugaauugaaauuuagguuuaccaagagggcuagaaaaguagaaauuucaaauauuaaaagagauugguuuuuauuuugauaaacaagcuuagucccuuagcuggccucugguuuuccacccuugcuguuacugcaagguccccuuaguuccucaggcugugggaauaacaggacugaggaggaugacuuccagcuccuauuucagccacaaaucaugguguuacuaaugacauaauucuugccuaggccuugcuaaaucugagguugacaauucuccuuuaggagcugcacaguacucagaacugugcauacugguuugugaucauacgaauacaguauugcuaccgcuugguacagaaaauuacugcaggaggagguccagcuugaccaguucugaguccccugugcguuauacccgguuuaaaggagguugguaucuaauuccagcuaaaauacaaaaauaucuaaggcucugccuccccuccccaaaagauaccaagagccacagguaugggucgugucaacacccacgagaggaaucgggucaaugucuacccaagccaagguuaauagcccacucaucuacggaugaaaaaauucauuugaucaccucaguuaagcguugccuuuuuaaacuuaauuaauaggggggagagaguuuggagaccguacuguuggaagggcaagcccuucacagccucccacccuaaaaaagccaauuggccuuguacuauggagccagucgucacccccuucucccuguuucccgccugucauccaaaaauguggaggaauaucaacucagaguuauucuuaauaaaguguauuuuuaauuuguucagucaaacuuagccaggguuccaacacccuacuuaaaauucaacuaggaaguuaccuauucagcacuaauuagcauuauaaagucagagccuacugcuuagggcuuuucuguuaguuguuuacuaggauagaaaggacaguccuauccagauacgguuuaccauaagaaaaguuagggaaucccauggagacagguuuuuucuuuagcccuaagaauucaggcagaacuauuaagcauagauaauuuuuuuuugccucaggccagccuuuuccuuuuuuauuuuuauuaacagcagggaggagauguagucuccccuuccugaaaccugcuugcucagggguggagcuucccacucaaucguucugccacgcccacugcuggaaccugccgcuuugcuguucagagcugugcacgugaucacccugcuauuagacccaaagauuaauuggugggaaucgagccccuuccccugcuucauaacugcgcuuugaucagaaugccugucuuagcugcauuucuuucucucuccgccuagccccucuucucuuccagguuuccaaaaugccuuuccagguuagaacccaggcugugaucugcuggccagacacaacauauauguuucacuugauguagccuugucuaaaaggacuguuauguucuaggucuuagauguucagccugagaggaaacaguaugaguaacaguuaaucuaauaccagauccucgacucuggacccauauuuuacgauaauuuuggggauuaugauuacaucauuccuaccuccugugaucaaucaguaaacacaucuaaugccugcagcuggcaagaagaaagguugauggcauuucaguucccaggcuuggugucuuuggaagagaccaugaaggagagggaagaagaagcaggaaaagggucccauggguggauggauugggagagcauggccaggagggcuagccugagaguaugagcagccugggcagaauauggcaagugagccgggcgugguggcacucgccuuuaaucccaacacuugagaagcagaggcaggcggauuucugaguucuaggccagcuuugucuacaaugugaguuccaggacagccagggcuauacagagaaacccugucucaaaaaaaaaaaaaaaaaaaaagaauauggcgagugauaucucaagguucuuacuaaagaaguagagaaauuagcauagaggaauguuauaugccccaugauggugcuuuaaugcuuauaauuauuauuagucauaauuauuauuucuuauuuuauuauuugauauuauuucacauuauuauuguuuaauauauuauuacaucauauuaauauuauuucuuauuuuauuauuucauauuauuuauuauuucauauuauuuauuauuacuaauucuuauuauuaguuuauuacucucuucuucgauuaucauuauuauuauuauuauuauuuaaugccucuauaauuuauguggugguaagaaauccacaaguaauauuuaccacaacaacuuggcuguaaaaacagcuugugcccaaugacugaaaugcaauugaaaguaaggugugauuuugcacacuuguaaccucagaacccaacagacaaaacagaaacauggccaacaguuacuuucuugcgauaagaaacaguuauuuucuucagaggaagaaaguucucugggaucucugcuaauaaggucucacacacacacacacauacacacacacacacacacacauacauacacacaaacaugcacacacacacauacuacauacauacauucacacauauacacacacacaccacacauaaacauacaugcaccacacauacaccaaacacacacauaaauaugcucccacaaaaacacccauacacauauaugccacuuacauacauucacacauacacaugcacacacaccacauacuuauauucacacacauauaccacacauacacauguacacacacaacguacagccacacacauaaacacaccacacauacccccacacaaacagucacauacauaccacauacauucauucacacauauacacauacaccagacauucacacacaugcacacacacauacaccacagcacaugcacacacauaacauauacagauauucacacgcauacauacaaacacaccacaaacacaccucccuuuuugauucugguucauuuugcuuaauaaugauuuccaguuccuucuguuucugugcaaguaucaugauuucacuuuucuucccgacugcaugaaaucaugucauguguacacccugugaucaauuugguuaacaagaaugaaugcauaaagcaggccugggcugaggaauuugcauugguguuccacauagccaagagugacaaggcaugucccagagucucuucucccucagugagccccuuggagcauggcucuugaccaagguuguggggaaggcaggaugaggaaaucaguagcugacauuguuuguauaccuacuugccuggugauuucugcugcaaccaccagguugugugucugaugaccuuccacagguuccaccaucugccugcacuuugaccccauggcugucaaaucagaacuccuggaagcuauugaaucuggggacuuugaaacacuuugagaaaauauggacaagguggagcacgggguauccgaggucagugaagcuggucuguauacauuguagaagacaugcaucugugaacccagaacaugcagcucaaagcaugaaugcuguguaggcuguagccugagugagggcaaugauguccaugcuacagaugccccauucugguggaggguguugaccagauggcccagggaaugucucugugccugucucucaauguuucuaugagucuaaaacugcccuaaaauaaagucaguuaaaaauacauaugggacccaaggagcuaaagggguuugccaccccauaggagaaacaauaugaaccaacaaguacccccagagcucccugggacuaaaccaccaacaaaaaagaaucccauggcuccagcugcauauguagcagacgauggccuagucagucaucaaugggaagaaaggccguuggucuugugauggugcuaugcccuaguauaggggaaugccugggccaggaaucaggaguguguggguuggggagcauaggaaggggggcgaguuauaggugauuuucaaaggagaaacaggaaaggggauguuugaaauguaaaauaaugaaaauaucuaauaaaauauacauauguggacuggugguguggcuccaugcuuaagaguucuuacuguucuuugagcagacucuaguucauuuccucccuuuuugagaggcucacaaucacugauaauuccagcucugggggaucggaugcccucuucuggccuccaugggcaccugcacuagcgugcauauucccaaccuaacgugcccauaucuguuagggaaguacauggcuuuucuaguccagaucuuggauuuuuggucugagucuaaauucagggguaguccuuuguaaagcacugaguauugagugccugcuuuguuuauagcuacugguuaggcacugaugcaagguaaugaaugaagugaugcccucuugacuucaugguguccagucaaccuggcugggugggaagagggcagacacccagucuccaccacuaucccuagucugcagagcaagggaaguccuagguccuccugcucuuuagaacagacucuggggcaaaccagugcuuuguucaguaagaacauugcaaguaugaucauugcugugaauggagagacugcaccauaaggggaaacagagacagugcuguagccuaggaagagaaguugugcucgggugacaggacuuuccugucccauucugacugccacuuagcucuugagucaauuacuagccucccugugagccccaucuuccaucucgaggaaauggagguaacacugggccucccuccuuggucuguccugaggaucucaggggacaaugacagcuuucagugagguacaagacuauuuaggaacagucccauaauacuguucacugagaagaggccuccaguccccauguugggaacagaaguaggaaagagauggccuucugagcuggcucuacaaggguggcuaaguuauauucaucaugcugacuguguguaucuuugaccagauuggugaugguagugugcugucugaguugggauauauuuuuacuccauguguacauuuucuuugugccauuuucugagccagcgaagcacgucugggcaguaugggcuuugaggaaaaggccugguucaggucacucccaauaaaauccagagcaggaccuugggugcucuuugagccuucccaagaccagccaggauacucuaucaagcauccuaaugaccagaaaagaaaaaggucuaggagccacacacagcugcaucuggauagcccaguuaccugaauccauagagcaauggccaugaccaucacccacauuggcuuugugacaauguuauuccagcugagggucaccaguaucucaccaggcuucuguuaaugggggaucauaggaauuaaacacacacacacacacacacacagaga

SEQ ID NO: 6606 - RNA, 2566 nt, Mus musculus
ggacaguggcuugguggcgcgcaguucccccugacugugcgcgcccgcgugugggcuccuuugcagaggacucgguagcugcagcucccggagcacagcggacagagcugcgggcugcgugcgccccugcugccaccgggccugccgcgguggcucccgcgccccgcggcgacuuccgcucccgcgcuucucuuuguucaaguccccgagcggcggcggggucggagcccgcgccuugggcgacugaggcggccgcaguccgcgccccggcgcccuggcgaugccggaccagaucucugugucggaauucguggccgagacccuugaggacuacaaggcgcccacugccucuagcuucacgcgcacggcccagugccggaacaccgcggcggccaucgaggaggugagugguagcuuagccggcgcccggcgggaggcuuagggucgcggggaucgcgcugcgcccugggcacccgcuaggcuuccgcgccuggugcccgauacccagugcccuccggcugcgcccacacccgggaaaaguuucugguaccccaaagccggacgcagccggaccagcagugcccgacacagaagcccuuuguucccugcucuagggagaggcugcuuggccaccuugggccuuuuuugggaacgcuccugucuguucccauuucccucgcaguuuuucagguucuuugcucccauccucagagaggucaacuucggcuguagagucuguggcggcuucgagccggggaccccugcgagcucugcuucccggagugauggcucucccugcguggaccucuccaacuuguuccggacuuagcccggcgggggcagcuguggcuucugagccaccauguagagcagauccagggaccccaagcugcuuaggcacgggugcccaucccaucuugggaggccuggcaguucccacuacuugccacagagcagagcuguagagggauguggagaauggucucuuugagguccaaaaggucuuugguggccgcuucugggcuaccuguguggugccuguugacagugugaucagcuccugugcccuuaaccuggaaagggccugcauagucauuguauugaguggcuaagcagaaagcucuccagauccuggggaagagggacugcgagaaggaagcaguuuggguugaaaauugaagcaggcuuggaagaggcugugugaguccagagaccacggcuguccacagcuuggggaagccucacuuacaucauuuucuuuaccuccccaacagaauuuagaguuucguguuuucggcucuguaggcauugugcguccagcuggacaaacaaaagguagcuggagaacgagacacacauguguaguaguagugaaccgaugacuacauuuccuuugcucagaauuuuaacaucaagguacauauauuaaaauacuugugucagaggcugguguucagagagcuuuuaaauuaagcuaugucauuacguccuuuccccuugcuugaacaaagcauucgcuauuaggcgggggaugggguuggggacuagacuauuguucuuucuuguaaaauauuugucuuuguagaccuacacagucaggacuagacucaaugaaaaauacuagguucagcauccugcucuuggaagugagcuccgguauccguucuucuccuucauccucgucuccuuucuuuccucucaccccucuucccaaagaucugcuuguaaaucuuuuguagugaguucagugagagcagauugcuuuaguccacuuuucucagccuggccuuuaggugccacugaugccuuuaaugaggcaggugggggaugagggggaugagagccccucccccuugagggcccuugaaaagcacuaggaagauagucacaguguuuugaaaauacaucauuaaugcuuaugaaaaugauuacauccaaaaagguaggauucccucuguggaaaggacacuugugugugauguccuuaaaagacagcccauguuuauaaaguuaggacgcuucuuucauuguauugaaucaguuagguaucaguaauacuggcagauguuggaaagccuggcaaauaggaguugcaauuaaaguaggcauggccucucucugauuaauuuuaguuuauaguggaugaacccaaagcugcuuuuccaugcagugcaggagauuacccaagagcucaguuacugaguagauuaaugagagacuggauuuggucauucuguuaaauugcaggcuggcuucacucagccuccaaagcagaaaauggauuugaguuggaaacagggaaaaccugaacucuuugcaggcuuaucucauuuuaagugaggccagcauccacucuaagcuaauaguguguaugaacugauuugaagggugaaaggacucaguguggauuacuuaaaauaaugcugucuuucuccuccuacaauauuuaauguuuacuuccaaaacaaaaaguuguucucuuucuaguguaauaacacaccauguuuacaauacuuagacuuuaagcaaaugucuuuuuauggucagaugagacauuaggguaggu

SEQ ID NO: 6607 - RNA, 1120 nt, Mus musculus
ggagagcugggaggagccauagguacugaaggaugcugagagagcugggaggagccauagguacugagggaugcugagagagcugggagagcugggagagcugggaggagccauagguacugagggaugcugagagagcugggagagcugggagagcugggaggagccauaaguacugagggaugcugagagagcugggagagcugggagagcugggaggagccauagguacugagggaugcugagagagcugagagagcugggagagcugggaggagccauagguacugagggaugcugagagagcugagagagcugggagagcugggaggagccauagguacugagggaugcugagagagcugggagagcugggagagcugggaagagccacaggcacugaacaacacuccucccugguuuccuagagacccuaagucuguucuuggugugcucaugucuucccccugagcaugggggccuggacucuggaagguagauucugcugucaagggaggcagcagggcuagugacaagcuuucuucugcccuauaaagaggaaguuucuguacccguaucugucugccacagacucuuccuuuaagcaaaaacccuucuguuuuuagaaacugaaaucccagaacuacagucccagcuaccuuguacggugccuagguccuggcccugcucccgauuuggaauuuuauugugaaaaagaagaaagaauccucccugggguggcaggcaucagcagaaagaucuaacuaccccccucuaccaucagagaauguucagaagccacagcugggcagcaggguccugagaggacaaacaccacuguacacaguugacacgugguucuggcugcauagugucugaccuagucugggacccucuggagaucugggagucacccagaucucacaaaaaacaaaauaaaacaaaacaaaacaaaaacccucccuacuccuuccauuagccuaauuauguugcugcuuccuuggaacaaagagcccguuggcugugaagucagaagaaggaggaaaaagaaaaaacaaagcaaaacaaaacacuuguccuucaugggaccagccagucugaagagcaugcucagaucuag

SEQ ID NO: 6608 - RNA, 1176 nt, Mus musculus
ggagagcugggaggagccauagguacugaaggaugcugagagagcugggaggagccauagguacugagggaugcugagagagcugggagagcugggagagcugggaggagccauagguacugagggaugcugagagagcugggagagcugggagagcugggaggagccauaaguacugagggaugcugagagagcugggagagcugggagagcugggaggagccauagguacugagggaugcugagagagcugagagagcugggagagcugggaggagccauagguacugagggaugcugagagagcugagagagcugggagagcugggaggagccauagguacugagggaugcugagagagcugggagagcugggagagcugggaggagccauaaguacugagggaugcugagagagcugggagagcugggagagcugggaagagccacaggcacugaacaacacuccucccugguuuccuagagacccuaagucuguucuuggugugcucaugucuucccccugagcaugggggccuggacucuggaagguagauucugcugucaagggaggcagcagggcuagugacaagcuuucuucugcccuauaaagaggaaguuucuguacccguaucugucugccacagacucuuccuuuaagcaaaaacccuucuguuuuuagaaacugaaaucccagaacuacagucccagcuaccuuguacggugccuagguccuggcccugcucccgauuuggaauuuuauugugaaaaagaagaaagaauccucccugggguggcaggcaucagcagaaagaucuaacuaccccccucuaccaucagagaauguucagaagccacagcugggcagcaggguccugagaggacaaacaccacuguacacaguugacacgugguucuggcugcauagugucugaccuagucugggacccucuggagaucugggagucacccagaucucacaaaaaacaaaauaaaacaaaacaaaacaaaaacccucccuacuccuuccauuagccuaauuauguugcugcuuccuuggaacaaagagcccguuggcugugaagucagaagaaggaggaaaaagaaaaaacaaagcaaaacaaaacacuuguccuucaugggaccagccagucugaagagcaugcucagaucuag

SEQ ID NO: 6609 - RNA, 2123 nt, Mus musculus
uaaaggagaggcaccgcagaggggcaggcccccgucgcgucgcgauccgggaugccgaagaacacggugucgucggcccgcuuccggaagguggacguggacgaauaugaggagaacaaguucguggacgaggaggacggcggcgauggccaggccgggcccgacgagggcgagguggacucgugccuaccgcaaggaaacaugacagcugcucugaaaucccccccaccccccacuauuaacacaaagagccaggcagugaaggacugugcuggcagcuacgucuugaaggugcuuaucucuuuuaaagcuaaugauauugaaaaggcaguucagucucuggacaagaacgguguggaccuccuaaugaaguguauuuauaaaggcucugagagcccaucugacaacagcagugcuguguugcugcaguggcaugaaaaggcacuugcugagggaggagugggguccaucguucgcguuuugacugcaaggaaaaccgugcaguccagcuggaacuggacaccacuggacaccguucacaggagugggaguugcugguacaaagaccaaaacaaccaaauggcaccgcugcccuguggguagcaucugucucucucagcuuugccuucuugcuuucguuuucauaucuguaaagaagaaaauuacaguuuccuuuaaugaaaauugaaauaaugcggagaaaauuuugucucaguggagguguuugauucuuucauaaucaugucaauaauauguaucccauucuguaauuuauauucaagcuugauugugcaguuucuaacucuguugacugguuuaaggguuuuacuuuauuuuuaaccaauacugagaaaugugaucaaaguugaggccaguuuccuaacucauugcuggucaggaagugaucuuuauuuuuaaaaaugagagacuggcagcuauuaacauugcaaaacuggaccacacuucccuuauuuaagcaaaauguguuuccagagcaaguagugggugagccccacuaccaguuuccagcuuucuuuccgcuugccuccagaugaugcuauaaguguaagugugcuacuuccuguuagcauccaauuuucauggccucucaaucucuuuguggugacccaggguccggagcaaggagucuuacucuauauaaauguauuuacacaauauaagcgccucuuuggcacaaacaucccauuuccuucugguaauaaggcugccuggggaaacagucccaagucagagacaggccuccagcagccucuggaugaaauacuuucaucagaaauaaaguagcugccuuagccauuacacagguguucacuggaacauuuccuaugauuucccgaggacgucuucagugcucuucagguaauggggaucucagaagauuugguucugauccaaagacacagucuguguuucagcucaguguuuuuuguuuuguuuucaagacaggguuucucuguauagcccuggcuguccuggaacucacucuguagaccaggcuggccuugaacuuagaaauucgccugccucugccucccaaagugcugggauuaaaggcgugcaccaccacgcccggcuagcucaguguuuuuuaagaaagaaaaaugccacauaguaaaagaaaaaaaguguuuacuucuuuggacaaaccaaacugauucucaaaaaaugacuggugcuuguaaaaaguuauuacaaaguaguuccgaaaccaaccaccugaaugugcguggccaagggguaaucagccugcuugucuuucccuaagaugccaacuccagagucacugacugaggugagaaccagcacagaaacucuauaaacugcuguuuuugauaccugcuuuuuuuuuuuuuuuuuuuuuuucuugguuuuucgagacaggguuucucugcauagcccuggauguucuggaacucacuuuguagaccaggcuggccucgaacucagaaaucugcuugccucugccucccaagugcugggauuaaaggugugcgccaccacgccuggcugauaccugauuuuuuuguuuuguuuuguuuuguuuuguaaaauuaugauaaacuucagaaaauaaaaugucaguguugaauaaaaaaaaaaag

SEQ ID NO: 6610 - RNA, 15983 nt, Mus musculus
auuuuuaaccuuuuuuaaaauaagcauuuuuaauauuuguguuaucaaaauagaaacagcuucauuuucauagcaaaagcaguccuuugggcuccaguaagauacaguugcuagcucugggagguuuugacccgacccucagccauucgguagacacuccauggcucugggcuccaacuguugcagucucucagccaaguacucaaagguacucuugucaagucacgaguucauggaaucauuugcaggugacagcaaaggaccgaggguguggggacggucucagugaccauucuuccuugguuccugagauacucuagguuguguucugaggauucauggacuggcagcuguucucaggagagggaagaugcugaugaaggccacugucuugguccggggaugcaacauaaaccgagaccuguuuugaccuuagcaaaaguugccauuguuucccuauucucuacccccuuuucugacacaaacccucaguuugucuagcugccaaacuaauagagcuugaaagaccucaaagaaccuccaggauucuccccaagagagaaacugagaggcccagagagggaagugguagcaagcuaauguaauaccgggaugccaaagaagucugugguucccagcccucuuucuuccugcuacauccaagcaggggaggcugcuacacuguggcuuggaggagcccccagcacacagaagggagaagccaagggacucaggcucugagucccuuguacacgcugaagcucuucaguccuugcagcuugccauuaccucgaagcugucagaaauacaaucucuggacccaucuagaccuacacacucaucaucugccugccauccggauacuuggaaacugacauacacggaggaaacugcaucacucuggagaaaccuuagugugaagacugagaacauaccuugguggaaacuucuagaagccuguggcacagaugccaagagggguugacccuuccccaccuggaaaaugaguaaguagaacaaacagcucagaauccaggggagccacacagccaggcuaccccucagaguaagaggggguacacacacacacauguguggccuggcaccuacucuuggucugccaggccauuggcaggacuccgacugugacucuuaaaagaucaguuugggaagauagcugcauuuagaagugguuccccucugacuagaucacagguagggcaagcuggugcccuuuacuguagcccaguucacagaccugcaaggccagugaugcccagggcugcuuguccagcucagcggcaguacucccgcucaaugcucgccaugagcuccucuucugaguagucauaggagauggccgacugccccucgggucucuuggggcuguuccccggggcucuguggaugagaaaugcagacagagguggauaucaccuucaaacucccauuucuccauccugacauccgaaccaaaacccucugcucuggagacaccugaacccuacucauagacaugaccaucuucacucauaucuaccgucauccucccauuuuauccaccaagaccuggaugagguugaagcaggacaagucagaugcccagggcuaucugagguuccuagcuaacccuccaagaacaacauccagggcucuguauacuucucccaaaacacagagugugagaccugggaaagcugcuugaccuuccaagaucugacugcugccaaugcauucgccuuuccuacuguaccugcagagcaaggcgggaggggggggggcggacauccaaaugcuuuggaggauggcagaucucagcuggcuuugaugcacaguaaccguaugucuggaguaguugugucucuugcugucuccaucaguaaguagaaaggacugcaucccaagacagcccagaggauugcuaagcugcugcuugugucuaauauggagaugaggacuuaggagggacugagcaggaguaacugcuugugagcugacugcagccuugcaagccuggaauaguggugguggcuacccuuccugaggguuccucuggagucucuacugaccgcugucagagagaaagggauacaagggccuaccauaacaucagaacaagccagggagcugugcaggaaguuggcuuuccugccagucuggagacccucaacagaaacaagcccuuccaggcuuaccccccccccagcccguggcacuaguagucgaggaggcugaaacaguggaggcugaagcagcuggcacccaaggggcugugacguggcuauaggccucucccaccaugcaugcugauauccccgcagguggauacccagaguuaagcacaauagauguuaaggacagcaugcagauguuggguucucccucuccaucauguggguucuggagacuaaauuauguugucagacuugguggcaagugccuuuaccuauggagccgucuuacugccucccccacuuuaucucuguaccgggcagugaaccuauggcauugcacauaccaggcaagcucccauuaggcuguguugccagccccugaggaguuuuaaaggcaaagagucuagggcccugggacucuacuuacaggguuugggguggguuuuguugguuuuguuuguuugcuugcuugcuuguuuuagacagugucucccuggguagcccuggcuagacuggaacuugcuauauacagaaggcgggccuggaacucuugccucugcuucuaccucuguguccuaagugcugggacuaaauacugagccaccagccuggcagcaccacaugugaaacuugaaggaguuuuaaguucauuuucuugaugacgguuuuggagcugcaaugauguccuuauagcaaaggacagucuuuuaaaaaaaaacaaaaaacaaaaaaaaaaaaccaaaaaacaaaaacaaacaaacaaacaaaaaaaaaaccaaguaagugaagaucuuaucaacacguuuacucugugucacuugaugacauuccuuuuauuuuuuuuuuauuauuggguauuuauuucauuuacauuuccaaugcuaucccaaaaguccccuacacccucccccacccacucccccacccaccuacucccaccucuuggcccuggcguuccccuguacugagaggcauauaaagucugcccgaccaaugggccccucuuucuacugauggccgaccaggccaucuucugauacauaugcagcuagagaaacgagcucuggggggguggggggggggguguacugguuaguucauauuguuguuccaccuauaggguugcagauccccccagcucccuggguacuuccuccagcuccuccauugggggcccugugauccauccaauagcugacugugagcauccacuucuguguuugcuaggccccagcauagucucacaugagacagcuauaucaggauccaaaggacagucuuuacagauaaacccacagaauacagcgggacacccaaguguaucugaacagaccugaauaguccagaguggccacagcgaacccagcgagggagggagggaggcggggagaggggagggagggagggagggagggagggagggagggagggagggagggagggagggagggagggagggagggagggagggaggggagggagggagcuaaugagcgagccaggaaacuaggaagcuaggucaggucaggaggaagcucagagcugcuguggguacuaggcucugaagccacacuucaugucccuugagggcacagcucuccauguugagagccucacuggccuguaguacaggggacuggaaggcucuaagcggcuaugagggaagcacuucaggcuccuccccauacuuacucagaggcacagcugucuucaggguugccuuuaaccuucuucucuggggacaccuugagcaggaagauaggaaaaggcaucaaaaacuugucaccaguauagaggaucaacacucuggcuuuauggaggagucaacagccaccguguuuaaaucagagucuguaaacaucaggauggagccucuucccuuggacucuggagccccaaauuacccauuuugcagucaagaaaacugaggcuguggaagagacuuauaaaacucaaaaaaugaacaaaaagaaagaaagagagagagagagagagagagagagagaaagagagagagagagagagaaagaaagaaagaaagaaagaaagaaagaaagaaagaaagaaagaaagaaagaaagaaagaaagaaagaaagaaagaaagaaagaaagaaagaaagaaacagcagcacugagauugggucucuugccucccagcugccaccacuuagggguucauucugucucucaccucgagacaucagugucccaaugugccuagcaugagaccauccuaucccuaccuccagggaucauaucacccagccucaagagcccuauaccuucccuucagcaaguaugcacugaguucauguuuacccugggcaugaaagaaagaugaaauuucacgaccuguaagucauauaaaguacucagaaauugcugguuguuugugagccuagaggcugccuggggcugagaacaaagaaaaagaaacccggguaugccccguaguuaaaacauucuugggaacaucuuguccauuaagauaaagaggaaugugaggacauaacugggcuaucugaacugagucaacaacucgcagaacucugacacccugcacguacauguaauuuuucugcugauguuugaauaagccaauagugugucgcuaugcugaauuccacaccccuaagccccuuaccccauaaaaaccccuaguuuucgagccucguggccgacauccauuaucuccugugugggaugcaugucgguccagagcucccuuauuaaacgaccucauguaauuacaucaaggccuuuucgugauucuuugggugcacgccgaauugggaauugaguggggguuuccccccuagguucuaucaggcacacaccuguaaucccagcaugugggaugcugggguggagagaugguucagugguuaagagcacugacuguucuuccagaggucccgagacacaugguggcucacaaccaucuguaaugggaucugauacucacuucuggugugucugaagacauauacaguguacucauacacaauauauacuuauauauguauauacauauauuacauauauaauauauauauguguguguaugcauauauauauuuaaacaacugaaacaacuacaauuuuuaaaaaagaacugugagcaauauguacguugcuuauagguaaccuggccuaaagcauuuuguuauagcggcuugaagcaacagugaugcaaagauaaugguuuaaaacaacaacaucgagcuggauuccuuaggagaccaaauuaagauggcuuaaauuacaucuuaaaauuuucauuuccuguaguuaauucugcauguauuacucuuagaaguaaacacaaguuaaaacaaccugacgggaauuccccaaguggcuuguuuuccaaaguccugagaacaaaacccuaaguuuccuaggucuuguaacucagcaaggcuugugaauggaaauaacagugcccagucacauucugcuuuaaaagauaaauacagaggagauaaaaagagaaaaaaaaacaacaacaacaucaacaaaaccuaaaaaccuaucugacaaaaggcucagguaaagacuggucaccuagagucaagaaggagguaggugagacggcagcaggcugcucugcuccguggcagccuggagaccagagucagagugcuccagggaugugggagagcgagugcuccagggauguggggaagcaguuucgaauuuguaauucuauucuagaauccaucaaaauagacaaacaaacaaaaaauucaaacguucaguuuaucaaccauuaccuucuggggaaaguguauguguguguguacaugugcacauguaggguguaugcauauaugacacaugugcacauccauuuauaggacaggucuauaccucuaucacugacuacuuuucuguugguuugguuugguuuuuagccagacucucucacuauacccagagcucaaauacuggcuaacuggcuggccagagugugcuccagggacccugucucaauccccagaacagucaagguuauaaaugcaaaccaccagauccagauuucacgugggugccgggaucugaacucaagcccucauauuugcauacagacacucuacccacugacccuucuccccagccuccugggaagauuucuaagguuuuuuugguuuguuuuguuuuuuaaaucuagauagagguugguggagacauugcucaguaguugugauggcuauccuugguugucaaccugacuacaucagaaggaacuacaauccagaaauaaaggguacaccugugagauuguucuacuugguuuaaagugugcgaauccacuucuaguccagacccuccagguaggaagacaugcugccuuugaaccagaacuugaggcaagaagacaagccuuguuguuguuguuuggauuuuguuuguuuguuuuuguuuuuguuuuuuacagacaggcuucuuuguguaaguguagcuguccuagaauuagcuauguagaccagggaaaauauacauuuaaucugggccacaccuuuugcuggaagccuauauaagaacauggaaaaacaacaacaacaaaaaaauuagaaacguuuuuuucuuugcuuucuugcuagcaaguccauuccuucauuggcacuagagccuacuucuuuggaauucuagugucuacugaagaccaguugagacaucuagccuuguagacugagaaacuucuagauucuucaacuuuccauucguagcccaccauuguuggauuaguuggaucauagacuuuaagugacucuaauagaucucucuucuauacauauagaaaaaaagauucguucuauaugcucugcuucucuagagaacccuaauacugcaguauagauuaagaguguucauguaggcuagagggagagcucagcaguuaagagcucuuccaaagguccugaguucaauucccagcaaccacaugguggccuucagccaucugagaugggauccaauacccucucuggugucuagggacagcgacaguguacucauauacauggagugaaugaaucuuaaaaaaaaagaaggcaaaagaguguuugcugcuucuacagaguaccuggguuugguuaccacacuccuguaucagcuuggaacucccuguaacuccagcccuaggggauucaaugccuucuggcuucuacaggcuucugcuugccugugcugcauacaaauacacacacacacacacacacacacacacacacacacacacauuaguaaauaauacuuucuaucugagaguaaggucacacaccaguaauccuagcacucaggaagccuaggcaggggaaucaggaguucaagaccauucucagcugcaaaaggaauuuggggccaaccugggcuacauaagacucugucucaaauaccagagaaaacaaaacacccagaaaaacaaaacacuuugccugugguaaaaauacacauugccuacauuuuuuucugguucaguuacuuccaagcguguccucccgggucccuuaagcacguucagacuguuacaagccaacgggccacacggcucuucauccugcugaacuaaaaguucacuaaacacuaacucgccacggccucucccagcccuugguaaccaccaugguugguguuucccaucuuugaauuugccuggucugaggaccauggauuuguccuuuggugacaggcacacugucuuuaagacucauccaucuauggagcaacgucugacagaacaucuaaagaaugaaagccauccugucccauggaugucccuguguggcuucuccagguaccugcagauagacacgguguugcuuccagccuuguuugagcuguggugguaaugcuuuugugaauaugcugugaaccaaucucuuuggacaaccuuuuccauccuuccggguguacaugaaguuucuuucucacauucacaccaaucugccucccuacagcuuucagcuguaaguuucagcugcccguccugcugcagcugguuugauuuuuuaugaaggccucuuacuuggacaccuaucucuuccauucagcuuccguuggcgccagcuucgcugccaucuucuuggcugcuucuccucuccuuaggacuguaagguuuguuaugguuucugaccaggcaggugacaagauccaagauggaagccagcaucaaccccgggaccugcuugcugauaacaggguuacuacucucccuggaggcagccaggaugacagaacuguauugccaugugaacugugcucuuagcauagggaucagaagagccacguuauggcucuuucccugauggcuccaccuuguuccaucuguccaguucucaccucuguuucucuuugggcccauguuucuccgaccaauuuguuuaagccuugaacuugacugccagaggugggaaauccauuagcuccguccuggaacacucagccuugccaaagccaaggaagagcuugagggaaaggcagagacagagaugucgagccuccugcuccagcccacuggaggccugcuaccugcugcccacacuucacaucuggaccaacagaguguaagcuagggccacaggcacugugcugagcucaggguguacaugugcuugugagugugccccgugggguaggagaaggcauagcuccccucaccaucccaggaaggcuuuagacaaacggagcacagccaugcaaagagacagagaacccgaggagcaggaaggguggcaucucuucaggucucccuggacucuuucaacuaagugugugugugugcauauaugcuuguaagugugcacuuguguauauauuuuuuaaguaugcaucuguguacacacagaugugcgccuauauguaaaguuucaaaggcuuuuucuuuuagaaauauacugccuacuuuacuuaccaaaauagaucccgugucuucuauggacuguuccccccuaaguugaucagcuuuguguguacagguguguucgugugcacaaauguaguauauguacaacguauauagggugguuaagaagcacagcuucauacagucuucauaaacauguguagcuaugcauccacacccacuaaaccauggacauagcagcucacagccuccuccccccacauacacacaaugcucucaucccuguucccuucuucacugccccucccccaggaagcuccuaaucuacucugccacugcggacacgucuccagaggaauggaagcuucaguauggacuccuuaccaccuggcuucuuccucuuagcacagugacggagagguccacccgcacugucugauguacucccgugugcuuguauguuaucuucucuaugaauuaucuuugaaucccaaguugguugguugguugguugguugguuugauugauuuuuaacuuuaaaaaaaauuuaguuaauuaauuuauuucuuaaaucucugcaaacuugaaaacaucacagacagaaaauuauuaagggaccuccaguaccuaaccuaccagagggcaguuuucaggauucuugccagucagacuccacucuucaccaccagagggcacuguucucccagcacaguggucagugccgguggccuuguguuccuuguggcuucaccuucaugaccaccaccagaccccgguagcaagcgagucacaugagccuccaucccugaccuuaacagagcugggaaccccacguagggagcagggcccaucugugccuuccaccccuaggaacugcaccucuagcuuuuaaaaaucuuacuccugguagccuacggaugcuagagucucccaggauccugccccuaaggucagaagggaacaucugccuuucuauuuucuuuucauuuuaaaauugguucuauucagaauugaccuuuuugagacaaagucccauuauauagcccuggcuggcuuggagcucccuaugucaaccaagcuagccucaaacucaugaaaaucuaccugcugcugccuccuaagugcugggauuacaagccagcaccauugcagccuggcuuagaaagaaaauggaagugguuuuccacuuccagguuucugguggaaugcgccauucuuuuauuaagggcugggcccugcagugcccccuuugccaucugucacaaugagacuuccuuuggcugggcuuucuccacuccuugacaucuccucaguguugucucuccuguuccuuccucagagccuccuugucacagcauggacuccccggcauugugugaguucucagagucagccaugugcuuuguucuucuugauaugccaugggaaccccucuucaugcuauuuacagguguggucuuugcucuagccuugucugcaggcgauugguacugucuggaagcucuuuguuuuguuugcgcucugaguccagcauccuuaagucccucuggugacuuugcagcugugagcuccuuucuguugcuucuuccuuucagguuccacagcagugccagccacaauaacccuaaaaucccguucgccugguggcaacagaaagacuccccccccccagucccucuugguacagcaaauaugaaacuuugcaaaaguggugaacaagacaucauucagccccagaaggcuacacaggcuugugacaaauccuacacacacacacacacacacacacgcacgcacgcacgcacgcacgcacgcacgcacgcacgcacgcacacacacacaugcacacacacacacacgcgcgcgcacacauacacgcacacaugcgcacacacauaugcacacacgcacacacaugcacgcaugcacacacaugcacaugcacacacacacgcacaugcacacacaugcacacacacacaugcacacacaugcacaugcacacacacacgcacaugcacacacaugcacacacacacgcacgcacgcacgcacgcacgcacacacacacaugcgcacacacacacaugcgcacacaugcacacacacacacacacacaugcacacacaugcacacacacacacacaugcacacacaugcacacacacacacacaugcacacacaugcacacacacacacacacacaugcacacacacacacacaugcacacacaugcacaugcacacacacacgcacacgcgcacacaugcacacacacacacaguggaagcaaugcucuaguuccccuaggucacuacugauugggauuuacaaggcagaggagaaaaguaacauuacuacccagcacuaaaaacacugaauagaaagaugacuccuucucuaaaagcacccaccaacaucaccagugcagccuacucugggacugagauaguccagucucacacacacacacacacacacacacacacacacacacacacacacacacacacacacacacacaccgccaccaccauggcacuguaacaagcauuuauaaacgugagagagcacuuccgcucccugcccucacccuccacggaugaaucgauauuguacagcucauuuuacccaggaagaggccaacugauggacaggggcuccacugugcccuucaggauugcuaaaugacucuuaggaacaccaacuccaaucgcagguuuuacucagcuuucccccucugcagaaucugaaguuucaaauaccccaacuaauagcauucauguucaaguucuagugacucuggggaaggauuccugccuugagcgcuucauguggccaugagauuaaaaauuaauccggaacaguagcaggagaggggguugggcccauggcuuaagggccagggguuugauagacuaucucacauuccuuaaaauauguaagaauauccuacagggaaaaucuguuuaugagauguuucuguagaacaauucaaagcagaaucacacauacauacauacaaauacacauaaaaaaaauaaaagaguuagaaagauuaucccuaccuuuaauuuuuuuuccuauaacucucauuuuggcaaaacuaaaacaucagacaaauccaaccucaaaaauugucuaaaugggagcuggagagacagcuuaucaguuaagagugcuggcugcucuuccaaagguccugaguucaauucccagcaaucacgugguggcucacaaccaucuguaaugagaucuaaugcccucuucuggagugucugaagacagcuacagugcacucauauacauaaaauaaauaaauaaaucguuuuucuuuuucuuuuuuuaaauugacuaaauacgcugggcagugguggcacacgccuuuaaucccagcacuugggaggcagaggcaggcggauuucugaguucaaggccagccugaucuacagagugaguuccaggacagccagggcuacacagagaaacccugucucaagugacaagaaaaaguuggggagcaccuccuccuaagggcuagaggguugugaauauaagggaaaauuuuuucauuuuuccuucccaauaaaagaauaggaaacguguguucaugcccaaucagagaagccguuuugcacagggacaaguucucucaaacguucugaagcaaggccauuuucuguggaugacuguugaacuugcaagucuuuccuaucucgguuguaaguuacuaauacagaguccugagggacucaguuacagacgcgggcaagcuacccacuagcauggaagcuuggacuccaggcuccagcaugggcaguguuuuuaaaagcaggggccucucuuucugauuuugucucucuuaggaccugagcacucucuuaggucucugggacucauuuguuaguuugagaaacauucacgguaagggcucccccccucaaaaaaaggggggguaaccacuguuccgacaucacacuuucuguuuuucuugagagaggauuuuuccguguagcccuggcuguccuggaacuuacucaguagaccaggcuggccucagacuuacagagcucuaccugccucugcuuccugcaugucugggauuaaagguaugagccaccacccacugaccacacuuuauuucuugaaccuaccuccucaugccucucucuccgcuaucccuugggucaaggacuuggucaguuggacauccagaguaacccugcugcaucauggugccccuaacuuucuucugucugauccacccuucuccugccauugaguaaucuccuccacaacacaaaaaucucacccucuuuagccuucaaaugcccacuucauuuucaacaaagucuauaccccugacauagcaagacauaguugaagaccuuuucaccccauaccccagcucaccuaacuguacccaccaucaugggcacacagaaccuccucuccaccucugcucauguccucugacuuuuucagacucaaguucaucugauguucaucuuggagcaugucugucacucccuccuggggacuccucaggcugagacuucucacuucccccuggaucccagaccagagcucuggacaccugucuuugucccugauaccuaaugcaagccccacuuauuagggaauguagcuguggcugggacuuccugucucuguuauauucuuccaggcugauacuccgaaagacagagggaaaauccaucuauuuccgaaccuuuggaaguuucccaagugcuugaaaaugacgcugaaaaauuguuuccucgcuaugucaaaaucucccccagaucccucaacuguuuauccaguguugguguuacauaacuguaggcugauguagucuuagaggaaucccauuauauaauucaguccucaccacagcucacuuguccuguuauaaacuucgacugggcaauggaaagaagggacuggacagagagaguucuauacccagggcuucccaucaucccaguggccuuuccaugaugcuugccugguaccugggcccaagaaggcauuccaacuaccucugccggccuguagaaaacucuggcuccucugucuuuggccuccucuuccagccaggagcagcuaagacccguucugauuuuuagcagcaaaccagugccaacccagcaaagauauguuuuucuagaacagcgggggguguuauuacaaguguucagcaagagagaauaaggaagcuaaaagacucaaagcaucuuaaaaauagcuuguacuaugggaauugccuggccagccaaagauccggauguguccgacgcugcagggcguuuuuccaaccacuguuuggcaggugguccacccacuuaucgccuccucccagcguauucccugauggccaaagcagaggcccuugcuggucaauucccaccugggcuguaaggaugcugcaacucgacuccgugcagccccacugguaaaggaaugcaagcccugagucagaagaaaguucuagguguuucugccaacuguuguuugcauuugucuccuuuaacagagacaguagcgggcacccacccaggaggcagaguuagaauaugcaagaguggggauaaggaagggacacaaaacccuauaagggacuggggcggggguggggggccacucugggugagcuggggacagaggcgccaaguagggacggaggccugggugggaggauacuagggaugcagagggauggguggagggccuggcccccauacucaccgcgggugcgagccgggcggggccucguggggucagcuccuggggcccccaggccuccgacucggccagcaacugauccagcaggcguagggucuccucccggccaccggagggcgucgcgggucgggggucgcggccgcucuccuccugccccgcggccguccgggccuggucagccgugccgcccuccgaggcugucucucccgggccugucugacgccugucagggcugcgucgccgccucgggauccggccgcuccggcugcugccgcugcccauggcgcgcacccagccuggagcgcgcagccugggagccgggcgggacuggggcgggagcgcggcgggccagauggggcgagggaacagcaagggggauucuggaggagugagcggcggagggugcgauggagagauagggagggaggagagucacgggggaugggagcuaugagaaacggggguagcaggaggagucacggggggcgcggggauggaagagacagagaagcaaggaugaucugggaggcuggaggaaguagaggcugcuaggggagagggggcgcuccucagggggagaaugggaggauggggaaagacuuggaggagaugaagaacgggguggggcagggggagcgccgugagacagggagaaaauggggaaggugauccugggggggaaggagaguaagcgggaugaagagagggugggagugacucccugggagacucucagggugcggcgggggugugggaaguuugggguaggguggcacugcagggaggugcaacaggguuaguauuguauggaagggagccuuaaagggugcagaguggauagacugguggaagggaagucagggcgaaagaaucaucuuggagaaguuugggggaggcccauggagcacgggugggagucaugcugggagcaaggggagcaaggcaccggcugaaaagagcuggggggugaaagacagaagaaugcuugaagcagagccggaugccagggaaggggaagaucaggagucgggguuggagacuagcacugucggaaaggaggucguuggggcuucagguacaggucugagagagcagagacaaggugagaggaggagggagacagaaaaggagagccggagaugugugugugagugugagagagagagaauguccaagggaggggagagc

SEQ ID NO: 6611 - RNA, 1413 nt, Mus musculus
agaggugauuuaaaauauuuaucgauauggcccaguuagcuuagcauggaagaaguccuggguuuuguccccagcaucaauaaauugugcagcgguggaugccgccugcuuuaacuuugagcugccacaugguguucagagauuuuuuacagcaucuacagugagagaacuuaggacacaagcagaggggagccuccccucguccucuuuuaaaauauuugaccugggagagucaguggagccuucccagguuccacguuuuuccccgggaucucagugucccaucucagcgcuuuaucucugguaucuuggaccccguagggcaaaucagaaagauggaaacuugaguucuugucuccacccucaccacaggaauuugcagauucgucuuuagacuacuggacgcccagagucguaaaaugaauguaugacucgucaccauccugugagcuuccuggaauuuguaaucgucuggcagcuuuuaaacuaauugggacagaggggacaggggucugacaggaggggcaggguagaaaaggaacccaaggcugcauccguaccccuucaugaguuugaagacagcuuuuuagggaacccuaguuugaggacccccuuaaucccacaaggccggugcgauugcucgggaccccgaaucucuuuaagaaaccagggucccccgcaccccucuacuugggacaugaagacagucaaggcgacgugucccagaggccagcagcgucacuccacccuuggcaccaaccucagcggcaacgcccgcccggcgacccccugcgcgcucaauccccaaggcucucgcaauccuaaccgguuccggccccgcgagcgcccgcgcacccggccggcgcaggcuccuuaaaggucuuugugcggaaggccugcggcgcaacucaaaucucccgcgcugggcggcgagcggggucagcggcguccaaugggaggcgaggccacgcccccucggagcgcgcgguuggguggcucuuuaaagggcgcgggcgcuggcagucggcggugcaccggauuccagcuguuuucgccugcuccucgccgucuccgccgcugcccucguucgccaugcucuccguccgcaccccgcucgccaccaucgcugaccagcagcagcugcaguugucgccgcugaagcgacucacccuggcugacaaggagaacacggugagggcggcccaggugccggcuggguuggaugugcacuggcaggucguggguucccggacccgggaggguggagggugccuaccgccauucaccacgcgugucccccuacagcccccgacucucagcagcacccgcguccuggccagcaaagcugcgaggagaaucuuccaggacuccgccgagcuggugaguggcccguguggggcugaggugggucgc

SEQ ID NO: 6612 - RNA, 1413 nt, Mus musculus
gcgacccaccucagccccacacgggccacucaccagcucggcggaguccuggaagauucuccucgcagcuuugcuggccaggacgcgggugcugcugagagucgggggcuguagggggacacgcguggugaauggcgguaggcacccuccacccucccggguccgggaacccacgaccugccagugcacauccaacccagccggcaccugggccgcccucaccguguucuccuugucagccagggugagucgcuucagcggcgacaacugcagcugcugcuggucagcgaugguggcgagcggggugcggacggagagcauggcgaacgagggcagcggcggagacggcgaggagcaggcgaaaacagcuggaauccggugcaccgccgacugccagcgcccgcgcccuuuaaagagccacccaaccgcgcgcuccgagggggcguggccucgccucccauuggacgccgcugaccccgcucgccgcccagcgcgggagauuugaguugcgccgcaggccuuccgcacaaagaccuuuaaggagccugcgccggccgggugcgcgggcgcucgcggggccggaaccgguuaggauugcgagagccuuggggauugagcgcgcagggggucgccgggcgggcguugccgcugagguuggugccaaggguggagugacgcugcuggccucugggacacgucgccuugacugucuucaugucccaaguagaggggugcgggggacccugguuucuuaaagagauucggggucccgagcaaucgcaccggccuugugggauuaaggggguccucaaacuaggguucccuaaaaagcugucuucaaacucaugaagggguacggaugcagccuuggguuccuuuucuacccugccccuccugucagaccccuguccccucugucccaauuaguuuaaaagcugccagacgauuacaaauuccaggaagcucacaggauggugacgagucauacauucauuuuacgacucugggcguccaguagucuaaagacgaaucugcaaauuccuguggugaggguggagacaagaacucaaguuuccaucuuucugauuugcccuacgggguccaagauaccagagauaaagcgcugagaugggacacugagaucccggggaaaaacguggaaccugggaaggcuccacugacucucccaggucaaauauuuuaaaagaggacgaggggaggcuccccucugcuuguguccuaaguucucucacuguagaugcuguaaaaaaucucugaacaccauguggcagcucaaaguuaaagcaggcggcauccaccgcugcacaauuuauugaugcuggggacaaaacccaggacuucuuccaugcuaagcuaacugggccauaucgauaaauauuuuaaaucaccucu

SEQ ID NO: 6613 - RNA, 5908 nt, Mus musculus
cugacauuaagguuuuaguuaaaucauuuaauacuuguaugccaugaaaguucaagacuguuaauucaagaguuuauuaauuuuaaguaacaauaauuuaaaagguacaaaggcuuuucauauuacaaaaacaucuauacaauaaucaaggaaacugaucaggguuaugucaguucaugaggaagcuagaucacaguaaacuaccucagggaacacuugcuuuuccuguuuugguuuguaagagucccacggguguacccaccacugggcucaaacucacuugugaauuccguacagccagggcuauacagagaaacucugucucgaagaaaaaaaaaaagugacacuauuagggcaaaugucagaauuuacuguaccaucauagcauuugcaaacuucaagauaauacugagcauuaaaaaaaaaaaaaaaaagcauagagguacuaccucauaaaauguauaguuuaaucgccugacagcacuaugugugugugugugcaaagugccaauuuuauuuacaaacuuguuaaguagacccugcaugccugcaggaagcaguccgacaucuuuaaacagcccuaaacagcaucuaaauguuuaaaccugcuugcuugauggucacugcuccuaaaaccuggcccagugcuguuaguacuuugaugaggucaaaggugaccacacuacuuguaaaagccaaggacaggaucucccuaaggauccaaguacccauuguuugaaguauacuuucuucuagugaccagccuggcaaacaggacugagguagcuacacagcuuuuuagacaccuguuuagcaaauuuaaugacaauucaugguguagccaguugguuguuuuugcugguuucuuuuaauggcaaggggacaaaaaucagcgaagaacacacgaucaguuacuuagaagucagcauccaagguaaaagaguucucugucgaauucgacaugacucccauccucugauacucgccuacucgcuucucaaagaaguuugucuuuccuucuagugagauauuuuccaugaagucaaacggauuuucuacucugaaaaucugaaaaagucacaccaauauauaaaugcugaaaacaagugaaagaaagaagaaagagacaagacgacagacagcagaggguggaggccauaaauaacacuuuaccuuguuaaaacccagcuccagcauaagccugucggccacaaacucaauguacugcuucaucaaagugcaguucaucccgaugagcuucacgggcaaggccuccgugaggaacuccuagagggcaagcaaaggggcgcugagcaccccgaagcccgaggacacccccgccccgcagcaaggacaaggacaaccugcacgcagucacucaccugcucuauccuaacggcguuggugauuaucucucggacccucugcucugcuggcuuguguaccaggugcuugaacaucaggcaggcaaagucacaguguaaacccuagaagagagagucguucaaggucaccguggggcucuacuguucacaagcaugacuuauccacccuccucagucuccugugacuuaucuggccacacagagagcacuuaaccuauccagagaaagguauuuaagcccggguguggugguaacacaccugcaaucuuagcauucuggagccagagacaagaucaccaugaauuugaggccaguucggcccacauuguuccaagccagccacaaaauccaacaaugcaggugagggaaauaaaccauguauuucacggccaauuaugaaagcgaggaauaggcuagcccaacucaaggcugccugacaccuauuauuacacagggccggggcccuucccuucugauacccagagguuucuucacagccacaggcucuacuaagaacuuucaguuuguacacucgagucuacgggauaacaggaauauauguacuaggaagucagugguuuaauaaguuacuuaagguaucuuauccuuugcugaggauuguauggauuccuacauuaaauauggauacagggcuaggaauguggcggaauacuugccuagcaaguaugaaagccuaggcuggauccccaagacuuggaauggcucaacaguuacaagggacauuugcugcuuuugcagaggacccagguucaggucccagcaccuacauuacagcucaaaaccacccggucccgaggucauccuccuccccuuuguccuuugcaggcaaagguucacacauuacaaucccuuuugaaaguggccacaccucacuucucagguccccaucaguagauguguaucuaagagccccagguuagaaagcuacuucagacucaccucgucucugcuaauaagcucauuggaaaauguaaggcccggcaucagcccccguuucuugagccagaauaucgaugcaaaagaaccggaaaagaagauuccuucuacggcggcaaaggccacaacgcguucuccuagcaagagucaacacgaaaacguucccggugaggccucgguauucucagcacaggccaauaauccagugacauuacuuggacaaucaagccugggcuugaggaggaaaaaggaaaggguccucaccauacguagccucuuuguccccaauccagcgcaaggcccagucagccuucuucuucacacaaggcauuguuucaauagcauugaagagauauucucugcaggcagaaaguauagcaugaauggauacugcagagcccuggcaacacaacaggcacagcguaggccugauucauuacuuccacgucugcuucccauccuggcacucacugccaccauaacccuaccaguccuucccagucucccuccauaacacaaacgccuucuuaauuuuucuauaauguccuagcagagcaaugucagcuaaacuggucuaaaauaaaccuuuugacucaauauugucuaaagcaauuccccucaccuccacuuugguuucauacucauucauagccacgucuuuaaauuuaauuguuuuugguuuuuuuugguuuugguuuugagacagggucucucuguguagcccuggcuguccuggaacucacucuguagaccaggcuggccucaaacucagaaaucugccugccucugccucccaagugcugggguuaaaggugugcgccaccaccgcccggcuuuaaacuuaacuuuuaauguauguuuugccuuaacgugucagacaccuuaugugugaugcccauggaggccagaagagggcaccacuucccugugacuggacuuacagccuugugaggugucccgugggagcuaagaacuaaaacugguaagcaguaaaccauacuuugcaggagccacagugccuucuaaaccucaguggucaucucuccagccccugggguugguuuuguuuuugacacaguaugcagucugacuagccuuugacuucuugacaaugcugcugcacugaucucugggagcuggaaauagacacaagcuaccacacacaaaagcuggaggcagucuugacuaagggucauagaaacaucuacugacaguccgcuugucauucugcucauuuccccuuuaugagcaaaaauacuggaaauaaagcagugagugagucccaggcaccuuggcagaguguguggauacucaccuuuccuugggaucuuuaauguaagugucaauaaggagacuguacauuucagaguguauguuuuccauggcaauuuggaagccauagaaacagcgggccucuguaacuugaacuucuuggcuaaaucgcuccaccuagugguaguaaaaugagccaaaguuaaauuugaagaacuacugguugcuucacuuucuccacacuaccaguagaguggcccggccugcugggauuguuccuaggccugcagcaacagugaagggggaaucugaguaagaggccauuuugguguacuuacugaauucuauucuaggccagccaggauuacugugagaccuugcuucaaaaauguaaguaaaacaaaacaaaaaacccagguauauauuuaauacaguuuaauccuauauuuuuauuaguucuucaugauuugcaagcaagcucauuauuucacgucauacgcucaauuuaccaauuaggaaacacauaacuccuaguuugccauuuauuuuaacaaaacuaucaugugcuccuaaccucuguggcacacaccaggccccacaggguuucuuuuaacacuguuauucccuaauucuguuucaguucauuccaaggacccacuuagaguuaagaaguauacaaccaaagucuuauagaaauccacaaaaaguuaagcauguagguacaaagagaaaaacucacuacugcuccuuagcagagggaaagacuaacaugaugaacguuaacauaacauucauagcucuuaaaaaguuuguuuugcuugugcuugccugggaauggguccgugcauguauaggcaagugcccaaggucagaguugccuuggugagaggagcucaccagcagaugggaagcaguccaacagggguaacucauaacagaaccugggucuuccgcccaagcaggaaguguguuaaccagagcggagacuggagucagucaucuaucccuccagccccgcuucagggcaaaagauagagagccaggaaccaguucuggaucuaagugaauuauggguauuucaugccaacucaccaaguucucauugacuaugccaucacucgcugcaaagaaagccagaacgugagauauaaaaugucucucaucggguuucagagcuucccagugcugaauauccuuggaaagguccaccugaaguuuagaaguucacgauuagcaggucuguaggucucucucucuuucucucucucauacacacacacuuuaaaacugaagucccccaaaccaucucauuaccgaauucuucacauccauuauucccuuuguuucagggaacacccaauaucucagugagcuaccauucccaagggcaaaaaguugugacggccaugcgggagccuucugacacacagcaaguccugaacgauuaccuccucggcaguccaaaaggaggccucggcuuucuuguacaucugccagauaucaugguacucgaugggaaagacaacgaagcggcggggguuuucucucaguaacggcucauccucaacgcugggguuaguaggcgcuuuacuuuccuguuggaugagagagagugccaagugaaccaacccccaaaugccaaccgaaccgcaggaaacugcuagccagugucucaucagaucgaguacuuucaacgauugguaaucucgugugcuuagcugucacgcugcacucuacuauuaccauaggccgacccgaguaggacauucugaggagacacuuuggcgggaaagaagagucaaauaauucagcugggacaaugcagauuuagcgccaacgagcgggcgcccucuacugggagccuaagcgacccaccucagccccacacgggccacucaccagcucggcggaguccuggaagauucuccucgcagcuuugcuggccaggacgcgggugcugcugagagucgggggcuguagggggacacgcguggugaauggcgguaggcacccuccacccucccggguccgggaacccacgaccugccagugcacauccaacccagccggcaccugggccgcccucaccguguucuccuugucagccagggugagucgcuucagcggcgacaacugcagcugcugcuggucagcgaugguggcgagcggggugcggacggagagcauggcgaacgagggcagcggcggagacggcgaggagcaggcgaaaacagcuggaauccggugcaccgccgacugccagcgcccgcgcccuuuaaagagccacccaaccg

SEQ ID NO: 6614 - RNA, 1072 nt, Mus musculus
uaaacgugaagacaaccuagggaaaaaaaauguauacaaauccccacaaagcaaacauggacgcguucuauucgggggcuugcgggcaucuugcaaggcguuuaaaagccugcacaggacaaugggggcaguggguucggcaauuuagcacagaagaaaacaacuucuccucccuggaaagcaaagcaaccaagaagguaaggcucaggggcaccggcugcgggacucacuaagugaugggugugacaacaaggaaagcggccugggccuggagucagugcccacgggagaacgccgcaccggagcgccugccuuccgcgcuuggcugcaccgaccucgcccgacgcccggacgccccgcacccagccuccgaucccggcccccucccccucuccggugccaccgacagacucgucucccuuuccccuccccccucccccagccucggacacugucgcucugccucacccgaccucuccgccuccgcacugaccgugucacggccuggccgaagacggcgcccucagcucugcagaacagcgccgcagaccuugucagaggacaagacgccaagagcacacagcuaugcccgcaccacgcccggcggccaucuuccuaggagucaggaacugacaggucacguggucguguggugggcggugcuccuuguggccacgccuccuggagggggcagugugggaggaguugcaggugcugaaguggcuuggacgcccuucccucuauuuuaaaggaauggaaacauugcuucuuugccugguuuggcuucagaugguuuggguuggguuagguuggguuggguuggguugguuuugauacagagucaaagucgcccaagcaggcuucaaacuugcuauguagccaagaaugaccuuuacgcucccgauccuccugccuccaccucccagcugacccagcuaaauuaguguauuuuucacaggugccccaggcaauauuuuucccugucauucgcgcuuuugaaaguuaauuuauaacccguaccuggcauuauaagcaauaauucagagaaauaaacaacaauuacaacuuugga

SEQ ID NO: 6615 - RNA, 88230 nt, Mus musculus
caguuccugacuccuaggaagauggccgccgggcguggugcgggcauagcugugugcucuuggcgucuuguccucugacaaggucugcggcgcuguucugcagagcugagggcgccgucuucggccaggccgugacacggucagugcggaggcggagaggucgggugaggcagagcgacaguguccgaggcugggggaggggggaggggaaagggagacgagucugucgguggcaccggagagggggagggggccgggaucggaggcugggugcggggcguccgggcgucgggcgaggucggugcagccaagcgcggaaggcaggcgcuccggugcggcguucucccgugggcacugacuccaggcccaggccgcuuuccuuguugucacacccaucacuuagugagucccgcagccggugccccugagccuuaccuucuugguugcuuugcuuuccagggaggagaaguuguuuucuucugugcuaaauugccgaacccacugcccccauuguccugugcaggcuuuuaaacgccuugcaagaugcccgcaagcccccgaauagaacgcguccauguuugcuuuguggggauuuguauacauuuuuuuucccuagguugucuucacguuuaaaccauuuuagaccauuuucucauuaauaacuguuuguggagcucucugcccccuagaggugcuugcuaaaaaugcaccgguuuugcuuuucagagcuucccauuucuuggugugggguguggcugaggaaaaaccucuuggaggugauucugauggguuagucccccgcucucuuuuugacgcuacgaaaaaacaaagcgucuacaguaaaaggaaaagacacauaaucuauuuuuaagggcaguugggugucugguucagagccaagacuggaaaugcuguggcaaggugcguucuuuguucucaagcuuuacaacgacagucagucaacuugaucagaccgacuuggggguccuuguuaaaaauuuguuucugagcuucaccacaggccugcaaaaaugggacuauuugggucaggagacaaauaauugcacaccaguuugagaauccuuuuaaacacucugagaaugguuuccagauuuaucuuuggcaucucguuuccauaaauucuuuucucuuuuucauuuuuuucuaccuucccuccuucccucccucccucccucccucccucccuccuuuuucuccuccuccuucaucccccucuucuccuuuuuuuccucucccucccuggucuucuuaauauguagcccuggucugcuuggaacugauagagaucagccugcuucugccucccaggccccugugccacuacaucauucucuaguuaucagcucuuuaaggguauccccacagccccaaucaauucuaagguggcugguuggaaggggcacacauauguaacgaaaugccugcugccuucuuuccuagacuuucccauuuccucccaccucuccucuuuucuuucccuuccaucccugcacgcaugggugcucuuucucugguguucaugacaacaacacuaacauuguuuuucuuucccagucacauggucguuuauuauuuuccuuaucucuggauauuuuguucuguccaaaauucaaacuuugggaauucuauuugguuaaacguaaugucuugcauuucuuuuccacuuuaauugccugauuccuuuccuguaggcugucuguuuuggucccuaacuugugccuagaguucugauucuuuuuuuuuuuuuuuaagucuauauuguguaugcaugcacugcuaaauuauauuuuucuauauaugaucccgugugagccugccauccccuuuuccagcuuuuguugaagaaugucaguuuuauuuuucuucacugaauuccugaauguuuggaaggcacaagcagaaaccuuggggaaaggaggcuucugggguugaggagaggucagaauccuggguagcuugaugaccugugucucaggggccacacugaggccgcacugacgaagagacuuucucuguucauagcuguaagcucacucucugaugauugugguuuuacuuacacagcaucaaucguggccuggacaguuguguuuuuaaagaugcauuuauugcauuuacaugaguacacugucacucucuucagacacaccaggagaggacaccagauaccauuacaauaguugugagccaccaugugguugcugggaauugaacucaggaccucuggaagagcagccaguuaguguucuuaaccaccgagccaucucuccagcccugaccuggacaguuuuaauuccaauucuggacuggcccagcuuaucuuuugagugucacauguacagauuguuguuauagccuugugugcggcuuaugguagagaguaugcuguugagggugaagggcccucucuguggacaaagacacccaaaagaggcuuccuuaugugucuaugucguuacugaacuugaccauucccucaugagauccuucuuguucuaggccuguaauggguucugaagacauaaccguggagacagacuguaagcuuaaagagacacauaucuaagccauuguggacguugaagccauagcugucacuuguaugcaggauauguuuuggauuauugggaguauaaaugcuggcauuccagguugaugaacaugggcaaacucaugauucuaccaacacuggguugguucuaccuuaugguacuaccaggcacuucuccagcuguuagaaacugaguggugaacagagcccugauucuuacugaacucuuugguggaguagggaaagcaggcuaaauaaguaacugguacguggagucaugcuaaacacuauccugaagaaagcuaguuauggaauggugguaguagugggaagcaagagcuguuuuauauguagaggcuggggaugcucuggucagguaacguuuguauggaaacacaagauggcuugaauaaagugaaguggagacugguaggagaugaaccuaggagaaggagcaguuuaagcaaaacuagagcuaggagugccaugccaugcaagaauaugacacuggcuuuuauuuuuuuauuauuuucuuuaaauacauuucaaaugcuaucuggaaaguucccuauacccucccccugcccugcuccccuaccuacccacucccacuucuuggcccugguguucccuuguauuggggcauauagaguuuccaagaccaaggggccucucuuaccaaugauggccgacuaggccaucuucugauacauaugcagcuagagacacgagcucuggggguacugguuaguucacacuguuguuccaccuauaggguugcagaccccuuuagcuccuuggguacuuucucuagcuccuccaucgggggcccuguguuccauccaauagcugacuaugagcacccacuucuguguuugccaggcacuggcauagccucacaagagacagcuauaucaggguccuuucagcaaaaaaaaaaaaaaaaaaaaaaaaaaaaaaaaaauuccaccagagaacuccuaaaccugauaaacagcuucagugaaguagcuggauauaaaauuaacucaaacaagucaauggccuuucucuacacaaaggauaaacaggcugagaaagaaauuagggaaacaacacccuucacaauagucacaaauaauauaaaauaccuuggcaugacucuaaggaagugaaagaucuguaugauaagaacuucaagucucugaagaaaguaaucaaagaagaucucaaaagauggaucucccaugcucauggauuggcaggauuaauauaguaaaaguggcuaucuugccaaaagcaaucuacagauucaaugcaauccccaucaaaauuccaacucaauucuucaacgaauuagaaagagcaaucugcaaaugauagcaaaaacucuucucaaugauaaaagaaccucugguggaaucaccaugccugaccuaaagcuguacacagagcaauugugauaaaaacugcaugguacugguauagcgacagacagguagaccaauggaauagaauugaagacccagaaaugaacccauacaccuauggucacuugaucuuugacaagggagcuaaaaccauccaguggaaaaaagacagcauuuucaacaaauggugcuggcacaacuggcaguuaucauguagaagaaugugaauugauccauuccuaucuccuuguacuaaggucaaguuuaaguggaucaaggaacuccacauaaaaccagagacagugaaacuuauagaggagaaagugggggaaaagccuggaagauaugggcacaggggaaaauuccugaacagaacagcaguggcuccuguuagcauuuugaguaguuguaaugcugcuuaugugguuuuuagaccccuccuuucauauagcacaagcauuuucagucaguacaguuuuuuuuuaaacauuugaugacagucuaucaauccccugugcguauuuguccccaguuuguccuauguuuaaaauauguaugccugaguuuguguauaccauuugcauguagguacgcugggaagcaggcuccccuggaacuagaguuguaagugaaagcgagcagggaauuggacccagguccucugaagagcaguaagugcucuuccuccuccucagacugugcucuuguggaucuuuguccacgguuuuccugcugcuagaauugcuuccugggugggaaaguauuggaucaccuaacuuuuuuaaaaauaaagcacauugguauaauuaaucuauauguuauagaauguaccuuugggcuaugguuuugaauuuugacagguccaugugauuauguaacaccagcacagucaagagagggaauauccacuaacucuccaauucugcauuccuaugcagugucucaucuuuuuucuuauacccuagcaaaucccuaauguguuccuguuuggucugugugguucuuguuccaggagauuauauuugcauggacucauauaguguaauaauaauaucugccucuugguccccaagguagagguacuuccugcauauaaagcaugaccccuaucaaggaccccagaauucuuagcuccucacagcaucaacucaguuaaguccuguaagcuccgcaaauucuaaugccgucuucuaaauccagcaugaugggggcagugcuacagucaacccagcccaugugggagccugugggagccagucagccaggcugcaggcacgugucuguaaucacgucacugggagccgaggcaggaggaucuaguuugaggcuagccuaaaagauguuuuaagauccuguuucaaaaccacacaaacaaacaaaaccuaaaccaauucaacaaaacagacaggcagacaggcaggcaggcagacaaaaggacaaguuaccuguuccagaguagguuagaaggagcaacuuaauucucuuagcagagguaaaguuuuuuauuuugaugaacccugcucuaucagauuucuccuuuuuaauagacugugcuuucacuuuugugucaaagcaguuuucuuacccagagguuacagagacauugugcuuucuucagcaguuuugugcuuuggguguuauauuucgguuaguuuucaguuagaacuuguauaguaggcaaaguaagggcugaagguuuugcauuuagaugucccgugagcagacuacuuaaacaguuuuagaauauacuuauuuauccucugacaauuuaauguacauauacaguauaucuuguauuguacaccuaccccacccccuccacuuccuccagaugcccuccaaaguucugcuuuuccuaacuuauccuaguuuugguagugcuccucgagcaaacaggacaccuuucuagugguggaggcugguagagagcuagguggucaaggggugggagcaggguuacuguagggcagcugagcuuacuacuuucauacuuccauggugguuggaauugcucacugcaugaccugcaagaaggagggaccgacuguguggguaugucugacaaagaaauuuagcagauaagcugagcguagaugccugggugggauaguacauggucauauagugaagggucugagggagcuguaggacgugggcucguaggugaggaaaacauuugauguuucccucuucugagaaaccauuggcgggcucuaagggagaggcuucagcccacuucauaagguuccaguccacauuuaagcgacaucagugucagccgccugcaugcuggucaaagaugcaaacucagggacccccacccacaccuacuaagucgaggcuccgagaggagggcccagggaucggugcuuuaagcccuaccggugauucugaugcaugcaugccuaaagguucuuuucuauuuuugauugauaaauauuaauuuuauauacuuauaugcuauggucuaguguuuccaugugugcaugcguuauggaaugaucaacucaggcuaauuaacuuguucaucaccucauacccuuauaauuucuuugaugugaggacauuuaaaaucgaccccguuggcuacuuaaaaaauaugauauauuauuaauaaaucaaagauacagacuacagaaccuuuugcccuggucugacuaaaacuuuguacuguuggacuauuaucccguuuucuguccauccucacacucuugcaguaucuccuagcucauguagaagcuuacuguggaugcaucauagucacagagggccagagaggcugaguggaaguagggaaacuaguuaggaaacugugagauacaucaggcuggcuuguacugggcugguagucauggaggcagcgagcaauagauaugagagcuguagggcuugcuauauuccauuaggcuauauauugaauucaguaucaggugaggagggcuaggucacaggucauucuaagcccugggcccuaagcuggccgauccaggaucuggagccacgugacgugaggugggguaagcaaugggcacagcaccaccucccuugugcuugggguaacggcgaugaagcuuggggugcaucuggcuugggguuuggaugaaauaagucugauaugcacugugagucagggaaaggauaucuugccugcauuuugacaguugggauguugggauuuucuaaaauaucucuaccauuggaggugugucugaacauauguaaggguaaaacugaaguauauuugauaacaacuuaguuuuuguuguuguuguuguuaacaacuuaguuuauuucuaaccagaauguacguuuuaucugacuuguuuuuacaggugaauuaaagucggcuauagauuucugugaaaaugucgguucuuauaucacagagugugauaaauuauguggaagaagagaauauuccugcucugaaagcccuucuugagaagugcaaagauguagaugagaggaacgagguaaggcugagacuaaacucuucacgggugugcagacugcucucugcacacggugcugugcucugggugaaggugggagagacaggcgguuucccauguugcaguggacggacucaugaugugauuuccuguggaaaguauuccacucuguguuuugaaagcucuuuuauuuauuuuuuauuuuuuauuuuuugguuuuacgagacagaguuucucuguguaguccuggcuguccugggacucgcucuguagaccaggcuggccucgaacucagaaauccgccugucucugccucccaagugcugggauuaaaggcaugcaccaccacgccuagcuucuuuuauuuuuuuaaaaagauuuauuuauuuuauuauauguaaguacacuguagcugucuccagacauaccagaagagggcaucagaucucauuacagaugguugugagccaccacgugguugcugggauuugagcucaggaccuucaaagagccaucucuccaacccccuugaaagcucuuuuuagcucguaugaguuauugacuguugaauuuaggcuuguugacuuuuccugugaugggauaguaaguaaucaggaggguugacucccgaaagccagaacaccucuaggaggcuuugcagaguaucuagaccuccccugucuuccaggcagacaggauucaaucuuuuuucacugaagucucaaaucugccugacuugcucauuccacucaccuuuggauuuuacaugaugcauguuuuagagaauauuauauaaguuauguuccuguuaaauaauuaguaaauguuagcuuaccuucaauauuucuguuaagugguaugagcaaaaacaaugcuuguauuucaucagauguagugugauggcugaaaacuacuuguuaggacauuuuagaaauaaucaacuuugacaguuaaaggcaggacagcaagcuuagcuccucagcucagcuggggacacccucccugggauccgcaccgccucugcugaggaggcagccugaguuguaagguucuugagcuccugggucucaggauaugcuuccccuaggacacugucccaccucaaaccugugugguucccaggugucuugagucucaggguacccuuccauccaagcagaaacacuuacagauacuccauuggaaaaaacugguuuucccuuugccaagcuggucccaacugauggugacuucuuaguuagauguagaagcugugucuacuuugaccucuuaguucugggaccccaucuggcuugaaccugucuaggucuugugaaugcugcuacaguuucugugaguucaucuucacauugcuuuuuaggauggucaguuaacaaauuuaaugcucaaauauagacuuuuccacuugaaaaaucuguucaugugugguaccucagucucuacugagugauguggccacacguauaauuuaaugucaucacuguaagaggccaguguuuaugugauuuacuuucuaugccaguauuuaugcuuaacucuuuacuugauuauccuuuuuaaaauuuuuuuuacauuuacauuuuaaaugcuaucccuauacccuccccccacccugcuccccuacccacucacucccacuucuuggcccugguguuccccuuuacuggggcauauaaaguuugcaagaccaaggggccuuucuuuccaaugauggccgacuaggccaucuucugauacauaugcagcuagagacaugagcucuggggguacugguuaguucauauuguuguuccaccuauaggguugcagacaccuucagcuccuuggguacuuucucuagcuccuccauugggggcccuguguuccauccuauaaaugacugugagcauucacuucuguauuugccaggcacuggcauagccucacccgagacagcuauaucaggguccuuucagcaaaaucuugcuggcauaugcaauagugucugcauuugguggcugauuaugggauagacccccgggugaggcaguaucuggaugguccauccuuucguuucagcuccaaacuuugucucuguaacuccuuccauggguguuuuguucccucuucuagggaagaaugaaguauccacacuuuggucuuccuuuuucuugauuuucuuguguuuugcaaauuguaucuuggguauucuaaguuucugggcuaauauccacuuaucagugagugcguauuaagugacuucuuuugugauuggguuaucucacucaggaugauacccuccagauacauccauacuugauuauccuuauaauagcauuuguuaaagcuugccaauuauaauuauucgcuuguuuggcuguuguuucuaauagauuuuuuaauucuuugauauuuuuguccacuucuucauuuagucaacaaauauuugaguaucuggguggcacuggcccuccuuccaucuuaauacuaaguacaaagacauugucggcauguguucuacccuuacggaauuuuaggaaccacauauaacaaucaacugggagaggcuggagacaugguuaaggucacugccucuugcagaggacucagguucaauucccagcucacacuuguugacucacaacugucugagacucucuucucagggaaucugaugcacuuuuugggccuucaugggcacugcagacacaugauaaaaaauguaagcaaauacccauacacauacagcuaaaaaauacuuuaaaaaucagcuucuaauccuacaaauauaaaucaaauuacaaaugauacugucaaugaggguuaaauacauaaaaaugaggagggaagguccgugaggccugguggggaugguagaggugaggggagagguggaccugcccuuguuugucuuugaagcacugguaaagauucaaguuguugucucagagauuagaggaaaacacugaggguuugaagcacagggaugucagcuuggcauaaaaaacagucaguuugaucccuagaacacaguaaaaaugccaggcgugggcucucaaaaugacuuggcaggucuaggcagcugucaucaagccugauaaccuaagugcaaucgcagggccccacguggcggagggagagaacaacucucaaaagcuaugcucuagucaccacucagacaaaauaauaaacauuaguuuugaaaaacgcagaguacuuuggcacaugcacaguguugggaagaccaagaaagaaggauucuuaggauucacugaucagguugucuagccugauaggugagcuccaggccagugagagacccugccucaagggcgguggauggugcuccugagaaugacaugacaccugagaucucucacacacacacauaugcgcacgcacacgcacacgcacacauacacacaguaaaaccacgugggcuagagaguuggcucagcagauaagagcauugguuguucuuccagaggacucagguucaauuucuggcacacacaugguagcuuacuuguaauuucaauuucagagcuucuggugauucaugccauuuucuagccuccaugggcacugggcacacaugugguacauagaugugcacauagguaaaacacccacuaugcauaagauaaauaauuuaaaaaguaaagucacagacauccucccacacacaucaacacacaggagggagaugcauaaaugcuuauauaauugagcuucauuuuugguguaaagucuuccaauauuuacuuuucugccuuuaguacugggugcuuacuggcugauggcuuaacuuggugcuucccaggcuguucaugucuugauugacaccucugaaaaggaacaugcuugugcugugcuugcaguagaagggguguggugcuggagcucucucuuagaucaccugcucaggcccugcccccugguuucuggccggggaagcucucuuugcauucacuuuuggaagguggaaaauauacuucaugaguuaagguuaugagagaaggcuuaaacugcaugugaaagucaauauguguagcaucuagacuuuaucauccucucugucucugucugagauaaaacauguauaauuaaagugucauucucuagcguauucucucuggaaaguuagguuaccguagguccugugagaguuugugcauguugugcuaauuguuuacagacucuagugcuaugcaggguuacugacucugaaugaguucguagucccuaaaagagguuacuaauauuauggggggggguguuacauuuuuaauggcuuugauauucacuuuuuaauggaaauugaacacacaaccauauacauuugaggcaagugcccauuagugagcuguauacccuaccuagcuuaugacuuuugaaucaucaguaaaccaaaccuauagguauaaagcuguugauaaauuaaaauuuaugggagacacagcagugcuuugcacaccuuugugaaaagcacuaccuuuguagugcugaacaggguuguagugagagcacaccauguugcuaagcuugcuguccuguuuguucuccaguguggccagacgccacugaugauagcugcugaacagggcaauguggaaauagugaaagaacucauuaagaauggagccaacugcaaccuggaagaccugguauguauaaaguaguuuacucauuaguccuccuuuucuuuaauuucuucauaaaaaguauuuaaagaauaaugauuaaaagcuguacuuugagggccgaauguaguaguuuaugccuuuaaucccaaucccagcauuuaggagguagaagcaggcagguuucugaguuucaggccagccugaucuacauagaauuccaggcuagccagugcaacauagugagccauugcaucaaaauaaauaaauaaacaaauaaguauuuuaaaaagugcuuugaaauuaagaaaaagaauaaauugcccuguccuagguuccuucgacuacuaguacauagagaaagagagggguuguacagcuugggauucaguucuguuccuagggccaugagaguugagauuucuguggagaaacuguauuuaugacuuaguguuucaaggucucucacucuccauacauuguuccauuguagauuuguucccaucugcugcugaaggaaccuucucuugacagugacugagaaauaaacugguguaugaaucuaaaaaaaagugcuuugaaauauaucucaccuuugccuaaugugcuacagguuuuuguuguuauuuuuauuuguuuaccucuuuaaucaggagagauuuuuuuuuuugcuuauaacugaguauaucugcaccucauguuuuuccuauguacauggcacucugaagcucauaucugugcaauuaaaugucucuagaauauuucaauguaugagccaugcuguuaagugauucucuguaauuauaauuuauaguguuccuugguaauugucccuucugauacugcuucugagggacaaaucaccacccaguuuccuuugaguucccaguguucucagagucaccuucaggaucacauggcuacauucuuuugcuuugagugaccaugugaauuauuuguuuuuaaaacagucucauuguguagaccuccuucugacucuccagugcugggauuaaaagcaugugccaccacucuuggugugaucauuugaauuaauucacucccuaaauaaacguuaggacaauucuguucucacaguucuuugucacaaucuuucuaaugucccugcuugcugcuguacugaauacuguaauacugaaugagugugugagugugcaagugugugaguguguccuuauggcagauugcaggcucuuuaauuuguggaacaguugcuagcugcgcgauugcccuuuagguuuuaguggccacuuuucuccuuucuacaaaaugggaugugagagagguccagggugagucuggacaagcagcuguggugcuguucucugcacugguguccugacaggaaggcaggcgauaguccugacauaggcaggcaacaucuuaaggcagcuuccgcuuuauuccacagagguuagaggggcucacaugguaucaguuggaaggucacuugggcuguuaaguucaagugcguuccucacuuuggaaugcuguguuuuauuuugaaacaugccauuuugaauguuuucaaggauaacuggacugcgcuuauaucagcaucuaaagaggggcacauccacauuguggaagagcugcugaaguguggggccaaucuggagcaccgugacaugguauguguguuuucugcaggguggcacuagucagcuggaaguuacugacgguaacagagacacaggaaacccugucuguuauuuuauuuuuaagacaggcucuuuuaugacuugggguuagauguuggaaugagucaaaaauguuuuaaaugcugguguuacagugucuccuguuuagaauaguuauuauuucaguuuaucucagaauuaaaaguucucagcucauuuuuuuggauaauucauaauuuaguacuuucaagaaaacuuauuuuauuuggauuggcuauggaaguuuaagucuaguuaaucuagaaggcccaucagguagcuuaaauggcucggguaaguuauguauaggcuuuggaauguuaguagauuuauuuauaaaugcggucuguccaggcugcugucccugagcacugaaugucucagcagacaugguccccaguuacggccuaccuccuguuuggucaugcucuggguaaggcacaagagugagaaaaaggagcaauucugucuuauucugucagauguuuaccuuuccagaaagucaauuuuagcagugcaagcaaggaaggaaaucaucugucuuggcacacaaagcacacaucccaucccucagcugccagguugcagagugcucagggcguaaguuuacagacacugcagcuuucugccucucucuuccuaguagacugugccacgcaacaauuuuauuucuaugauuuuauguuucaaaccuagggagauacugcuguacuuagcucggaugugaaaugccugcacauauuaggccccuucccccucccugcuucuucuugcuuucugaguacuauggcugcaagcagccagagugacucuuagaagcaugaacaucccuaggugacuuuugugacguuuacucuaugagcuuugcagugaccacuuguagacuuagcagauuuuauucaguucauguucaacugcauauuugugaggagcuuaagaauuuaagacuauuauuguuauaaaauagugguguuacaaagauguauagagagagugccugauuaaaguuguugcuugcuuggggaugguacauuuuacacgccacuuuuuguccucuaggggggauggacagcucucaugugggcgugcuacaaaggcaggacggauguuguggaguugcuucuuucucauggugccaacccaagugucacugguuugguaagcacuaacaaaaagugaauucuuaaugugaauuguuuuuuguuuuuuuguuuuguuuuuguuuuuguuuuguuuuguuuuguuuuuuagacaggguuucucuguauagcccuggcuguccuggcuguccucacuuuguagacaaggcuggccucgaacucagaaauccaccugccucugccucccaagugcugggauuaaaggcgugcgccaccaccgccuggcaacaggcuuuuuaugcuucauagugaauaggaauuuuuuagauuguacugacugucauauauaaugcuauaugaccagugagacccagugagaauuuuaagacaauaaaaauuuuguauacugucuuuuucucaucuuccaaugaaaaagcaagucuuugaacucaaauguuagccauaauuggguaacauuucagaagcagagugugaauuucuuaguuaccuuaccugugcacccucacucuguguuucuugaagacauuuaccaagaagccauaccauuuuccuacaugacuauuuuucuguacauuguguacauucuacauuuuuuacuuuuauucuacuuacuaauauuuccuauuagcuagauaaucacauuaaauaaguuaacucugcaaaaauauauguauuauuaaggcuuaacacauguuaauugucaguuauauagucugaguauuuguguuuuaaaauggagacuggucucuaauugauuuaaaaaccauucccuuguguuacuccuccugauauuuacuuaguaaauuuguguuguaaauguccaucuaaagacuguccucuucccccguccuuuugcgugucuguguaucccagcaguacagugucuacccaaucaucugggcagcgggcagaggccacgccgacauagugcaucuucugcugcagaauggugcgaaagucaauugcucugauaaggugaguugcagaguccacgcagguucugcuugugcuauguuauaaauagugucauuugaaacaucucuaauguaucuuauuuuuguauuucaacauuuuuaccuguguauucacagguaauagaugggucuuguauuuguguuauggaccauguguucuugauauucauuacauuaaauuauucucaaaaaagacagggcuaaugaacucaugucuuuauuguuugaaguuuucuauuauaacucuucuuccuguuuucugucuugccugcuguguuugugugauagcaaucuuaaaauucagguucuguucucucucuugugcuuagaauucuaaagcuggugguguggagauuggaaauaacgacugcaaggugcaucuguguguggaaggaagggcagugacagacucuuaagggaaaggcugauagacaguugcguaggcaaggcaagccuacauucucaggacuugagcuagagaccugacagaaauggaggagcaggaagagaggagacagcugaguaauguccugaugagaugggaggauaggaucgggagugcaggagaaggcgauguggcggguagcccuccggagcaucagcaaugacagucugucggacuucaugcugagacugggaagugugcacauaguuagugggaaagaccagauuugaacuugagaaaaaguggagauauuuacuaacugaagagccauuggaguagacagggaacaagguaaggacauccagauagcaagaguuauguuuaaggauguaagugagguuaucugcuccuuagugucaggguaagccggccagcaugguggaaaagagagagagcagacuuuguagugucaggguaagccggccagcaugguggaaaagagagagagcagacuuuguagcauguacucuuauacaucaaccacucagaagguaacaagugcaggagacgcucaagggaugggagcucaggcucaguugauaaaauuaggaugccuugaugagcuguggaguuagagaaggugcuucagauagacaaugcauuuccuacaaaggaggcugggaacauuauagaugcaggagcgaagugggggaguuuauucugcauuccuuacacaucucuuuaagacugaucugaggcagugacgaagaaaauuguuuuccuucacccccuucuccuguuguuagacuucuagucccacuugcuguauucccauccuuguuagccucgcuuucuugugugaaaaugugauguugugaguugugcuuauucugugauaaagccuucaugccguaacuguguggaguugugugaguugugauuaguauaaauacuuaucuaagaauaauacucaaaauauaacuucauuucaagcugcuuucuuuuaguacaugacugaaaguaauuuugaauucauuaccuguuuuaauaguauggaacaacuccuuuggugugggcugcccgaaagggucauuuggaaugugugaagcauuuguuggccaugggagcugauguugaucaagaaggagcuguaaguaccucuguucuccuggcccucuggcagagugaagcuuguguuuuaagggaauauuuuaggcuaguacaaaccuagaaaaaauucccuggaguucuuaaaugcuuucuuuuguaauuuaaaucguaaaugcuuuccucuugaguuggagcuucacucuguaguccaggcuuucagugagcucaggcucuuccuaccuuugccucccaagugcugagauuuccuacguguugcuaacuuugaaacuaaugaugcuauaauauaaaaaacauaaugaacauuugccuuugagaaucuguugcuaauauauauaaauuuugggaaauuaaaaccaucaaaaauauaauuuuuuuuuaguaaucuuauaaacuaaaaaauucuuuagaucaaguagcucccccccuuuuaauuaaaagcaaauuuuuuuuuuugagauagggucuauguaguccuggcuuuguagaggaagugggccuugaacucacagagauccuccugguuuugccuccuuagugcuaggacaaaugguguaugccacugugccaagcuaauuuuuaauuguaauuguagguauauaucaugcuccauuaaaaugucuucuccuugacaauguaaagugauguuagacuugguggauuucuuuaaguuauuuuuuuccucucaauaaacagacagaggaagucagaaaugaacuguuaagaagguuaaagaugggccuggaaagauggcucagugguuaagagcauugucugcucuucuagaggucuugaguucaauucccagcaaccacaugguggcucaccacgaucuguucuggugugucugaaaauagcuacaguguacucguauaaauaaaauaaaucuuuaaaaacagagagagaaaagguuaaaaauggaguugagucuaacugacuaccaguuauuaauuuauuacugaccaccagcuguguaucucauccuugccgagagugcugcagggccaggaggaggcuaaccuuuccauaaacgguccaggacuaugucaggaaucaguguuugugggcagcaagcaguuuuaaggcacugaggacuacuacuaguauuauuauguuaaguuaggcugcacaugauggagucugagaggagaugccaccaaaucuccggacaucugaaaccaaguuaaacuguaguuuaugucugacuuccuagaucaauggcauccaguguuucucucgucccugaugggagagguggccgcccagccgucagggcgcugcucucgcugcuggagccgcagcacugccucuccugaguuacauaaugggcggcugcugaugugaugauuugaugaagggaaacucucuuuaaaugucagaaagguguccaggauguuaaaggacuacuuagcauacguuaacgggcuuguaggaacugugaaagcucauuuacugaacaauaugcucuaauucuuaauucauuguuuguguuuuuccccuaaauguuuuauauaaagaauucuuaguuucaaguuugauccauuuuacuuuggguuguuuagaugagaaaguguugaaucuuaggucugucuuucaucguuguuacaucagugaaaggguuuguucccugcauauagaucagugcagguuaccaucgagaaagcugaacucuuagaucguccacccauuauguaacacaaguugugugucuuugaaaacugaaaauaccgauggcucaggggcucaguggauaaagcccuugcugccaagcuuggugacccuaguucugcccuugggauucaugugaugcagauagaaaaugaacccauaagacugaugugaccuccauaugugcauaugccuaagugaacgcacaagaaaaaaaauguaaaaacaauuuuuaaaacaccugaacauaugccuccagccacuuuuggcauaugucugguuauuuauauugguauuuugucagaaauaacuuaaaauuuuaaccacauuuguuuauuucuguaguagaagagggcacauguaagccacugcacacuggcauucagaggacagccuguggaguggugaggcuugaucaaaugggggccaucaggcuuggcagcugugucuuuacagcugagccuucgugucggcccugucagaaguaacuccuagugacugguggagcauuaccgugggagagcccuuaccuagcgugcucaaggcaccaccagcuguuaaaaugugaauuauauuuuaaaacuuauaugugugugccuguguuugccuguggauguaugaugugaguggggggccugcggagacuggaagagggccucaggccugggauucucuggagcuggaguuacucacagguggucuccaguccucugcaagagcagcaaaaacuuuuaaccagugagcgagccaucucucuagcagcugcaaagagcucaccugcuugaaaauaguuuucugauugugguaugcauauuguauuuuccagagcacacuaauuguuugcuuuucuuucuaagaauucgaugacugcacugauuguggcagugaaagggggcuacacacagucagugaaggagauucugaaaaggaauccaaacgugaaccugacugauaaggacggaaacacagcccugaugauugcgucgaaggagggacauauagaaauugugcaggaccuguuggacgccggaacauacgugaacauaccugacaggguaggggccuacuucagauuuguuauuaguggugaaguagacagaaaauuggcuccuuaucaucaagauucuucacaugugacaugaacuuguuuuaagagaaguuuuauuccuaccuuugaaacuaauaaaauuuccagucuuguuaaauaauguccuuauuuuuaucaaauaguuugguuacuagaaaugucacacguaggguuaauuuguaacucucuuugaugaguauuccuauauguguuuuucauagcugauguuauucauugucccaggacuuagauaguaccuuuauacuuaagauuuuuuucucuugccugacuucuucucugagguuucacauauguguucagaacucuccacuuggauguauguuuagugaguuuuuaaaaacuuacagcaaaauaaaauggaagaggaguguuuugucuuuuugcuacugcagccauuuuccuccauuuucuuucucucagcgaacggcccacuacccacucugaugcuuucccuuuuccuucccuaccccaugcagcgcugcugacuccauguaaaacuugcccuuuaccuagcuucaccaccaccauugccucccugaccaaagccacccucuccuguuguuaaaacaaaucauaacagauccucuauugucuuugcuuuaccucugcuuguggcuaaacgcacacacuccuuuguugaagccucuauggauguguacugcauuugaauacagacucugcaugucaauguccuuacuugaguccuuguccucauuuugugccaucuuccccauuuagaagggugcagcccugcuaagucccuucucuuucuuugcacaugaucuugucccacugugaggcauggcuguguuuucagucuagaaugcugccuacacaugguggcucccguuugucacucuaccuaguuggaaaggucauccuuagcuuuccaguccaaaagaccuccucaguuacuuugaucaauuaugcuauucuauuugcauaguguuugcuuugguuucuuuguuuugauuguauguuguuuucuuuuucuuuuuuuuuuguuuuuuuguuuuguuuuuguuuuguuuuuuuugagacaggauuucucuguauaguccuggcuguccuggaacucacuuuguagaccaggcuggccuugaacucagaaauccgccugccuuugccuccagagugcugggaucaaaggugugcgccaccacacccgcccuguauauuguuuucuauuagacuauaaauuugcuuacgacugggaccuuaucuucuuguuuccaaggaccuagaguggugccuggcacacuguaacagggaaauggauuacuuaccaguggacugguccucacccacuccgaugcuaacauucuuagcuauagaacuggccugccuuggguuuauguaugcuguuugugguguagcuaaaauacgauaccacaaugcuagacuuagaacccucaaggacugauuaauugacuugcagccuguugggguccucaggauggaagcaggcaacagcuugcuggcucacuuagcacagaagucuacaacugaccugcaauuuagcaaugaaaugacaagauacccgagcccauggcaaaauuaguauuugaaguaguggaaagcugugauucaaaauggcuguugcuugaugaaugucaucugaggagcugugcuugugaggcguuaaacuugguucaguuccugcacaggaagcugaaguagccugucugcccuuugccugugacugcccacuggcuguauccacagacacuagucugggauccagcccugcuguucuucagagccacaacagcauaucagcucuaugcccccaacuuagagccuguugcucuuaucacacggcagucuuugaagaggauuuauuauguaacauccaaacugucaguauccugugacuucaauuagaugugugaugagaaauugucuucaagagacuagacucuaccugaguaauuuauccuuuuaaguuuucaucauggaauuucaugaguccuuauucuaaagacuaauguccuuugugucauacgcagaagguugcuaauaucagauauuaucaguuaauuaauauagugaucaucuuuuucaaagagauuuuuagaacaaaucuauuacauuaauaaacaaguagccuuaauuucagaacuguguucuuuguuuaguaacugaccuuguguuuuuuuuuccuuuuagaguggggauacuguauugauuggcgcugugagagguggucauguugaaauuguucgagcacuucuccaaaaauacgcugauauagacauuagagggcagguaugugcgcucacauugcggugaccaugaaugcgugugucaaguagucaggaugcugcuccuccuccuuucuguggagaugaaaacaugugcgcccuaaugcauuggcugugugguggugguggugguggugguguuucauuggcacuauucuaaaguuccagaauuaaugcccacuuaaacucagauacaaguaaaaaagucccacaccauucuaggcuguguagugaaacucgucuuaaacugaaacaaggggcuggaggugguuaucuuguuagggugcuugcugcucuuggaggggacaccuaugcugggaggccuuaaacuccagcuccaagggggcugacccccauuccuggucccugagcuucugcacaugaugaacuuuggcccacugacugcacugggcagcuugugcacaugccauaggcuggggccaacaaaccuuuagggaaauguugacacgggaaaccuaguguggcagcuacaggagucaguucucaguuaaaggccuuauuuucacuaauggauggucccuagaucaccuguuuucagaccacugacaacugugucuaucaguuuugugcaucuguuuuuaaucaguuuuuuuuguuuguuuguuuguuugguuugguuuugguuuuucgagacaggguuucucuauauagcccuggauguccuggaacucacucugugaaccaggcuggccuugaacucagaaauccgccugccugugccucccaagugcugggacuaaaggcgugcgccaccacugcccagcuuuaaucaguuuuuuaauugauguucugaagcucugcuuuccaggucugugugagucaaagguuugguuuuugagcaagguagguuacugaaggagcugagcuguucaagacaguauaggguacagaguaaauaaauauaggcaaauaaaauuacaaaaggaaugccugugucugucagaaacacauuccuacuuacugucuuugcugggcuagcguauuuaauaaugacuuguccauagcagaguucagguauuggugacuuguaaucuguuuuaucucccugacugcauuucacaguguauuuuagggcuguggauuuggcccggugaucuagugccugcuuagagugugugaggcccugggcuccaucaggcaccacagaaacaaaagauagcuuaucaacucugugguuuacuccuguuuuacuuaauuauacuaaguuuuucuaggauccuuucauaaagaguuucucagaaguaaauccuagaugucaugaagauugauauuucccaccaguauaaguauucacacuuuauguucacaaauagcagcuuuuaguacugcaucucacgugauuuucuuuccuucuacaggacaauaagacugcacuguauugggcuguugagaaaggcaaugcgacaauggugagagauauccugcagugcaauccugauacggaaauaugcacgaagguacagggcacacuuuguucuguuagcugaaugauuccagccuuguaguggugauguccugggucaggaaacauucugccaguucuucacaaaccgugaagagauugcugcccuagguucuuuguguucuguuuggaaugcagaacauacuugcuuuagacaaccucugugagcugugucugcuucccuauaucagacauuuuaguuuuacucaaaucaugugaaacugugguugcaguuaguugugugugcaaguguccuauacgagaaaguauauuuguaauucaauaaaaagguuaaagugccuuaguaauauaaagcuauuuccaugcaaaucacugguugggaaagcaucuccuugacaguuuguaaauuauguuuucuuuagaauauuucagauuuggacuuacugaaauaaggagagcucuguccuuuaaaccuugucuaugcccacaggauggcgagacaccacuaauaaaggccaccaagaugagaaauauugaagugguggagcugcugcuggauaagggggcuagggugucugcuguggacaagguaagagcagagcugugcacggcaccuuugguguggugcugguaggccuuuaauuucugagugaugccugugugaaucuugcaucuggcuuugcauagaccauuucacagaaauaaacuuggaaacaagauguuugaucuugcucugugucauuuucagcauauuugugaguuugcguauguuuuccagagauuuuaugugcugaggauauuuugcuuucucauaggcuugagacuguggaauggaguugggugguuaggauauguugaguuugagggcugauagagagucaggggacugugaccagcagacauugggaagggugggaugagacucugaggagacaccaaggauaggguugggcuugggguuagugcaggaugugcgaggggugguagugacgaagacagcaguguaaagaacaaugaauggucaaaguuuaccucuuagagugugcaucauguuguugguuuuauaauuauucuugguuaugaaguuuuuuccuuuucuaucaucagcuauauaaagccagaaccaugcugucuuccgucuuuguaucuuccagugaacccagcacauaaaguucuugacauuggcuugggucaguaguuauugcaccacuuguacaacacaggaagagaacuuagagaaggaauauacagaagcagaagaccaguuuagauaagagccuuccuaggagccaugggaaagaggcaugcaggccucuuccauuugugucucagagcaaucaguguagaugagagcuggggauugaauuucuauguuuuacaucaugggcugucuucaagggaauguuggugaaauggcagauagaguacucggaagacuggggaggucccucacugugaguuucccaagcagcuggaagagucagguacagacacuuacacacagccaauggacauaagcaggagccccguuguugaauuagggaaagacuggaagaagcugaggaggagggugaccccauaguaagagcagcagucucagcucacuuggaccccugagaucucugagacacugagacgccaaccaggcagcacacacuagcagauaugagcccugacacauguacagcagaggacugcucuggccucagugagagaagaugccccaacccucgagagauuggaggcuccaaggacuugggaggcuuggugggcuggggguaggggagugggacaucuuggagcuggggugggcuuggggggaagaaugggaugaggaacggucagagggcagaccgggagggggaucacgacuggacuguacauagaaccagaagaggguuggcuauaucuuuuuaaaaauuaagagagaauuaaauggaaaaaaaaccaacaaaaacuuuauaguaaagguucuguagccuauaaugagaguucaagagcaagaagauagguagacacauggaagaguccucaagccucuuccuccacagcaggaaguccauuucgaauaugugcugcagcaggaagaugaaggcagcgacaguccaugggauuguuuuauacccagccucgugagagacgugauuuaauuuuaaaacaugguauaccuauauuauaaaagacuacucauaugcauauauuaaaauuaaguucguaggagagaaaaaaccaacuaugaguuuccuuagugugggaugugaauacucacgugacugaagagucucagggaagaggcagauagugcagggaguggacgaugaagagccuaggagcuccuguagugcucagaggagaggugugauaucacggauccuuaacagcaggcgcuugacaaaggcucuagggccugcugggcuugacgggauggcugaguacuggcaugaaggcugguagaauauggcuaguugaggcaagcugcugguguccuuggucagugaucuggugcacagaaggaugccuaggaggagguccuggccugggaggcacacgugacaaaggcugucguucuuuaagugagcugcagggagagaaacugauucuagaagccagagacggggugggaaggagauauuucugugaaacacuuguacaggucuagggaaaggaacugugaagaauacagagauccaaauuuacaagcaacgugaaccuccagauugucugcuuuguagaggcauaaaaaguauugcucagagcugcuuuugagaacacgcaaguucagccugugcugccauuuugcagaaaggugacacuccccugcacguugccauccgagggaggagccggagacuggcagaacuucuuuuacggaaccccaaagauggacgguuacuuuacaggcccaacaaagcaggcgagacucccuacaacauugacugcagccaccagaaaagcauuuuaacucaaauauuuggagccaguaaguaaugggguuugucccugacucagccugcacaggcacaauucuguguguguaugugugucuguaugagugcuuucauguauacgugugugccuguguguuuauauauguguguguaugugcauuuuuuaugugcaugugccauguguguuuugcuggaggucgaacccagggcccuaccaauacuaggcaaaaacuucaucaccgagcaacucaaacuugaguuuuuaaauaaugaauuucuaauaaaaacauaaggaaaauaaaugguucaacacaccuggcccaaaaaguauuuuaacaguuuuuauuaugcuuauucauuuuauuuuauuaugugugaguguuuugucuacaugaauauauguccagucccccuaccaacaaaaagacuuuuaaaaaucaugagauuuuagugauauaaagggguaaaggcucuugcccugagccugauguuuuaaauuuuuuauuaauuauuuauguguauauuucucuguguguguauguauguauguauguaccuggaaaggauaaaagaauguugaaucccuggaacuagaguuauaggccauucuggacugcuuaguauagaugcaggaaccaacuugugucaucuggaagagcaggaagcccuauuaaccauugagccaucuccagcuccucuuacuucuccuuagauuucaucuaaaaaaaaauauuuucauggcuuuuuuuaaaaaaauugucuucauuuaguaggaauugguaccugagucauuaaaucuuucugcaaagaaucauuuugucuuugauuaucuauuguauucuuuaguaacacuucauaguguauguacuuaaauauuucuagaacugaaauggucuugaacuucuuucccauccaugguucuaagaauugcacucaaggcucaugcauggcagcaaguacucuacugcugccugcaugcccagccguggacuaugugaugagugauagagaagaaagcaucauuugucagcacguuuuuucuuugcuguacuucaagaugauguaucuuaucauuaacuaacaaauauauuauaauagaugaccucaaauauaucaugaccucaaaauauaguauuuguguaagaaucucugaagauguuuuuaugcagguuuaaaugcucaagauaagguuucccacccuccauucccugucccaggauacagugauaccaaaguuuaauauaaggaugugguaugcuucuuauuacaggacacuugucuccuacggaaacagacggugacaugcuugguuacgauuuguauagcagcgcccuggcagauauucucagugagcccaccaugcagccacccaucugugugggcuuguaugcacaguggggaagugggaaguccuucuuacucaagaaacuagaagguaaaggcauguuugggaagucuagacaugcugcacagcagcuugugcaguaaagcucugugaguagcugucuugucacuccaucugcuguggugguuggcauuucucuccuucuagccgguccuucacgaguuuucguucuaaaucagguccaguugugggccagcagcuaguacagcccuugguagugcagcucauagguucuccccacacucgccaaugugcagaucuuccagugagcucuguacugcagucagaacuaagugcauuguuaauaaaccaggccuuuucugcuagaagccaugcuugcucuucaaggucaggcuucaguagagcaaauaaaaauggccucaagcuuuguagaaacaauggccgcgugguucuugcuagguugaugcaccuuugugaaccucaguggggugaggggaucuaagagcaguacugauguuuggagagaguaugauuccugccuuugcuuaugggaacaauauuucauacaagccaagaucaguaaaaccucagcagaugagaauaauggagaaagaguuuuaugcauuucaguaugaagugggacuguggggaaggacagggguaggugugcaguguggggcaggacgcucaaacugauuaaaagaaaacgcuaguuucaaugaugaagcagcagcaggauuaucaaaggcacuuguuaagugcccagcacaaguuuauguuaaaacaggaaaguuaaagagugaguuaaaaguuauaucuaagcacgacaaauaaaacuggacauugaucuuccuuucagaugaaaugaagacguuugcagggcagcagauugagccccuuuuccaguucucguggcucaucguguuccucauccugcugcuguguggggggcucggccugguguuugcuuucacaguugauacaaaccucgccauagcgguuucauugaguuuccuagcucucuuauacauauucuucaguaagucuuuguuuuuaaaaaucuuuuauuuuuauuuacuuauuuuuuaagguuuauuuauuuauuauauguaaguacacuguagcugucuucagucacucuagaagagggagucagaucucauuauggaugguugugagccaccaugugguugcugggauuugaacucaggaccuuugggagagcagucagugcucuuaccugcugagucaucucuccagccuccuuuuuaaaucuuuuaaaaauggagaaaaacauugaguguuacuuaaaacaucugucucuuaaaaacuuacucuauuuuuauaauuggcugaaaaaaauugaucuuuuugcuacuugguugguauagaguaaccguguacaucccuggcuggagugacuuuaagcaccaguccauuuaccugcucauaccuaacuugcacagcaucuguuacaugcugaugacccucaauaccaucacugcacuucaguggaccuugcugaaggaaggcucccuggcuguugcuggccagcucuuggacauuuugaccauuacuaugauuuuuuagcuuuucaaaagcaagcuaagaagguaaaacaaucuguuucaggcuugucuucagcuggaagaaaggaaauagauuuauuacugaaggaaguaguaacuuuagcaguugcaaacaugacaaaacccagcuccuuugcaucugaacuaccaacuagacucgugaggcuuugcuuuuucuuaugacuccaaugccaguuuuuaguuucugguuucacacgccuucuguguguugagaaggccacucgagggauucuucaaggaguauuuaagaauuaguauggucaauaaacaguuauauagauaggcucagcucuccuuuacuugcuacgugacuauagagaaaacaagcugccuaacuaauugaaacuguaaauuccagucgucauuuacuucgguggacggcaggaaggagagaguuggaacugggccugggcucucagcaccagacuggcaaggcacauuggguaccuggagcuccucuucaagcugauguuugugaacccacccgaacuaccagagcaaacgacaaaggcuuugccugugaggugaggugcuccuuugacagaaggaaucuuuaauaaggguaacaaaagaguguaaagaauuuuacaggucaucauauuccaaaaaauauugcuaccuuagucucuuaguugaacaaaacaaaacaaaugaaacaaaacaaaaguaugucccaauaccucugagaaacacuucacaguauauccuccuccuaugcaugaggucggcuuuccacagcaugaaaucugcucauuuucaugguauuuuauuugugcagaacccucucccucauccuuguaccuguuacguacugagggcuuuucugggagcagugccaggguuuaaaccagggcucacugagucacucucugugauagggccacaccucgccuccauuaccauccuuucugauacuuuggaaggaguauuggccuccaggguagagcccuggcagacagaggucuggagugaaggccucgcuucuccuugaaggaacaguaaccccuggaaacucugcucacgccgagcugcucucuccucagcucugcaaguagacacgugugucuagagugauugaguaucucaaacaggaagucacgagaaagagguguaauaaaggaauaaagaaagguguaagauucuagauagaagaaaggguuuuguuuguuugguuguuuguuuuuuagauagaaaauuuagagcaaaaagcuuccauagggguugggaagaagaauuaaaaaucuguuaaaggauuaugacguuuuaaauuauaauaagauaaaauaugcaugaacauaagucauucuaaccaucaaagcugugcuaggaauauaggugagaaaaauaaagguuaaaaaauuacaaauacaagcuggagagauggcucagugguuaagaccacuggcugcucuucuagagguccugaguucaauuccuggcaaccgcaugguggcucacaaccaucuguaaugggauccgaugcccucuccugacauguacauguagauagaacacucguauacauaaaauaaauaauaaauaaaucuuuuuuaaaaaacaaaacaacccuuuaaaaacuuaggaaaaaauuacaaauguagcuggcuguuucuuacuccuggguucuauaucuccagaugcaaccaacuauaaauuauaaauauaaaaaaaauuguaccugauacccugcacuaaacaauacagugcaaccuuuguuuacuguuuacugaauguaguguguucauuguauuaauaucauacagaauccagagaugguuuaaaggagauugcaauaugugcacuuuuuauuuucuaugagagacuugggcugauccuagaaccagcuaccuaugaauacugaggaaccauuauacucagcauauaaauuuaaacauuaaaaauguaaagcugagaaguuuuagaggaacguguuugagguuggagauguggcucagugguuagaagagcuugcugcuuuuguagaggacugguuugcuuuuagcaccuacaaugggugacucacgaccacuuguaacucuaccaucagggcaucugaaacccuugucuggccuccacggggauccauacagugugugcacacacacacacacacacuaugaaguaaauauuuuuuuaaaauaaagcauacaauauaggauaauacaauggagggaauuuuuacagaaaauugaagguuuaaaugaacaagaugggcguuuugaaacagaacaaccaacaugguaucagucaggaccacaaucucuagucuagugccauuccagacuguaaucugaaacauguuuuaucuccugggcuaaagugagaauuuaguuuagguauggaagaaaaagaauaaauuaaugcagaaauaaguaauucugagccugaagaugucagaaaaucaauuuuuugaagaauaacucugaaaauaauauuuuacaauuauuucuaaaaaccuggucuauguuaaagcuauaaauaaaauaaaacauuaaaaaaguuuauuuauuauuuuuaggauuucuuuuaguguguguguguguguguguguguguguguguguguuuugccucauguauggcugugcacaguguaugcaguguauauggaguucagaggaggaggucagaucucuggacuuggaguugcagacagcuaugaacugccauguaggugcugggaacuaaaccuugguccucuggaagagcagcugguguaaccauugagccgucccuccagcagaaaccuugcuucuaagugauauuucuggguuuggaguuacugucuguggugaagacucuccugccugacugccucagcuguuauuagagcucuuucucuuuugccucuguucucacccaggccgggcucugccaucacucugcccuuucccguuggccagucacacacauugaacacgcucgugucuuugcuaagagaaagucuaacaugcuuagccaagaagauaauuaaucacacaucugcuccccucccuuagaacuuuaaaagcaaguuuuugaaaagaacaucaaaaaauauagaauaaaugggggcuggagagauggcucggugguuaagagcacagacuucucuuaugggggaaucugggugggauucccagcacccacauggugguucacagccaucuguacauccacuucuaagggauuagacgucuucugucuucuguggguaccaaggauacauguggugcauagacuuaaaauuaaaauacuuuuuaaaagaagaaacaggcacugucuuuagaaaaaaggaaauguagaauaacugauagagauggcauguguaugcuagaaacgcugcauucaguagcugaguaacaucggcuuggucuucccccaagguuucuguuuacagauuacaauagacucuccaguguugggggagagacuuccuuggcugaaaugaucgcgacccucucagaugcuugugagagagaauucggcuuucuggcuacccggcuguuucgaguauuuaagacugaagauucucaggguaggauuacuucccucccccucuuccuuccuucuugaaguguuucuaggugugggggagggaauaaauguucauuuauuuucaugagaccaugaauugaaccuuagagucaucauaugcucuugaccaaaaagauuucaguauucugaguacgugauacgauaauuguuaauacgauuuauucuauuacagguaaaaagaaauggaaaaaaacaugcugucucccgucuuuuauaaucuuucuuuuuauuguuggcugcauuauugcuggaauuacucuuuuggcuauauuccgaguugacccaaaacaucugacagugaaugcuauccucauauccauugcaucuaucgugggguuggccuuugugcugaacugucgaacaugguggcaagugcuggacucucuccugaauucucagagaaaacgccuccauagugcugccuccaaauuacauaagcugaaaagugaaggauucaugaaaguaagaacuugucacuagauaaacuagugggaauaugcugcuguccccaugcugacuugagcaugcucucgaaauguuaaaaguuacguucaaggguuuuguuguuguucuguuuuuauuugcucaguaguagggacuugugcauaccaggcaaguacccuaagacuccaagucuauugcauuuaauuuaguuuaauuaguuuguuaggcuuauagcaaacuccauauauaccccauguaucuuuuuuuuuuuuuuuuuaguuuuuaaaauaaauucauuuauuauauguaaguacacuggagcugucuucagacacacaagaagagggcaucagaucucauuacagaugguuguaagcuaccaugugauugcugggguccaaacucaggaccucuggaagagcagucagugcucuuaacuacugagccaucucuccagcuaccccauguaucuugugcacagccucuguuaucaauaccugucaaaggagugcuauauuuguucaguugauggacuugcauugguucgucauagacucaguguccacaguuuacauuagguucagucuuagugcuguguguucuuuggguuugcacaaaugcuugauaacauacccaagauuacaguauguuuacugccaugaaagugccugccuccucuguucagccucugucucucccagcuccagucagacccugaugaguucacuaucucaguaucugugucuuucccaugaugucauguaguugcaaccauguagcauguagcccugucauauugguuucuuucaucccuuuuguagcuuacaauugcauugcuuuuuaggccugaauaauauuguugccuggaagaagaguguacguuuauucaguuucccacagaaauauaucuuguugauuuaaauauuaguaguuauaaauaaaauugcuauaaguaucugugcucagguuuuuguguagauguaaguuuuuaguaaguaaguuuuaaguuuggaguaaauaccaagaauuguaacuacuaagccuuauagcuugaauauauuuaacuuuguuaaaaacuagaugccaucaaggagccaagaguagugcagccaccaguagguguuuuggguggaauucaaguccaagguuuuugucauucauagucuuuaguuuugacaaguaagucucucaaccucuucuguagucuguaaauuccuaucauagcaucccuugaugacauccugagaaucaagugcuaucagucauaacugaaaccccuacaacagguuuaaaugccugaaacccugaagggauuucuuuuccuccauuggauggauuucucuugugcuucuaaagggaugugccuuaucuucuggugucuucugugccuugugcagguccugaagugugagguggagcugauggccaggauggccaagaccaucgacagcuucacgcagaaucagacgaggcuggugguuaucauugacggccuggacgccugugagcaagauaaagugcugcagaugcuggacacuguacguuuccgcugucuccacacuugucacuguggccacgugggaugcaugacuucacaaacuaucucagugggaugaaaacugugcugcuuauuuaagaaacucugcuuucucuagugaaucucucgcucacaagaacuauguuuuaaaauucagaauuauagcaaaaguuaauguuugaucaagaacgauuaagucauuucagccugauggcacuuuaggaagaaaacacagcaaaaccucacagagagcaucucugagugacaaguguggcucaguaugcagcagucauguuuguccucugagaggacagaggggaccaggagaauuuguagugcugugaucugagguuuguuauaaacaacagugguuaacugaguaugcagaacucacaugugcucaccggaaauugccauguguugaucuuacuucuguguaagcugcaggugucuggggaggaacccacauuagcaguucccuuuguuaguugugucacuguggguagaugauagcaaucuaagauugagccaucuauaaaaguuguauauauagagaauaaauuuugaugaaaaaaugaaugauauuaaaaauauagcaccaaaggauaguacauauuuuaaaaaagauauuucuuguauaauuuaaaaauucgcaucacguccauaccuuucuuuuaccacagguccgaguucuguuuucaaagggcccuuuuauugccauuuuugcaagugauccacauauuauuauaaaggccaucaaccagaaccugaauagugugcuucgugauucaaauauaaauggacaugacuauaugcgcaauauaguucauuuaccaguuuuccuuaauagucgugggcuuagcaaugcaagaaaauuucuuguaacuucagcaacaaauggggacauuucgugcucagaagcaacagguaaguaucaagcccuagagugcucaagcuugaaggcagcuuguagaaggagggguuuauuuagcuaugcuccaaagggauaagaauucagcaccguuauggcgggaagcguggcaguggggcuggaguagcaagcugagaguucccaucuuacacugcaaguaggaaacggagagcaaacacaaaggcauacaucuucaaacucucaaaaggcaucuccagggacacacuuccugcagcaagccucauccccuaagccucccaagcagcagccucaaguggggcccaguguucagacacaggaggcucugggagaaacucauuuuaaccaccacagugcugucccaaugcuuucuuccaggagugcaggaggaugcugacagaagaguuucacagaacagccuuggggagaugacaaagcuugguagcaaaacggcccucaacagaaggguaaggugccauuccugccguuuaauggugugauugaauuuuccuuagaguguugggguugagccuuucaaagccuuccgcaugcuaggcaaguauucugccacuuagcuauauccugacucugauuuuuauuuuuuuagcagucauucaaauaaaauuaaguuuguggcaccuaguguucuucuguaaacaaugccuaguguucucuguaaacaacgccuaguguacucuguaaacgccuaguguucucuguaaucaacgccuaguguucuccuguaaaggcaaacacgaagcuaagcucuugaggucggugcggagcucccuuucagcgucagcugccucagagcugccuggaggguaaagaccuucaucagggaggaggcccccaccccgcagccucuucccagaucacugcugacucugcaccuaaguaguaagauuuccuagccagcaaaugaucguggccucacguucguuccugagcaggugccggcccuacuuuuuuuuuuuuuuuuuaaucucuuuagguucuuucucuuugcccaauguuuacaaggucuggauuguagucuccacgcccaggugugauucagggcccuucccagucucccuggguuucugguucagugcuucagucucucuguccacccaucuuauuuguagagcaaaaccagguguauuuauuuaggcuuguaaagugggaagguguccacaggcaggggagcuuugcugauaaugucacuuacggauggcugacgugggcucauacuggcauugccuguuuucuuguuugcuaccaucuggacauuacuuugguuuuguuuugguuuugguuuugguuuugguuuuucgggacaggguuucucuguauagcccuggcuguccuggaacucacuuuguagaucaggcuggccucaaacucagaaauccaccuccugagugcugggauuaaaggugugcaccaccacgcccagcuuuuuuuuuggggggggggcauuacuuuuuaaaccuugugucuuuggcuuugugcccacaugcuuugcaggauaugaauucagagauaauaugagugacaaaugauagcgccaaggucaggggggugugugaugcugcauguuggauuucucucuuggcagcccagguucuuggggaccuaugguuucaucuaccuuucccaugcgucaggacucgggggaguguucuucucuuaggagugggauaccuuagccacuccagcccacucuacagggugccuucaacucuuugaggaaaugccagggaaguuaagaguggcugugccugggauaaaaucguguuacacuuuaaaacacccuaaaaauagagaugcugaaucccuagaaccaugaaggaacuuaccugcuuuauuguuuuauggcuccuaguacgaggcuuuauggagcuugaccgugauuuucuuuacagaguucugugcacuucuuaucugagacauuacguuuucucuaacacaugggaugccugccugccaacucuacugagucauugcucuggaaagugccucagaagugacuguacuugacuagccugcaaucuuucucuuugguuaauauugugaauucugcuuuucuuacccacugaguuggcucugcagucuguuuuguuggucuuaccauaagcgugcauguuaacucucaaggauggguguuucucacuggugcuguuguuucaggauacuuaccgcagaaggcagaugcagagaaccaucacgaggcagauguccuuugaucucacaaagcugcugguuacugaggauugguucagugacaucaguccacaaaccaugagacgguuacucaauauuguuucggugacaggugacuuuuguuuuucaaguucugugacagauaauaaguuuuauuuuguuuauauuguuuugagauaguaggcauugaacucagggcuugugcaagcucugugaauguugugcuauugaguugcacccccagacucaccauaaguuuuaacguuaacagagcacuuugagugugagcuguguugguagugguagaugauaguaguaacuuuuuuguaauaguacuugacaaucugauaucacuugggaauuuaucuuaaaaguucaucauuuuaaaguucuuuuacuuuauauuuaggcuaaauuuauauaauuuauauaacugagcacauuaauauuugugcugaaauucagauuuuuauauacugccauauuauuucaguuuuucuaugauaauuugaauaaaaauauuuguaauacaauggagacuauuagcuaggcagugguggcccacaucuuuaaucucaacacucuggaggcagagacaggcauaucuuugaucagguucaaggcaagcuuggucuacagagugaacucuaggucagccagagcuaaacagagaaacccugucucgaaccucccaagccugccccauuccccaaaaaggagcuuauugcuaugacugaauucuuuguguggacgcugcucuucuguauguuaaggcuaauuagcaugagagcagucauagacacacuugcauuuuaacuucuagaaugugugucuuuccuuacaugguauugcuugguaccuucugguguuuccuaguguugacucugucaauuggaauugcauuuuauacuaaguuuagggcuccugacguaaacuguauuauaggugggggucauaccuaagauaacauuuuauaguuauaaaucucuuuaaaugagacuucaaucuuccaaugcugguucgacagaggaacuguuuccugauauuauugcuaacaccgacauucucacuugacaauaugucuuaucauccuucuuaugcccagaguuggucugggcaugguagaaauuuaacaggaaguaagauagcaccccucccacucaagcaccucccuuucccuggaacuucuccuggcucugccccuccuggcucugccccugccuuggcccugcuucuguucucagcaaagcuccuugguagagcacacugcccucucccaugcuguucuuccuccaguccucccagauuucccaagacccuucucagggcuucagcgaggagacugcacuugagguuccccaauggcuccuacagggagcgugcagggccagggcuccauccuuaucuggaugccacaagcagcuguagcaaugguuucccuccuaacuguugcuaguuaacacauuguguccucuugcucuuuaauauuaggcugcccgugacuacaguucuuggagcucaacuuuguaucuugaccaguuuucauuaacauggccugucaugauucugagcaguggguuuucucaauucuuuagguguuucccuaccuauaagcuuuuccaugagaccuuccugcaucucaaacgaaacgauucugccgccuccuuccauguuuccuccuacuccauagaacagcugucuucugacacauacugucuuugucugucuguucucuggaaggggagacccucaugcaagggucuuugucugaucugcuuaaccgcaguacccacuucagcaucuggaauagauugugaaugaguaagagaccugaaugaaauuagaaccacacuucacauggcucuuugagagaagcauucugaggaaaaggagcagcaacugcagaggcugggagcuggauuccaagaacagcuagagugccagccuggguggagugagaggagcagagcggcgugaaguggugucagagagcugcagcucauccgaggccuuagggcuccagaauccacagcaaggaauuuagaguguugagacaucuucagggacuccaaagagaccugaguugauaccuuuaaauaauugaugcuagccaggccugguggcacagauucaaaauguaagcuacucacagggcugaggcaggaggaucucaaguucauggccagccugggcaacuuagugaguuggaugugaagguuuacaucuguaguccuagcagucuggaaguggaggcaggagaaucaggaagucagagccaacaggcuacauggaccccuauguuuuaaaaacuaaaaacucagccucuacaagaaggauauugucaagcuuaucuuagugcuuagucuuccauuuuuguugcucccccaaaagacacauuuaguuaaauguucaccuaguuauuucauagguugucaguugcuggguuuaucaucuguuuugcugagugaacgcuucugaggaaggcugugacugcaucaccuguucuguucuguucuguucuguucuguucuguucuguucuguucuguucuguucuggguuuuaccacaguuaguagucacgguaagcccauaguuggcaaaugcuuguagcaucgcucacugggaugaaggagucauccugucaugcauccagaagagcacacccaucuucccggaaggucaguggugagaugcagagggagggccugaggccagggaagagcuggaugagggguugucaccuguaucacgugcgggccagcaggauccccaugagagccugucagacaaguagaugugggugcagguauggacugaccugguggcaauaggauagagcugcuguuguucucacuuaagaaccaagccucucuguaguccugucaaggugaaggccucaaaacacugcagggaagccuugauucugaaagcuugccagugcaguuguccucaaacuagcaugcccugaggaaugcucaguuaguccucugaacacccuaagaacaagcuaauuguauuccacguguagacaacaaguuuuagauacaucguaacacaaucuaugugaguaaguaagaagggaaguaaauugagccauaacacagagacugaccaguauguuuggguuccauuaaggucccagagcuguccuuagcagucagcauggacuaccauggcguuuuauuuuguuuguugguuuauuuuuugagacagucuuacuguggcucagguuggccucaagacuuguccucuucuacuucagccuucagugugccaggguuacugauguccucuucuacuucagccuccagugugccaggguuacugauguccucuucuacuucagccuccagugugccaggguuacugaugucugccacuaugcccucugagucuuuaaaaccuggauuuuagaaaccauauaaauacuugauuuaaaucuguaguauaaacaaguggcaaauuuuucaaauuuuaaauaucaauuauuugugacuauguuauguaauuauuuugcuuaguauguuauuaauuuaaaauguuuauguguucauuaaagggcggcuacuaagagccaaucagauuacuuucaacugggacaggcuagccagcuggaucaaccuuacugagcaguggccauaccggacguccuggcucauacuauaucugggagagacugaagguauuccugaccagaugacgcuaaagaccaucuaugagagguauuuuacucgacuguuuugcucuuaacuuugcuuugaguacuaaaacacagagugcgcacacagucucuccuucugaauuuagucagucuuccugggcuccuuggugagcuccggagcugucaucacauagcugcugcccugugagcuuacagcuccauuuguacuuccucuuuuuacagcuguguacaauuguaagaguuacuauggcuuuuguagagucacaaagccaaaaugauuuuguuugucagaacacaacaauagcuuuaagguccagcugcuggucuaagaaacuguuucuuaaagcuggaugguggugugguaugugccuuuaauccuagcaggugaagcucugacuugugggcuauagagcaaguuccagaauggccagggcuacacaaagaaagccuuucuuaaaagacccaaaaauaaauaaaccguuucuuagaaaaagauaacuuacagaaauuagguaaacuuuaaaaauggaguauaauuuuauacuguuuuaaaauauaaauaaaauacuaauauaguuuauauuuuuauagucucuaagaguucagaucauuuuuauuccuuuggaauguuguuagcauuugauuuuuccuaacugauuuuaggauuguagaggacugucucagagucuguccacagcucugagcucuucuaggcuucuguucaagugugucaguggccuaacccuggugcagcuccagugagacggggcauggaugaccuugugccgugagaacuugacuuggggcuguuagaagucguuauaucuugagaucaugagugagcuuauccuuggcuguaaaauacaaaacugucuuuuauuuguguguguccugaguuaggaguuagguaauuguguuuccuagaugcgugguuacuacaguuuagaauggcgcuagaauaguuccuggcgaggaagcuugagguucugaguguucauaacuccccaagucacgcagucucauguggcagagcuggcgucuucaucugggucgcuccgaucuguauggcacucauuguaagcacugcagcgcuaacuccauucucacaauuccgagagagguacuguuauccucauuuuucacauuagaaaacagacaccagugaagacaagucacuugcuaaaaggccaguguaugauagagcugggauuuaaagugaggcuccacaaccucacucaggugugugucagaaggacuccuuucauugcguccacaugacauggacccuuuccuaggcugggguccuaccagaaacauacugaaguuugucauggagucaaagggcuggaguuucuaauggaaacaugggcugcaauguugacauuuucuguuuccuauuucuuuaggaacauugcaaacuacuguaguuuuuguaugagguuuccuguggauuguuuauuaauuguaacaaauuuacaaacagauaacugcuauuuuuuucuauaaguugucuuugccaucauaaaaacaugaguuuucuguuaaauaaacuguuaguuacugccucuccagucuguccgucucggucucucuuugucugugucugucucugucucuucauuuuuugacagaguagccaugcuaguccucgguugggcguggaaugggauucacacuagccccuuuccugcugugacugagaguccauggaucagagacacuauggccaacaauucaagaaguguauguagagucugcacaaucuaugacaagguuggggagagugauaaaagucccuaggcaauagaaguagaagaaauauaaaauaaaacagauuuaaaagacauuucaagacucugagucaggucugugugacagcaguugucaggucccuguagcucugcuggaugcugcacuguuguuguuuggguaugugucucccugaaaccuguucuuguugcuuuucuuauuuuugugcuccugggugucgaagucagagucuuaugcaugugucuuagcgcauucuacugcuacuccacaccagcccaacuuguuuuucuuaagaagccaagauuaguagguauuuuggugcuuagaugcuuucuuucaguuucuuuuguucaaccugguugauuucuucauuagcauauacugaguguaauuuuucucacugagagccggagcuuaugccauuuguguucuuauaugguauaggggcugguugggugaacagagggagagauaaaaagcaugccauguucuugaaguauguacauguuuaauuuucuucccuauuuaagcaauuuugcaagaauaagaauaguacaaacaacaccacauccccauccuuccuucagacucaucuguuacuguugacuucauugcuucaucaguuccaaucauguggccuuccgagucuuguucucucuuuauguuuauagaucuauaccaacacaaacauaguuuuuccaaacucugugugggaaauuacacauaccauaucauuugccccuaaaugcuugaucuuucaggacuuauauauagccugauugaaaauaaagcauagcuggacaugguggugcacgccuuuaaucccagcauuugggaggcagaggcaggcggauuucugaguucgaggccagccuggucuacagggugaguuccaggacagccagggcuauacagagaaacccugucucgaaaauaaccaaaaaaaaaaaaaaaaaaaagaaaagaaaguaaagcaaagcaugcauauuuggaacaaauagacagggaaggaaagauggcuuaaaaaauuagccagcuaagucauuuucugggcagaaggagacuuuuuagucuacugcucuuuggugagagacaauugcuugguguuuuauuucuuaugcuuuuuuuagggaagaaagauuuauuuugguucaugguuguagucuguuguguugugagagcauaaaggacuagaaacucacgggaugccagccagaagacagagagaaugucaguguuugcaggcuugcuucucuucccacuuuuuauucugccugcaccugcagccuguaggggaugcugcugccuguauggguguccagcccuugugaaccugguauuuagcaagucucuaagccauuaccuuccauuuccaccccucaaaggccuggcucaucaugcaaaaugcguucaauucaucuguccuuaaccuuaacaguuccaguauuguucaguaguugaaguuaaguaugucuuucgagacacgagacaaacucuuagcugugaacccuugcaauaucaaaaagaaaaugaccuauuuccagauuacaguggcacagaguaaagauuucccuucccaaagcaagggaagggcuuagaacacagggauaggacaaaaccaaagcccagaagggcagacauuagauucuguagaucugguucaggcaucugcugucuuuuuguuuuguuuuguuuguuuguuuguuuuugagacaggguuucucuguauagcccuggcuguccuggaacucacuuuguagaccaggcuggccucgaacucauaaauccgccugccucugccucccaagugcugggauuaaaggugugcaccaccacacccagccgcaucugcugucuugaugugagaagccaacaggcguaggauucuugucucuauagcuuugaaaacgucgcccaguggccuuucuugggauugcuugguuuauugccugcagcuucccucaagcuaugucccagguagcaggagcauuuaacuuccuuagcugcuuuugugucuuuagcucuacauucaugauugaugcauuguuuccugcauucacaccaacccugccauacuuugccugucuuccuaggguuuucugaaaaaaucucaugcuuaguguccuugacccuguaacauuuacauucugcaugucugcaaacccagugucagaucagauaggugacacugaaacuaaguuaacuaagugagcccgcagccccaugcucagugcucacugcccuuguucccauccacauuccggugccucgaguuccuccuggaauagcccaccagcucuacuuagggcauccuggagccucuccagcuuacagccccagcuucuccagcuucucccugcagaccuggccucagguuucuuacggauggccagagcagucucucuacuugucucgcacucacucucuguguguguuagacuuucaguguggcgacugcagcuaaggacagaaugguuauauuuagcucaugcuuucaaagguuugcugugcugaggaaagccugggugagcagagcugcuuucauuguggcagacaagaagcagagaaagaauugcucaucggggcuggugagauggcucaguggguaagagcaccugacugcucuaccgaagguccagaguucaaaucccagcaaccacaugguggcucacaaccauccguaacgagaucugauucccucuucuggagugucugaagacagcuacaauguacuuccauauaauaaauaaauaaaucuuaaaaaaaaaaaaaaagaauugcucaugcuuugcuggaaauuuaaaguuugcauuguauacagaucgcaucaucugaaucucauagguaguucugaaauuuuuuucaauuuucaauugaaauaugucuuguaggcaagaaagauucuuaaauugagauguggugacacaugcuuuuaaucccagugcuuaggaggcagaggcagaggcagauggaucucugugaguucgaggccaacaugaucuacagagaaacccugucucuggguagggcugggggaggggagagaggaacacuugcaugcuguuuaaagauaauagcaauuauuguacccuuuuaugaagaaaauaaaauauuguaaaauaauuauuuggggggugggaaauguuuuuuuuaaaucauaaugaauauaaauuauagugaauuuuuauaggggaauauuuuauuuugaucguaucaauauaggauaauuuauauuagaggcaaaaugagaccaugucaacuuucuuuugugauuuagccaaccuaucacuuuagcccucagcccugcuggucuugcugucugagaggagacugauguagcgugacucugaggugcuugucuuuuuaacuaugccuuauaugccuauaaauacuuacagaggacauuuguaguuauccagcaaagagaaagagauaguguagaaagcaaucugaaaaucauaagggauuuuauuuaaaauacauaaaauaauuggcaacgaacaacuguaggaagacaguuugcucagcuuauugagaacccgucuuuuacuuuagcaauuuagaugucuguuugcauuuacccauacucaguucuuuggugcuugucauuugaauaauaaaaaguuuuauuuacagcugacaaaaagcagcaguauauaauugauauucauuuguuuuauuaaagaaaucugauuugguaaaaacaaucggaaaauaguauuuuuaacgcuaguaguaaaauuuauuuuuuuaauccauaaaaagccucauuuauuuuuauagcaauuugaugacacaucugcuugcuuuauucagcugaaaaagaaaauguugguucuugguguuugguaaaauugcuuuguuaaauuauuuucuaaauuguucaacuuuuaacaaaugacauuugauacuaacacuggaaagcaauuucagcuaauuaaguagaucccucuauaaaccauuggaacauuaagaugacauacuguucauucaagauuauuuuaauugguacaauuauuguaauuuucuugcaauuauguguugagcuaaaagcuuuugucuagaucauuugaggguuuuuuuguuaacauacauuuaguaagaagaaagaaaguuaaauaaaaacuguagauaaagauuuucugucuaccuuuuagugcagcauuuuagacaaucauugaaguguuuuaguauaaaaguuuauuucugguauuuuagacacuuaaagcaaugauagagacuuugaaaagaucaauucaaauaguuuucaugaagauaauacuuuaaauuucuguuuugacauugcucaagccaugauuuucucaagaagauauggucagcagaacuuugugugagaggcagcaugcuuuugauagucuuggauucuuaaaaugaauugaauggguuuuaaggagguaaagaaugauggccacuuucugucucacagaaacagcuguuugccgaguaaccuuggacauuaccauaugauaguuauggaucuaucugauaucuuuuaaguuauucagucauaucuuagcaaauauaucauauauucauuucuuauacgcaacaaaagcugucaaaagcuuaauugauuucaucuaaccucccuaguucuccucagagcuuagcaaucuccuuccuguuuccuccuucccauugccaccugucaucccuuggaugacuuacacagccuuuugaaacccuucaccugugauuguccuuacacaagccugugagcugcaugacccuccuugcuguacagauaugucuuuuguacugauacuuauuuucuuagagauucuaggaauaucuauuuaaaacauuauuucaugcaugcuauuaagguguuuuuuuauguauagcuuugaauuuuacuaagagucuauauucuugauaugguaggacuucuuagagauuuugauguugccaucauucaugauuuauuaaauuauuaucuuguacauaauuauuuucauaagcauagcucuagauauucccaacacacauuugcucagaauguagagguuaaauauuucuuuguuugugaaagagauuaaucuaguucuuugcaaaaaucaucuuauaagagagaaaacuaaguauguuuucacuggaauaaagacuccgagacuauaacagaagucuuucuuuagauaaaauaaggaacacuagcaggguaggugagugugacgugagaauuaacccugcaaacuguacagugagguagggcauugacaguugcaugcaaacuucugauuuuccauuguucauuuauauuuuugauagaaauuaauuggcaaauccagauuuauuuauuuauuuauuugugauuuucaagacagggcuucucuguguagcucuggcuguacuggaacucauucuguagaccaggcuggccucagacucagugauccacaggcuucugcuuccugagugcugcgauuaaagcauguggcuguuauauccagauuuuuacagauaaauaaaagugaagggcagaauuuuucaaacauccauuuauuuuuauauuauguauuugagugcuugccugcaugugcaugucugugugacacaugcaugcagugcccucaaaagcagaguccuccggaacuggaauuauagauggucgugagccaccuuguagguucugggaauaaaacccagguccucuggaagaacagcagugcucuuaacuguugagcucucuccagucuggaagaaguuuugaaauuuauuuuugaugcacuuggaaaacauaccuacuaucauuguuuguagaaaagaaaaacggagagaaauuagcuaggcagguugggucagucuugaauuaucuguuauuguguucugccucuuauuuguucuguuauugcuacuggauuuguagccaauuaaagggugugagagaaauuacuggagaaaaaaaaaccaagguaaaauuuguuguuauuuaggaaauuguuccuuguuguuguuuuguuuuguucugagauagggucucauuggcuggccuggaacucacuguguagaccagacuggccuggaacucacagagaacugacugcugggaaauaguucaugagagcccauuauggacagacacaaguguaaauaguaguauuuacuguagaauacucaugugcaaggcuggcagagaucccugucccagggauucuacgcacaagcaacguauaaacuaugugauuagcaacaagcccuguggaaaggaugaagagaggaacauuagggagauaaggaguagugcugccugugcaggacaguccucacugagaagagaacuaagcagggacuccuaaguggagacagauagccaaguagaacccuaggaggugagagggccucugugcugcugaagacggcuagcagucauggaggugguagaacauaaaugcuuuugaaguaauauugacuuugaauuauggauaaucaaaaccuggacuucgggugcuggagagagcugggcaggagcaccugcugcuuucccagaggaccuagaauauucgcuucccuuuggagacucacacccaucuguagcuccagcgccaggagauccagcgcccucuucuggccuuuccagggaccaggcauacacaguauacagacagauaugcgagcaauauuuggagauacccguccacauaaaaacaaguaaauaaguaaauaaauaaaaauuuaagaagccacagacuuugaguaacacagugggcauuaaggcuagggaaaagaauuguuccaaaugaucugugggaguccgcuuugugugggagcugaggcaucaccagcauggccugcuuucucaccuugaucuuagaccuuuccaccugcucuuuuccuggcccgucuucccgucuccugccucauuuuucuggucauuuuuuaguuuuuguuuccuccuuaagaugguaaacgccauagauuauaacuuccuucuguuuccacacccauugaagggacagagugagauuuuugaagugaggaagucugauggugcguuuguguggcucccucaagguggcaggugugaagcccugcuuuaucuugagugggguccuccagacgcuucauuggcucuggaugcaggggaaauguuucuuucauuguucugaugugaaucccucuacccuacuguaaagcuuaguauagggcugaagcccuacacuaacuggggacuaccuacuucaccuagaguuugcuggcuccuuccuuucggcagcucgcacuaaaaucacagcagcauuucuuuagcccguaaccaaguuuauguuucuagguucuuauguuuauaaaccuuuggugaagcaguggguuguaguccuuuuuugcaggucuuucccaauacagucuguucuuacagaugauauucuguguccuacuagagucaauguaucaagguaugauggcacaugcuuguaaucucagcacucaggagguagaggcaggaggauugcucugaguuuaaggccaaccugaacuacauaucaaaaccauguggcagaacaccaaaaguuaaucaauaaaguaaaugaaggccauguguaguuagauggcuccauuuuguucugcuagucaguuugauuguuagguauuuacaguugcuacaguuagaccugugcugggugcacgcuaaggacugcacuaccuaccacggugccugagcugcucuugaagguggcagccaguggacuggguguugugccgagcaucccaugccgugcucugcauaaccaagggaagcggagagcaggaguuacgaucucugagcugcacuggaguuucucccacacagucuucuguagucgcagaagauagcugugggucugugauaggaagacacaguuuucagugauaugcauaugaauauuuagaauauguuaucaguaggaaauuuuccagguacaaacuuucuaaaacauaaauuuauuauagcuauuaaaaaugcaggcuuuuaaaaaaaaaaugcaggcuuuugcaaacuacagaaaacucuacauacauauucaguucuaauugugucugagguggaaaaugucugaagguuguugguguuccuuggcauuuugcuuaagcuuuuacaccuuuauguucagugagugucugguuuuuuucuaaguagguuuuccucuagcuuuucuuuugcugaucuggagagagagacacacacagacagagaggcggaacugacuaaggaccagacgucuaaggcgcauugugugcacuauacugcugagcgguuccuccagauacuguuuugcuuuugauaggauaaaauugauuuaaaaaguaguuuaucaguauuuacauucaugguaucauugucaacauuuuaugcugauaaaaacuaggaaauaaugguaaaugcuccagagucuuguguaaauaccaucaacaugaaaacgaaguauauuaucaagacuauugaguacagacaggaaagucaguuucucgaaguaugcuuuaauguguagacguacauuuaauacacagaaaauguauuuuuaucagguugacuauuuuacaacaugggaaaaugacgucauguauuuuuaaacaauuucaacuauugaaggacccauauuuccuagaagucuuaggauaucccuuuacagaucaaacaaacuuaacauuuuuguacaagaaaaaacaaaaccaguguacuguaacagugugggcuuauuuugaaucugaggcgagguacuaaugcugcaguauucagcaaguccacaagauggggcugucucacuggaaauuuuacuagcaugacuggccaugagcccagugaaguacuuuuugcuuucccauuucuauagcaggaacaugggggcugggggagugacaguguaauggaagguugaauuucuauucauuucauguuucauucauucauucauucauucauuugugugugggagugccacguggagacuaggaguuaaccuuggaugucauuucucagacauugucuuccuuggugguuuugagagcuguccuuuuuugguuaacuagaagauaagguuucucaguagcauguaacuuaccagaaggcucggccggccggccagugagcuccaaggagcugcacgcguuugccuugccagugcugagauuacagguaugugccagcauucaccgugugcauauguauucaugaguaagcagucuucccgucauagggaccuuuaucaucagggaaaaucgaaaccguagucauguaagugcacacaaucauaggacguaguauuuucagcuuuguaguuccuuugucuugcagauuuuuugcauguauguguguuugcauccacacagaguaucuggguagagggguguuguaagugaucuacuacugaucuuccagcucgcuccuauucguuuuuuugaagaaaaaaaaaaaaaaaccucauagauaacaagaagaaagaauuuuuuugucugcuuacauauuuuggcuuuaaaaauauuaaaugaaccaaauuugguggacaacacuuuuaaucccugcacuggggaggcagaggcagauuuaucucugagauggaggacagccuggucuacugagcuccaaggcagccaggguugcauagggagaacaccucucccccccaaaaaacaauaaguaaguaaguaaauaaauaaaaugguaaacauuugucuuaguuaggguuuuacugcugugaaccaacaccaugaccaaggcaacucuuauaaggacaacauuuaauuggggcuggccuacagguucagagguucaguccauuaucaucaaagugggaacaugacagcacccagguacgcauggugcaggaggagcugagaguucuacgucuucaucugaaggcugcuaguggaauacuggcuuccaggcaccuagggugagagucuuaagcccacacccacagugacacaccuacuccaacaaggccauaccuucuaauagugccacuuccugcccaaagcuuauacaaaccaucacaacauugcugauguaauuaaagauuaaaucuuuacgauaacaugcaaagguuuugcuuuaagcuguaacacuauagacuagcuuugaauucagaguucccauuugcuguaccuaacaucucuuaucaguuggcaggaaccuaugauauugucauagucagugcuaccucaaaaaccuagaucuuuugucucauuuacuuucaucugagcauuuuaaaauacagauuccugaugccagaaaucaggcugagaucuuugguggucgacacugugcucaacuuuggucucucucccucuuuuuuuuuuuuuucuccgagacaggguuucucuguauacuccuggcuguccuggaacucgcuauguagaccagucuggccucgaacucauaaauccgccugccucugccucccaagugcugggauuaaaggcaugcgcuaccacugcccggcaacuuuggucucuuaugaacuauuuugcuucucaucuuuuuacugaaagcaucuuauuauccuagauuaaaauuauguuuggucaucucuguugccaucagaguuaggguuacucugcucacucccaugcaccuaggcacugugcuauaaugcagugacauccguacugugaaacauuugccaagugaauccuaugcagaaucccuaaauaaaauagaucauaaaacuaauuuauucaaauuaaauauuuaaagcaaguuaauuagaaaacugggcuguuuugaagaauuuaugaaagugaaaguuauguguggggguuuugucuuuuauugucuauuguaaugcuaagugcugcccaaagaccuggagucugcacuuagccucugggaccugcucccaaguuaauuuugauugaugaauaaagaugccgacagccaauagguggccaggagagaggacugggauugagguuuugcagacuuggguggagaggaugaguaggagggccaaggagagcaaccauggacuaaggaccaagacgacguggccuagagggcugcccaguuggguuaagccaagaugggacauagaaaauacuaagugauaaccuggaguuacuaauaggaaagaagauucuaacagcaaggagcguagacagcugcccagcuacugugcugccuaaggcauauauaaaauauaaaggcuguauguguguuucauccaggaacauaauuuuuaauauuuuuuacuacaguuauguauuaagauuggagucuccagcuuauuuaagcaucucuaguuaguuuuauuauauaccaagaaaauuugucauuauaaauagaugcuaauguugcaaguuuuuaaacuuccuuuuugaugaugauauaguguuuaauuaaucuuaucuagaaacuuccaggauugauugggaaucuuuuuacuuagagagucaccaagcucgguccugcuucucuaacaugauucugucacucgggcacaaaacaguuuauacucugauugauacacucaugcuuggacacacaggcugugguaggagugugcuuucuuguguaaccuuaugaacaagaaauggcuuauauugucccagggucugaaacuguuuacugcucuaaagaugguuaaagagacccagaaggacaaagcugauaaacgaggcagacuaaagucucaugcacuagccaacuuuauucagaucaucagacaauuuauacuuguccaaucacaagagcaagcugcacguggcaaaaauauguuuuucccuagugcuguauagacaaagaacaauagcuaguuauaacgaauuaccugaaguaaacuuacucuuaucugcuacacuugggaggaacaugaaagcauaauccaaaaacaggucuguguuuuugaagaaacugaagucccaagauucuuguguugguuucuuggaguuuucuugcaagcacucagauucuccuuacaugacuccauucuuagaccauauucugacaaaacacaaguacaaagucaggaggacuuguucguagaacccucugagcuggugaugcuuagugugccaaaaccuaacacauaacacauaacagcauucuauuacauuauuucuuccauuuaaaaaacaugcaaguccgauggcagcaguggugcacaccuuuaaucccagcacucaggaggcaaaggcagccugaguucaaggccagccuggucuacagagugaguuccaggauagccaggguacacagagaaaccuggucucaaaaaaaaauccaagcaaacaacacacccuaaacuuaagcucuguagcugggauuugggaggacaggccaugcugacaaugcucaucuccacauccacccagaaagcuaaugaaaaacacuggcuaaagcuaaccugucguuucaggaucagaggcaaaggcagaggcagaggcagaggcagagagagaggcagaggcagaaggauauagaagagccaggcuucucuuagagguggaccuucaccuggaucacacacucaaaagauuaaagaaguagcaguggccuuugccaggugacaagauaauuaggcacucauaugucacuuggggagcagucaggugugcuucacauuaaguaaacacuacaguuauaugcuugcuggcuuauacugacuucaguguuuaugguaaggggcagugucugagaagcuagagaaguggcuugugguuaagaguacuagcuguucaggcagaggacccugguucaguucccagccauccagaauuccaaguccaggagaucugauuccucuucugacacucugcaccaaguaugcauauaaugcauauacauacauguaggcaaaacacccauacaugcaaauaauaaauacauaaauugauuuaaaaacauaauauuuguuuggagcaguaaauuaucucucuuucaccaacugguguuccagccagagugacaagacaagaaaaauagaaggaaccaaauuauauaguaguuguaaaacuaucucuaauuacagauacuaagauacuguauagagaguaucccaaaaagucuacaggagagcuacuaacaauaaauccaacaguguugaggauacagaucaacacaaaaaucauuuguguuucugaucucaugcuguagauaaucugaaaggguauuuuauuuaaccaaggcaguuaaagaauguccauuaaaagccacagcauugcuaaaagagaugaaggaagaugaaauaagugggaggacacucaguguucauggacgaggaaauuuaauaacuaggauauuguagcuaccugaaauucccuucagagccaguggaaaaaccuuugaaaaaucccaauaaccuucaugugaagaaagggcaacguuuuugaagaaaaacggaauucaaaggcucacacuucaaagcucacacaaccuacaguguggcagaguuaucaagaacacacacaaggcagucaaauagaacaaagccagacaacuauggcuacuaaggcaugucacuuggggcaagagugucaagucuguucaauagagaaagucugccuguucaacacacagcucuuggacaauagauucccauauucaucccuaccucacaacacagacaagaagaagucaacgugccccaccaauauuuuauuuaagauuuauuuauugauguauuaauuacacugugucugucuucagacacaccagaagaggacauuggaucgcauuacaaaugguugugagccaccauguaguugcugggaauugaacucagaaccucuggaaaagcagcuagugcuuuuaaucacugagccaucucuccagucccccaccuauucuuuuucaagcacaaaauuuugucagaaaggguaaaauuuuagaaagaauguguguauguguaugugugugugugucugugugugucugucuaucugucugucucuucacuuggcagauauuuauuaagcaacugugcuaugacagaauucuaggcacuggagauguacuaaaguuuugacaaaguuggagucaaaaccaacuuuaauggaagggacagucuggagagggaguaagauguuuaagaagauacuugcacuaguagguguacaucuggcgugcaggagaguaaggaccuuaggucugucauagaggaauacgagcguccuucagguaggcuucccuaagcaagagaauugugcugaaugcaaaggaugacugagaaguaagugggugaagacaggaggagagagugucuaggguuuugucugucuuuccaaagauauuaguaguaaaaaaaaaaaaugaguuuuauggggcuagagagauggugcaacaguuaagaguacguacugaacgccagaggacucaaguauaguuccuagcacacauauggcaguugacaaacuucugucccaugauuuuuugcacucaugugcacauauaucaacauucaggcauauacaccuauaauuuaugucauuuaaaauuacuuuuaaaaugaguugugugguaucuuuuguuucugacucuggcauuacaguggguggcuuuuguuguuuuuuccuucauugcuagugauugaaccuagggcuuugugggugcuaagcaagcacccuuucaugaagguacauccccagcacugagugggccuuucugucuguauuauugugagggucgucuggaaguuaaguuugucucaaguguaauacaguuccaaggcagaugagagcuuauaaagauguuuggauugccuagcauucgugaaacccugggcuugaucaucagugagugaaaauugggagguggagugggguggggggguaaaucuuaauuuuaauucuuuauuggauaaucacauuauuagaugaccaacuucagaaaaaauauaauguccguuucauaaguuauacauuauggaccuuuaagauauaaaauuuuccauuuaauuuugagccuuacuuugaauagaauugacaggaaugacuuauguaaauucugccaaguaauuuauuugugucuucuauaauaaagcacugucauuuaucaucaaaaugcuuuaacuuacauggauguuggcauuaacaagugcuguucgaucaguggcaucaaaagaaacuacacucaagcuuccugggagcucagugaugccuguacuguaaaaaugcuuucugugggccauuuaacugcuggcaacuuuaguucacaugauuccuagugcugaaaauuuaaauuugcucuuaauugaaaagugaaguuauuuaaauucuuuaaaugcuaaccuuuggaaaaaauaucugaaaaauaaaagcccauaugauuuugauggcccacugccaaaagauuaucauuuacauaaacgucucuuuuaacagaagggcuuaaugcauugagcucaaaagguuagaauagagacuccaaucuggagagcagcaguagacguuuggcuugugaacagccgcauuguucgccacgcugagaacacuguucgcauucaggcugaaagcaacgcuggcauuaggauucgguuaauuuguuucaugugacuugucagcuguguguuuuuaucuaaaucuuccuagccucuucuuuuuguguguuacacuucugagaaaugaacugccuuuuuaacuguuucauuucuaguguuuuuucuacguuugcaaaugauaccaugugaucguuuuccagguuuucauuacucauuaaauguacuuaauaaucagugaggaugcuguuuuacuuuauugaaagcaaugguaucuuaaagagcuuugugcugugugcauguuugagucuguagcaggagucugugagacucacacagaacugcucgcccuguuuucucacgagcacccauucuuuccuuguuugcuaauuuuguucucuggaucuucccucagaugacuuuuaauaucuggcuaccagccaaguacugggucucagcaauaaagugcugaucccaaagaaaagaugcagcuguugcuaaucuuaggguuccaucucacuugggaagagcaggcaaauguucuuuccccuaaaauggagcccuagugccacccaggagcacaggcucuugaguaacuggccagugcugugaggagagcuucuagagaugcuguuaccauaggaaacgugugcggaggcugugcggucucauggcuggcguuugccuaggucugcagagcuguccucccagucagagagguggccaugccaccacuaggcagguuuccuccagguucaucgugguccuguuacucuccuccucaccuccccaaguucccugggaacugugaucugcuuccuucacacuggccagauuccuuacuuaauauagcugauuaugagguuugccccugucaaguucaacacagucuacucccuuuuccuguucaguuguauucugugauaucagccuccauccacucuguacccaucacuuaguggacacuggcccuucucccaauucuccuguccaccuguuugagcaucuccguugugguuuucauugcuuuaucucuggagcauucgcucacacaucucagaucagcuuacuuacucccuggugguuaguagggagaacccagaagaacuggaacauucuggccauuuguuuacuuucaagacaauuucauauugaucauuguaacauugucuaguaaguguuuuuaaugacuaaaauucacuuauuuuuacauuugagaauuucugauugauucaaaauuauuuaugguuugaacucauauaaauaugaguuuauauauauacacacacacacauacauacauacauacacauacauacaauaaaagaguacaaauauauuacuauauuugauugacuaaaucuuauccuuuccaggcuaccuucuguguuuuaucauaucuauuauacaauaagcauauauuaguuuuacaauagaaaauagccuuuuauaaaggaaaaaaaaccugugcugacacuuuuuuaguuugugugauuuauuuaaaaagcuuuuucccugggggagggggggggaagagccacggugucacauugaaaaaucccagguugggcccccaauggaggagcuagagaaaauacccaaggagcuaaagggaucugcaaccccauagguggaacaacauuaugaacuaaccaguaccccggagcucuugacucuagcugcauauguaucaaaagauggccuagucggccaucacuggaaagagaggcccauuggacaugcaaacuuuauaugccccaguacaggggaacgccagggccaaaaagugggaguggguggguaggggaguggggggggguaugggggacuuuugggauagcauuggaaauguaaaugaggaaaauaccuaauaaaaauauuuuuaaaaaagaaaaaagaaaaaucccaggucucagcaccagccucucccucauugugugauaugggugcgcucauagcccaguucagucagcgagcaggagcaguuggcugugguguaccuggugugucuuccucuuucucauugucucucuaguccacacccaucagugcaguucugacuuccucacugucaccuuagucgucuugggacuguauuauuauuucccucuuuuagguucuuugaaggauauuuuugaaaugagagccaguguguaaugugcuccuuguggacagaagcaacaagguuuaagaaugaagaauuugauagcagcauuaauggauuuuucauuucuuucuuuuugaagaauaucaaagaauaucccaacaacuaaagauguugagccacuucuugaaauugauggagauauaagaaauuuugaaguguuuuugucuucaaggacuccaguucuuguggcucgagauguaaagaccuuuuugccaugcacgguaaaccuggaucccaaacuacgggagaucauugcagguggguauuguaguacagcuuuuuuuuucuuaaaaguccucaauuuuuuuucauguucuguuccuucucuucucucccccucucaccucuuuccuucuuuccuucuuuccuucuuucuuucuuucuuucuuucuuucuuucuuucuuucuuucuuucuuucuuucuuucuuucuuuuuguuuuuuucuuucuguuguuaucuuacuuagcuaucuaauuuuuaucuugcuuuaugaaaaauuaagaaauuugaauggagcauccacagagaaauuaguuagaguaggacugggcuguugaccucucagagugucagcuauuuacucuacuguguccuugugcuugcucaccaacucaguucucccuuuggaacccugaacuucuguucuuucacauauagucuugacgcucagaugccacauguuguaauugucacucuuucaucuucuguucuaauagggacauccaaguugagcagaaaacaaaaauaaaacuuuacuuucaucuuaaguuuuuaaccagggcuugaauauaacaaggguuaauuuauuuuaaggccaugcuagggacuaagcccaggccuugggcaugcuaggcaaacacucugucacugacuguggccucaccucuuuucacuuucauuuugagguaaggucucaguaaauugccuaaccuggccuuaaacuuuuuuugcauccugguuuuagagcucagauggguuuuagagaggcuauugagaggccggugugcacuggagagaggccggugugcacuggagcaugcgcagcuguguuggaacacaaggguuucaugugauacugcucaucagaccauaacugagcuuucugggacuuauggaggggucgccuucaauuaguccuguaaaguguaagagcuucccagguacacucugcgcuugcccauguguggaugcugagggaggauagagcaggcagacaaggggcaaugggaugagucagggagugggcacagagguacauuggguggggggauaauuccugacucuccuuacacagucaggugauuaccacuaacuaugacuuaaugacuguuucaaaagacccagaagaggccauuucaaauggucucaucgcagaaaaaugaagaguguuugaagugauggauauguccauuuccccaguuugagcauuaugcaauauauacaucuauuaagggagcauauugugccauaaacaugaaguuauuauguaacaacaaaaaaucccagccccccaguucuuuuucucaguguuuacucuaaggcuggaggcuuuuguggcugucugcucuguguugagaggucgacuugucucaguuuguaggcucacaguuuagcucacauuguauguauuagacaaauuugagucuuuuguuagcauaacacaaauagaucuuuaaagagucaaaaauuauaguguuugguaacugaagaaagaauccaagugugguaacuauucaaaugguuaagaaaaaaaaaccucuuuuauguacaucaauugggcuuuuuuuuuuuuuccacuuaaagccuguggacuagcgaagauuuccugucaaacucagcuggagucacuagcagugaugaaaguauguccuuacuuaguagcuggcaacaggacucaucauuaguguccuguucuuuuuugcuuuuuggguugugauggaauuuucagauguucgagcugcaagagaacagaucaacauaggaggccuugcguaucccccgcucccucugcacgaagccccuccucggccuccuucuggguacagucagccugcaucugucugcuccuccucagcaucuuucaaugggccguucccaggcggcguuguguccccacagccccacagcagcuacuacagcggccugucgggaccccagcacccuuucuacaacaggguaagagucggcaccucgccuuuacagugucucuucccaggggcaccaucauucugccaucuccaggcuugggcacugguuuggagcuauaauuuggcuuuaaaauaggaaagucuaaggcuuaaauguacaaguguaugauuuuuuuuuaaaacugagucuuggauuuuaauauguucuagaguucuaaagagugugaauauaagaauauuggcuuuuauuuucuuguuaaaggaaacacuguaacaacaaugguuccuuugguauauuuuguuauagaaauuuauauuggcauucauaacagugauaaauuccuagagucauucauauccuuagacauaugugaaauaauaacgggcccauauuacuugaaggaucaaauguuauugccaguuaauuccaccauaugccauuuuaauuuuaaauaccuuuagucauauauaauucuuugcuuaauacacaauuuauuaacuaaaaaauaaaagcacaguuuccagugguacccaaaccauguuggauguaguugcucgaagugucuguucucaucuuaaugcccuaaucguguaaugacacuaaugauuuccuguaggaagacggaucaugagcuguaguaugcuuuguggaauccuacuuuuaaaauccauuguagguuuuaauccuccuuuucucccugguuaguguauaaggaaaacacaggcuaauauucauagaggacaacugacugcaggacuuuauccauaggagcuggcaaggaagaguuuggggaaaguguggcaaagaaggaguugagaauuuaaauuaaauuguuauuuuuuaaauaucuauauugguaauuagcuuuguuguuuguagagccuuagaaauguaauaccauuuuucuguguggacaagacaacacaggagcacucaugagaauguuuguucucugucaaaauuaacugugugguaggugguguggaauauagaucugcagucacuagucuuaaaaucugcugcaauuuuacauaagguggcucaauuaauacuaauuagaggugugaaaauauauuuauuugaaaaaaguuaugaaacuaugcugguaucuuacauucaucauucauuuauuuuaagagcaacaauguaauauaauuuuaaaguaucuaauuauuuuuaagacauuaaaguuucucuuauguuuuuagguuuaguguuucuguuauuauuuaaugguauuauucauacaguugaaagucauaguaauucuauucucuuaaagugccagaguaaagaagagagaagcggccaccucagugcagagaagccuaaugaauucugaccuuuauguuuccagucccuagaaucugaugugugaaaccagcuacauguaaauucggaaguuaagucuuguguagcuagcaggcuccccgucucauagucuagcgugcacuccggugccgggacacagcugagcuccagggccccccagugagguuguccuuggaaacacugacacuuguuuccaagugaccagggcaguuuugagucuuaguaacuauuuuuuuuuuuuuuugguaaggcagaguauucuguuaacauucuagucaguuuuaaagaagaauuuguuaguuaauacauagaaaccauguacagcaaacuuguuaagaugcuaaauauaaagcaaauguuuguguuaagucacgagguacaaaacuugagcuguguuuuaagccuaugucugaugaaggaggcagugucauuguccuaacucuggucuggaucucaaggccagcgggagcaugagacuuuuguuuugucacuugcuuuugaaguuuggaguuguguugguuaguuucacuugaugacucucauuacacuuugauuucuguaauuguucaugcccuuuuuuuguuacauguuucuccauagccauucuuugccccauaccuuuacacgccaagguauuacccuggcgguucccaacaucucaucucacguucaucaguaaaaacgaguuugcccagagaucagaacaauggccuaguaaguauauaaagggguaacuaaaauauuaaucucauaaaagaacauggauaccauuaaaagcucuuuuuccuuuuccuuucuggaguaaaagaguacaacuuacuguauaguuuugaaaaacaagcuauuacaaauauaaacuguauguuuucauuucugguaaauaucuaugcaagacuagccaucucagugacuaaacguugaguuuuuacaaccagagaucucuggcuuguaaugcaguguuugcuaccaaaacuucucaaacuagaucuuuauaacugcuaauuucugguaucuuuuuaaagggcuugcauguucucucucugugcauuuacauuggcauuacggcuuagcagauagaggugcagcaccaggaaagcauuccagucugcugcagggagucugcagagugagguuguuuaaacauacuauugaguagaauuaauccaaaacaaaacacaucugugcaaaauauaguaggggcuccugaugauaaacuucaaauaacuauaaaaaacaaguucccugauaacauaauuuaagcuacauuuuagagugguggaaggggaauuucugucagaguuaucuguguuguuaucucagcaucguguuccuucaucuuccaugucacucauccugcccuguuacucacucuccuguuuuauguugcuaggagguaaucaaggaggaugcugcugagggccuuccuucacccacagccuccucgaggguaauggguaacuuucuuguggcguggaacacuagugucucguugcuucugcagcaguaaugaugucuuaaagcauuuggcacuaacucacuuauggugugaugggcaguguagaguagccaagcacuaauaauuacagcucaugaguucauuccagagcuaauguuuccuccugcauuuccccuuucucagagaugugagagggcuuauuuucuucaguaaggaagggcugcuuccaggagucaucacacguguucagauggauuuuuccuuagugccaaacguuguuuuccuuucuaaguguuuuuuuauaaagucuauacuuggugugauucuuguagaauggcuuugaaagugucacacaucaccuuugacacaggaggacacaggagccgggugcugcaaaucagcaugucccuagcuccucacuugcuucagugucuccaccgauggcaucuuccugcagcacuacuuucuccuucuguuagucaugaaaauaaaccaucuagacagacccagcacuggcucagcaucuaaaggaaguuguuuaacaguacauaaccacacaacagauuguagaggaagccacuaaaguaauaauccuuccagaccuuauauuuaauaagaaaugccugcaaugagcagccauaaaaucguacuuuagucagucaguaugcaguugaggaacccagcuuguguguuaugcucagaguauguuaucacgugcaaacauggucucucugaucuagaccuauucuaaaaugcucuaagcaccggagaauuacaggcugagguauuacauccugaguuuaucaagaacauuuaacuuaacacguauauuuaaauaggugauaaauuuuuaaaccuucauuuccuuuuaauuaaucuaguuaagagacaaaaauggaaccauuuuguuguuuucaaugaggagaugauucuuaagucauugacauucuagcugaaauguuuguguaauucaauuauuuacaaaugacaggcauacugagucacagcagucccguuugggugcuuagggacucuguggccuauggacgaucaacauuguaugcaaaagugacuuucaguuuauucagagagccuuugcuacaggggauuaugugugcaauucaguucuagagacuaaaauuacucagugaauuucugaugaaaaucugauauuacgaaagauuuaaugcuuuugaugaauacagaaauacuagcucuuccuguguacggaaauguaggcaaacacuuguaauuaaaaugugucaguaaauuguuuuuucuggguccauuaaggagagcauucuacacgguuugaaauaagguuucuuuuuuuuggggggggggggcaaggggaauaaugcaguucccgagccaugcuuagaagcucaauacuagcacauaaaggcacgucacauagggcagcgucugugucagugaguaacacaccucucguucuuagcacuaaaagguagcuuguagcugguagaguagauaauagaugcucaccaugcuucuugugcuucuaagaaauuaauagugacaacagcugguaacuuguguccuguagaagacuaggaaaagcaagcugacauuuguucaaagccaaugaaagcagugauggaaacuaaagaaccugccagucuuaggccuugagacuccaugaccacagcaaugcuuauaaaggaaacaucucacuggggcuggccuacagguucagagguucaguccauuaucaucauggugggaaacauggcaguauccaggcagacaugaugcuggagaaggaauugagaguuguacaucuggauuggcagacaggaaagagagagggagagagagagagagacagagaaagagagagacagagacagagacagagaaagagagagacagagaugacagagacagacagagcaggggagggaagaagguggacagauagacugacugacagacugcugacuaggccuggguugaacauuugaaaccucaaagccuagcucccaauggcacacuuccucuaagaaagucacaccuaguucaacaaggugacaccucguaauagugacacucccuagugaccaagcauucaaauuuaugagcuuuuggggcucauucugccacacugcuagcugaaccagcagccaacgggggagucaguggcccuuugugcuggacgcgcacagcaaggcugguuauuggucuugucucuuuggccagcaagcauaaacacauagacaugaugagaaaggccacuggcagauaacuaggagauaaaugaacauuucauaacaaauugugauauuauuacagacccaugauaacauacaaagagaugaggccaaaaaguuaaccgacuauggucuuugcaaaauuuagaugaacucaccuguuuuuaccacucaaaaauuuugacaaaccuuuggaaagcaaaccuuuguggaaaugauaaguuugcucacacuaacauuauagaggucguggccuacaaaguacagccaaaccagcagguagguuauagauaacuaucugagugucucaccaaguaggggcuuggaauagaagcuccgugcugguuuugcucccuauaauuuuauggcugagagaacaugcaugccagaucuugugaaagugaagguacgcucucagaccugagauacgcucuuagagcguuagaguuggaaaggacgaguguauccuuguccgaagguagaggacuccuuucucauaauugaaguuuaaucuguacuugaguucauaagagcagcccgugggccagcuucagcuucccuuuucuccugaugcuuccuuaggcacagcuuggauccuggggucuggucuagcuuccauggagcaagugaaauauaggggcuuacaccaggacacaggagcaggagccagaugaggccaucccuguggccugccuugcccauucccagaaugugaacaggcugcagccuuugugguuaauaggucaugugauacauuccugcccuugcagaggccacccugauucugugcuuuaccaccugaaaaggcaggccaguuucuuugguuugauuucgggaauacuaaagcucagcauauuuaauuacauuauuacuaagauuacccagguccuuaaagacagaacucaaacugcuucaguugggugaaguuggcuaucgguggaaagcaguguccgugcucacagccaguuuagauuagcacagguguuucauuuauugauguuucuuaggugcaagaggcauaauuuagauaaguuuugagguuuugcaaaugcccguacaucucuuaaggacaggaaugaucugggaaucccauaggcaguccucugcacauagaguacacuuagacagacuaaggcagcuacaccaucauuagguuggccugccauuaacauggucucagguugccugaagugcugcgagccuccugacuguguuagggaauuugaagcuuuccuggaugauuacacuacucucaccagcguggccuuuggccucuacauagacuugaacucuguggccccacagagcugugaauugcuuugaggaaaaagauuuacaaaguucgcaaaacacucugagaaggcauugucuagaaauacuggaaaaguaagggagaaugguuugucauaaaugcauaaaauguauaguaaaaguaauacacacacauacauauauauguauauaugugugugugugugcauauauauacauauauauauauauauauauauauauauauauguucuaaauaauuaaaauguauccaaguuuaugaacaccaagaccauugcauaguacacuugaaaugagagaaacguaaaugcaguugaggcacagugugaggcccuaacuggcugucagagccaucuccugcugcuucaugagcucaagaguuagcuuaagaugcugugggaguacaggaagauuaucugcccaggaagcugcauacaaagguaucuuuuguauaauauauguagcaugcaaaguaagggcugacccauugcucucagguaggcuucugcuuaggagcaagcuacuagcaagaguuuuagggagccaagagcucuauccagauuccugacuuugggucguugguucccuaacuccacauugcucaggagucagcucuaguggcaaggagaaucuucugaugcccucaggguaggaagggccccuuauggagggcccauugugggcuaggucuccagagagacauucuguuggugacccagagaugcucuagagagcagcuuccaguuugcugcucgugaugaggacugaauuucauuggcagacaguuuuucccucaaaggaaggaaaaccauagcauuucuucaucuuucuaaacguuguauuuauuuuugucuuccuuacugacguagcagugugugcuccuggcagucguugucccaucauauugauugagcguguagaggcccucucuggugggauagagcaggagacaauggggcauccuguccucauagcccguggguucucaggcuuccaagggcucagcagugucagucuuucuugaccucuaggagaucacuucuauacaucacugaaaagacaugacaguauuuacuaucaaguuuaauugcaaacaaauuucagaauuaaauaggcaauauuaaaauaacuucacaauuuccagugucuucuuacuauuacguuuagagauugaagaaaacucuugauuuaauaacagcauuacaaacgaagguccgagcuuuuacucagcaggcuccagcucaugcaguuagguguaaaaagcugucgcuucuugaagguacuuuauauccaucauugcuuuuagagcuugcaaauuguguucaaggcaacaucuguccgaaccaagcugucucuuguuugcucaggagaagagcuggacaagaaagcagcugauggagguaaggagucaggcacuguagacguccuuuagacuguaggugacacaugcacccucacccucagagacuuccugcaguagugucaaccagcuggaacauuaugcacccuuuuaacaguacuuacgaagugguuuuuauuauucuacuugaacuagggggaagugcuaggggcuucuccccccuuuauugaaauauagccaagaauauauuuacuuucugcauggaagucuuuaugccagguuucaauucaauuuuuuuucucugaauuucagguaaauggacugaaauauuuuuuauaggugguauuauaguaauguugaaguccuagguauagcuagacauuaaaaaguguguggggugggguggaaagaugguacaguggcugagagcacugacccucuggaggacccagguucgaauuccagccagcaccacauggcuguucgacuuguaacaccagucccagggcauccauuggccuccacgagcacugcauuaauauauauacacagaugcagucaaaacauccauacacauacaaauaaauaaaauguaaaacacuuuaagguuacaaagcagacgaacauguugcuacuuguuuucccuccuuugaauugcaguccuuaagcuauaguguucagccuucuaagccucguccaucagccuugacagaguuguuucuccagcacuuugaagaauaaguuauguagugaucauaauagcacaggagggagaagagucaaaguugcauuuacagcuaauuaacgcuugugcuucuuguuuggggccuuccuacagugguuaccgcuccacugcacuugucugauaccucugcucauccaagugugcauguguguacagucaccuucuagaagcuugccugagucugacaguaaacaguagacgagguucccacuguggauuugauauuggucguguucacagauggacgucugagcguaggcuacugaacccugccccuuguucacuaaaacaccguguucaguugacuguaugaauuugucagucaucaguagacuguuuuaagcauuuaaaaauauuugccacugauuuuuuuuuaaguacagaagaauaauuaacaacagugguuguugcuuugaaauagaauucuuaaagcuuuacaguaugucaaucaaagaauguggcuuuuuuuuuuaacauuucugauuuguugggcuguaagacauuucaagacauuuuuuugaauaggccauugaagcaucugucagaaucaacauagucaaugaagcaacacauauuuaaagauguguuucuuacuacuaacuaucuuuuaagguagucuacacaauuaagccuuauaaauguuuugacaauuuuaacauuauauagaaagaauauuggcuuuucauggaaaaguaugauuuaccuaguuuuccuguugaauguaucaugcaugauuuauuuuuuaaugaaaaauuuaaaauuucuaaguaucuacuaauaaaacgguuccacguguggaugguccuugcuccaugcugcugauaccaagguuuguccagaguugaggggaaauaaaaggcuuggcaagggcucugcauauauaugugauaugugugcuuugaugauuuauuucauauucauggucuucacucuguuuuauuccuuccuuaaagcugugugacucuggguuuaacaaacagagacagguacagaaacuccuggugaaaucucacuuacccuacuagguuguuagauggucaucggcuacuucaugcugggcuguuuauagaucugugcucauucugugucuuggguuuauuuccauaguugcuuucagccucugcauggcagucauugcugacuaaucaguuuuuagcuuaucuaauaaauugacugaagaugugguauuucagaguguacuguuaaucuacugacaccagaaagcaaacccgccaccucagguaacuagugcuuucauagcuuugcucccauuggaggaauucugauuaagacucauuuugaagcuuccaucuaaugguuuaaaacaagcuaaugugugcugcguugaguucuccaaguaagaaaaauuaauaaauaaauucugacauagaaaaccaguuuacugaagcgaucuguucuggauuacacagguggauuucaagagagacagcacaugcauguuaaaggauuagccuuuggauucuuuguucccucucaauauaauuaguuucuuuuaagaauuuagcaacuuaauguuuauauuccucuuaugauauuucaauuaaaauucauuauuucagcuauaagguucauuuaauuuaaaaguaauuuuaguauauaauauuacuuuagaaaaggcuuggaaagugauucacauuucuccuucauucaaagaaacuauuggaacauauaugguuuuuaaauuaguaacuuauugcuugauaaagaccaacguacacauaggagucagacgugcucuucacuccguggcugagguggccucugcuaggugucaauacuuuacagcguucuuccuuucuauuuuuaaacuaaugcacucuugggguagacauuugaaacucugcaauguccuguucaacuugcuuggcuuuugcccuuuaauugauggccauugauggaguuuauaauacagcugcuguaguggugguguuugccugguggggauuucuguuucucucugccaugugcauuaguuggaauucuaugaggaaaaguguuuucuuccuaauucauccuaauucauuuacuuaaguauuuaguuuuaaggcugagcauggugguacacgccuuuaguuucaguacuugggaggcagagaccagccaaucucuguaaguucaaggccagccuagucuacauaguuccaggacagccagagcuacauagagagaucuugucuuaaaaaaaaaaaaaaaaaaaaaaaaggucuuaucaguaugaauucauggauuuuuuuucugugaacuauuauaauaucauaauuuauauuugucaaucaaauauuuauuuugugauuuuugaaacaaaaaagaaaguaagccaauguaaauauauugaaaguaaggacccaaguuaaaggauugguugacauuuaaaggaaugguauuauuuaacaguaaaaggaagugaagugugacaagaugaaugaaugagccuuaaaacaacacaccgugagagucggacagggagggucacacaccguagaaagugccugcaauagacacuucaaacacgggguugccugggacuagggugguguugaaggaauuggaguaacuaaugggaacaguuucuuuugagggugauggcucacaaacuauguaaauaaaguuaaagucauugaauuguacauuuaauguggaaguuccacggcauguggagaggaaaucagcaugguuuuaaaauucacauagcugagagugcauagugaaaacacuggcugacuuacuagacagaaaaaagagccaugugcaaaguuaugaagaccaaagugugaaagacuggucuucuguuguuauuauuuuuuuuuuuuuuuaaagugaagcaccaguucauuuuuuuuuuuuaaagauuuauuuauuuauuacauguaaguacacuguagcugucuucagacauuccagaagagggcgucagaucucguuacagaugguugugaaccaccaugugguugcugggauuugaacucuggaccuuuggaagagcagucgggugcucuuacccacugagccaucucaccagccccuguuguuauuauuuuaacagcagcucaacccugaaucguguacaauguggcacaguuuaugguuaaauaaaaacaaacuauaaauaaguguauuuggugcagcuuguuccaggucaucuguucccaaacuucgauauaccuguguugccuuuguagagcuagguagagucccugacucauaaagucaccguuccugcugucugagucuccauucccaucugaaacaccuaggugcaugcacacucuuaacacacaugcacauauaugcaugcacauacaugcaugugcaugcaacaugcacacaaacacacaugugcacaugcauguguauguauuucugugguagugcaacuauuuuuucacauuacaaauuaacauucacugugcuucccagguauuuuuaaacuaugggauagucuauugucuccugacaccaguaaaagagucagucggacauaagugaaauauuuauuuacccucccccaccuggcaguccaggaauucacuguguagguggcuuugaacuaagagaaguccaccugccucugcuuccugaggacuaggacuaaaggccugagccaccacucccagccagaggugauaaaucuuauuucccacaugaagaguauguugaaggcugaacagggcgauuucuuggauaguuuuaaaaccuuagacuaccaagguaguguguagaauaguuaagauauuugauauagacacuugaagaaaguuagucuuagacaugucuuugugcucuguaaguguaauuuucuucuuuucuauucccuuaaguucucucccucuuacugagggcagugcccuuauuucuuaaaguuaaguggaauuauuugaggacuugacauaggccugggccacaggauggccaucuuguaaaagugcuuugggucaggcugucucuacuguaauaaaugcuacucguuacaugucagauagcugaaucuguuuauuaagaucuuuuuuuucuuaaauucuauaugcauuggcugugauuucuuuauuucagcaguauaacuagaugaauuuuucugucacaugaccucaaacacuucauauuaauguuacucauauuucccuugacuuaucuaggcauccgucccugccacaggcaccucucuguuacugaguucaaugacuguggauaucgugugugagaaacugagacagauagaagggcuggaccagggcaugcugccucaguauugcacaaccaucaaaaaggugauguguguuugcaucuauguagauaucucuaagugaaauggugcuuucuuuuuuagaacuacucuuuuuuauaauuuuaugaguagauuaaagaaagaguagcugaauuacagcgcuacuuaaccagugucuaauauaauuaaaaauaaaauagcaugguggaaaauacaagagcucauucaccguggagcagagagcauugagcggcugcuugguacauccauuaccuucagcugcacacaguauuauucaucuccaaucuggaaccucuggaauaggaaacucuuuugagcguggaggucaguauaagucagauaucagagccuuugauuguuggacuuugugcugggugcucagugaguaaaacuugaaugaauaucccuuccucagugggaagcacugcacuuggaagcaguuuuggucccaagcauuugggaaggauaccuggccuguauguguuugugugacuucguaguaauuagagagugagcaucauuuccuacaaguugucauuuuguaucauguacaauuuaugauuauaucauauuugaagaaccauauagguugggcuugcaaggcugaugcauccaugaaggguuuuuuucuuccagccuuuauaguuccagaaucaacgccgaagcugaaugcaccuccgagcaaggcauugccugcgugaaguuaacugagugcgagccucuacugcuuaugcccuugaaaggaucacgugcauuuucaugugcaguuuuacugaccuaagccugcauuugggcgggaguuuagcacaggcccauuuucuuacaaaccuaauccaugucuaucccugucugugugcgucaguaccuccuuuccacccaccaguuccacuccuccaggugaccgcaagugucagggaagcccgcucucaucugccgagcacaggcucucugugcuuguuccuuugcguuaacuuggaaauggagcaucuuaccacuaccagacacaaugcuaccauuuuuaccaguuagcagucagacuuuuuuuuucuuucauaaaaucagaaggccacccuauaauuaugcuacuguuucucauuuaagugcaguuaaaauuacagggauccaaaacauugcaaaccuauuuuuauccuaacuuuaaugggcugggcagauaguagcuggacauuguguauccauuagaaguggagcuggccuguuagacacacuucauuuagaucuucacaacuaacacccucgcaagccuagaaaucaguuuugcuucuagcagccguauucaucuuaauauuuucucagauuauaauaggaaaaguaaugguuuuauugcugcccaggacagaucagggggaaacauuugagagucucauuggucuugaagugugguuuguuucacugaaaugcuugacacuuaggaaaaugucaagugguugguguggcccgggauacccaacucauuauauugcauggagagagauggccgcucugagcgcagccgcucugcaaacgggguagaagcgguccuguaaccacuggugauucagagcacucuagauuuuguuucuguuuucacucaggcaaacauaaauggccggguauuggcucaguguaauauugaugagcugaagaaagagauggcuaugaacuuuggagacuggcaucuuuuuagaagcaugguaagguuuuugccacguuaccuuacuacagcccuuuauccuacuguguaaaguagucugcaacauuguagaaacccaguacgaagaaguacuggccagaagugauacauuuuccauauuaauuuuaaaaacguuugcauuuuguguguuuuuuaauugaguaaacuuauagucaacccaguauuacggggaauaguugcaacagcauguggaaucuugucuuuucugaggaagaagcaauucacugguuucccauacuuuuauuuaauaaaacauguucuccuugaucaagccaugggccccaagccccuaggccuccaccuucagugucuguccuuguccggugcucuguguuaggcaacaauacacaggagccacuuuagaaagagcccagcuugaacccgagcacgcccuuggugcuccucugguuuccucuuaucuucuguccacucccagcugaggucucaucacccggcuugucuucagaaaucuugucaaauugguuuacccagaaucucuugaaagcugaccuuccccgccccacgcucccugacucuuaagcauccacuuggugcuguuuuggaguagaauuguucuauacugaggucagcgucccuaucauuguaagucucaaugcuuucugcuuggcucuggcuuucuuuacacacuccacuugaauuuugguuuuuaaguuuuaaaaguuguacacuaaaugcggauacuucucuuagcauuguuaauaggauuaagguaagauuuggcauaacgucacuggaccaucgcagugggcagugugcuuucuugacccucuugcaggaacaguacuguccuguacuuuagcgcucucugaagccucuguaaugggguuugacgaugcaaacaaugauucuucuucucccaaggucuuagaaaugagaaguguggaaaaccaggugguccccgaagacccacguuuucucaaugaaaacuccagugcccccguugcucauggggaaucugcucgccgcacuucucacagugaacugccccacacggagcuuuccagccagacucccuacacccugaacuucagcuuugaagaacugaacacgcuuggccuagacgagggagccccacggcacaguaaucugaguuggcagguauuuauuuugugucauuuuucauauaauuggagaauaaagacugcagauauucuggugcauuaaaacacucauucaggcaguguugcuugagaacccagcugggcaagagcaagggccaucuacugaaggaguuggguuuauuuugaaggggaagaaauacagaagcaaaauacagaggaaguuaaguuauucagaauugacaggaagagugaaagcagucccagaagacaaugguaggagaguaagaauggggggcugggccugauggugcacgccuuugaucccagcacuccggaggcagaggcaggaggaucucugaguucgaguccagccuugucuacauagagugaggauggggcuguguuagggugguugcaaacuuuccuuucuuuugguauuuuccugugggauaugguaauuaccagccaaagugcaccuguauggaagacuagcuuccugcuguccuacugacaccuucaguuugguuccccaagucacauacauaggagcacgcacuacgcaucccacuuauucuuucucucauguugcucaggcuggccuucaaccccagggcucaagagauuccccugccucagcagcagccugugugguaggaccacaggccuguaccacgucuucuguggggauauucuuagaggugugcaggcgucagaagcagaaguacaagugggguaugcgugaggaggagggaagaggaagaaggagggggagaaccagagcagugugcagaggagcagugaggaaguaacagcaaggaagcugugcucuggacggaggggaagaccaagccuggcgggugcuccugggagggcuuuugucuggcagugaaaauauuuuuaauuuucuccauacugugugccuuaagugaagaagucauuuuuuauuauuauuaaauacugacuauuguaagaauugcuuuacagugugcucaguucauacuugguccuuuggugucuuuguuccgacagacguaguuccuuuccuuuccagcuuucugagaaacugcuccuccuuacuccccugcaggugcuuccuccuguacccuuccauccucacugccugccugccugccugcggcucucacagcccuuugagcuuagccuuuguucuuagccuuaggcaggucucugggcuggcaagaugacucagcaauaaagaugcuccuacaacccagugaccugagugugauccaucccugggacccacaugcuuuaaggaaaaaaaaccaacuccucaaaguuguccucucaccuacacacacacacacacacacacacacacacacacacacacacacguaauaaaaauuaucagggcccagaaaacuuuugcauauguaaguuacuauaaauagcuaaauagaaccugaaaauguuucuaaauauuuuaaguaauuauauacuagcauaaauaauauuuuuauaaaaaaugcuacuuuuucaaacaaaaccguccagugggaaugggaauguuuuaacauaucuuuaugauugucuucauagaagacugcuggguccccaguugcuccuucccucacaucuccugagacaacacacauacauguagcucugggcacuccgugaaugaaggagagaaggcacagaccaccaucauguccugcagagugcaguucaggacacauggguccccuguacaggggccccacagccuuugaggagagcugcauuagugggugggggagguaucacuccucuagucugacagcauccugugggaccucuucaaggagacagaugcugucuccuuuccagagaaaagauggucucgccucucucugugccuggguucuagccuuuccuguggucugauuguaaacucucuugacgcugcuucuuucuuccccuguuucuuuuuucuaaucuguacuuuuaauuguucauuuguuagcguuucuacagucuaaagcagcuggucccuuaaagcccaguacuagaaacugaacuuaagucucccguccugauuucccugggguccagcgaacccacagcuucuguugagguucauugcaaaucuguguuauccccccaccccccauuuuaagaacauuucuuucucugaauuaaaauuggacaggaacuuccaauuuugucaaauaauuugagacagguuccuuuauuguaccuuaaagacuuuguuuuguuuuugcagucugucuuuguuucuucuuuaucucuucuaagaggaauucuuucuagaaggugcuuuuaccuuaaauaaaacaacuugaaauuacuaaacacaaaugcucagaugacuucuacaaccugaaauuguucuuuuaaauauaaacaguaaauuaauguugcuaaaaauuucuaagcuaauuacagaauuauucaugaacucauagcuuuuguuaaacuguuaggucgauuuuuuaagacccuagaauugugauaacuuuuacauuauuaguauacauauguguuuccuaagcugauguuuauuauguauuuccccuucuuauuugaauucuuaaauuuuuuuuuucugucuucacagucacaaacucgcagaaccccaagucucucgagucucaauucccaggacuccaguauugaaauuucaaagcuuacugauaaggugcaggccgaguauagagaugccuauagagaguacauugcucagaugucccaguuagaagggggcacagggucgucaacaauaagcggcagaucuucuccacacagcacauacuacauaggucagaguucuucagggggcuccauucauucuaaucuagaacaagaaagggggaaggagaaugagcuaaagcaggaggaggggcggaagucauuuuuaaugaagaggggggauguccuagauuacuccucaucagggguguccacuaaugaggccucaccccuggaccccauuacugaggaagaugagaaauccgaccagucagguaguaagcugcucccaggcaagaagucuucagaacggccuagucucuuccagacagacuugaagcuuaagggaaguggucugcgcuaccagaaacugcccagugaugaagaugagucugggacagaagagucagauaauaccccacugcucaaagaugauaaggauaaaaaggccgaaggcaaagcagagagaguggcuaagucuccagagcacagcgucgagccuaucagaacauucaucaaagcaaaagaguauuugucggacgcccuccucgacaagaaagauuccuccgauucgggagugagguccaaugagaguucucccaaccacucucuccacaaugaggcagcggaugacucccagcuggaaaaggcgaaucucaucgagcuugaagaugagggccacagugggaagcgagggaugccacacagucugaguggccugcaagauccugucauagcucggauguccauuugcucggaagacaagaaaagccccucugagugcagccugaucgcuagcagcccugaagaaagcuggccuucgugccagaaggccuacaaucuaaaccgaacacccagcacugugacucugaacaacaacacugcgcccaccaacagagccaaucagaacuuugaugagauagagggagucagggaaacaucccaggucauuuugaggccugggcccagucccaacccaacugcugugcagaaugaaaaccugaagagcauggcgcacaagcgaagccagcgcuccaguuacaccaggcucucgaaagaugcgucugagcugcaugcagccuccucagauagcacgggcuuuggggaagagagagaaagcauucucugaggaagagagaagugaaguagcguuguccuaccugaggacaagagugucauaagcuuugaguugacccauccucauuacucaucguguuuaugcaucacagacaccugauagguggcaggcacuggggaagcagacgggaaagccugacaggacggucaccagucaucuccauugucaccgucaccacaggcacuuuaacgucucacuaccacugcugugcccuuuccugacgcacagcucugcagagaugagaucaggcugaauacagagagaggucggaaauguauuuaaauugaaagggcuuaagucacaaggaaauaaacccagagaucuccuuuauaaacuauucauguaacauuugaggggagauauaguauuagaugaagcagaaaccaauuucacugguaguguuuaaucuuggugcagauuuauagguuuuagaguagcccagaaacuaaaagugaauaccuagcaaauggauagccaguguucuguauaagaaucauugcuuuuaagaggucuuaaaauuuaaguagaaaauacauacuaaagagggcguaaaaguugaugauuaagugaguuagcagagcccaaagcaguggccugggccauggugagucguuagcagaggaguuggaggagggcaguguauuccugggauacucuuuccaacccagcccuggcuuccgacaccacccaccugugcccucaaaaccaucuuagucuguucugcagcuacuaaguaaugcucauggcuaaagaaaaguuagugguacuggugaugaaacgcaggaccucacagaucuaaguccucuagugacuagcuacguccccagccccaagugcuaggccuuuccuuccuccagagauuugggaagacauuaaaggaguuagugacggugguacuagacaaaugacaguauuuaguuugcuaacauuaaaucacugccucuguacugcaauuauuuaacguaucuguuccuaaaucagcauuuuaguucuggggagggggguggauuauaaaaauggaggcaugguuuuaaaaaggaauuugaaagcauacaacaaagcaagaauagaggcggagcuggugugaccuugacacuuuuauuauucuuagcagagcuaggagaaugaccacauacauuuaggcuagaggugugccugucuucauccugcauugaaacuguuugucauuugaucauaguguguuuacguagaucagcucuagugguguguccugagccauggguagaauuguagaugguaagguugcaggcuuagugcucagugagauguccaucacugacuggaccugugugguucacuugacacugugcucauagcugcuccgugucccacugccuugcuguuugaguguaauugagcauuuucaugaagugcauauguugcaugaucuuuaacagguauuuuuaaacauuaaaaacagcacgauguuacugacauuaugcaauaucaugugauggguacuugagaggcaguuugguuucuuuccaggugaguaguuauagcucacggucaugggagcccuuuauucacacugucugugaaguuaaugcuggagugccaagugcacacggggacuaggaacaauaaagaguugcaugccauucugacucacggaguuuuauucacuauagcaaugacaauucccauucugauuaaaaauuaaaacaugaucugugugucuguuuuguccuaugacuggaguauguaaagacuuacauguaggucaugaaauuuucagaauuuccaggcagcccuuauugucuuucugagagagguuggcuccgaagccacugugccugcuuucuugaagcacagcaucccagagcacgugggcaccacagcacugagaaguccaucucuguagcuagaggcagugguccagaucccuguagaauagcagcuuauuauguguacguucuggacguugcucucuccuauugacacagaaagugacaggccagauggauccccgagucaccauuauuucugaggcugcaugucagugugugucugugucuauaaugcauagcucagucugauuuucacacaggaaaaacugcuuuaagcugaaugaaacaauagaaaagugagccaagcuuaaacccugccaaucucaaaaacucugagucacuuggcuccaccuucagcucuguugacauagcauccuaacaccaacaccguggccuucuggagggucauuuucugaguacaucugcagcccuggcuguccuggaacucacucacucuguagaccaggcugaccuugaacucagagagucaccugccucugcuccccggugccgggauuaaaggcgugagucuacuuucccagugcuggaugacuaagacgucuacacugugaauuguaagccucacugagcguagugauucugccuguaaucccaguacucaggagacagaagcaggagaaucagggguucaaggucaaccucagcuacauagagauuuugagacccgccugagcugugugagacccuaucucauaaaacuaaaaaugcaaaucugaaguauuuucaauaagagaacuuguuuuuguguguuauuuuguauagguuuuaaauauagucaggauaaucuuaauugccuaaccaaaguaauuuuaagaguuguuugugcuuaaauaaguacucaucucgagaacuuaagcuaauucgcauguucuggugcuauaauaaaauaaucugugaucaugauuuuuuucuuacuaaucauuagaauuuuuugaaugaaauuaaaucuuucuuuuuucuuuuggccuagcuaaaguauuaaauuuaaaagguuuuaagaccacguaauuuuugguuacaccaggaauucucagccucuuuagaaauaucccugaauuaaaaaaaaaaauccaugaauuccuggcaaacuccugaauagaucaauguacuuuccaggaaaagagagccuagagucccuuuuaauuuaugggugaaugaccuugaaggauuagguagaaaggagggugcuaucaaauuaacauuuuuggcaaaucugugcuaugggucccauccuaccuuaucccccgucuucuuuccugggcuaaguagacacagcagaaugcaagugaauggggacccccucgugcuuggggcaggugagcccucugacguggcacccuugggcacucaagcugaagucuaggcuggaguuacacagugagcugagcacuagagauuuaccgauagcagugagcuggcucuggacaggguuuaauuggcucaucgcuuggcaaagguugagaaucccugguugagacuaauuaaguagaaagagauuuaaagucuuacauaauguuaaacccuuuccugccuaggaagaaaaugccgccccugugcuagauagacagcgguucagaagauccaguuuaaacugagguauguaaaaaacuaguuuuccaaguaagaaguguuuggaacaguugcuaguuaagcacugucacccacaugguugaagaguuuuuaaaguaaacaaucagcaaaccuugcugcugugagauccuguguccuaggacugccaagguacaccaauccauggcuuccucagcaugagcugagcaagagcaguaggcuugccaaaguggacuggggccugggggcagcucauggggccucaacccuacccagagcuaggggaaacuaagggaugcuggcaguaggagaaacggucuuaaccagggacgagcacaccaguuguucaccaguaccaaacggagagcccugaaaacauaaguaacauggaacagacuggacagguuauguguguguuuaggaacauacauaccuguauguauguaacaauaguuaaugaaaagcagagaccaugagucugaaagagagcaacgagggcuauguggaggaguuuggagggagggaaggacgggaggaggauauauauuaugaucucaauuaaaaaaaaaaaaaagaaguagcaaaccacggcucuggccucacggcccuccggcuguugguguaggcaggugcugugggugaaaggcuuuccaaggacauucuggaacucggagcugaaaccguuucugcaaggggccucaguggcugaaggguggaugggcacugugcuggucucccaggagagugaaacauuuugaaaagugaugagagagguugaucaagaaggaucgaccccuucuugacucaggauaggaucccaccccaagugacagucccaugagaaagucacaggcucuguagaaugccaggggcucacucucccaugcugccauugccaccuaggagcacuguguccagcccuagcaagguccagcauuugaaaucugaaguguggccauccacugguguuuauugcuuuugugccucuguaaaaggccaucugcauucccagaaacaacaaaggguggaaucugaacugagguaaagaccaacaaaaguuagcaaaaaaaaaaaaaaaaaaaaacccaaaacacacaacacaaaacauacagugcuuaacacucucauaccaaaacaaaauauucugaaucugccuguggguguggccuguggucacugacugacagggaauacuccccaguccuuccucugcagcuaaagauguccucuguagaguuauuuauuuuacugcagucuagcaaagcauggacugggcauaucaaaaugaauuacuagccugucaggacgugagcgugugaacccguagucacaaaagagaauguucccuguauuauguuaagaagcuguuugaggcccuuaaggucucgcugauucgugauccuuuuccgguuuuaucgcauuuacauguauuuaccuccuucucuuucaaggcaacaagggcucuagaaccuuaguaucugcccauagaccaagcagcgcuucuuucucauucuccugacaauucgguuaauuuucccagcuggcuuccucaccacguauaagggggugaagaagacacggccaucacucuagccagagaagaaaugugucaccuuaaccagauguaucuguucucuguaauuguaggauuuaaguuagguuuuaaagaaguguuacuuuuaugagauuuuaggcuaaagcccaauguauagaaaaaaauuguaaauaacccagccucuccucucauguccuguagcauauucuuggucagauaacuaauaaaacauagauauuuucaaaauuguuacaguucuuacgcuugcaaguuguauuucuuagaacuuuuagaaggcaugcuguuuuuacuuaaugcaaauuaaacuucuuuauuuugaaagagau

SEQ ID NO: 6616 - RNA, 2790 nt, Mus musculus
aucauauggcagaagauuuauuuuacaaacuagaaugcugucagucugucuguccaccggcuucuaaaacuaggagcucaauuccuaggacagaacucucaggcacuagaguuugucuucuuuuuuguuggguagcugugcuauagccagguucuaggguaaagugggagccugccaguguuagaucacaguuccacccccaccccucccacuccccucucgccuccccuuuccuuuucucccccucccccuucccccuccccccugagauaguaagaaaguacuccguguuguugccuugccuccccuuugaacaugcaagcuauguuuauagucccaucuaagcacauaucuaggccucuguggcaagggcucauaggcugggccagacuacaucacaugggagaaguuggcugacccccuugaaaaccuguuaagaauuuuuauauaaauaaguaauaauaauuuauuauuauuauuuauauuuaugcaaauauauuuauauaaauaaauuauguuaaauaauuuauagaaagagagagagagaaagaaagagggaaagggaaaggggaaggggaagggaaaggggaaggaaggggaaggggaaggggaaggggaagggaaagggaaagggaaagggaaagggaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaaggaaagaauggaagaaagaaagacagaccauccucugcccuuucuucaggaagcccauugugcuaaccacgguggcugugucuagcucagccccuauggaucugaagggaaggcucuucucucaaggccccaucaaacguccuuugggaguucucuucuaacguuccucugacaugaagcugaccugguugugagauucuuucucucuucuaaguucauuccaaauugguugcacucaggccagcgucuuuccucaaaccuuccuguuuacccuacagcuaaagcacaguccacaaaucugcaggcauaagaaggcccacgugacucuugcugcugcuggggaggccguucaagaauugacuccuaagaaucaaacacauuacagguaugucuggcguccuaagugccuuaaauggcaagggucuauagggguuguaaagcuuucuuugcucaguucacagccuucuugaaucuccuugcccugcucccuacuucucgaaaccaugguagaacuggcugauugauauacccgacacuccucccucugugucagagguuaggauuuuaguuaacuuuccuaucaggauaaaagcuguaccaaagucaaaaaucucaacacaaagaauuaacuccuauuacuuuaaugcaagaagacaccaucagcuagggguaauacuaugugcucauacuauguggggcacaucuaugugcucaucucacugugaccuuccuucagggcacagaaccacacccaacuucccagccugccuugcagcucagcaggagcccaugacuugagaagccaauguggauaaaaguucaaaaguaccauucauaacucugcagucuggacagcucacucuucacuguugaucccuugcuccucuuggacauauuauugaucaaauauguagcuagaggacucugcugccuugaggauggugcagccacaagauaauggagcuauguuuuuauguaaacuuagguaacaaugaacuauuaugaacaacauguacaauaaaugacauuugugaugguacuacccuacugcugaagacaucacguaccugagucauagaacaugauggaaccaaguugauacaucccuaguggcucgcuuucaucugcaagcugcaauagugauuggccuggcaagacaugcccacugguccaauagugccaugaacauuaugagaacugucuuaguuaggguuuuacugcugugaacagacaccaugaccaaggcaacuccuauaaggacaauguuuaauugaggcuggcuuacagguucagagauucagcccauuaucaucaaggcagaaacauggcagcauccaggcaggcauggugcuggagaagcuaagaauucuacaucuucaucugaaggcugcuagcagaauacugacuuccaggcagcuaggaugagggucuuaaagcccacgcccacagugacacaccuauuccaacaaggccacacuuccaaauagugccacuccuugggccaagcauuuucaaaccacaacaguaaccaaccacuuucugauuagauuuaaagccaguuccacaacaugaaaccuauaccuggcacuauuacugggccacuaaccuacuguuagacaggucauaggucuaggggagaaccuacuauuauguugcuaaguggacauaguauuaagccaauuccuaaugacuuuucaucauauccauagagcagugcaucucuuagcuucuuaucugagacgcuuucauuugcaguaggcaguaaucaauacagagacugacaacugaccaagguacagagaauaagagauugcaaaauguucaacccuaaagggaauauauaagacacuauacacacugggguggugagauggcucaguggauaagagcacugacugcucuuccaaagguccugaguucaaaucccaguaaccacaugguggcucacaaccaucuguaaugagaucugaugcccucuuuugguaugucugaagacagcuacaguguacuuauguauaauaauaaaa

SEQ ID NO: 6617 - RNA, 3345 nt, Mus musculus
cauugaugucagacacauuuuauuauaaucuuaauacagucuacauaaauuugaacugguauuuauuuggguucaguuauaacauagcauaaaaaaaaucaaagcacugguugucugaaauaaagcaagcaaucaacauucaauaaacacacuugauuuauuuuguauaaaaggguuaaguuuacaacuaaacuuuuauaaaaaguuuagcauaaguacgucauuacauuuuaaugcagaaauagguuauuucugccacuauacaagaaaacucuaauuaaagaguccacaagguucacucaauauauauauauuuauauauaaauauauacacagcauucaguaggcucgugucaaaaaggccauuucugaccgaagacuucauuuaaguaaccgaauacuggguccuucugguauucacgcuccaccuuugugaaaaggcaaagucugcuuacauugggcaauuccuugugauuuuuuucuuuuuuuuuuaacguuuucgcuccccauggugggaauaguauauaaagaaaaccuuccaacuguagaaagggcacugaaagucucucauaaauaacgguaucacaguccaggccggagaacgacaccugggcaagacgaucauccuuaguuuuccuuccgcuuucuuuuuaaaaagguccauucaacguguucuccuggugaaauggcugauaacaaaagucuuaaaagaucuuguagacuucuucuugugcaaaagaaaaagagaaaguaaaaagaaaaaaaaaaguccccaaaugccugcaaaagauugggagagaaaggcaguuuaggagaauguaaccuaagggcagaggcgggcgagccuggcgccgaggaagccacaguuugagcauuuaaccaaacccuggcguccagaugcggcacacauacccggccccagcagcacaaauuaaacaugaaaauagcggagacuccaggggaaaacuucccaaacccagucuccuauuuggaucucuaacagcccgcucacaggcgccagucugcuucuuguaacaauuauuugauugaaaacagcccuuuaguuaacagauauggaaaucuggaucccagagcacagggguaaggcucgggguagccgucuucagcuagccagagaaaucucagaggacuacaguuuugggaaaagagaaucacuauggaauuuguggcgauaagauuaauuacagcugagguuaccaccucaguguaccgccacugggcucauaaaagucagccacacuugguccugacaccuucauaguaaguuacuggcauuucuuuucuuucuuuuuuuucuuucuuuucuguuuuuguaaaggcaacuguucuguaguccugagcaaccacagcuacaagccccuucaugccuaugugguaagucaagcggcacccguaacacagugaaguaagcaugcauuuaccaaaccaaacauuuaacagacacacaagcacauuaccgaaacgcgcacacaggaggcacccgcaacacucaccauuuauuuagccacagaguacuuugcuaucauucgacauaagcucagaagggaauucagaugccuggggagaaagaggauaaaaggcaggauauuagguaaucuuaaaggaagguagccccccuccuccuuucacaaaagugccaacaagucccaugaaacaggaucaugcuacagcgcagauccagaugcaacccacacagaacuuauaaguagcgauuucacaugacgcucaauauacaguuuccucaaaaauaaaguuaaugaaccugucucuacgaugggcuuuaagagugacagcucgggagacccggagcgucugggcaguggcguacuugcaagcuagucucaccugcaaggacaggaugcugauguccguguucaggguggucagcggcguccuggacgccugguucuguccaggucucuggugaugcaggcugacgauagugggaugcgaguccagggcgaucugcagguccaagauguaaucgaugacgugcugcaggauuuccaucuuggucaccuucuuguucugggggaugcugggcaccaguuccuugagcuuggaguagcagucguucauguuguagagcagacucaucgggucguccaccgggguuuugcuccgggagaugcccaagcugugguccgacaggcuguuuuuccuaacggaccucaccggacugaaggcuuucaugcugcucguaggaggaagaccgggagggagccgccacagggggcugagcugacugcgcggcaccaggcucgguucagaaugaagcgcgagccgggcggggcgucuuuuaugugcacucgcccuggccgcucaaucgggcaucccugaauugccauugguggaagggcucccguccaucauaccaggcgaauucucccauuggugaguaugagcucucgguucuuccgcguucgcagccaaugccuguagggugggaggagcgggcgagagcccagcugggguggcaaauugaguacagugugcgcugggcgcccagggggccugagugugcaauugugcccgccuuauuccaauucccagagcuggcaggaccccugccccgggggugugcccggagcuagcuauacccgcccccaggacuuccagcagccccacucucuccgcacagcagacgggaagucacaggucgcuagcguuagggaagacagcgaccguggcagaagggaaaagaagcgcgcuuuugggaagucacauuuguaguguuccuucuuuuaagauaaaggaaagcuauuuggggagggggggggaaccuacccacauacacguccacgacagguuuagcgugaagcuuugcaacuuggagcaacgcgggaggccuucucggaaacucagugacacgaauuguaggaacacugugcggucucccucagaccgcagaggagccccgagggacccggugcauucggaacuccccccacccccaagaaugaggcaggguuacuauaaugacuccauuaaucgaaggucauuagugggguuugcacacuggaacuacauuuacauacacugcccuuggucugugcccuucaguguagguggcaaagugaugcgauuaauuaugcacaaaucgugauuucuggugucacauuccaacacuuagagcucuugggaagcucuuugucagguaggugguccuagcuauugacugacagcuuaucgcuguuuuuaaaagaaaauucuguuacguacgagguuuggaaucuuucagcacccuuccuagaugcagccacauuuugaaaaaguuuagagcucuugacuccaaugcuuuaauucugaauucuuguuuugcug

SEQ ID NO: 6618 - RNA, 2501 nt, Mus musculus
cauggagauagcaagucuccugcauccuuccaaguggcacuggggagacaugggucuaggugaugguaaugaugaggauggcaacacucuacuucauaauguaaagaugcuaucugcuacgaguaacugucaccuugggcagcuucaggaccucugucauuccuucuggccuccuccacuuauaccagacaccaaucagacggggagaaggggauaagggagauagaagcaggggaaauagagaagggagaaguuagauggggacuaaaagaacaaaagcagguaugcaugucgcauauguacauguccaugagacuauuuguauugugaauacauuaacuauauauagaugaaucuaguacacacaucuucauagauacaaacacacacacacacacacacacacacacacacacucaaacacacuuuuaacugucuuuggauucagcagcccaguucugcugcccguaauuuugaguuucaaguuguguuagagggugagaacuuggaaggaaggaucaagaaacuggagcaaagccaaagcccacauucccguuccaaauaggaguggaagguaugggguaugggagauuuuacauccugguugggaagcuaugguaacaaaaugacuccuguccuggcacugaccagaagccacacaugggggacauaugcugaggugcaucauagcagaauaaccaucaucuuccgucauauuacaaacagcauugaugaaauguuagguaguucauagagcugucaguuuagcaucacacugaggcccaaauuucccuuuaaugucucuucuggagccuuuccugccagccaccuccugagccagcaguggcacagagucccagaaguugccaaaggggacacuucugcaccagcugcucacccucagcaggggacaucuggagagcagccuuugaucugccauucccugcacaucugguuaccuauaagggguucacagccccuagcuuguguuugcuguggcucaacucuggugcccaguggagcucuggcaacuuuaggcaauaagagaggcugcuuuccaauauagcaucuguucugggcagccgcuguccauuccucucuaagcagcacucccggcugcagccaaucuggaaagaugggcucauccacaauagugccugcaaucugacagguacaggucucuuggugggucauccgcuguggcuugggaccaaagaauuccagaaggaaagaguugcaugucaggagcuugccaccuggcccugggaucaaauagaaacaauuacauuauugauggauuccaccagagcagacaguugcaugauagguauccuuugcuccucuagguauaugcucagagacgcugugucacauagggcaauggugugacugugaccacuaaacagccaggccagggcaagcccucagguuauuauggucuuuugcucuuuaauuagagaugcccuggaaaagcaguuaaaauacauuaguaaguuuggucacgagggaaggacaaaggaaaaggagggagggaagaaggacuugccacagccuggguugugcacucaugaguacuggagcgucuugcugugugacugcagaagagcuggaugaaauguggaguggagguuacauuuauacacauuuaaagagcaugugauacaccgugcacaguuagcauaggucagcucuggugagauaaaggguugaaugaauaugauuauauauuuagauaugaaauuaacuuugaggcaucccugugggccuuuaacucuucuucaucuauguguacuuguagaaaaauugagcaucuuccaguuagagccaggucuggcuugaucucaggccuguuacuaugcuggcagcuguguagaccccacgucccaccuucuuucuccauaacucagacaaccaaacaugcaucacaguuuucaccuccugcagcucugugccaaggagcaucugugcguuccuacaaagcacugcagucccaagcauccuccuggcagcaguuaggaggacuucugucaacuccucgcucaaguacagcauuuucucuacuucacccuuaaaagacuaacuuccauauacaaaggagcaggaggaagaggaagaggaagaggaaggaagaaaauggaggaaugaaggaggaggaagaagaggaggaaaaggaggaguugaaacagccagacaggaggaagaagaaggggaggagggagaagaagaagaagaagaagaagaagaagaagaagaagaagaagaagaagaagaagaagaagaggaggaggaggaggaggaggaggaggaggaggaggaggaggaggaggaggaggaggaggaggaggaggaggaggaggaggaggaggagggagaccgaacaaagagagagagaaaaaaaaaacaggaagaaagaaaaaaaccuaugaagcuggaggagaagggaaagaaggaggaggaggggagggaggaggcagaaaggagacagcagcagaagcaauaac

SEQ ID NO: 6619 - RNA, 970 nt, Mus musculus
ugcucaggaccacucagugguggcuccaacccacuugguggccugugccaugggagcugcugaucaauccucaguagcuagcugcacacuccagucuuccguggggaacugcuggaugggcacagaggguaccugcauacccucagaccagucggccaccucaggcugagcagcagugaacucaggagcuggugcgguccauucacucugaauuccuccuuggucacagccuucucagcagcagcccgcuccuccuucucaauccccucugggucucuguagaaguaaagauaaggcauaaccucccaugggugcucacgggagauaguaccucgcaugcggaguacuucucuggccagcauccaccacaucagacccacugagugagcucccuuguuguugcaugggauggcaauguccacauagcgcaggggagacucuguguuacacagagcaauggugggcagguugacauaagagaccucugugaguggcugguggucagcccugggauuggucaccacuagaagcuguggcucccugaaggcugcuuagaucugguuuagugaaggucccaggugugaagcggccagcgauuggaguggcucccauggcagcagcaaacuucagcacagcucgcuggccaguguuccuggaggagaugacgcugaggucagcagaguucucaauggcaacaauagcucagucugugagcaacaguuucucccaaguccucuucagguuuaugauguagauacugucacuuuuccuuuuguagauguacugcuccaucugaaagucaagguuggugccaccuaaguggguuccggcagcaaggaauuugaggacaucuuccuccuuuauccgcaggacgucaagggcuccggacauuguguaaguuucccuuuaaguuacgaugggaaucaagaacaacgccauauggacccguccccggguagcgcggaaagcg

SEQ ID NO: 6620 - RNA, 8015 nt, Mus musculus
uauuauauguaaguacacuguagcugauuucagaugcaccagaagagggugucagaucucauuagggaugguugugagccaccaugugguuucugggauuugaacucaggaccuugggaagagcagucagugcucuuacccgcugagccaagaacccaacuuuaugaucaaaguaacagaaguaacugugcuucauauacuuuccaguguccugugcacuguccgggggcuccugagguucucacuaggcaguuaaaaaccacaaacacuucaucaguauauggucaugucucuccuaaagauaguguuugccuucauguaugccccuuccauguguaugacuggugaccccugaggcuaggacaucagcucccuggagcuuaagacaguugugggccagccaguaaauguuaggaauugaucaugaguccgcugcacauugcucuaguggaaaaaacuccauuagauuuguucacauauaguuucuguaacucuauuugugguauuucgauccuuaguugugggaacagugugcugggaaucaaaccuagaguuuugcauuauagauaccuguauuuuauaucugccaguuagucacagugcuauggacacaggcaguugaucuacauggcuucaaggccagucuugccuauauauaaaguccuugucccacagaguucaauaagccacaaagaugacucagcaguuuugagcauuacaaacccacccauaaguggacaaaagauuagcuccuaguuguccugacuccacaccaaugcugggacaagaacacagccgaaugccauuuuguuuugguuuucaagacaggguuucuuuguauagaccaggcuggccuugaacucagagauccaucugcuucuggaaagaugggauuaaaggcauguaccacuacugcccagcuuuuuuaaaguguugauguauaaaaguaguuauuacugggucuuuacuuacuuacuuaggguuuuucaagacaggguuucucuguguagcccuggcuguccuggaacucacccuguagaccaggccugccucugccucccaagugcugggcguacgccagcgccaccaccaccaccaccggguuuuuuuuuuuuuggggggggugccuuuauugacaagaugcuaguuuuguuuuguugugguugagacagggucucaucuguagcucuagcuguucuggaaggauguagaucaggauggccuagaacucacaaaaaucugucugccucuuaagaugguuaacucugaaaacuuuuacagcaauguaauguccagcuguuuaaaaagcuaauaacuuuuuaaugaccuugaacugcugaccuuccugccuuuaccucacauucugggacuaaagcccaggucuguaaagccuaggccagugcuaacugugaucugggcauacaggaggcaaagcacagcagucacacaaaggccagcaggcuacagauaauacuuagaggcagagccgagcauggcggcucaugucuugaaccccaguagccacugaagcaaaggcuagcaaaugagauuucucagaguuccaggccaccuguaaaaagcagaggcaggucagugcggugaagccccgucugagcuccauuagugcuggaggaaacugagggguaugaaggaugaagcuggagguuggggacacaagguacacagggcuucccacuguuugucauucuguaccuggaagucucugcuugacuguguuuacaucaacugugaaguuucaagaaaagucacaauauucuugaggcuuguauuauuacacucacauccugucuuacuagaaauuuccacuuaauaacccaaacauccucacagcuguuuaaaacugcaauauuccccaacacugccucugccaguucccggguaaccuuugucacccucuaaaauauuuauaaauggaucuaucucagggggcacaggcuccugguucaaagauuaagaugagcucaccucagcuucuagacuaacagcaacauucaucaggcacauucugcuugguaguugcuauuuuuaagaauuacuuuuguauauugaugcuuugucugcguguauguaugagcaguuauguaccuggugcucagaggccagaaaauuagucggcuccccaggaacuugagucagaugcaguugugagccaugugaucacuaggaguagaauccagguccucuggaagaacgucccagagaccccaagcacugagccaccucuucagcuccauuuuggcuuaagaccuucuaugaacacuggcuagccccaaauucacccucaugcaucuacagccuacugcagaaccaugagcagaugucugcugugacugcgguaagcugaggaggugauguaucagagcagaggaaacaauaccacaguugcagcucccauagcaaggagggcagacgacaggaaaaaggcagggaacagaguccuguacagaugcuuugcacacccacauauccaccagggacaugaagcauaguaaagucacacaccaaaugccugaaagccugccccagugcacacaggagcugcuccacauaaaaggugcccagggccacgcacagcauucaauaccuccuguuccuuuuuuaacuagcaauaauuaaggccauagcuuaaggcuugagaauggagcagcuacccacagcugucaucuguauugggagcuuccucacucaaggccuuaaccuuguagagcacaccuguuuccauuuacccugacggggacuugcuaauccuaacuugcugaacuugugcagaaucagacaggggacacaggaaugaugaagaccauggaccauaaacccaggagaccaucuuuaggccagcuugcacuacagugagaccacauuccaaagaaagacagaauaggacauaaaauguggacaguuguuuacaaagaaagaaguuggagggcagugaaguucuaaucccgcaaggugggugugaaccccagucuguuucacagcagcagaaugcccccauaucaacaugacuggcuucaguguguuuuucaccuuccaggcaccucuugaaaacuucaguucauucaagaagcuacugcugucgugcacccauggcccugagauuuugacaaguuacuacaaccaaauacuaugaaugacacuuuauucagucauuuucuuuacaacugaaacucugggaauucaaaauuaacauccuugccugugagcuucuuguacacaccagaaaaaguuucaaccugcaagagaagauagaauucaucacuaacuuugaauaugcaauagcccugaaagcuaguguacugugugguuuuccgauucaacaacccugcaauguuugaccugggcacaagccuaaucccaacacugagguaggacuucuacagccugauccuucucaaaccaagcuacuuggggggacccagggaguaacggguaucaucaagacagcucccuuauucuacuauaccacuauccauccaaguugucauaccaucuguccucccugaaacuggagaccacagacccagcuuguuuaucucauaguaaauuuauaaaguguuccaguuucuaaaggagcuccaacauaaaacugacacagaaucagacagaggacagauaaaugauggagaccauggaccauaaccuucuguugaauuaggcccuuaccuuguguuccacguuguucugcugugcuuugucuaagugaacuuuuaugagccggcugccauccaguuucacacggauccucuuacccacaauuucacuugggaagacuaaguccucaaggauggcgucgugcacugcugucaggguacggcuggaaagaaaugaccaaaguaaguuaccuggcagaaggcacccuuggaauaaaaaggaaaaacaguccagauuccugaaaucaaaacuggggccaagugugacagcucacaccuaagacacaaacacuuaagcaagugagacaggauucccuaugacuucaaggccaaccaggaguccuugucucaaaacaauacaauuuggcuccaaacagauagcuauucagugucccagagacuaaaagcuuugaguggcaagcaagccaugcugauucccaaagccauacucaaccuggcaauccacauauacaagccaccuaggggagggaggaaggggguuagcucaggaaggggguuagcucauccuuuuuaccuuacuauucuaaucugcaguaagcucuuuuuaguuccacacagcucaaguauuuaaaaaaaaaaaagcuggccauguaauucaccuaaucaaaaccucucaaucacuuucccugaccuccaagaggccacugaccucauguaucaggaucaaacaaaaccgcuccaaagacugcucuaucacagcucuaugacacuggcccuugucauuaggaacaaguuccaaugggcucuugcuucucagagcaucccaaccuccccgaggcugggcaagcuccaugacccacugacuuauaaucacagguggaaauaucccagccacagauuuaacacaccugaccuaccaagugcccuaguguaccaagagaucacuacgggugccagcaguuauaguccgugacugcagcauggcaccugggagcuguggcuguucaugaugacacagcuuugaccuagaaaaagcacuaaacucagaacccaacuagagucuccagaaugcacgccgcuuccaccacugaaaagccaagcuuccccuagucaggaacccccgugauuccaaacucugaggagacuggggcuacggcuuucagucugaauugcauuccaaggaaaagaguucugcuucacccuguguucacaaggaagcaccgucugaucaucacacggcuucucacuacuacucacuucagagcacacucuuaccacacuaguaggugcaucaacauggacgcuugcucccuuaaaacagaaacuaacagacucaaaguuaagaguuaacucaaaauuccagcauaacaaagcuggaaucuggagacauuaguauagcaccacgacaccuugccagggaucuggcaucaagaguagaaaucacuaaggucacugaacaccgcagccauuaacacacagggcauagauagugaugugcaccuguauucccaguaccugaccacaagacuguuguuggcuacauaggaaguccauggcucauccggucucaaaagcaucaccucucaagaguagauuuccuugaccaguuauaagggaaaaaccacacuuuuggcggugagggucugcagggacagucugauauaauuacagcaucaacagaaggcccaaguccaaugacugaugugugaagagaccaucaccuuuaaagagcaaugauguagccuugucagccuagcaccaggaaacccacccaugcucugccugccacacaacaaaaccaucccagcaccucagccacaaacaaauuuuuauccccaauuaagaacuaaauaguuagccagguggugauggcggcacacaccuuuaaucccaaccuuugggaggcagauggaucucaguguucaaggccagccuggucuacagaguaaguucuaggacacaugggcuacaaagagauaucuuaaaaaaaaaaaauacuuucuccuuugaccacagaauaaaucaagccucaccugugugguaccagugacuuacaacagacaccacauaguguauguaugugaaccacuuaaacguucuaucuagaaugaaucccaacacacagggaaugaggagacuccccguccugaggcacugugaggugugggcgcauggccgaggcaacggaacacucaccuucuggggcgcuucugcuuauuuuucguacggcuuuuccggguuggcuugggcagaauccuccucuuuaaagugaauuauaauaaaaauaaacacaaaacaaugagcuaauaauaaagccaacaaaucucaacuacuuuaaguacaaaaauacccaugucgccaccuucacaacagcccaccacucagcacaaauugccagcagcauuccucuuucccaucagcccuacuucauucacccugcacacugcaccaaagccaauccugaacucaagcacugucccauaccagccccuccagccugcuacucccagaccagcagacuucccacucucaccccaacacccuaggcugagcuuuccaccaacagggcugacagcauccucaccaacagaacuuaagccccaggaauugaagaggggcaacugagcagauggauaccugagcaaugaagaccacgugcuugccacugaacuuuuucuccaauucacgaacuagccggacuuggauuuucuggaaagauuuaagcugaggaacugguacaaaaauuaugauagcuuuccgaccaccaccaacuucgauuuccugggaggaaaaaaugucugugucauuuuucaguccuuaaccuccaucuuccucauucaaauggcaccacucacagccaaauaccaccugaaucaaggacccgcccccuucugaggcagaguccuuguaguccuuguagucccaagugcuaagauuaauaugcucugccacaaccagcaaacaacuccccccucaaacauucuccugugguuuggacauagccuagggguucgcaaguuaaaccaugacgcucauauugagguucuaagguggagccuccaucgcacaaucccggugacucuacaagagacaccaaaaggccagcagagagcuauguccauauguccaucauccuagcacuggagagguagaggcaggaggacggaguucaaggcuagccucaacuacaauccaagucgggagaccagccuagguuagaagagauucugucuggugagucugaucagaccaugacucuggccaugugccaccucaggaucucccaacaugauugaaccaucuagaaaggucaacuuuaaauucaccauggccuggguaucucugauguaaggcucuucuccaaauucaaaacuuuccaacacuaugaaauugaccaaaaaacucaauaaaauuaacacucucccuggguggcugagcagugguaguucagggcacaggacccagguucaguucccagcacucacaagcauuuguaauucaaguuucaggaacacgcaaggugcauguacauuaacagaagcaaaauacuaacuuacaaaaacgaaacaccugucaaacgccaaacucagaaacacccacugauccucaaccgagugguacugggucuaaacacuuccaaaaaguuaagguuaaugucaguggggaaagaaaaaaaaaaaaaaaaaaguccagcaaucaagugcagaaggcagcacggacuuaagcgugagacuggccugcacuggaagucccugucugcugcccucccgucucuugccccgggaauagaggcugucaaccacccgugggcagcgagcgagcgcacuccgggguccccgcucaccuuggcugcggugauguugaguucccgcagcugcgccuugagaucggaguucaucuccagcucgagcagcgccuggggagacagagaacgugggcgccaugccgggggucaggggacccugaggucaagcgcgaucgcggggggcacccgggcgacaagcucaccugagagaugccagacucgaacucguccggcuucucgccauugggcuucacgaucuuggcgcucgagcugaacauggcuucacccugaggggaggaaggugccaccggucaccuggggcgcgggccgccaaagccggggccaucuacgggcgcaaggcggauaauccgcugcaucccaccccggggagcaggcucugccgccccggacgccccccaagagucuguucccccaaacucugcgaaaaaccgcggccacauugcggcccgcgaaccuaccugacggaucgccggcuuagaaagagggacggcucucgcgagaacggcucauauccggguggcggaagaaaagagguggggacagcggaaguagguggg

SEQ ID NO: 6621 - RNA, 80059 nt, Mus musculus
ggcacggaggcaaaagaggcagugccgcgaaagcucacuuccuagaacacaacaaaauuuguaaguauucaaaaaagguauuacuagcaacaaaacccuuggauacagggagaaaggaugauaaagggaugugggguaacuuuguugugguacugcaguuuuaaaagcagaaucagggauccaaucucugucccaagcgacaccucugcaccucuaggagccccccacaguggagucugugugcacugguccugcaguccaaggaggcccugcugcaccuccgagaagggucgcuagguucagacaccaaggcccuggugauugcccagcccccgcccucugcgaagcuaagagggggcggagccacgcgcaugugcacagcuggcgccccccuccccgccccccgcgcacagcugggacgugggccggggaccggagggcucaguugggagccggcgguggacgcgcccgccgaggccuccuccgcugcuguucacgcgugccagcuccuguccgcgccaucugccauggccgugcgccccacgcgccgcugccugcuggcgcuccugcugugcuuugccuggugggccauggcgguggucgccucgaagcaaggggcaggcuguccaagccgcugccuguguuuccguaccaccgugcgcugcaugcaucuguugcuggaggccgugcccgccguggcgccgcagaccuccauccugugagugcggcccggagggcgcuggggucugcgggacgugcgauucagggggaucgaggggcguggguaucuuggggggcagggguacugguuuggagaggugggcuaccccggcguccggcgcagggugugcugggccuuuuguccguccuggcuaggacgccaggggcggaccugagcgcuuagcgcgcggccuggggagccgccuuuguucaaacucggaaucucccgcuggaccgggaaguaguagggagucgccagggaaagccccgcgcgucucucgagcccuccccgccuggccuucccuccggugucuucucaacuuucucuccacucgggguuccucucccucucucuucucuaaagcgcaggccugggguugggucgucccuccuccgaccccuucuuucuccaucaguguaccugccccccuuucuccuccuucuggaaggaugcccaccccacaucacccugcgccaaggaaaccucuugcagauucugggucccgcggcgccacagcgccaaguguacucccaucggcuucugcgcuggagccuucaaguucgcuggguguccugaggacucuguugggcgcagcccuuguaaggagcuuuuucuuugcuuggaagaagcuuggcguuccaggugccauggagggcccaccaucgugcggguggccaaguucugagcagcucugggacucuccucuugcuguuucuacucaguuggucaguuucgcagacguccuccacuuccuggcuuuuucaccuggaguugugcuuugcgccuucaccgaaagcccccagaucugaaggaaucccagugcugcagaguuggcugcaggccucuguguguucugagauuugguucugugaaggaaggcaugcguuuaggggccaacuguaauucaggguccugcagcugcacuucugcauuccaaaaagaguuuucacuuuuuuguggcugggcuggaggacuuuggcaucucugaggaugccugcgaaaguuauaaaaaucugagggaacuauucaaggagugggcggucggucagggcucucacuucuaaaagugcauggguguccuacuuccucugggggagauugugcgggccgcacgcggccagucuggggugggaaugccuagccuaguccucuagagagcuaaauaaggcuuccauuccagaggguguggauggucagccaaggcugcaucugagaggacagacagugugcuuuaaaccaauaaacuuuuuaaacugggccagaguggaacgucuccaaauacagagaauuucuguagugacucaauggccaaaacuuggacccuagagucauuucucacaucugggcaaagucagauucucagacuguucccaauucuuaguugcuuucugcagcaguguuuuuacaugagugcuguagaacccagcaggaguccccccacucugccuuguaugcuaccaugccacauaaaaauuuaguguguguguggaggggugggggggcgggggcaagcuuagugguuaaagaggucugcagcaaagcuugacaaccugagucuuaaggcccacaugguggaaagagagaccugacuccugccugcaaauugcccucugacuuccagaugcaugccacaugccccucccucccuccuuccuccccucccucauauacaggaauaaacuuuuuaaaaaguaauuuaaaaaauuaaaugcagcaagggguguauaagguuuccagaaaaacaccagagaugcuguuugaaagauuuccccagaagguaugugugccgaaauucaaacuuuguacuuuuauggaugucugaaaguuuccugaaagguuuuuguaacaauaacacuugguaucacugacuccaguguaccagguaagcacuugacagaacucaugcaaaguuagcuucauucugugucugggugcaggcugguaugcgucagguggcgcuuuggggcagucacacauaaaacacugcuuucuuucagcuucucggcccacuuccugcucucauguacauguugauauuuuauauuuuucuacauaggagacaaagguaucgcucagugguagagagcuugccuuagcauggaggcccagaguuagagcccucuuuuaaguacagcugagaaaggaaacaaaggaacaaugguuaaguagaaauuggacauaaaagauguuaauuugcaagcccccaucccccaaggcaguggaaucacugccuaagagccccacccccacucaaccucuccgaagaccaaauccaguccuucccuuccccaguguuucauacuuauguuuugaccugagagaaugccagauuguuuggggcuucacaguggucuuagguuagaacuggcuuugcucucuagcaucuggaauuucaaggugguacccugcuucucucuguagcuuggaaggcugguagaaacagcugccugguacccuggccuucuuggggaaauagccuuuaaaaggcagcacuggguucuucuguaggcacugggugucucaccugacagccugucugcuccuuucacauccuuuucugcccccugaagccuccguuauugaggucaugggaacugagccugaaaaaaauaacaucugcugggcauuccagggcacuccagugccagggaguuauuauagacuggugguguggcagaagcccugguacgggaaggaccgaagcuaugaauuugggagagcucuggauuccaugcauaggccccagagcagucagggccuggccuccuaggccucugucagucugucagaggccuggugcuccugcuuaguuucugauugccucuaauguguuuggacuugugauauggucuagacuagcuauuuuagucgaccuuguaggcuaacagcuuucccgaaggagcacaggguaauuuucauguucaggugugccaggccuaugugggacggaggagguuugcagagcucugguagccagcacuugcugacucgugcacaugggugaaauucccaaauaaugcuguuaccgagacaccaagaggcacccauagguauggagauggauguuguugucuggcauaucuuguccuguuugucagagcuguucacaguuugucaucuaccagcaccuuaucuccaaauaaggcaccaaagagagagcagcuuccuccagacuccccacguagacucagucaccuuccccuggggagcacgaucacccuugccugaagacuggagaagagccugggguaguguucagcaggcucuccauuacuagcauugccaggaguguaugaacuaugaacuucacagcaaguucccuggcuccugaccguguccuagggacacccuuggcucuaguuucuuagcaugugcucucuucaggauggucacaacaggagagcucaugacccuggucucagagcccaaggaugcucagaugugugagccugauguuucauuccacugcucacagcucaaccaaggccugugaauaugcugcucauuuuggguucucgggguacuggccuaagaggagaacccucauuguccauccagggcucaguuaggccugugucauacguugagaccaucggggugcucuuuaggguuguauucuguugggauauauugccugugugcaugaucuuggauguuuguaaggaagaugcuccugugaggaagccauguugguuuaguccgucuaucucuacucugccaaauuuguuaacauccaagaaaugguguaaagcgagucugaaugccugggacccuggcagcucugacuggaagcuugguuugauccuaaugaagccaccuuccuguaguuuucuccccaugguccacuuggccuccuuuuuuguuaguugacuccauuggugguaagugggagcugugggaagagccuuccuggaacagcuuguuugagcucaguuugcuuccacuccaugucuccagucuguguuccccaacauguggaccagaaccagaggaggguugggguggaauagcugaaguuuuuggauguugggcagacuggagaagagguguucucuacacagaucugagccccacggucagcagauaggccugauguguaucuacaaaugugggaguuggagagucacuaugaauugcugguucccauugacagaccauguucuuuucauguccuguuggagaaauuggccuuuuccuaugcacuuggcaauaaggggaaaugaaaacagauucaaauagauaaaaggaagccaaggcuguucuggggcucggaagucaggacuguaggccuggagcuagagauuucuuaggagccaggaaauuaaggaaaugaagaggcaucugcaggcugcuggccuggccugccacucagggagaccucuugaauuucacaauauccaggacaccgucuugguuuuacagugacaguuuugugggcuuuguggugcuggagagaauuacuuauuuaaaauaucauuguuuuaauggauucagucuaagagcaguuuaacuuucauguggggcuuaaaaagcugggacucugucuuaguuacuuuuccguugcuguggcuaaaacaacauaacugaaguaauuuauacaagaguuuauuugggcucaugguuccagagggauacgcauccgucacggcaggaagacgagguagcagagucagaaaguugagcgcucacauccuuaucugcaaacauaaagcaaggaagacaaacuggaaguaggcaagaaucguaacucagaaacguacuucuugcaaggccacaccucuucuuuuuuuuuuuuuuuuugguuuuuucgagacaggguuucucuguauagcccuggcuguccuggaacucacucuguagaccaggcugggcuugaacucugaaauccgccugccucugccucccgagugcugggauuaaaggcgugcaccaccacacccggcggccacaccuccuaaaccgccucaaucaguucuaccuauuggaggccaaggauucaaauacuggagccuacaagggacauucuuauuaaaccacacugauggcucuuucuuggguugguuaguuagucucugugagccaggaguccuugggaccaggguggggcuguuucuuuacuaaauucugaauaccauauacccaccacaugcaccuaacacaccaaguauguggaaauacuugggaaggagcauuuuaauucccuaguauccuagaacuggcucuguagaccaggcuggccucgaacucacaggcauccaucuaccucugccucccuagugcugggaccaaaggugugugcccaccgccgucuuguaggaaugcuuucuuguugcuugaaaugacgcuggugaugguuuaacauauuucaaaguugguaauucuaaugcuuugugccuuuucgucuugguguuuguuuugagaaucaggagcccugugucaucauguccuacccuauguguuagaucuaguuuuauuucugggccugugacaaauaaccugaucaaagccaacuuugagggagaaguaguuuaucugacuugcaguuauagagcauuaggccauuacuaaggaaagucaagaagaaacccuaggcaggaauuugaaggaggccuccuugacauuauuauuacagaccaaggaacucacuucauggacaaggaaguguggcaggaacuacagaggguguugaugacugggcagcaggcagaccuuaaacuuagcuagcuuucuagcuggcuaguuuuauguucacuugauacaaaguacugcuuuugggaacccagcugagaagauguccccaucauauuggucuaccuguaugugguuuuuguagguaccuauggaugcuggaggucuauacugaaugucuuccucaaucucucuuugauuuucuugaggcagaaucgcucacugaacccagagcucacugauuuagcuagauuggcuguccagaaagccccagggauagucgucugugcuucuugagcacugggauuacaggccuggacugcugugggugacuuuuuaugugggugcuagggaucugagcucagguccucacgcgugcucagccagcacucuaaagugagugagugagcaacugagcuucccuucagcaccauaguauauuuuaaaauagaaccuagauuucaugaaccugaccuuuuuugaggacugaguaauugugucccgaagucaaccccagcuuuguucuaaugauuagauaagccacaggaagucuaaaagucagaugccuucuuccccagccugugcaucucacuauuuaagacuuaggaggcaggacuggcagcaggcuucugucauagaccaauuacuauuaacccuuugcguccccugugacuuugcugugugguggauacaaauggacacuauucaccuuggucaagugugaaugaggccuuuaagccaaugggugcuuccauccauguugguggaggugagcugccaggcuuggcucuguacucugcagcucccuacagucuucuuguucuccuucugggguguucugguguuucuggcaucuuuucugcagguuuuggcugccucugucucuccggacuccuggcauuaucuucuuucucaagcaguuugcugggucgguugcaugcuuacugcauuugcucucugucucuccagguucaccuccaguuuugauggaggugcauaccaugaaaauaguugcccacacauuauccuuuuuugguuguuuaaugaugggagucucaccugucacuccaucuuguuugagauuuuucuucuucuucuuuaaauucuuuugcugcaaggugugaucaaaagaaggagugcucagaauaaacugcugaguucaccauguucacauguugagauuuuuuuuuuuuuuugagaaaauguugaaacaacucaacuguggcguuuuccauuugucuuuggagcguuuagccugaaguacucugaggaggaaugacaggguccugguguauuagaccaugugaauuacccacacagaugcucuuggcuggaccgcuuccuguuggaaguucugcuuaaagccaggguuaccaacaacagccuguggguagccugccuguuacagcuugagguuuugggacaagccaggacgggggcucacauuuugucuguggcugccugcuaaccacagaggcagaauagagaagguaucacuagcuagaaguguuuaccaucuggcucguucgcuuccaccauguuggguguaagcucacagaugucuccucucaauccugaaccugucucuuccauagccucaaggcuguaaacagagagauaagagaaggggguguuguugaagauggcccacaaugcuaaguuuucuuaagugaagccacaccucugcucacuguauuggugggguggccauguguuuuacccugcuuugugaguccagggcaguggaccagacauguaauuauaaaguggcuucaagcagcucauguucccuagccauggagucuuuagauuccuuucccugacugacuuucuguucuguguacuucuugacagggagcuauguggaaggguucugaacaauguucucuucucagagguguucaccagcauggaguguguguccccauauuuccauguucugugauuuagggggaauuuuacccucaccccuaagaggaaaguaggagauacuaccauuaaucaaaguggucuuaagagccccuucccaugagaagcacugugaugugcacugcuuggggguucacagcggcguucaugagugauauaugcuuaucugugcuaaagggucaguggucucagugcggucccuaccugaguccuuauaacaggaugaccaaccagccauuuacauagugugaguucuccaagggaugagagcaguggcuccuaucuugacugcuuucagguaauugugaaaacgaugggugacaugguaaaggacgagaacagagaaacacagggaauacuuaguccucagguucagaccaucggauucucgggaccaggagucagcugcauuucuaagcaaguuuggcuucugguaugaccauacaucuuaggccacagugugcuaaggaugugagguugcaggccgcuuaaguucuuguccucuggcugggggccuucagcccuuccuguuuaucuacuguagcucuaacacugcauauaaacuugcaaggucuuaggaaauccaccccuuaauaucuucccuagggucucugaagcagucaucucugggaggaguuugguucaacaaacaaacauuauuaaauuggccuuuccugcuggagagggcugaacagcagucuucacagguugugcuaggaguuaugaaacuaacccccuaacccacugaccaaccuuauuuuuagacagcauuuaaaauuuuuuuugcaaauaauacauuuuuguauuaaaauauuuuaaauacagauaaaacaaaacagacagcuuauauucuaucauuagaucagauucacauuuauacaaacaucuguuuauaugccuagguguacauugacauguauaccuguuauguuuguuuucaaaaauuauggcaugauauauuuccaguucuauaauguucuuccuuucuuucuuucuuucuuucuuucuuucuuucuuucuuucuuucuuucuuucuuucuuucuuucuuuuuuuuuuuuuuuucuugacaggguuucucuguauagcccuggcuguccuggaacucacucuguagaucaggcuggccucgaacucagaaauccaccugccucugccucccgagugcugggauuaaaggcgugcgccacaacgcccggcuguguguauauauuuuauaaguguccaugaauguuaugucucuguauguguauguuuugucuuuguguguaugucugugugugugaucuauguuuuguguauguguauaguaugucuguguguauguuaucuuuguguuguaugugguguguguaugugguauauguuaugugugugucucuguguuuuguauguuauguaugugugugguguauguuauguguguguguagcauguuguguuuguguguaucuguguguuuuauauguuaugcacauaugugcacagaggccagagauugauaugaagcauccuucuugcuugucugccuuuuaucuuuugaaaaagaaccucucacugaaguuugagcucacugguuggugagacuggcuggccagugagcuauggggauccuuuuuucucugccucccagugcugcugagguuacugacauccacugcaucccuacugcugcacauucaaacucaggaccucaugcuugcauggcaagcacuucacucagucagccaucuacccaguccacauacuugcucugaccaugugucuacuggguaauuggaagucauuguuuauagacagauagauagaugagauagauagauagaugauagauagauagauagauagauagauagauagauagauagauagauagauagauaaguugauuugugguuuaaaugagaaucuuccuuauugacucauaugguuggucuacacuuucuuggaaaggaccaagagguauagcuuuaauggagauaggagcaaaauugcaaggcuucaaagaccucuuaccguucccaggauguucucugccuccugcuugucgaucaagauguuagcucucaguugcuaaguaagugcccccugccgugccuucucuccuccauuguagacucucuaacccuguggaaccauaaacccaauucaacucuuucauggguuguuuggucaugguguuuuauaacagcaaauagaaaguaacuaauaugcacacagaugcacacacucacaguugcauacauacacauacacacagugguaggaauugaauccaggaccuuaagcugcacggacagaccuuacccucaggcuugucuugucauuguuaaugaauacaguauuugcuucugugaaaucacaaaguuuaaccaaauucuuauuacagacuacugcgcgugcucgcucucgcucucucucucccucucucucucucucucucucucucaaaccuaaauaauacuuauaaaauacucaguguacaguuucuguguguaucugucuggguuauuuuuagaguaugcuucuguaaucuuccguguggcuuuguucuguguggcauuugauguggcccugccgguuuucucccuugccauagcuuuggugagaagagaugaaccuguuagcauugaucacucagcuccuauagggcugcacaagucccaucgaggcaagccugugacagggugacaguaaggugcagaggggacagucccagaacugugguaaugagacugaguuggaaccugcauuuguguggggugacuacauuuuugucaccaugguuggcuuucuuuccuggugcuuugauauucagagaacuuuuagagcaaucgaggguuuguaucucucaucacacucuugauuuuguuuuuaagauggauuauuucuguauaguccaggaggguuuggaacucaacacguggcucagaguagcuugcauucucaguaguccuccugccucagacuucagagugucugguuacagacacgcggucaucauaccuaggcucucagaauucuuuggacagcugucuuuauuccgaauucugauagguccuguucuauggcuguuucugggcaggucagaggugagaaccuacauuuaaaaagccugaucuuguguccucuggucccaggcucuguugaugacugguucucaggguuccugguagguauguccaagauaaugaauaaggaggacacaggauaaaauacagggggaaguuccugcagucuccugucacagccucaucgccaggaucuacagauaacaguaguuugcauauguuacagugugaaaguacguccuguaugcauuucaucuauuaaccauguacugguggcuacgagcccugcaacacauuccugaauggaaccaacaggacuccaucugaugcgcugucuugucugcaaggcccaucacagcugccuguuuugagaccggggcacauaccaacauccugcucaguugggaauguuuuaacagcaaaaucaacaauacagaguacaaacccaccaaagcuguggccucagaagagacaccauaggggcugucacaagaaggccaccuguccaucguccucauuugggacaaaugucucaggcgccucagauuuuccacuauucugcaccugucuacagcugauggcugaacuccaaauauuggcuuugggguaacauuucacagagauggaaucugcaaacagccaucuucuugaauucuaggaaggaacacugucccuaacucagaggauccugaccuaaagugagauacugguccaagauuaaaggacucuugacccaaagugaggugcugcuggagcugggacuccuagaccagcaggccggccucuguacagccacucccagcagucccauagguauucgggcucacgggagcaaccugggacucugccucauucagugucggaugagggcaggacagcucugugcaaagcaguaagaggcuuaaguuucuuaggggagaucauaucuugacccuugagaacacaaccaucuuuuuauuuauuuauuuauuuauuuauuauauguaaguacacuguagcugucuucagacauaccagaagagggagucagaucuuauuacggaugguugugagccaccaugugguugcugggauuugaacucaggaccuuuggaagagcagucgggugcucuuaccugcugagccaucucaccagcccgagaacacaaccaucuuaaaguuguucaguuucccuacucuuacagagaauaccugguguggagguacaguguacaaaggugugugugugugugugugugugugugugugugugugugugagugugugagcuaggugacuugguguuaaagauguaguggucuggcaggagacccacuccccggagcauucaugugauggguuagggcuggagcgugggaaaggugaggaccuggauauggaagccaggcucacaagguuggcucaggaaggcccugucagagaauacugaccagggugugcugauaguucuguuggugagugggcuaugaacuuucagggcugaauccucucuuucauauguugacuuuaguggacacagagaggcuguaaugcaaacaggaaauugccugaguauaguuuuccaugugcgcuuccaugguuuuuucuaacaagccaaaacagauguuuaagaaacaucuaauuuuuccuuuugagggcgggacaugaaaauacccugagaccguggggccauucccaaagccacuuuuuaaauuucacaaacaacuuaccuuuuucaaagacacuucagaccuaauguuagucacucacuaagaagaaaggacaacaagaguggaaagacagacuuacugugagcaggcugucaggagagaugagauuuugauuuagcaauaauugaacucagacuaauacagucucuuuuuuaaucagaccauugacacucaggaagauuucuucgcauagaaacugcggagggcugaggauguagcacagcuggagaaguaccuaccucaaauguaggaagccccaaguccaaccccccccagccaugguacauaaaguggccguggugcuucaugacucugaucccagaccucaguaggagcugacauucaagcuuauucuuggcugcaucaaaaguuugagaucagccugggcuucacuuaacccugucucaaacaaaacaaacaaaccaagucauaggaaagaagcaugccuuucggauauaaugugagagacggcauuguguuucuccaguggaaaacaaagacugcagugugucggaaguccuugucauuaaagccauggcccuccucuuccuagucaccacuggccuuccuuuagggaguaagauuaggcucguugcuuccuggagugaaacaaauguuucucaagaccuauaaccaaaagagcaguacuuuuuaacuuuuaaaaauagcaauuaaaagagauuaauggucgccguuguugcuuucucaaaugugugggauguuuguauuggcauagcaacaaguugaucagaauuagccuguuguuuuucaugauacaauccucuugaaucagugucugggucauccccuguauucugcccucccaccuacccaucugucuauacacccagcuauccacccacucagccaaccacgcauccacccaucuacucacauauauaucuagccacuuacccacuccauccauccacucaugcguuugccuacccacccaccuaccuguccaccaauucaucugcccccacccacaucagcucacccuuucuuacugacugacaaagggagucccuuguaugucaggugcugguguguacaugcgugcccgguggucaggcacuugcuguagggaaagggcucaagccagugguaucagacgaugcagucauguuuccuauucacuaccucccacaaugguuuaagaacaggguugauaauuaggcggagcuuguggacucuuguggaagagggggaagaaggauuggaggccagagaggucaaggacaccacaagaaagccuacagaaucagcuaaccugggcccauggggugccagucccagacugcuuccucuuccugaaugacgaggaugcagguagccccucugguacacagaaccucuuacuucagcauuucuacuugguauauggguuaguggauuccauuucacucuugcuuccuccaaccucagggaagcagcaaagauccgccggggucaagaagccuggggucagcucuuccuuggguagggugaaugcgggcccguggccuucuguuagccaggcggcugccugacuccuggauggcugcccagugggauaacaugauuuauccaucuacuuggcugcacccagaguguucuggucucugugcagagcaaccuugguuaacccgcucaauuguuuagauaaugauguuuuugguacacuacuauauccacuguguaagaggaaggguggcccuucaccucacugccugccucucuguccaugaugguggguuuugugugucacugcuguuagaucacagcucccauauguguggucuuauauccuggaugccucuguuuaggggguuuagaugagacggagacuaaaucaguagucugugaguaaggcagaguugcccucaaaacuuuauggacuuugugcagucaguucuuuaauagagcagaaauaggucucccgugagcaggagcugacagccugugaaccuaacccagcuucacguagcuucucuugcaggcaggcagaccuguuugcccaccuucagacuuuuggaucucuuccccucuguguucacagcauccucuugagaccccugacuaacagugucuguguggucuguugcaugagucugauacuucuaggucauaggugacuggaucugguuggguccugacuuaagcuagcucgcauccgaugcaugaggaucgcauggagauagcuauuacugucacgcuuaggagaccuauguugucuccucagaacuugagccaagaaguaucaagggaaggaacagaucuuaaggagguggggggagagguaaccaaguacaugcaucauaagagcaucagagggcagggcauggggagaaggucaauaagaacagauggaaaauaccauaacaaaaccuauuaguauguuaauaaaaaaaaaaaagaaagaaauuguuuugaaaaaggaaguggcagccuguggcaagagccaaagaccaggcugugucaguagaguccagaggagggaggggggccauaggagaagaguaaagugcuccuggcagugggugguaagacccuggagauguuuuugguacacuacuauaucuacuguguaagaggaaggguggcccuucaucucacugccugccucucuguccauggugguggggggcuuccugaggggagucaguggguagccaccucugcccuguucagcaccaggagucgaguccuggaaagaguugaauuccuggcuacugcuugacugaaaggggaaggaaggucaaaagggaaggaagguucuuagugcaggaacaaggccauugauaaaaggccauuuuaaaaguacuuuaauuaagaaaauuugcuaaucuuggaucuauaaucuacaaggcauacacacucaguuuuuguuuuuguuuuuccugggcaucuuuuuaaaaguauuuuuucaaguaguuuuuucaaguauuuucuaaagggaaaccugauacccaugacucugacuuuuccuucaccaugcuuucucugugggugugcaggguauuuguuuguuuguuuguuuguuucccuguccagcucuguguguuuccuuguguccacuauguaugccugaguucgaggucauucuuagcugaguguuucugccacauuguuuacugaagagcaguucugaggcuuguagcaggucccaucaaccucauccuugcucaccugagggugucugcuaucuucuugagcccucugaugcaauccccaccgcagacccugggaagcauugaucuuagucucauuuuccagccacagaagcaaaucgugggagggcucuaccgggguuuaugaggggcagaauugaguuugccaucacacagaccagagcuggaaagccgccuccccacagaauacaggagaaccaggggccucugaaaucucauacccugcacagugagucacuccugcgucccaggaggggaagaccccacgacugcacugaggccuguucuuugaauuagaagaugcagucacucagcaccuguguccuguuuucauaacaggaagacuuguccaggccuccuccagccucagccgaggcucccuucgcccagugcuggaacuccgagugcgugacugcuaggaauggguccuccguggcugcuguuugcuuggcugguuccgauuaggaagaugucugucuggcuauguuuuuaccgccacacuuacuuggaaaugauggguuucaugcucuaucguguguugguuuuuccuaccucccuguuugcuuagaauaagaucuugagcccuucucucuccugauuuggguuguuguuuuuacuguugacccucaaauggggggcggggugucuggaagagaauacaaugcccuugauagagucuacaaguacagcauucuggccaauuauucaggaggagggaagaauacugacuucaguuuucagcauucaugggagauguuugggguuuguucccagggaaacaauaugcauggacuagcgcauuugaauuguuuauucauguguguagcagaaggcuuugcagugacuguguuugcaaguagccugaaaaccucgcuguaguaaacaaaaccuagaaaugcaucacacuucugggcccagcaguuggccaggccugcagcaugcaagcaguguguccuguguccuaacucucugggaccuaaggacaauuugagccugguuucauccaccuaagcauuuccacuuuuaagugacugaaaaauuucacaagaguuuuaugaaaucggcauccaguguggcgaguguuaguucauugguuaaugaaucguaaaccugguagaggacacaguggggagacacugaccccaagagauucaauggcccaaagcucuuccacaaacaagcagaucuuucucccuguucagcauuccugggcccuguauuuguuucauuuccuguugcuaugaagaauauucugacaaaagacauguaugagagaaaggacuuagcucacaguuccaggguuccaguccaucacuucagggagaucaaggcagcaggacagugaggagcagcgagaaaaggggugccuguguguuugucaguggcucagcuuggcuuuucuuuuuuucuuuuuuuuuuuccauuuuuuauuagguauuuagcucauuuacauuuccaaugcuauaccaaaagucccccauacccacccccccacuccccuacccauccacucccccuuuuuggcccuggcguuccccuguacuggggcauauaaaguuugcaaguccaaugggccucucuuugcagugauggccgacuaggccaucuuuugauacauaugcagcuagagacaagagcuccgggguacugcuuaguucauauuguuguuccaccuauaggguuucaguucccuuuaguuccuugggugcuuucucuaguuccuccauugggggcccugugguccauucaauagcugacugugagcauccacuucuguguuugcuaggcccuggcauagucucacaagagacagcuauaucuggguccuuucagcaaaaucuugcuaguguaugcaauggugucaguguuuggaagcugaucaugggauggaucucuggauauggcaaucacuagaugguccauccuuucgucacacuuccaaauuuugucucuguaacuccuuccauggguguuuuguuuccuauucuaagaaggggcaaaguguccacacuuuggucuucguucucuugaguuuaauguuuuuagcaaauuauaucuuauaucuuggguauccuaaguuucugggcuaauauccacuuaucagugaguacauauugugagaguuccuuugugauuggguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccgguuggggcaucuucuggauauaugcccagaagagguauugcuggaucuuccgguaguacuauguccaauuuucugaggaaccaccagacugauuuccagagugguuguacaagcuugcaaucccaccaacaauggaggaguguuccucuuucuccacauccucgccagcaucugcugucaccugaauuuuucaucuuaaccauucugacuggugugagguggaauucagcuuggcuuuucuuuuauacggucucaacccagggaacaaugccacgugguuuuggucugggcuuuuccaaauccauuuauguaauuacaccaaucccccacagagaugccuacaggacacguggucuguacaguccuacaucuuuccagaugauauuagguugggucaaacggacaauuaaaaccauccagcuucccauggggugcauguggaccugcagcugucucuggagcaugcaugcucucuagagcucugugcuugcagccuuggcuugaacagguaucaccauggauccagcccugcucaccuaguuacccagaucucuuggggagcugcucaguuaaccaguugugggagagccucacuacuggguuuuguagcuuccguguccucuuccucuucaaugaucagcgaaacauagcugagcagagcuccuguugggcaccucuucgucuugcacccugauuacccuuucccagagcagccucugucugugagcuugcauggguagcauuugaagagguaaggaaacuagacgugaacacacacgagugcccauagcgucuugucacguguguugcucagagccugcuguauuuuauagaggauucggcauccggagcugaccuagcacccugacuuucccaguaccagccggugcucagcugcugacucuguguguucacacaugacugcccuggaagagcagacuggguaggacaugggcaugucuggcacucccccguuuggugcuuuaggaaggagcucuuggcucguuaaaagcuguggcgucuaucccaggaaacaguccgggcuuugaaacaauuguuguguuucuucagccaucucccacccccaucuucauaagucaaguugcccuugcgucugacacuuucuuugcuucuuaagugaggaggaagugaugaacuagacagacacauaagagagugagagacagacagacagacaugggggcagggaacucucagaggcuauccuccuaaggcccuggauaauagaucccucucagguacucccaaauauauucuccucuacagccaccuagugugguagcguaguagaguagguagcaacucaucacccugagcuuuggaaaugacuuggucagagaacuugaaggaggucucucugcucugugauaaaaagucaaauuacauucuucaaacucucuggagacuuagaucuucaccccccccccaauacccuguaucagaguuuauaugggaaaaccaucugugaagaacaaagcagacacuggggugacuuuucuggccgccauguuacugugugcacgcaugcaagugcugagccuuugcucaucgcaggcauggcuguuuccuaugggcacagggagaauguuuagccccucugagccuagcauucauuuaugaaugguguguguguggcuuucuaaguaugacauuugguauaaagucucacauaguuauguuuguggagacaagaugucuacagauccauuuugggcauuugggguaacuaacaucacuagauggcaaaauagcuucuuaggaguuuugugguuuagaagguagguagagucuguuguagagguuguugcaguacccaggauguguggcugcuuugaccucagaggagccugagggcuuaccucuuggcuuugcgcagucaucccuggccaguguccuuauuugcaaguacaauccuguuuugggccccguggaugauggugagcaauucuugugagaacccaucuguacaagugggguuuucauaagagcccaugugcauaguuagcgugucaacagggaaccagcagagacacaggccaggacccagcuuugugcuucucagugugucauugguuauaggggaucuaugguacuuuuaauuuuaguaacucugauaaaggggaguguaugccuuuguaugguuaggaaaauaugccuaaggaucuguggauaccugaaugcugagcagggucuguaaaguccucuggaggcuggaaccacgagcuaagagaagugaggugaaauucucuugugcugugaguuaaaguugugcgcugggccauggggaugucaggaaagcuagcagagcuagcuagugacccgcucagccgcugagugagugauaucuucuauuguuguaaaaaguucccguuaccuccaucucccuccaucucagcagcagaacucaacagcaguuccccugcuaccucaauuuccccuaaacaguugguucaggguuguucugugucugcugauuuuuguaccugagcagacucccuuucugugccgccugcugggauacucagagucagacuuuacccucagcacccauguggccagcccuuugugugugugcuccguacugcccuaaugaucacaggagagucacaaacaaggcuguuaaucaguguacggccugucaggaaaucaccuugugacucuguuagucguuguguacaaucaauaugacaagugcucucucucucucuuuauccucucucucucucucucuuucauuauuuuaguugggcuauaucauuaaugaguuucauuuucacacaauacauaaaaucacuauauauuuuuauuuuugaaccuguauguaugcauguuuuuguguguaggugcacacgucaugugcguuucagugcuggucagaagauaacuuugggcgccgguccucaggugcccuucacuuauuauuuaaggcagggucucuucugagucuggaaccuugccaaguacacuacaaguguacccguugcccuugacuuuuuacaugguucucuggauagaacuuggggucuguacacuugcuuuaccaauugacccgucuccccagcuuuacauauuuuucaucugggcugcauacauaucagucuggagcuuuauugguuacuuuuguguuauuucuauaaaguugugugacagucauaagagaggacagguuuauuuugacucacagucucagagagcagggaucuccggaucauggugucagaaaauauaguccaucauuccaaaaagggcagaaaucaugguuucaggggauacaguccauucuggcagggaagaccuggcucaagggcucagagagguucaguccgucguugcaaggagggcauaacagcagggcugucuuguuccucaugucacauggacugaaacagcaaaggcuuuggaaauaggcgugggcucuaagcccuugccuuuuguaaccuauuucuuccagucagacuucaaccccuaaaaguuccagaucuucccaaaauaaugccaccauccuaggaacaaaugcucaaaauguaaguuugggggugcuucagauguggggguuaauucacagccauuccuaugguaacucaacaacaguauugucaauucaagcucagcauagccagcuguggcugccacacagcuugacgugguagugcaucauuuaugggaagaaccauuuucuggucaaggugaaugcaggucuguguuucccucaaggaugcugucggaaauaugagagccccaggcuagagacacgggaucucagaacagcacuuggcaucacauaacauuguuugccccaccuguaucccuuguggcgaugcaggcagauagagcuaguuauaggagaggaacauugagccuugggacaucacugcuuccauagagaaugguagacagucuguucuuggcagagaagagaugcugccccauccuucaggguugcauguugcaaaugcaacgcagaagaauggcucagaucagugggagccugagucuugcauccuuucaggaacauacaucuaccuaggcuuggacuuaggagcccuggcaagccucuuccacagcacagccaggacccauagcuuucucagaccaggaacuauugcugggacaggaccaaucucugcugucaaaguguggaaaggugucucuagagccccacucucuguccugacacccagauacauggcugucacuuuauucugggcuccccagcuggaaaccagaguuaucagugcuucuccauugcccaugcuuccccgacagacacuguucccucggcgcugguguggugacuccucucuucagggugguucugucaguguugacuguugaacagacagcccccccccccacuuuuucaugaugccaaagucaugucugauccucauacuugacugugcccuuccuuagcucauggcuuauguuacuuugggaaggagcuuggguuucacguccugcugagcaguaccaugccuuguacugauuagagcugaguacuggaugcccuaggacaaugagauggauaaacagacauguguguggauaagauugacauugccuccuaauguaacuggucuauugucaggacagaagauagaugggagguaugggguaguuaggcaagggcagagaucacuggagcuuagugaucgaguccuccaguggacuggcaggucagagaugagguccaugcagcugagaggaaggugaggaacucuuccaucacccuagcuccaugagccuuauacucuggcagaaagcaagacacauuuuccucccacugagcuuucugauuggaaccauguagagacaaaggaugagccuuucuuuaaacaguccaggccuuggaaguucucagcaggacagggaauccaaagcaaauauuagcuacugaguuuacacacagcagagaugggaagauaacuugagaagggccauucuucccagacuagaaggcugggugugccccccuuguucccaggacaagguucauuguucuggcuggggcaggguucugaugaggguuccugggucauuucuauccccaggcuuuguggagcuucagcagccuaggaguagucucaguuguuggucaggguacugguuauucucaggcacggaguccccauguuccuucuauaaucuucuuggggguaaacuggcagacgguugcuuugugcacauggacacaacuuauuucccuagaauuuugacaaaggacacaaaaccuuugguuuuccugcuguguaugacacagagucuucccuugccacacccagguauccuaucugguguagaggugcccuucugcggguguguggcucgcucuuguuugcuccacuguagaaaucuggcaacacugccaggagacagaaucuggagagacccggaugugugguguguuaucuagcaaggcagaggagccugcuguuaaaguagaagugucuuuggugacuuguauuugccaacuuaauguuugaaagacuuggcuaaugcagcugggguuacuuaacaaugcaucuuuaaaaaacuuuucagccauaaggaaugaaguucugucuuuugcagaaaaauggaugcaacaggaguuagucauauuugaguaaaugaagucagccccaggaagacaaauaaugcauguuucucccauuugugggcccuggacuuuauagauacaaaaaauaauguguagaggugacauaaaaaucgaaguaaacuauuuaacaugacaaaagggacuacuguagcagggagaggggaaaggaggcuuguaguguuauguaucaggguuauguuuggaggacucugugcacacaauauaaaugcccuuguauaacuguauaauagguaacaaaacaaagaaacacacuuggcucauuaguaugcaguuuuacuuuugucuuuaauaaaugguaaaaauucuauguaugccaaauauuuuuuuaaaauacauuuucuuaugguuuaccaucaauuaaggaaaaaaaaaaacaccuuaauuggauuuaucgguuuaauguuuaggagugacuuggagugccugggggggcuguguuuuucacaguucucccuuaacuuguuccccgaaagacucgcuaggacaugauggaaggcuggaacuccagcuuagcuggacucaaggguuccgauaaccuggguuuggaugcaagcccuuacccgggaauagcuggcgcuggacuaauugcccuuugaaagugaauggcucauaguuuaaaguuguuuucuaaagcacugacagugcaauuuuaaaaauguugacuguuaaaaaccgucaccaagaccccaaaccuaaaacaagcagcccauauaagcaggguucgguccaccagcuccuuccauacuugugggguccagauucuaagccuuuaaaaauguugcuggauguuuaguguuuuuuuuuuuucccuaagaacaagaccuauuuuauuguuugcuucuuuauuguauuuacuguauaaauacauguaucacugccugugugugcauacaugugugucgcuguggggaugaacuuagguuggcuggcuugguagcaaacacuugccagcccagcucucccauuagcccaguuguguguuuuguaagaagcucacuccugaaggcacaucacagagcucuucucuuagagccgagcugcaugaccuuaccaugucaacaugccugagcacgucagcaggacuucagcacagugcuugcacacauggaaguucugcuaagcugaggcgagauugcacccuugggcuucucucugcuacagagccacagaaccccagaaguguaugucaagucacagugggauccauccaggacccugacaggauuuuccuuuuucuuucuuuccuuuucuuuuauuauuugagauagaguuuugcuacguagcccuagcuggucuagaccucauuguguaaguuaagauggcuaccaacuuacagauagcaucccaccucugccuccacagugcaggaauuaaaugcaugcaccauuacacugggccuaacauggcucuugucucagcuuuugagacugcacccagcuuuucuaaaacuaauacagcuauaaggaguuuacauggugcauagcaaagaaugcuucuggaccaagacagccagugccaggcccuggaaccaggaguugcguuugauugcuggaugagggagaccuaugugugcuguggagacuaagagggagguaggaaggccuugcugcuuuaccuuagcaacaguuguggcagucauugaacggguugauuccaccagugauucugacuucauuaggcccgagggucccaccaguuguuagaggaacacucuucacaagaugggaagugcagucagacuagaggguggaggguggagcuggagauggagggacagauggugcgggaggugaaguagaugugaagucuaguuacaccuuccuguagcuagacaugggaaggccagggcaucugagaugccacccucaaaguccuaugcugagcuaauaggaaaggaugucccuuggcguugggggguggggggcggagguaggggauugucagucacaauguguuuuaguuaggguuuccauuccugggaagagaccaugaccaagacgacucuuauaaaggacaacauuuaauuggggcuggcuuacauguucagaguuucagucccucaucaucaaggcaggagcauggcagcuuccaggcaggcauggugcaggaggagcugcaaauucuacagcuuguuccgaaggcaaacagaagacugacuuccacgugguuaguagaaguucucaaagccuacccccacaaugacacacuuccuccgacaaggccacaccuccugauagugccacuccuugguccaagcguauucaaaccaccacacagugucaaacauucuccuccuuaaaccauucgaaaggauuuuguucuaaacacccugguguugaguagaauguacucacauguucaaggcaagaugggacucgagaauguguucccauauucaaggugagaugcugaagaguaaacugcucuugccuaggcaggauggucaacgggacaccuguugaguucucugccuccaaguccucuaagagaggaggacucuggagauguggaagguauaggucacauagccucuuuccuacuugggccccugugcauggcagucugugucugaaauugcucuuaacuucugaguagaagauguacuuaagcaagcuaggauaggauguuauaagucucagcaaaauguaugauuucaaccuacaguauagaagcaaggcaguucagcauucagacugaggccacguauccuucuguacuugaagagacugcuguacuuuguugguggggaucugcgggaagagaauacuugugaacucugugugcucccuguaccacgccgccacagaucauugaagaugaaccauuucaaucagaaaaugccccaguagcauucucaagcacaauguaaugagcuuaggaaggauccugucagcuacagauucaacgaugccaggagagauagucuccaagagccaaguuugauaucuagaacccaaguaaagauagaaggagagaaccuacuuuacccacaaaguuguccucuuaccuuuccacauguguacucuccaaacacacacacacacacacacacacacacacacacacacacacacacacacacaaagcaagcacguaugcacacacacauccauaguggagagguuguaaauggccaugaucauuaagcuuaagcgcaucucucgggacagguaggcagcuggcaguagcagacuuccaggaaacugcuggguggaaccugcugagugugugcccaccuucuccaccagcauucauucgguucagcgcacacuaaauucccucggacucuaaauucuccuucugaacuuguauguuuccccagcacauaccaagcccugcccugcccugcccgucccaucucugcucaguuuccacaagugucauuccaaugcugggcaaacaguuugcuaauuuauaccacaggaauucccuuucagcuguagacauggguuugguggcuuuuguaaaaggcaauacauugauucccuccagccucuuuugcuacuaacaucucaagcuaugggccuccauccucagcagggcucagcaguccccagggauugaagagagaaaggggugucacaguucccucagcacagagcuuuccaucagcaucccuaucugcuuuccuucuuccacuaugcaagcaucccucaucccuauggcuccuccucucaucagcagucugauaacagucuccuucccaggccucuguucucuguguccucucugacuccuacaaacaaugaccugcuugcaaguguugcugucaucuccccugugggcuguguaugggacuacgguauucaguuucagucauuccgaaaauaagugugcuguggaagacugugccaaaagacauccuaacagacaggaaacgggcuaaucuauguuuucauuccccucuggggagugaugcugucuuuaaccaucaccaguuaguaacaucauuuucauuaacagguaggcauucguucauaagcacagaaauuucuuuaguaccaccaaacauugcuaaaaagaauacagacucuaguuuuaggguguuuucagcugucacucuguagcuguucagcauuucaugaugagggacuggucugucuggggcuggugagggaauacucagucaggguccugcuaggagaaagggcuugcaccugcccuguaauaauucugauuuucaaaacaagaacguauuuaaaauaugucuccuacuaaggcgaggagacauuagcuccuuuugaugaguggugugagccuacacuccuggagaaguuuaugucaagucaacaaugucuucaagucuagggcacaccagacccacacucucugugcaucaagagcagaaaaacaaggucaguugcucuugugcucagcagcuuuugacacuaugauaccacugaccucagaaguucuccauagcauguaaagaugcugaaauuaaccuuaaaaguccuggcugugaagagaacgugguaauagagucacaucauguacgcaugcguccaguucagcuccgugaugccuuacuucuggacuauuuguaggcuuacuaguagaaacaaguacuaaauacaaaacuacaaaucacagcccacagugaggcgcaggcuauacagucuuccuaccugaaaaguagcuguauguguguugaggaucagugagcaaagugguuuugguucucagaccaaagagaagauacuuauuauuuuuaauuuguugaccaaaucauucuuaauauuuuuuuuaagauuuauuuauuauuauauguaaguacacuguagcugucuucagacauaccagaagagggagucaaaucuuguuacggaugguuguaagccaccaugugguugccgggauuugaacucuggaccuucggaagagcagucgggugcucuuacccacugagccaucucaccagccccauucuuaauauuuaaauuuaaaaauaaaugcaaacauaugguacuuuuuaauggggaaaaacauuacuuuagaagugguguuaucgaagauuacaauaaaugaacuuuauaugcaauccuuaaauaugacauuuuuguuuauaguuuuuucugguuaagguacagaucacugagugggguauguguccuaaguuauugugaaaggagauucugagacagauuuaaggagucuaaugcucuacugaggcuguaccugagacagauuuaaacuuggauuucggacugugaagauggcuuagcgagaaagugugcuugcuguccaaggaugaagaccugaguucagaucacuggcaccugaacuagauguggccauguauuucccuguaacuccagccuccacacauguacacacaugugcccuugcauauauguauguacuacgcguguacuuacagccccagaucccaagacaacaaccaaacaaaaaucuuuaucuuauuuuuauuauuugauaguuuuguaauaaauuauauuuuaacauuauauuacacuacuuuauuuuguaugugugcauuuuacaugugugccuguacaccauaguacgcuuguagaagccagaggacaacguugggguugcuucucuccuucucucacacgaugcuggggaaucaaccuuagggugucagguugggucgcgcgcaagcuucgcagcaagcaccuguacacccugagcugucuucuugaccucaugcauuauuacaguuuugauauuuaauauaaucaugaacucuaguuuucaagcaguagguuuugcuauucugguagguuuuguguuucuauugagauuuuggaacaaugaggaaaauaagcaaacauuaaaagcaagacacaucuuuaugaaacucuuugcaagcauuuuaaauucaaaaccugauccucccuguguucugaugcuaugcuggagugggagauuuugcauuucauuuuugacccuuauugaggucucuuugcauuuagaggguugucccaguucagaggucggugaugucgcaugaggaagaggggaaagggugcuuagacuggcugguuuugugugucaacuugacacaagcuggaauuaucacagaaaaaggagccuccuuugaggaaaugccuccaugagauccagcuguaagguauuuucucaauuagugaucaagggugggagggcccauugugggugggaccaucucugggcuggugguccuggguucuauaagaaagcaagcugaucuguaaggcaaaagacacugucaauaagacaaaaaggccaccaacagauugggaaaggaucuuuaccaauccuaaaucagauaggggacuaauauccaauauauauaaagaacucaagaagguggacuccagaaaaucaaauaaccccauuaaaaaauggggcucagagcuaaacaaagaauucucaccugaggaauacuaaauggcugagaagcaccugaaaaaauguucagcauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggauugcaagcuugcacaaccacucugaaaucagucuggcgguuccucagaaaguuggacauaguacuacuggaggaucccacaauaccucuccugggcauauacccagaagaugucccaaccgguaagaaggauacaugcuccacuauguucauagcagccuuauuuauaauagccagaagcuggaaagaacccagaugccccucaacagaggaauggauacagaaaaugugguacauuuacacaauggaguacuacucagcuguuaaaaagaaugaauuuaugaaauuccuaggcaaacggauggaccuggagggcaucauccuaagugaggugacccaaucacaaaagaacucacaugauauguacucacugauaaguggauauuagcccagaaacuuagaauacccaagauacaaguugcaaaacacaugaaacucaagaagaacgaagaccaaaguguggacacuuugccccuucuuagaauugggaacaaaacacccauggaaggaguuacagagacaaauuuuggagcugagauuaaaaggauggaccaucuagagacugccauaccuggggauccaucccauaaucagccuccaaacacugacaccauugcauauaccagcaagauuuuguugaaaggacccugauauagcugucucuugugagacuaugccagggccuagcaaacacagaaguggaugcucacagucagcuauuggauggaacacagggccuccaauggaggagcuagagaaaguacccaaggagcuaaaggggucugcaacccuauugguggaacaacaauaugaacuaaccaguacccccggagcucaugucucuagcugcauauauaucagaagauggccuagucggccaucauugggaagagaggcccauuggucuugcaaacuuuauaugccucaguaugggggaacaccagggccaagaagugggaguggguggguaggggaguggagggggagagucuggggggacuuuugggauagcauuugaaauguaaaugaagaaaauaccuaauuaauaaaauugaaaaaaaauaagaaagaaagaaagcugagcaagaagccaggggaaccaguccaguaaacagcagcccuccauggccucugcaucagcuccugccuccaaguuccugcccugugagaguuccuguccugacuuccuuuggugaugagcagcaauguggaaguguaagcugaauaaaccaucuccuccccuacuuguuucuuggucaugguguuuugugcaggaauagaaacccugacuaagacagugccauugagaaagagucugaaaggagccaguagcuaagucuuccagagccuucccuugcacuagucugugcucagucaagcgugauucccacccauuggguuucuccuacuguguauaaaauuaaagaauuuggaaguuuuuaguucugaguucuuacuugccauguaagagagcuuucucuggccugauucuaaugcuccccuccuuucccccuggcccaguuuuuauuuccuuaaccuaauaucccagggcuaggucuuuagaauacaaccuugguugccauuauagccagauaaggacuguauggaaaaccaugaucuugcccuaaaaauuacuguguagggagccuuugagugacugccuaugcauucuagggccacccaaaugccaagccuauuuaacaaacacauuggcacccgguuugugccuucacugccaucucugaguucugugggauacacaaguacaguugauacucaagauuaguguuuguggggcuagucacuuggaucugugcccuuuguggcgugcucccuggucucacuucuauugguauuuaugaucuaguguccaggguuuagggagaagcugauguucaucacaaagagcuuuuguauggacgcuucugggguuuggguccuagcggcaacagagcacucagagguacucucucugagguucacuuucaaaguugcuuuuagguaauuauucuggcuauggccuucccagaacuuucuagaauccaccuccauuccugcuucaugccaacuucaugggggaaguuugagacauucauuauuugcuggggaaauguuuuuuuccauaccacgauggugggcuccagauggucugagcauuagcaagugggugggaaucacugucucuguggacagcagcucacuuuccccacuccuggcuccccucucuugcccuccccacuccugcccccuuccccuucccccaacuccuggaccaauagagaagagagccagaaagauacuuugacuaaccgacuuucuuucuuucuuucuuucuuucuuucuuucuuucuuucuuucuuucuuucuuucuuucuuucuuucuuucuuucuuucuuucuuucuuucuuucuuucuuucuuuccauguuguuuagagguuuugguggaucucuuaugauuuuaaaaaugagaguuccaaaaagagagagagagagagagagagagagagagagagagagagagacuucuaaugucaucugaguuguguuaaaucuaugaugaagaggggcaaggaccccacacuccaguucucuggucugucucucgaggccugugcagauguuucuguaaaaacaaaugaaggguugaucuauucacauuuaaacuucacagcaguauguaaguggacuaagggcuggagaagaaagagaugcagcagcugcugcuugcacacacaaaugauuauacaugugugaaugucauuuucauaucaugcauguguacacauguaaaaauacaugugugcugugaccuuccuagcagacugaagggcauuguuuuuugaguuucaucuugcuuucccuggagaguuugcuaaaaacacacacuucugccuugccccacaguucccacauuaugcucuuggguguaacccagaauuugcuucuaaaaguccccaguugcuaccuccaccauuaccuugcugcuuacugggggcacugcaggaaccuuggaagggacagccuucccuauggcucccuaaaugaacauucauucauguagcccugucaugagccugcaugcccuugaacuuugcuaacccuugaaaggguauuuguaauaucccaaggccauagcauguagaauuggaccauaggaccaucuaucauuuguccauccuuuucuucuguaagaugaaaauguaugaagcugucauagugucuccaugagguuuggacauguagacuggauugucagccugcuccaguucccauuucagcuaucuuccuuuccuauggucaucagagagaaaaauauacaaguauauaaggauaaauauuugugcuucuacuuggguauccuccaacguucagcuuggccuucaaagaccaguuucugcaauauugaguguguugcaaggucuguggagugagcuuuucaucucagcuacccuuugccaggucuacaaugucacuuugguucauagcgguuucaguuucuugguuaagaacccugcuuuguugcauaggggaccgcggacccucugaccuucuuagcaucaggcugugguuggcagucuuugauugccuguguacacuuugugaaaucacauucugaacuugcaccaguuuugucuagcaggaaugcauggugacuaagaugcagucacauaacaaaacaaaaaaaaaaacaacuuggauaccaucuuauccaacucugcuugucaaacguacuuagauuucaguaugugaucacuggugugaaguuacaccauaauccucucagcccugaccaugggccaagugcucagagccagcccucugucccuacaaccagaggauugguggccccaacucuagaccagggaggauguccgucuuagcuuucucuuuauccugcuuaggcuucaucuuaaugcaucaauaucuuggcccucacagcugcuuucuagcuuccaagagagucauacacguuguccuucugucuuuugaaguggaauuugauaaagagcuaauuucaagauggagugugugucuguuuuccuaaguugggugugcuuucuugacuguaaguagugacauccggcacaacuucuggaauggaucgucuguccaacacuugugucaggucagagcguccucuccauguuggagaucaugcuaaagccugacuaaccagguuucauuucuuaucaacaguugguccucugccuuccuccuuuccacauaucguuucccugggucccacccuuuccccugacugcuccacaucuuccacugugaaguaaaaucucacuugagugaaaacaucugucagugcagaggagguuaggauuuuacaugcaugaauucuggggaaacacaguucaacguacgucagaauccccuaucaaaguuggaggaaggaauuuucauuuucuaagacaacuuacuaaacauaugggcuucuuuauuacucaaugacuuucacguguguaaauuuaggucuuuuuuuuuaaaguuauuuaucguguguguguguguguguguguguguguguguguguguguguacaacuuucuaugugccacucuaccugugaaaguuagagaacuucuuucccuccaccaugugggucccugcugucagguugguggcaagugccuuaccccugagccaucucaccaaccagccuauaaguggacuuuucagcucaagcuagagacgagcuuccucugaggagugaggcagaugucugcucauuuucacagcuuagcuacacccagaggccucugcccugacucugggccugucacaucugugugaguggucagacucucccacgcuugcucugagcucagcuccauuggacucagagccaucuucugcuugaccaucccaaagucaguuauuuuuccucucugguccuugugugcagcccacauaugugccccuccccggggaaaauaagaaccaguuuuaauaauuuaauacgagcagaacucugcuugucuacuuguuuggagaugccugucuguauuccauacauaggauggccuucuuucccaguucuccugccgagaggacucugugcuuugggacaaccaguaaguucauggagauaacaccgugggcccacagcuguguucuggcccauguucuugcuggugaacacugauguguuucuguguucacagcccgugcgaugccuuaaaucuauacagaucuaccuguguauguuuaccugagacuuuuuaagagaaguuugcucaguggacuuggccaaggcuggaauguggaggcagggcauucauuccuggcauuuuuuuuuauguuuaugauauuuuuaaucucccuacacuuaccuguuaagcagauuaaguguaauguuguuccuucacgcagaggaauacuccuauaggaauauuccggaaugguggccuguguaggguaauuuuuauaaugucuuuucaucuugaagucauuuguuuaaggagaacagcugugcauuuucugucauuaaaauccguguccucucucuucacagagaucuucgguucaacagaaucagagagauccaacccggggcauucaggaggcugaggagccugaacacacuguaaguuagaacucguaguuaguagcuagugggagaaaaaagaguggacguuguccuguguaccuguagguagauggcaagcgcuguggccauccccgagugccacaguugcuggguacuuuuggcuacuuuguuggguucuuuuuccuuccaccccuuaucccugccaacucaacacuaaguaagagagaaagaagguuaaaggggaaguggggcauaaccuccaccuucuuaggcuacuuccugcugguuaaaggcauccaauucuuugagacaggguugaucuuaccuuuaggauagccaguuucuucugccugucucuuugaucacaaccacuugacaaacuauaacaugggggggggggggggagcagcagcugcuccucuugggcucuggcauuuuuauacccuuuuaagagcuuccagaauuccaaacuaucuucagcuagcagaaucucgcuccugccggagcaagagacaaaucacagucagcugcuguggacaaucuacauucccacaccugggaucaaaacaaaaacauagucacauaacauaaacggguuuuuaaagaaaccaguauucccacuacaaguggacaugggugaggggagccaggaugguagagaccugucugcccuuuguauguugaccagcacguauaacacucuggggccccagcugugcuuuagcccauggucuucugggugaaugcugaagggucucuguguucacugcagcguucuguguucgcugggcuuccugucggacucucccucacuucacaccucccuuugcuggccucgcugaccuccuuccuguauggcugaggaggguugucaucuccugagcucaggcuggcugcagacaggcaccgaaucgugccaccgaaucgugccaccgaaucgugccacagagauuugaucuccuagggccacaaggagccacagccaacuccaggcucuuagaaguacauuggacacagcucgaagcuucuuccagggaaaggagauaaggaaccacucaaguccugcagggcagagugggagguagcuuuguucggcucagcgccucacccuguggaagaguggcaaaccccagagaaugacauccuguauaugcacgauuggguuagacuggccccuugguccugccagaucagagacucuaggagguggugagcugaagaugcgugcuucugugucaaggaaaggggauuuacuucuuuaguguauauccuaguggaagagagcuaucugguaaccauaguaacucaggcugguccuggagcugggacuuaaucacugcccgcaggagcaucuguacuucaucaguuucggacccuucagaggccguagaagcaguuuccccuuaguauaauuuggaagcguuucuguuugucucacgucuguuggcauuuucuuucacaggcuucuuaacaacaaccagaucaagaagauccccaauggugcauuugaggaccuggagaacuuaaaauaccuguaaguucaggggcagcucuccacccagcagcacugcucucuguccuuagagucuguaacuguaaaaccaagagcugcucuguuugugaguuacuagaaaaccauccuaaaaugguuucauuuuuagaaggugggugaaauucuaaaacgugccauuggcauaaagugauggggugaggugggcagagggacagauauacguggacuaccuuugcugcuuggucuggccuguauaacuucccagguuggaggggcagugcacaaggcucgcuggucucugacgcuuuuccagcuguaaguggguuaugacuguaaguuacuaacuucuuuggagugucacuaauuccuguuaauguuuucaccuuccugauuuggccucuucuuauucauaucuagugaacuagucucuauuuuuggaauauuaacuuuuaucauuuaaaucaucucuugcuuguugaagucagcucuaaaguuuagaaaguuaucacucuuuuuaaaaauguuaggaagccaggagugguguuugugauucuagcacauaagaaguugaggcaggagagccaccuugaguuuaaggacagcauggggguuacauagggauauccugcccuguacuuccuuaguaaccugcccgggcacguacuguaaauaagaaggacuugggaaacaugguguuccuaugggcugugcccagugucauucaggucagaagcaccugucaccugcauucaucgaaguugaugauuucccuaagcaaccuguuuucuuauuuauuuauuuuuuuuuuuagaaaucugcgccauauugcuuauaaacaccuguaacucgagcugauuuuaaaaaccaaaccuuuuuuuauuauuauuauuuuuaagugugacuauguauuggaagucuguuuugccuauagaugucaguggcuuucccuaccgcucuguuuauugauauauuuuccucagugaagcuguugugugcaaaccccuuccccggcuucuuuggcauagaaugcugacuuuccacacuggugcucgaagccaggauggcaggcuucuguucucuggcuuucuuguuagccuucuugcuguugcugcccaaguuccaccgcggagcuuugauuuccuggaaaguggaugguguccacugauggcagcgguggggcugugugugcaucugugguuuuaacuguuuuguguuccguuucauguugucuucugagaauacacucaguaucagggggaauucagggcuucugucuuccacagugucuuugaaaucauagccucuggccuuaucugugauugcuuuccuucccagcagccaugcccugacuucuccuuucccuuccauagggagucagcuuacagugaaccaggacaguuggucuccgucgaucaaacuagcggacaggcugcuaggacuggagccuagugucuccugcagcuuuacgcagguccuggcuagcuucauuccucaguucccuaggauuuuaucaggagaguacuuuaauaaucacuaugauaauggauuuuauuuggaauuauuuagaauaugucuaaaauguauugauguauuuuaaccuugcguauuauuagucaaaacauguuuuuggacucuggauaguccuuauuuccuggaccucuguuguuucuagugaggcauuggccacuuacuucauucauauuucuugauaaugagauggccucuugcagcagaguucaugguacaaggaugaagugugaaauaagaaauuacaauugauucuuagaacaucaacuuuuuuauucuuaagaaaugcauuguuuaagugucuuuaauuuuauuuuuaaacuuuugugugugugugugugugugugugugugugugugugugugugugugugugugguacugggcaugaaauccagagauuugcccuuauaccuuugagcugccccccaaauccuaccagugucuuuauaaacacacauucauaucugcucuguauuuuguacaucauucagaaggacuccaucuuucugcaaugguaaaaggcaauguucuuugguauuuugcuuaaagaaguggccacaggaggcagcuguaacucaggccuucacuaaagagccgugugcauaauuaacucuaugguucuauuuaagaauccagggugcauaaagauugaguuuuuacuaucgcuucaugcuuucaagcagccuggaggaccaaugcccguguggcuuuuguucuagaugcugggcuauugauggggauggacagguccuggaugguuuguguuaagguuugugguucuuugaggaccacuuucuugauuugcacagagggaaaaggcaagagcaucuuugguggguugcagcaauuaaagagagcacuucuggcgccaugaaguagguaggaccuuguacagacagacagcagggaguacagugagugaucugauccugggugucauaccacaagaauuaaggcaaagaauacugucuuguuuguuuguuuguuuccuuuuucuuacacaucaucuuguuaguugacauccaugucuuuuuuuauuuuaauuuuuuuaaaauuuguauuaacguuagcacacaaaguacuugguuuuauuaugacaucuucauaacugugugucauuauacuuucucauuuguucccagacucccuugcccucagcguggcucuuuuccagcugguucucugcugcgcuuuauuacccguauucauuuccaccucuacuucucuccucccuuaaggugucauauucugcuccuaugacauccuuucuaguuucaucauacaacacacagcacgcacaggcacgcacacacacacauuuuauagaaacagguaguugugcuagaugcugagccauuggcuugaagucuuaaguuuucacgugacagggaaucaugggagaagcuugcuguuugacuuguccuucugccugugucaccgaggaaaacaaaccaguuucaauaaaguauagugcagacacaccagucccagagagggcgccaucucuucuuacucaguguggcugcugaagauuggguuaugagguguagugcggaacuggcaugucagcaugccgagaugugacacugagguagcucuagcacauauacugcucccacacuguugaugaaggucacuucauugcagugcuuacuugucuuggaauucgauuauugauuguuuuaauuucaaccauugaaaaauggaaagccccuuucuuagauugcaggccauuucuaaacagacccuuggaaagcaucaugucugcuuuccaguauaaagaaugggguucugggugggagagacauucaagacauuuucagacagccugcuuuuugugagcugugcuggugugccuuuguaguagaaagugcugguuaugaucuuacagucaaugccuuuuacuuguguaugggagucauuuucucuucccgggcuuugaagcagaugccaggacucuaguagucccaguaggagaauccuuugguccuugagguguaagagaagugaccaucgagaguggccugguacccacagugugauguuuccuuuauaccaucaugcagucauugauuuuaaacuguucuccauugcgucaacucaguucuucccgccuggaguugagagcucgugugugugccuaauacuccuccauguuucuuguuucagcuauuuguacaagaaugagauccaaucaauugacaggcaagcauuuaagggacuugccucucuagagcaacuguaaguguccuccaugccgucugccuuauugccucccacagggagagaugacugguugcaugaugcaugucuguacuuucuggggugcagggaggguaugcaugacgaggagaagcaucaguggggcguuuuucacccaccucucccaccuugcuccccugcgcccacccaagagcagacauugcuguguuucuucuaugcaucagacccugacccuccacccaucacaucaggagcagggacggaacuugcuuuccugucuaacaguaagaacuuugguguucacguggugguagagacagacguguaaacaagcaggagacagauaggcuaucaugauaggagcauccagcaugggacacgugcaguuucaaucauaggguucauuguuuuggagagcagaagccuuguccccuuguaguucuagcaaguggguguugagugugccaaaaugcugucuuucuaaagcauaugaacuagaccuuguuaugaagucagucaucauggggucuuuuucuuaggcauaaaguucuaguaagauuaugggggucuucugguuuaugugccuuacuggguaaccuuucacucaguaagcugaggcaauccuugugggauuucaggcuaucuuggguuagcaguuucacugauggaaaacaacuguuaguuuacggccagaguagccuugcacuugaggccugugcgucucuuccuguguuaagacuggaggacuggcacagaugggucagggcagcagcagguagggccauggagugcagcagcccacaugguacaucuauaucccacauuuugagucucugcguaaacugcuucagacagaugaaacggggaauccagguuauugcaaaagcucuuggaacuaucucgaggcuuuacagaugugggagauugcagaggacgugcucuguuuucaugcagacagcacuaaccuggcagugaggccacugaaggagcccagccaggaggaauuaggagcaagaggacuugagugguuuccauagccagcggggcuuucugcucaucggugacagggagcgggauccugagucauaagggaguuuagaaaaaccuuaggcgaggagagacaggaugcugcagcugggguauggcuuucuuucugagaauugaaugcuguagugagacugggggauaaccgcuuccaggugggaugaaugguucaggucagugugucaaaaaggccucaggccucaggcucucucugaugcuugugcagggucuguuauugggaaaagagaguuucaacugccucugcuucagggucucucuacccucuccuguagaagaugcauguucuuaacacucagcugggucugugggaauugggaagccaugaaguccugaaugaagagcccaggggcagcacuccucagggggcccuugucagcuccagaguuaguagcugauucagcaaagauaguccauguaacaugaggagucccucccugugcuccaguuuucucagacacccagagaaggguaauggugcccagaaucuaucuggagccccaacaguccagaguucuacaaacccugaaagccacugcccucgaugcuucucggggaaggaugucuaagacccaccuguucaaacuucacugcaggcuaaagggcuuugaacacaaaccgugaugccuguccuuguagggcucuugaauaucugucuuuguucccucuuguucuuccaguuuagaucaggacuuagguuuaaccagagacuucccagaagccccccaguguugaugguuuaugugagccauagggccuggggaccagaggaauaugcguguuggccuacgcugccuagcacacaccacaccucauggggaguaaggaugucucuuugccccugucuccuuugauguccuuggaucagaugauguacuggggcagucacugacauuggugcucuuuucuugucuuguaaacacuuugucauauagggagcgaggguuacaaaccugcacccaaggauggucauggagaccaugguacugugugucugaggaaggacaggugggcguggacugcggcccucugagauuaggaggcucuggacugguucugcccagagaguugccagggaaugaagcccauauagggacccaggaguaacaguuaauuaaucucagaguuaauguaaauggauuugaagaacaacaaggcuuuauauggaguuauggugaugaagacuguauguuguuucugcugcuuguuucugucuuuggcccuucauugaauaagagcaucuguuaccauggccaccugaguggagccuucucucuaggccagugaauaagaacuugauugauguugucuugaauaaaaaaaaaguacccaugauucaaaaacagcaaacuagcacccaggagaaugaaauuagcuacauuccaaauuguaaauuguuugaacuaaggcgacaucuuaaauaggaagccauauggccucuggguauucaguaugaccagaggagcucugggaaguccaucgccucauaugacuuagagcugcuuaucuccugccugggugccugguuuuguaucuacagcauucuuagugucacauggaagcuuugacaguuucaagugcaggggugcuguggauggcacacggacagugguccugucugcugggcugcuuuugguuuuuccuuguuaucucucacuggguauuuuauagauuauugugaagugucugggccaccaucacuuggguuccuggagacccagggcuuaaguccugagguauuuauugccugugggucauccaaguacaaggcagccugccugcucucacuugugucuucuugccuccauacaccgggcagagcacagggagguaccuagugguauguggauacgaagugcgggaaaacuuuggagcccaaaaucuggguuggcaaaggucgguaagucauucacauuguguggcuguuuuauccccuagguaccugcacuuuaaucagauagaaacgcuggacccugaauccuuccagcaccugccaaagcuggagagacugugaguccugcuuccuucuuuaaucuguaguugggcccuagcuccugcugccugaacagugaacaucagcuuaacacuuccaugaugcuucgguguaaaauccaacucuuggccaaucaucagaagugggacucaauauuuuaugucuuugaaugguaguaaaauagcaaagaaauaugauuauuucuugaaccaaagcacauagcugucaaauccacucauuaaauaaauacagcuaauaagauguuggaucucuugggcucauuuucauauguuuaggauguuauuguuguugaugcuaaguaacgccuuucuguuuucucuccccacagguuuuugcacaacaaccguaucacgcacuuaguuccugggacguucagucaguuagaguccaugaaacggcuguaaguguguauucagaugucuguguguucaugggaguguucaugggaggcccucucuccuaguucucucauuuggccuuucuguggacugggcaagcauuuccagcuucagcgaagccuucagaggcaucucuaugccaggaaggcaggccuguuaagccuaucucagugugaagaggcaagcccgugacccugcuguaugcggcagcaggcugauccuuuaauaaggaucuugacacagcuuuuuaaauuauguuuaaauucccccaauuaaguuuuaauugcgaggugcauauuuuaccagugagaaugaaagccagucuggaagcaacuucaugugcauacguccaguaccucuucuugauauccaccuacuugaauaagcaaacugauacacauuuuuuuaaugccucaagaaguaagcuuugcauacuuauuauuguaagggaauuggaggacuuuaguucuaauggauuucuuuaacacccuggauuguuugcccugugcccuuaagagcacuugcccaauuaagaaguuacuggaauguaauagacagacucucacagaccauacauuuagguaaaacaccaauguacauagaggaaaaacaaacaaaauuuuaaaauaaagaaagaaacacagggagcgauugaaggcgugcgcgugcacagggcaggccucacucggaacagccugcucacaggugcuuuagauggggcugugucuccaguccgguuuuuccugcccguguccacucauaucagcaggaauggcaccuuuuccuaucuguguagucuggucggaggcugaugugucgcugcaguuucauuuagcaucucuaccuuauaagcgguagaggugggcuucaucuccucgugagcuguuacuuuaucauccaugagacaaagacucaucaggaaaaggaaucaggccaggugaauucucauuagggugggaagacaggaugacaacucaucuuugguagguaagagggaggaaagcauugccagauaaauggcacagaaagcagcccaggaggacucagagcagaggguggggcagccaguggacuagccugcagauggauuucccuauucgcggcuucagagagacacacuccucuuuuagaggaauuccaacccuucuuaccccauacauuccuuccuucgcuggcucuacauugcucaagcaggagcaaccuagauuuggagauaagcugaacccaucagaguuggccuugccccucuauggccucacugaaauauccucucuuaaggagcagucgagauggaguggccgccuuccagcugacucaacuggcuaggguagacuggacagaugugccuuggugaacugcccauccagacucaccaacugcccccuugaucuuguuauggcuguaggguccugguauucagaaguagauuccaggcugggugccccagcaagugguagcucuuaucccacccaguguccaucucuugucugagcauagggugcugcaucuugucugccgugucuccucaucacaugauuaaugccuauaugcucaucacaauuggcaugccuuaaggcuccagaaccuggaaguugaucuauccaggauggcucacugucuccuuaacuccugggugucuucuuggcuuuuucuucccacaggcgauuggacucgaaugcacuccacugugacugugaaauccuauggcuagcggaucuacugaagaccuacgcccaaucuggaaacgcacaagcagcagcuacaugcgaguaucccagacgcauccaaggacgcucuguggcuaccaucaccccagaagagcugaacuguggugagugugucccggagacccuacugaaggaccagugugaccccagaaguccaggcuuauccccaguucacguugcagaggaaggcuugucuuccaucaccgaugacugaaacucuagaaagacaacuugucauuuguuuggggguggggugggggggucuguucugagauguguauuuaggccaucccugccaugaggaauccaguuuggguucccacacacgugagccucacauuuuucucugugguguuuguuccuugcauguagaaaggccccggauuaccucagagccacaggaugcagaugucaccucagggaacacaguguacuucaccugcagagcugagggcaaccccaaaccugagaucaucuggcuucgaaacaagugaguugugcgugagcagaaccgaaguccugggggccacaucaggagccccauguacccccauggggcuccccacccuugauaaauacccuccccuucuaaguaggaagggaugaaggaaaaaaugauuccuuaucuucccucuuccacauagcagcugccugggagacacuuuugagccugaaguguuuucuccccgcgggauucauuccacuuaggccauaggucccuuuccucuggucaaccacugaccuggcagcacacuggaacuuucuugccccaucaagugggagugagagaagucuugcaugcccauuucugcccacuuguucucuggccagggccucugguguuuggcaagaugcuuguggguuuuggacccaagccauggugaugggcagccuggccuuagggguugugaugagucuacacaggcccuguucguuggcuucuggagucacauccugagugaaggagcgucucuucauucugccgacagagaugugacggccaaacaucuggcagcaguugcucauggguggcagaaggggucgccugccugccuaccugccuccagcuggaucugagaguuggguguugaguuuagcaugggaagggguggacacagagagagguggagagagacacacaugguugggguugaggcaaucaguggugaccaugauaacaggggcagagacucagaugggaaugaggucacaguacaugggaguuauagcuggaagguagaauucuuagaggaaaauccugaacacaccauuguaucguugccucuuaaauccauuuauaccgagaggcaccugcccaagcaaggacugcucucacagccuggcuccugguauguuugugccaagcucaguggcuguguucaguccuguggaagcagagaggccuccuugagaacauuacuaguggaauuucagaacaaaagguucagacgcugacugccaagucauccuuguucuagcgaaacucucuuaaguacagcucuguuagcagaugcaacagaugggacagugcgcacucaguaucugagagaggcuagggacacaguguagagacgcaucagagucacaacgagcucaggauugugcucuugagguggucacauugguguggaucgaagcugcacggggaaaaugugacauauauccagccauuucaaaaccuccacgucauggguagcucuggggcggaucagaguuaaaacucacgacugacuauggaaggaacugcagaguguuagagguuuguaucaaacaggagaagagcgugacuauggcucaagauucucauacgaacuucaguuuauacacgaaagacuugacgcauaaguucaaacuacaagaauaaauaggaaagaccuugcuuggaucaaaguccccaggccuggccucuggugccagcucuguucguuacucccugaggagguccccuggcauuccugcuggugacccacaugcacgcagggguugcugucaucuugggagacagcagcacgcccagauaaaugaacuaagaaaggaggaguggaccagagguuauuuuguuuguuuguuuguuuguuuguuuagagcuggaucucacgcgccccugucuggcuacaacuugcuguguagccgagggugaccuugaacuucugaccuuucugccccuacuucucagguggugagauuauggauaugggaagcaugccuagcuccuuccuuuuaaauaaaugaaacuguguuucuacauuuaaaaaaauguaauuugcaaaaaccagggaaauguuuaauuugcauguuccauuggacucauguuucucuuguuuggaauuaggaccacaugaaagcauuuagaucugcauguagcagcgaacacauauuuguaguuuucuagaugugccugcuaagucacaguugcugaggcggaccuauccggaaggcuguugcucuuguucucugagccuggcaugugccguguguaccccagagcagcagagccuaccgucggacugaccccugagagguacaguaucuuccuacgcugugagugcacuggcuucugucuuuacaguaacgaguugagcaugaagacggacucucgcuuaaacuugcuggacgauggcacgcugaugauucagaacacacaggaggcggaugagggugucuaccagugcauggcgaaaaauguggcuggagaggcgaaaacgcaggaggugacccucagguacuuggggucuccagguaagugggggauauugcaagugaggguuacucuaaugaccuacuuccuccuuucuuugaacuccagcuaagugaagucagauaugguaagguucccaagccaaggggcucacaggacuucugaagcauagaaucauaggucauucuaaccugucucaggcccguggcugcccccugcuacauaggcguacacagaagcucuggguuacuacuguaagcaagaaauggcaaugggaaccuggagagacuggucaugcagggaccuguacaaccacaucaaauccauacugcuuguucacugaggcuucuguuugccaagggcauugauuauuucaaagacaacuuuaaaauauugauuuuuauuuaguauauccaugcugaaggugcuaguauauaacauugaagauguaaaaagucugucuaaacccaaggaaacacagcuguggccuuuauaccucugcgacgcaugcacgagcccuauucuguccauggcccgugucuacgguugauccagauaauaggacaucaucaacuuuggacagcagagacaugugcaagccguggugcuucaugcugcuggggggagccuguguucucugaagccuucuugcugccuuggcuucaucuacagguugcuaagcaucugcuuuuacuugacauccuauuuuuuuuaggcuuuuguaaacccgaucugauagcagugugccugauucugcacuguaguuucuuuaagcucuuuuaaguuucuuuauaaccaucuccuuugucucaguacaucccagcaucaacaauuaaauauuaauaauuuagaaugcuuagcugcuuaauuuuguucagaggaaaucgaguaggagauagagcccauaggcaaguaauuuucuguuaaguuuggccccaggcagcuagcaucuuugugagggauacugcugucagccucuagagagaaggaagacaugaguccuggucacagacagugaugcauauaagcagcagaggcagccuccaaguuggauucaugguaguucaacagugacauguguaauaggacacugggaauaagguaggcuuggguaacaaacuuacugaggggagaugcacaaguuauugaauccuggauagcucuguggccugagcauucugaauguaaguccuuuccauaugaguuacauuucuucuuccagccaauggcuugauuuaacagugugcucugauuguauuggcauagcugucccagauauacacaaagggccuccucuagaauacuguugaaccugggaacucagaaaggggucaguuuaaaagacuaaacucuguggaucaaucccagcugcuucccauucaucuaaaguucauaauuuagccauugcguuuuaaagugauugacaguuuuaaaagaacauuuuaugugacacgugaugauuauaaaaagcucaaaugucagugccuguaugaauguccuguugggacauugcugccugucuucuugauguagcagcagaguuaaugagaaacacagucugugggccacaaagcugacaagcuguaucauugaccuguauaaaaagcuuuuaaauuccugucccagacuguggcaguagcccauaguaagaggaagaaagccuuccuuuccuggauaacaaacagauaaauaagcuuuauauauuuugaaauacuguuauuaaggggauauacauuguauacuguuuuucuggugaauuaaacuuuugagcauuguuauuaaaaguauacuuucaucuucccaguacuauguuggaaguuuuuauauagucuacaauaugugugcauacacacaugccacagcauguguggagauccgaggacaacuuuguggaguugcuuaguucucuucuuuuaccaagcggguacuggaagccucccugcucucuugcuuccauacaggcgccaucuguauuuaaccaggcguucuuugcuauaccuucaggugcuuuuccaaaccauuaggugccagagucccauauccuuuauucagaaccuuugaacuagcucucuuugaacuucauaaauucagggcugcuuuaaaaaaaaaauaaagggaacauagaacauaacccauuuccaacccccauucuaggacgauacaccgcacacaaccacacacaguccaggugcuaauguccaccaagagagcuggguggagaguccugauaaguacuagaugugccucaugcuaccuguguuuaauuuugcaaacaauuaagagaaucuugguuugggggccuuuuggauuccauauuuaugaauaacgguuaugggccaaaaccugcacgggguaaaaaaaaaaagauaucuguauauauaucauggacauauauagacuuuagucaucuagaaggaacagaaaugcacacacaugguuugggcaaaggucaggaacaggggugacauaaaugaaggaaaggcaggaggaggacuuuucuaauuuuuuuaaauuuuauuuuaguaucuguuugguguuuaaauuguacuaucaaaauucacuaaaaauuuccuauagacuuaggaagucauguguaggguggguuccaaaacuccaacacaaaggugcaugcaacuucuauuccuauggccuuggcuaccucucuccacguaggcuacguguaucaacuauggccccauuguaugcaaacaccuucuaugaaacauauuagcaaauguguggacgcccucccccacacuagauuuagaguggaaacuauucuuucauugugcuuauuugccuuuuucauuuuaugaugaaaaugguauucuuauaugauuuaaauauaccccacaaacaauuucaugggccaguaggggcuacuaccauuaaucaaguugccaguauauuuauaauaaacaaaaguaaagguucugcauagaguugagggugcaucuaguggaaaaaaugcagcucucuccaccguggucauuguccacagguugccugcauuuggaugaccuggguguagguacuauuuuauuuuuugcacuuuaaaaaauuuuaaucaguguauucauguagauacaugcaugccacaauguggagaucggaggggaauuuuggcuguugauccaugccuuguaccuuguuugagacagggucucuuguugggcaccacuguguacaaagaccuagcuggucaaacuagagucugagaauccuccuucucccuccagucuugcauuaggagugcugggauuacagaugcuaccacaccugggguuuucugugugaugggcauuuaaauugaggccuuuguguucaaaugcaagggucuuauugcuuacuaagccauuuccucagccccaucugcacauuuccuugaaagggaaagacaacaagaaagcaugcgguuaaacauuauggcuuuugcuuauuuuggaagccauucgggugaaugagcagccuggacaucaaaaauaccauacagaaaucuugugaaacucuaagaaauuaauugagaauuuuuguuugugacagcccgacccacuuuuguaauccagccgcagaacacagagguacuggugggugagagugucacucuggagugcagugccacaggccacccucugccucagaucaccuggacaagaggugaccgcacacccuugccaauugacccucgagugaauaucacucccucuggaggacuguauauacagaacgucgcccagagugacagcggcgaguacacgugcuuugcauccaauaguguggacaguauccaugccacagccuucaucauuguacaaggugagcauccuuggguguugucagacucuuggcuuugcauagcuccaacagccuucuuggcugugccccgccuauacuacaccacaccucugugccacuucauuuguucuguucccuucucucuguuuuuuugagacaaguccugccagcgcagccuggccuugagcuugugauccucaagugcugggacuaagaugugugccaccaugccuagcuauuuuguuauggauauaugugcaugcuucugagaacauguccaugcacauguacauuuguauguggcugggugugcauacauaaaccagagaacaauuucaggagcuguccucgccccugcaauugggggauuugagguuguuuaguuuuuguuuucuuguuguuuuguuuugagacugaguuucucacugcccuggaauucaccaaguaggcuaggcuaacugacuaggaagcuucauguguccacaucccucccccaccccccaggaccaagcccagcuuuguuuuaugugauuucuaggggcuaagccaucuuuccaacacugccuugccuuuugaaaucuguaagagccacucuguuugaccuauuauacaugauuuggugguuagacagcuuucuuuaggaaaauaggacuuugagguuguucauagcauccagguacucacaucggugaauguggacaugaauguggacguuggaagugaaucgguguguauauggugcagucagcucugggugcauccugaggucacagugguagcuagacaguguguaccccuugcauucugcuuugaaugucuacugacaucacaguaguauguuacagaacacugccaggcgcaccuugcuaacaagccagugugaacaccuugugugcagcugcgacucuccuuagacuacaauggcaaguguacccugcacacagaugugaaggcacucuuuagccagaguggucuuaagucagcaugcauaccaugcacacagcugugaguguacccugaggucacagugguaucgagucaguguguucaccaugcaguguuuaaaacagaacacugggaggagucuuuguuucuaauuccuuaacugaccuuaggugagcuucuuuauuuccagguaaguuaugaaacagggcauguguugggacccucucagaagcacggcugugacucucuccucaguggccucgugucucucuagcaguuuccugugcaucagucuuucccauuuccaugcuacacacagcugugcagucaugggcgguagguuugccucucuguaugguuucuuuauacaggcccugaugacuguccuguggcaugcucuuaacuauucaguaggccuuacuccagucaguugcacaaaagcacuaggugacaugcuuagccaccugcauguugugacuaguagugaguuagaccucucccuucagcuccccugcagcacacugugugagugcucuucuguguccugcucuguguagcucugagggagcacugguuggggugguuuuuucgguguucuuuccuuucucucagugccuuucccccucccucacuuggagacaugaugugacauggcacuauucccugagagaagugaacaaguaucuaucacuccggauaggaaacagaugacagagcaaaagacagauaucaccagaguccgacuuggggagacaaugaguguguguguggggggggggguugcaggaauaugugugagcagaaaugacucaaacacagcuucaucaccauugcccaggggagccuaagugacagcucaugaaggcagagaaccuggagcucccugcauggcugcaggcaccgcuacagguuggggagugcccuuucuaguugguucagcuagucucagucucuuucaggcagcucgacuuuuguuuuguuuuuuguuguuuuuuuuuuuuuguuuuuucuagucagcuucacuugucucugcugcugugacacuguuuagcuggggucugcuucuuccaggugucugggacugucugaaagucuucccucagcagugcucuuauuuagacacucggggaggaauaggaaggguagugagucuggucacuuuggcgacuuucugaagcuccucugagucgugcuuguugccuuagcaaugcuucccuauggucuuuauuucccuuccccugagaacauucugcuguuucaccuucuuucccaagucuuauaccuuaaguuucccuccaagauggaggcuuucaucuuggaggaacagccgaacaguacacaguacccuuggcacgguccuuuugcugugcugcuauguuacacagucacuuuauagggcauugucuuucagcaucacauuuuaaauguccuuccucugcagcccuuccucaguucacugugaccccacagagccgaguggucauugaagggcagacuguggauuuccagugugcggcuaagggacacccucagccugucauagccuggaccaagggagguaagaugguacacugggcccuccaccuucuccuucagcuaggacacaagcuauuuucccuggucaggcaaaacuaguaucuuucccaaagggaugagcuggggaagaggauguagguauccauuggaccugccuugcaguggucacuguaggcaucauggauugaugcaugucccucccugucucucccccccccccugagagucugcccucgguguguaauugcuuaacacuuggucacuucauggccccuauggucugauggaagcuccuaagguugggugagauuguagcaagggccggugccauguucccugaccaaaccucuguaggucuccaauauuccugcccuguaggcuaggcagggaccccagagaugaccugccauuuuuuuuucuucaacuaaaaagccaaaaacccucccucugagaaguccugcccaagucuccugaggaauagacugagguaguggccagcuggacagcucaugguuggcuagggaggucacccagugaaaaggcuuguccacaaaaacaugugagacuauccuucuccuguaacggccuugccuucucuguagucugggcccagguccccuuacaguguguuuccuuaggcauagcuggaggucagcccuacccuacuugcacccugaguccuugucugguccucacuccuaauuuugcccuuugccucuguuccuuucuaugauacuccucgggguugucauuugacuugucacagcccacaagugguauugaauaagggccuacuuacuggagcaggagaggccaguugguaucugauccauguaguucagcccagugacacugccaucuuuaaagauaacauucucugucuucuaucuccuagcuaucucuggaagccucuguguccagggugccugaugucuuucuuacccccacuuuguagggagccagcucucaguggacaggcggcaccuggugcuguccucaggaacacucaggauuucugggguggcccugcaugaccagggccaguaugagugccaggccgucaauaucauuggcucccagaaggucguggcccaccugacaguacagccuagagguaggugcuauugucuuguggaucugugcaugccuaucaucaaugacagccuucguacagaugacaucagcauuaauauuguaguuuuagcccuucuggucucuguguuauguuuagaacccuggcuuuguucaugagggauuugaacagacacuuaaaucucuucucuuguuaugaaaacauuuacucaugucaugcuggccucagugagacuggcuguguuggggagcagauuagggcagauaguuggauguaccugaggucacugagguuaccaugaaccuuguauugucucuuacacccauaauauccacuguggguuuugugggcuucccucccuguacuugcuuggcaaacccaaugugcucagauccaguuccccauggugggauccaaugucagugccuguuaggcucccucucccgucaaaugaguuuuggaugucaggacauuguuuugucagugggucacaccacacuccaaacugcugacugcuggucaugaaugugggcuagggagcgcaggcagccuggcuuucuaggaaagccccagaacuuuuugucuuagccaauaagacccgaauccaguucaguugcggggcucuggguuggccugaguaugggcucugcucuucuggagcuucgugguaugaaucaggcugcugccuuguucucauacuugccuuguagucaccccgguauuugccagcauucccagugacaugacuguagaggugggcaccaacgugcagcugccuuguagcucccagggagaaccagagccagccaucaccuggaacaagguaagagcugguaucucccccaagcucccucugaugcaguaaguauguguuugaaggaagucugcuuuugcucuuucucucucuuucucucucucucucccucucucucuccuucccucccuccauuuccucuauccauccacccaccuauuuauucauccaccuauucaucuaccuaccuaucuaucuaucuaucuaucuaucuaucuaucuaucuaucuaucuaucuaucaauugguuuuucaagacaggauuucuccauguagcccuggcuguccuggcacucucuccauagaccaggcuggccuugaacuuagagaucugccugccucugccucccaagugcugggauuaaaggugugcagcacaaccaccuggccaaagaaagucuuaauaauaaaaauaauaaaaacaaaacauaaucuccagcaucagaagcaaagaaaguccuuuacaggucuacagccucaaagaguaaaguugaauuuuugcuaugucauuuuucuuugcucuucauauuuagcccacuaugaugcugaauucacaugcuguauacagaggauccugcugggacauguagggaccucacuauaguccucacagaguaccaguucucaguacccuccaucucugucacugcccacuuaucuucuccagaguggugcagcuguggucugcacaugaguuaucaguucugucucugggucacuuucucucagggcauuccuagaucccugagcccuauccaccauagcucugggccuccaguaguuaccacaggugcccccaguuaguggaacuuaucuauugcacauagcucucuucucagugaaggacagguguggagaagagcuuaucgaauggugggaguuugaucugcgagagcacuaguaaguuuccuucccugggaaggucggggcagauguaaacauagccucagagaauuuuccauuugagccuuaacaguugaccaacauuccugucucccagaaaagcaacuucuguucccuagucuuauugcagucucauuuuuauuauuuugcuccaggaugguguucagguaacagaaaguggaaaauuucacaucagccccgaaggauucuugaccaucaaugauguuggcacugccgaugcaggucgcuaugaguguguagcucggaacacaauuggauaugccucugugagcaugguacucagugugaaugguaagauguauaugccaagcccaaggcauugucucagaggguuugggugauauggcaucaggccucuuuucucauccuaugagcauccacuuaggguaugugcuaguuaguuugaacugacaaugucacaccaucuagaaucgccuaggaaaaauuuauuuagaaauuaucuagauaguuggcuuguugacacaucuauggguaauugucuugauuguuuauuaauguaaaaagacgaagcccacugugggugacaccauucccugaauaaggggucuuguaccacauaagggaugaaaaaggauguguuuguuuuuucucugguuuugauuggauuuguuacuuuuaaguucuugccugacuucucugacaguguacuguaaccuaaauuguaagcaaaauauauuuuuucuuccauaaguugcuuuuuaccaggauauuuguuacaguaucagaaaucaaaugagacuaggaugucagaauaauucugagaacagaauguuugccccuaacuuggcccauggcugggcuucccuuggcauaccuuccccuuccuggacguuuuuugacaaucuuuagcagcucuuuucauacccaacaguuugauuuauaaugauuccuguaggcaucaugugccucccaguuggguauggugacgugcagccuggggcauuacucaugcacauggacugaccuuuccugggguagugaggagccagagugucaagauuccaucucugcacccccccccacacacacacccucauucuccucucugguugucuuguucagcuuuggagaagaggagaaacaagaacacagcaagaacucagacacagcaaggggaagaagcugaugagggaggucugggucuagaguucagggaauagucagggcugagaauauuaacacccugggacaaggugaggucauccagaaggccugucuuaagaacucaacacaccauucugcccugggguguucagccaucaaacaggcuagaaauggaaaacucaacaaaaagauaaucucuaaauggccagugaggagacccaucuccucagugacaaggaucaugugaacuacuagacucuguaccugucaaucaacauugggagagagagagucagaguaggaaagaagaagaaaaaagaugaucaaugcaauaugagcaaaugccccagagacugaagggagcaggugcauccuaguauaucccaagguguagaggucugccuaagcagggagucuaucccaacacugccuugcccgucccaggggaagcaaguccaccccagcaaccaagugaaggaccauuucaguaaggucucuucagcuguguccaggcuuaugaggauaugaaagagagcugaccauuggccuaagaugagcuguuuuguuggcugaggguaaaagauuguuuacgauuaugugugcuuggcaaagucucacuacugauuacucuuuaugaggugagaaagaaagaagugagaaucacacuagacuugguggugcacgccuuuauugccagcacuuggaagaagcagagagagcucugugguuccaggacaguuuggucuacauaguaaauucuaguccagccagagucugguauagagauagauagauagauagauagauagauagauagauagauagauagauagauagauagaucuggcauacauacauauagauauauagguauagauagauaagguaaauauauagauauguagauauguagauacuaagacauugucucaaaaaaagaaucaaaguaugaaacuuugauagaaacagguuugcuguguuauuugcuauauauuauguauuuaucugugugauguguauaaugguauaggcuuguucagugcuguguucuaugugcaugugaugguguaauaugucggugugguguguguuacauagcauguauauuuuucuuuauccuuugguauguguaucaugcauagugugguauaugcaggcugucuggguguuguuuauuuugggggguguauacauaggagagagagaggaagagaagagagagagagcgagugagagcgagcaccuuaauaaugaugcugugaugaugacuaugguaacuggaggaaaggacuagcaguggaggggaaauuaaggagcugaguccagcauuggagaugguuguccuuuuagaagaacagagacuccuggaaugaagguaccucccuggaugucacuguccaccagauagaucugaggagccccagcaacagccacacaggcaucaugcuguguauaagugugucugaacuuuauguuguaaacugugcuuuauguuugccgcuucuacaggaugucguguaacuuuucaaguuaagaaguaugcgauuuccauacuguuuaaaaacagcuucuaguagaauugaugaugaaauaacuugaguguugguucagcaagcagaaauagcuuuuggaugaaagcauggcuuaugccuagaugaugucgugucuagacacagcuguaugaguaagagaguguaguguucccuuuuuuuccuaguaauauguguucauguuuuccuaguuccugauguaagucggaauggggaucccuauguugcuaccucuauuguugaagccauugcaacuguugacagagccaucaacucuacaaggacacacuuguuugacagguaugguggacagggcuguggugcuggccuugauggagaagcggguggggugggguggggugcaaugcaugcuuuccuagugcauggguccuuuaccgucccuccccacccccaaacuuuaauauacaaguccuaagaacauucaugugcaagccauaagggacaucagcugacuguggcuucucugggguuagagcacuagcaggagauguaccuucuucauaggcgcuggacugugauucacgaucaaaccauuuuuagaagacucaccucauucuuguggcuuguuagaaacaauuuggccaaaacaaaauguuacugagguggccaguggaucccgccauguuggcaauugcuacggacucucugcaccuuaacugaaaugcgauuccugugacucucucucuugacuuauuaaugguuuguuuucagugucuuugguucuuguuugucuguuuguugcucugucgccuuccaccugggaugagucagguacagugcaccacguugucgaaaguagcgguagaaauuuagucauaucaguacacuuuuaguuucuggauuuuuguuccccagugauuuaucucauugauucucucccucccucccuccugccagccguccucguucuccaaaugaccugcucgcucuguuccgguacccacgggauccauacacagugggacaagccagggcaggagagauauucgagcggacccugcagcugauccaggagcauguucagcauggcuugaugguggacuugaauggaacaaguaaguaccauguucuuccauccucugacuugagugcaagguagcagacacucucugcugcaugugcaucauguaagaggcucuggcuaugccugcacuaguaucugagcccacuuucucuugagcuuauguagguccuggugucucuuugggccccuauccaggggccucggacugcccuuuagcuccaggagacccccaggccuuuugggccagcagcaugccucuacuagguguccaugaccuuccuaaagucaucaaaacagccacauaaugaucccaggaucaaggauccucaugcucagagcucaguuuuauuaaaugcugccugaagacacuggcccggccaaggccuuccccuuccucauucucucuccccugcagaguguucugggcuucagacaagccagcugugcaugcagacaccuaugcacacgcauuugugaauaccaggacuuugaacaauguaggaccugauuagcuaggcugauugaucugugccuauuugggccuugcuguguguccucccuacagauuguccuuccugcaugucuaguucuugugugccagagaugaaaggaaagcuuccugggcuaaucuuggguagcugauguuuccaaaacaaucauggaauuuuuuuuuuuuuugguauggauauuuuacaggucauccucuguaagaaggggcucuuuuacagccuuuaaaauguguagacugggucuccggagccagacauaggcuagagauacuuuaaugaaaaguugcagggcuggcucugaucagcagagagagcaagcaagagagagacagagacagagacagagagacagagagaaagagacagagaauacacauggauauuggucucauguaccuggauauaugcacaugugaaugugauugugcccacgugugagcaaguuaucuugcauauuuuacauagaagcaugucauaugguuaugcaggcaggauuguguauguuuaugaggguuaaacugugaguguguauacaugagucucagugagugagcuuguccucagauauuugugcuugucugaagacuggaacacucuguaauggagggauagagaggaagggggaggccuuggcuaugccaaugucuucaggcagcauuugaugaaacagcucugagcgugggguccagagguguuuauguaccugguuuugauggcuuuaggaaggucauagagaacuuuuagagucaugcugcugaccaacaagaccugggguuuuccuguagcugaugggucgucuaaggcuucugagcaggaaggcaaccuagugggaaucugccccuggcuggccagguggaugggugugucuuaugguggauuuugugagaagcaagaccagugucaugagcaguguccuggguugaugacagaggaaaggagaggguggcaggagucugaggccccuguaagugucugacucauacuugcagguggcuauaggauggacucugaagacaggugcuuugguauauuuagucacuauagugaacauugaugggcauagggaagcucuuccacaaggagaggaccuagggcugguguggaggugcuucucugccuguuccauggaacaauaugagguaggcugaaggcccucaguuuuggaccucugaaugugcuggguuucuugaggaaucacuuuauuagagcuagucguguaaaaccauagaccugauggaaaggcgucaagacugucagcaaacagugagcugagcaggaagggaauacuccacccaaucagcagccagagcaucugcaggcaccagcggagacucugaaggcaguggucugcaccauggcugguagaagccaauacuucucuacuguguugcagguuaccacuacaaugaucugguguccccgcaguaccugagccucaucgccaaccugucaggcugcacugcacaccgccgcgugaacaacugcucagacaugugcuuccaccagaaguauaggacgcacgauggcacgugcaacaaucuacagcacccgauguggggugccucacugaccgccuuugagcgccuguugaaggcuguguaugagaauggguucaacacaccccggggcauuaauucccagcgucaguacaaugggcauguacuacccaugccccgccugguguccaccacacugauugggacagaggugaucacccccgaugagcaguuuacacacaugcugaugcaauggggccaguuccuugaccaugaccuagacucuacagugguagcccugagccaggcccgcuucucugacggccagcauugcagcucugugugcagcaaugacccucccuguuucucggucaugaucccccccaaugauccccgggugcggaguggcgcccgaugcauguucuucgugcgaucgagccccguguguggcagcggcaugacgucccugcucaugaacucuguguacccucgagagcagaucaaccagcucaccuccuacaucgaugccuccaauguguacggcagcacagaccacgaagcccgcagcauccgggaccuggccagccaccguggccugcugcgucagggcauugugcagaggucuggcaagccccugcuucccuuugccaccgggccacccacugagugcaugcgcgaugagaacgagagcccgauaccaugcuuucuggccggcgaccaccgugccaacgagcagcuuggccugaccagcaugcauacgcugugguuccgggagcacaaccgcauugcagcagagcuguugaagcuaaacccgcacugggauggggacacugucuaccaugagacccgcaagauagucggggcagagauacagcacaucaccuaccggcacuggcugcccaagauccugggggaggugggcaugaagaugcucggugaguaccggggcuacgaccccagugucaaugcuggcaucuuuaaugccuuugccacugcagccuucagguucggucacacucugaucaacccucugcucuaccggcuggaugagaacuuugagcccaucccucagggccaugugccccuccacaaagccuucuucucgcccuuccggauugucaacgaggggggcaucgacccacuucuccgagggcuguuuggaguggcagggaagaugcgcauucccucucaauugcugaacacagagcucacggagaggcuguucuccauggcccacacaguggcccuggaccuggcugccaucaauauccagcgaggccgggaccauggcaucccacccuaccaugacuacagagucuacugcaacuugucggcugcuuacaccuuugaggaccugaaaaaugagaucaagagcccugugauccgggagaaacugcagagguggguauugguaaacugaggcaccuugauagguauguagaugucaagagaccuuggcugugaacugugaugucaccgucucuagguucaagcuucaguggugagagaaaucuguggugacugagauuggacagccuguggucugcuggccaagaugcuacauacagagccagccuaggguugggguagucguguuugcccaccucuuugugcucaggagguagacuuuguaaacuguaaggaguuuucuguugagauagcaguuauacuuuccuagcugggacaguaaagucacauggcaaaugggccucagacuggccagccuccugggccuggcucuccaccuauagugugacucaugcaugaguggcuauugcucauacaagaggagagcuggccugggagcugaauaacagauguggaaguuucaugggagaugaauaacccaccacucagaggauagaacuggucugcucgggauuugguuaucucaucuagggccaggcuucuucggaccuucugccuccuaggggcuguucagaccugaggcgugcaggaaggucucccuugugagauacugcaguuucugaaugacagcugccucccugugcuccagugcacuuacauaaugggauuugauuauuggcgagggaagcacgcgaguucuccacggggacaauauaucuuuuugucaccguuaugcuuaauugggauuuaugcucacugacuacuucauggggcaucauguccccauccagauggccacggauggcuuucccaguucauuuuugcuuuugcuugccaaaauauuucagaacuucuugguuucugguaaucuugccacugcugcugcuggagauggugggccuggaccagcuguaaggggagagaccuuggcaaagacacgacgcaugcacgcgcacguacacacauacacacauacacuagucauuuauucuuucugugaacuaauuacaaagaggaaaaaaugagaugugacugggaggagagcugaauggccaugaaagccugggcugccaggauuuucagcaggccuuggggaacgcagcugucgucuacuguccuggcagccuguugaaguuuuacauuucagggcagccuggagaugaagacgugggcugaaucugggcuucucucccuggugggguccacaggcuacccccccuccgggggggaggcucuguagugccauggagagcauccccagcagaccugaaacauauccuucagccuucugcuaccccuuuacagacgggagggcaaagagcaggcauccugaggugacacugucaucuggugcccgcgcagcaaagccagcagcccucucuguccucauggcaggugacuuccaguaaggccugggaggcuuaaggccagggugcuugucccugaaugucagugaccacaguuugugcuuggacaagcuagauggcagcuugaugagaguagauuugauggaagaggaauguuugucauguugggagaugaauguaugucuuuuccgauagauuauagggugcuccacugucgcuccaagccugguggggaauggaggguugggcguagggguuggaagauguuauuucagacuccagcacagucucuugcagcaauuggaaccaagacuaccuggugccuuguaagcucuuagaaaauugcacaaggcuagaaaacaaaagucuuuuggcauugcugguucuuucuguaucuuucuguaugggcauacauauucccagggcauggaggaccuaagagaaugcuuguuaaacauuugauaauguuuaagcuucauguuagauaucuacccuauuuaauuaaccagcauuuccauugacaaauacauuucucuauacuguaggguuuaaucuuauucuuuucaauuagacuauucauuguucuuauacuuaaggaaaaggauaggugugaggagauagauagguugccucaugaacuugggugauucucccuggagcacaggaaagaauuaugucuuaauuuucuuauguuuuuggcuuucaaaucacuuauaaguaaauauauauauauauauauauauauauauauauauauauauauauaucccucauauauacaaggaaaagaggaaaauucuuuaaaaugugauuaaagaagauuuaaagaaauagcaaugagcucucuuuguccaggaaaugucuggaggauguaugggggccuuuuuccuguuugcaguguuucauaucccaggcagcuaugaugagcacacucaacuuuguccuugucuauugcaggcuguauggcucgacucucaacauugaucuguucccagcccucaugguagaagaccuaguaccuggcagccgcuuggggcccacacucaugugccugcucagcacacaguuccgacgccugcgggauggagacaggugggugcuagaaaaccuugucuuacacuguugguguggaucuggggcagagaggaccugugcuugcuuaggacagggagagccccuucccacuugcugcccuucagauggcuccguaccuccucaaggcugccuggcaccuuacccuuucaggcuaacacaccugagucccagguaccauuggccucuggagccagugagaacggauauauuuccaggagccuuuugaccaucccaggcaguaccaggauuagagcauuguuguuuguuuuguuuggguuuuugagauagggucucacuuguauagcuugggcuggccucaugcucagaugugcacccuaacaacuuuacugagacuugaggcuuuuggcaagaugauuuuuuuuucuuuuuaauaauguuaauuuacuuuaggaaaugggaaagaggccaaagaaucagcugaggaguuuaguuagaaguuucacuauccauccuuuugucaagaguagccaucuucuugcuguuuucucucauuuauugggugggaauuugaacaaugguggcuauauacuuuuuuuuaauuccugcuaacugaauccaugauuuccauauuggcuugaauccuuguggcugacauucucccugcccucugcugaccccacugacccugcucuugucauccccggaguccagguugugguaugagaacccaggcguguucucccccgcccagcugacucagcucaagcagacgucccuggcgaggauccuuugugacaacucagacaacaucacccgugugcagcaggauguguucaggguggcagaguucccccacgguuauagcagcugugaggacauccccaggguggaccugcgaguguggcaggacuguugugaagguacaugcugccagcacccugcccugcccucacuguguccccauuacugcugcuuugccugagaacggggaaaguggccuuugccccucguugugggaauuguuugugauugcuuugcuuagugaacggugacauggucugagggaagaauguccaguuuuaucuuuuauuguaaaagcaccuagccuugagccuuagcuauauagguugguaaguccacgcacucugccucuugaugaacguaggaggcacccaaggcuagaggguugcuuuacccuguagauguacacuauaaaguguggguggaaguucaguacagaagaugcucacaccaaccacugagccaaguguggucauaaacuccaugcgcuuaaugucacauuuuguccuacugugaguacagugcacuucucgauggcaguuaucaccgcagaugucucacguuaagaugucacuagaagaucuuuugcagccucguucuaaucuuagucugcaccuuguaucgaacaaaauacuaugcaaaagaggacaaaccuugagugaguuugcauuagcauagcuagcauuuaaccuauugagcagcuucaugcgagugcuugugcacugagccccgugaguccugcccacaaaggauaacaaccagccccaccaggaagcacagcaaacgcgcuaugcaaugccgaugccacccuguaacuuacaggaaggagcuagaggguagccugcaggugugagaggucuugauguuagcucuggagaaccuaauaauggagucugcgcaguacguucccgucagccugggcaggccugcucccgccaugucuguccaucucacagaggccaccagcacagccuagcagccacuggcuucuguggugacuauucuacagucucuuucccacuuuacauucuugaguuccucucuugguuaaccucuuuuuccaguuucuaauuggacugcaauuuuggcuuuauucaaacuaugaucagagccccauagauaauaaagcuggggacauugacagccuaagccaagugacauaguguuuguggugagaggagggcuccagaggacggaugcuccaggcacucacgguucucagcccugcccuacccauuggacccugaacaagaugggccacguaaggcuggaaaagcacacagaguucagaacugugguuauuuuuucugcuaaaguagucacucaagauaauuaguaaguacuaaaaucgggcuggcuuuggaagcugcauuuaauauccuaagagggugcuuggcaugggugcaacuguacaugaguguguaugaccaugugguuuguccaaagugauuguuuugcaugccuuucucccauauguauauauuuguguauguguguaucauguucucucccucucuuccaucucucccucucucucucucucucuccuucucucccccccucucucucucccucccucucccucucucccucucccucucucucccucucccucucuccgucaucucuuccucucucccucccucccucucucccucaucucucccucuccccucucucccucucucccucucuuccucucucccucaucucucccucucuuccucucucccucucucucucccucucucccucaucucucccucucucccucaucucucccucucucucccucucucccucucuccaucaucucucccucucucucccucucucccucaucucucccucuccuccucuccaucucucccucucucuccaucucucccucucucucccucucucccucucccucucucucccucaucucucccucucucccucucccccugcacuguaagaaggacauugugguuacuguguaccugauccuaaauuacugcuauucuugagaucacacucuaggaacuuagaucugcuuccccuucuuuuugcuuuaagucucccagguuuuuccaguuuaaauacuuuccugcaaggauagcaucauucggccuguagcagacuguuauguugucuuggaaguagugugcaaggccgguucuuacuuucagauacggagccucuauuuucugauaacaacaccaggacccuuucugcuacagaagcugagccaagcuucauucuuuacuuagaaguauccaugguucuggaagggaugucucugaggcaggcguugucuuggcuugugccucuauucuaauccauugucccagcugcuacagagacucagugaccaaggcucuugccgacacagcuucuuccagauacugugccuccuaaaauagcaggcucuggccaacccugaagggcuucaagauucuaaauuuaugguuuccauuuuagccuaaacccauuccuaacauauaguagaaaacacaaaacauugaaaucuugcgagaaaaaaaaauguugguugcuguuaacuguuggggugggugguggguggugggugggucgugugugugcauggugugugcuugcauaguauguauaugucugcaugcgugcagguacacuuggcauguguauguguacacuuggcauguagaggccagggguuggcauccagugccuccuuuguucacccuccacuuuauuuacucaucagggucuucuauugacccuagagcaugacaguuccuuuugucucgcuagccagcucgcuguagagauucaagcuccacuccucugauuguucagcgagagcuguauuuacugagcugucuccccagucccuguuguaacuaagcuuagaagaaggcuccugagggagggaucauuuccuacagcugcaccagggucacagcaccaagagcaacacccauguaccccagaaccugaaagagcugcuucugagcuggggccgugcccauuuucuuaaacuagaugugagauugcagccuagggccugaugagucguagggcauugucacauacacacacaugcgcaucccacauauguauacacagaggcacucacgggcaaauacauaccaauacucacaugcagccacaauuugaaaucuugcagcaauuauugaaauacuacagagaauucaaauaugucacccaaacucaucaacuguauuaacauuuccuauagauuuacuuauacuuuuauuuaugcauguuuuaugugcguacaaguguguauuauccauaaauaaaucacaaauguugcagauuuccugcugccugcucccaaacaauuuacugaaguauaauuguaauuggaaaaugucacauggaacaaauuguuaccuaaucuuuggaucuuguuuaaguuuuacuguucucccaauguuaguucaugacagguuccacccaggcuccucacuuaauuuuacuugcaaguucccagacuccuguauccuggaagacgucuuagucugucuccaucugggcccuuuugguagcuuucccuccauguggguuuuucugacuuuuuccuaaagguuaagugcaacaaugggacauggaucgaggcacacagcgcuguguuauguaugcuuauuuuaugcaccauaguaggaggcaugagggacaaguuugucccaugacuaguuaacuacugaaaauguuugacuagaaauucuggugucaggaggguuacaaacaugugacuucaguuagaaucugaacgucuccuccuuggcagcaaauucuucuacuguacaaggcccuggguggaggaguagaccagucuuaggcaggcgagguguuccaggugagggucagauuuggagcacaggugcccuguauacacagaacuuuccagguguuaccaugguuucauacguuugcuaugugaacacagccauuucuacagcagcaacauugagugugggguugcacuuaggaccaaagugcacaaagcagacacaggccaggcagaaucguguaguccaguuguacuuugugcuugagcauccauggaaaauaugguggcucugaauucccagaacccaucuaauguauaguucucgggucagggccacuuggacgaacccauucacaugggacacacccugccuucuuguuguucuccgguaaucuggggcaagacuuuaugauggagaaucacccuugcccucuuccagaaccuccagcuuugcuuggcuuggcuucaguuuucagaaaagauuggaggaagagguucuaauuguuguugugaaaggccacgcugcugugaaucugguuugugucccuagagccaucugagaagccauuuuaucuacucugauuagugcacagggcagauuuaauccucccagcuuaacucaggucagauaaugaccagugacagcauaugccaagcuucucaaggacugcuauguggucagaagggaggccuuggcucaguuagcacauguccucccauuucuagggacagacaccaggaccuacagucucucauccauagaggcaguuaccacuggucucuguguauuacuccuuggccuuggccaggguuucugcaucaguggggucacaggacuuuagaauuuguuagagauggcauuugcuuucuucugggccaggcuacucuaaugggggaaaaggagguaugaagauggauggcuuuaguggauguuguagguaggcuuaggugagagagaauaggauuucuccauauauccagagcuugggaugaggccucaaccaagacaaggcaguguuugcaaaugacuuggacuuguugcagguugauuugagcugaucaugaggucucauggggcagaguauccccugacaagggcaagaggacuuagaucauaaaaguagagugcuaaagucuacauguguggacugcaggagggcaucguggucaccugggaugcccuggugcaggcaguuuguccucagguggacuugcuugaagcuuuuagcagguuugagugcuggaaccccagauacucacagacccacuguuagcuccgugagucccuucaggugcugccugauauuccuguauccuaauugaagggggaagagagaggaugggucauacaaguagcuccuacuuuacauaagguaaguguauccuaacuuagagucauuuguagcugauuuccccacuuugcuuuuucaccagauuguaggaccaggggacaauucaaugcuuucuccuaccauuuccggggaagacggucucuagaauuuagcuaugaggacgauaagcccacaaagagagccagguggcggaaagcacuaaggugaguuuuggugggcucuggaagguauccugccuaauaauuccagccaucucuggaauagacggaggucuuccuguugcuuugggcucagucagagccuaguuuggcuauagcagaaaugccccagaguucagaguccucuguguccugcuugacagugcugggcuguagugugcuauccugugcuacagaagggaugcacuuaggaacguugccucagacuuguacauugacacuuugcgucuuauccuuccuccuuaguguaaagcauggcaaacaucuuagcaaugccacaucagccacccacgagcacuuggaagggccagcaacuaaugaucucaaggaauuuguucuggaaaugcaaaagaucaucacagaccucagaaaacagguaaggguggccugagucaccgcuggcugcuucuccuuggacuuuugaucagcacaucucuugcccccuggguucucagagaccuugcacuugugagugauuguggagguguugacuugcccucaccugcuggggcagggccacuuauauagcuugcuuugcuccagcuugcuucuagcuagguuccauagaagucauauccucauguuucccugugaacugguguguuagguacuucuguauugcugcgauugcacaucauaaccaagacaauguauagaagaguuuccuugggcuuacaguuucagaaaguuaaagaguccaugguuguggauagaggcacagccgugggaguaggaagccaaaguucauaucuugaaugggaaagcacacgaguuugaaaaggaaccaagcaaugguacaaggcuuuggaaucucagagucuacucacaccgauggacuucuuccaacauggccacgccuccuagaccucccccacacaacugggaaacauuugcccaaaugcccaggacuacuaggggacauucacaccaccgcaacuggaacacuggggaguggacaguuggugucucuaaguuuagaguacuuugccagggaauauggcugagaggacaccauuggaauagacagaaaguuccagaaaacucaggcaaagucauaugaagaaguguaggagaagacaaaccugaauuccuguugguuagccaugucuuauagaauaguuuggaaauaacuguuuccagagccuagucaguccgugaugguagacgggcagaaguuguguggcaggguaccaggacuccacacuauagcccugccugaggaucuauacauaaagcccucucuuccugccuaaggagcuuuguucugcuucucuggagcucuguguuuaguuacuaaaggccuuguuucaaagagagggaggcugagacaugggagguacggucacucgaugacgaagaacaugaagggcacgugcuugaaguugugaggcagagaaguguucuccugggugguguggagagugucccaggagguagugugccauuagugccugguuuuugggauucuugggucuggcucuuuuccuaucccaaggcuacucaugugauaagcucaggggagacucauguaacucaaauuccuuucuagauuaaaaaaaaaaaagccaucccuauggcaucuguuccugcuagauccuugcccugcaggccuagggcucagucucugcauuccagcacccagcuagguuugcucuggagcacuaguggguggugcuggggauuccuggcucaggcagagaagcucagaccaaucccaggagaccucuagauacugaugagcagguguccuucagaccaaggguugguccaggaagcccacauggacguaauguccauaguacuauugcaugcauucuaccugugguguaguuagggacugcucagcucgagaugccaguagaccugacagugcagaauggccuugguacagauagcucaggaaauuuggucguucccugcaugaccuaugugugcaguugccuauggcucgucagugcugacuacuguccagaucccagccuccuugguccuuagauaucugggcuuugaguuaccucagagucagccacuagugcccacaugaaucucgacuuccugagaaugcucaucuagccuuugguuuucuucaaggccucaagcaggaaugcagagaguuaauaccuaaaauaucaauuaugccagugagucguuccuacagaaguucccuuuguuuuguuugggaaugcuacagcaugucucauugugaauagcucuuuggcuaacuagauuccaguugggauuuaggcugcugggugggaagucauccuaaugcaaagacaaccaggggaucuuagugccaagcgucgauguucugugcucugcuccagcguggacuggggaguaugcugugcgcaguagguaggcagggggcgggguugaacuccacacggcaaguagacucccagcaccuguugucacgugggcagccucuccucugcuggcuauggcugcugacguuuauucuaucaagucugacugccuugcgccuugcugcagauaaacagcuuggagucucggcucagcaccacagaauguguggaugacagcggugaaucucacggcggcaacacaaaguggaaaaaagacccaugcacaguuugugagugcaaagugaguaugggggucgggucuguguuuguaccuggagggcuggugguccaggugucagagugagguccugcuggcccucauccucagcccugguuuccccucauacgcugcaaagagcaacuaggggcauuugugugaaccaccuucgcagcuaaugguguacggggaacauacacacaaccaggaaccugagaacuccacagcuuaggacccgugcucgaaaagcuggcuguuacauucaccccaccccacccccaucccuauuguccaguuuuggccugggauauuaguuacagaaaauacuaucggauauaguccaucuuugggaagaagugacaaguaggccaaugauaaaccuugcuuaugagcacagguuccccugacguccugacagggauacagagcaagaaggcaggacagcaggaaugaggggagauccaggucaccucuuaucuagcaggggucagggaacaguacagaguacucuaagcaucccuggauugccuggcuaaggaagacuaagcuaggagaggaaggauuguuugcagaggagaagagugcuuccgucuggcucagugugcuuccuggcaggguuacguggagauuagguuugggacagcucacuccuuugauccuaggccucaguagggugagaggacaaugggguccuccagggaauguacuuguagcugaaacgcuccaauuagugucuucagucccagucccaguccagcugagucgagcacaggggcuaggaaauacuguggggaugagggaaagaaccauugggugucauacugggucaggggucaugugggucaugccaagccgagggcccaagaaugacaagaguguaucuccccuccuuuagaauggccagaucaccugcuuuguggaagcuugccagccugcagccugcccccagccugugaaaguggaaggcgcuugcugucccgucugcuuaaagaacacugcagaggaaaagccuuaguguucccgagcuuagcuccucgaagcugguccacagaauacuugugagccuagaugacaacauggggagcuucagaccacaggacaaguugggaucucagacauuucaggaccucugcugugccaucgcagaagcagccggggcugcuucacacccuguguuuguagaaggaaauugagcaggcgggagugggugcaggcucuggcccucacuucauguuagacuucucagguuuauauuuaaguguuuuuaaauggaaaauuggugcuacuauuaaaucacacaguugagacauggguuucgaaauugcuucggccugaugaugccacuucuguuuaagcgaggcagaaggucuuugacaggcuucauuuaaacagaagcauuuggcaaauggaacaggaucuuauaaaauaauauccugggccaaaaucccuacagggauacuagggcuuucucccacugcucccucaugucugccaucuuccccuucagggcccuucagcgucuaauaacaauaccaacacaaaccugcaccuugcgaccauguccacccuucuacacaggacugucacauuaucaagccacaguuagaaauaaucuuguuuccacuuagaaaauguguaaauacugccuugcuguaaauugaaugugaaauccuuugguccuaugccauguugagugacccgaauagccccuugcaucggcaggauggucugcagccaccaccugccuugguuccuggccaugguguagggagggugauggucugcagccaccaccugccuugguuccuggccaugguguagggagggugauucacucuccagguccuuugaauaggugacagacaggcagagccugaaugucaggaaauuccauuguaugaaugcuuuaaaggaaaacguucccuauaccucauuauuuuuuauugcaugauguuuuauaaaaauuugcccauuuuagauguuagaaaaauuauuuccacuaugcaaauuucuuuuuaauucagugaaaagcaacuguuauaccucauagucucuuguuuuuaauugaccaaaauauuccauucuauucucacaagguucugaggucucugccugaaaaagcaagucucacccuauagacacugaugugcccagcacuacgugccagccauugugggaacacaagagggucaccugcccaagggcuagggaggaagaccucaagaacacagaggagguggaaaaggacaaaauaggugccauuuuagggagaccauggucagauagggggaugcucaguuccuugcagccucgggcgggcuuauguuggcacuaaggccauuguggaguguacuuauaugaucccuaugcugauaggauuaccuuccuagacauagcuagacgcaaagccacauguguaaggcugcugagcaaagacagcaucccagcauggguguguucacgguggauucaccacguugcauauguaaagugguccccuuggcuuacccuucacuuugcucaugagauucagaagcuggugguccagcaggggugagcauuugugaaauaguaagcugaacuuaguggugagauuucagaacagacuucugugaaguaagagauguaaccaugcaucuaaaaucagauggccguguaacugcucgggcauagaaauggugggagaaccuguccuggguaccuggcauuucacaugagcccagggauaugucuugugccaaggcacacaaguguccauggacuuggacaggugccaaggguuuuugucucuguuccuaugugggaggcuggcugugauuuacauuaauuucuguauuucaaacgaagaugucugcagaucuccauuuugauguuacagccucauugcccaggcagugggcagugcccagacacccuuucugacuagccacugcauugggcuucugugauucaaaguaguguauauauuuauuuacuucucugacuguggccaacagccaaaugccauuuuauguuccuuguauucaguccauuaccaaagagguguuugcacuuuguaaugauaccuuucaguucaaauaaaaggaccacaucguuaaguggagaaucug

SEQ ID NO: 6622 - RNA, 1685 nt, Mus musculus
ccuagcguugcuggccuaauggaaaggauaggggaggggaagggacaggggcuagaagaggggcuccagagggccaucaagguacaggcacuacacgcaugguguuggugaauccagagccagggcgccacccggucagcacaaugaccacauaucccuucuugaagaagccucgggccuugccaacauccauggccaaguuuacacgaaggucaacauccucagcccaggcauucaguacggcauccuuacacagcacagggaagaugccacgguacagaugggccuggcgagcagucuggggauugcacgucacagcaaugaugggagcccgagggcgguaccuggccacuuggugagcacuccugccagacuuggagagcacgauaauggccccacugcagcacuugaaggaggccuucauggcgcccacggcagcagcuucuguggggucggugguaaugggcgccaaguagaggaguuccucgaauagcugcaagugguagauggcagccucugccucucgggcagucaggugcugcaugagaacagccuccagagggucgucccccuuggcgguuucuccagacagcaugaagcagucugcuccauccaggacugcguuggccacaucacugccuucagcacggguggggaguggcuucuugaucaugcucuccagcaucugcguggcacagaugacaggcuucccagcucaguugcaucguccgaucuucaucuccugagcuaggaagaccuucucugcaggaaucacaaugcccaggucaccacgagccaccaugaucccaucacuggccuccaagaucucaucaaaccugcggacaccuucauaguucucgauuuugcugaugaucuugauguucuugcccuucucuccuaggaccuuccugacuucaugcacgucggcugccuugcagaugaaagaugcaaacaccauguccacauccugcuccaccccaaacuucagguccuagauguccuuuuccaacacagcggggagauccacagcagcgccgggcagguucacgcccuucuugcuguccaaggagccaccauucuccacuucggucacuaggaagucagcaccuuucuccuucaccugcagugagaugagcccaucguccacguagaucuugcugcccaccuccaccaccuugcagauguucuuguaguccagccacaggauccucucgucacacuucuccauguaaucguuguccaggguggucuucggaguggcuaccuucuucagcuccaccucugcagugccgcugcccuuggugagcccauuccagaucucaggucccuuuguauccagagccaccgcaacaggauguuagagaaugggaucagauggacaagaauggacacaucaagaauguggcuucauggacauucuugauggucucugcaugguacucauggguuccgugagagaaauucaacugacccacauucauuccagacuuaaucaucuccuucagcaucuccacagaucaggaagcaggcccaaugguacaaaugaugcuaguguugcgggcugugacgggcuagaguuaauguccaggaggcacauguguuccaggacggugucagccauggcugcauggagcugcugggucugaaugaaggcaaucccugcuucgcuguguggcuucggcaug

SEQ ID NO: 6623 - RNA, 64413 nt, Mus musculus
augugcgcaugagcagagacgccucccucgguuccucccuaggcgaaacuuucuaauucccuucuuugggccggugggcugccaggagcggguugagcgcucgcccagccgggugaggagaacaaaguaguuaagcgacuugacccccuuccugggcccagcccccgcuuccgugggagcggcaggaaauggaagggccccucuccucucucccaacauuugccuuuucuccccgcuaccucuccagaaaggaagacccgaagaaaagacaggcagcuugccugcugcguccuccuucccgugccgcguccccucgucugcgaggacuggacauggggcugcuccagguguucgccuuugguguccuagguaacucaguaaggguuggggggaggggugugcuccggcauuagggaagaaaacccccaaaccgguuugcccccgcuuugaaggcaguuuugggggaucgggggagagagagugguuggaaaugacgccgugagaucgccaccgcucucgcuucggugguggccagggaccgcgcacgcggagcuccgcggacccgcauccacuggguucugcgcacagagcucgcgcuccugcagguuuccgaggugaucgcuccagggcuuugcaccuuuuaccaguuaaacgcuguuuccccacugcggaaggcaggcucccugcuguggcugggcagacugcggaggguccuggaaaaaccaauuacgcacaaaagugucggggcccagagcaggcuucgacuugggaacagauuggagccauguggcuuuaauuaaccauccuuguuugucucgggguggcaccaugaacaguugggccgggugcuuugcuggaauggcgaagcguugaagccacuacagagacacaccagucgucucuagcucagggcuucuguggcaaacgcggugccucacccggcgcaaucgccggugacccuggcgcgugcacgcggacauauuuuugugccccccccccgcccccagacuaaccacacucacaccgaggaugcgcgcacugccaugugcacgcggguuuucauuagcgggugugcagcgcuuggcagggucaaccucacugcgcccugguccaggcacuucgaagugaccggaucacucuguccaccuuucauagagggguagaucagaguagacaaaaaagucaguuguauuuucugggugcugcgcucagcugacugcuagucaaaccuaaugacgauucugagucuuuuuuuuuucuuucauccuucugucuuuuccuugucccagcuuuccaggccuuuucugcgccuaucucuccaccguguuuuuucuauguagucuccuuucuuuuuaauccucucugucugccccuccugcuguuuucuuuugcccuggcuugucgguugcuuuuuuuuuuuuucuuucuuccuaaccuuguugcuuuucuuuucuguagcccuauggggcacccgagugugcgcucaggaaccggaguucagcuauggcugcgcagaaggcagcugcuacccugccacuggcgaccuucucaucggccgagcgcaaaagcucuccgugacuucgacauguggacugcacaaaccagagcccuacuguauuguuagccaccugcagguaagacacgagucuagagaaugcauugugggcugcauccuccuccuggccgaucaaaggggcuugcccaggagacuccacauccugcugucaauccagauaggaaguacaaccagcagaggagccccgggaugaagccaguagcucagucccaaucuccauuugcacagucgcacccgccaaacauuuccugccaccuaacaccaccaucaguaggagaagcccggggcugcagaugagcuuagccucuguccugugcccuguacgguccccuguauuuuauucuguuguuauuuauacuguuugaucaaacccuuuugaaauuguguauuguagaugguucaguucucuucuugcauuguugguguuggguuuccaucuuuggcuugaguauaaggacgccccaagcgcugaagucuuuucgaggugauucagucaggaucagacauacuuccuuacugaaaaaugcccugguugucauggcaucaucauaguggaagacggaaaugaaauuaaugaggggcauaugcuucuaaaaguggucucagguuuuagauuucauuggccauguuuagauaagagcuaaugugaguuuuaucuccaccaccguccucccaccaccccuaccucacucuccggggaaaaauaaaaagaggcuggaaauggaauggggccucugacaguaacagguguuagucugugggugaccugggcuuugcacauguaauauaauggcgucacaacauggccaaguggauuccacuccuuugcuuccagguuuauccagagcugucuagacugcuuccuccugauuagagggaggcuauaauuaaacuuuuuuuuuuuuuguaguucugguaauuguucuucagaacaaguuuccuugacuacaaguuaaugaaggcaauucauguuaccuuuucuaauguuagcauuuucauuucuccuaaaaugucuugcuaacauuuacuucagaggucagagugcucucuguccgugagucaccagauccugaaaucagcuucguccacagugaaaacuucacuuaaaagcaaggagcgccagacuccccuguuuguaugauuagcugugacacuguagaaugcuugucugagaucucaggaucuccccucucugugaaacacugaggaguagagaaugaaaacaugguacuguaguuccugaucccuuuguaccccagcccugacugccccagggguccugccccaucccccaucuuuuggugagaaguuaauuaaauagaugcaaauguuaaaguacagucuauauuggcauuguauuaucucugacuaaauucugauuauaagaugugcauuggucuguagcuauuucaugcuuaacaucauuuuuagauguaaaaauaaucaguauucuagaaaauguaggcacagagccaagcuccaaaugagaacagaaguccuaaguguuguuuuugguucacugugacaugcugugaagaggagagaucuuacccuagaguggcuguggcucccauuuagaaaaaaagaaaacaagaaaugaauuuacuucuauggaaaccaaagucuguccucauucuagccugugcucaugugggauccucagaagugcccuccguucauggugaucccagcacaggacuuccugccccagauacucugagcaguuugcaggucagccugcuccccauccaccauccuuggauaaagcagaagcuaagaaccugguccuucaggaugcguuuguucaucuaugguuccugccucacguaggcuuuagaaaaucaggcagacaguuuuggguuuuguucuuguuuuuguuuuccuuuccuuuccuuuugcacuaugucagcaaaaacucuccguuaccucuuuugcaugugacuucugaggaagcugcacacagagaucaagauguaagcggagacauuuaauuuugauuaaauuaguagcuuauggaaacaaugcccuauuuuacucuugaucuuaaguugcaagaaaggaagaaauaguuuucuggaucauuuuggacaguucaguaaguuuaaaagugagaaauaggccauauauuauauaauuuuuccacauucaucuuucuugaagguggucgucuguuuucuguucuguggauuuaaugacuuuuuuuuaaaugacauuguuucauggacccaugcuacuguugugcuuuuaggaggacaagaaaugcuucauaugugacucccgagacccuuaucacgagacccucaaccccgacagccaucucauugagaacguggucaccacauuugcuccaaaccgccuuaagaucugguggcaaucggaaaaugguacgugaugccugugggagcacguuccuuggagugugccugggaacugggaagaaggucacauggguauuugugacugugauucgcuucuugguucucugauuagagcccuugacagaauuacugucuggaacacucaucuugcucaguuaaaucugacccuccguccuggaguuugugcccuguuaggaagcagccuuugaugcuagaccaaaggaguuugcguaggccucacccugugggggcuucuggggacugugugugugcugaagggagucaggggagagagagagagagagaggagcgagcaugggaaagcuacacaccucaggccugucacaggccugucaccuuuuuuuuuuucuuguuaccagcccucaaggaaggggguggauaacaaaaacaaugcauagccccucccccaccuuccagccacagaagauucaugaaacaacugauagucccauaaaauaagaacugugacaaaacugggcagcuugccuccuuguuuagcaguguugugaguguagccuaugcaaaucaaacaaucagauaugauaauguugcuagaaaaccauggcuaugugaaaucuagggaacaaagguacaguuggugaaccgguuacuuaauucuguagcuuggaucuuaguaguuuuuuuuuuuuuuuaaaaacaacuuguugcuuuauaugaaacacagguuggcuucaaacuugaaacccuccuaccucagucuuaaaauuggauucccaaccugagacugccaugcaugccggacuucauuacauccucuuauuuuuaaaauuauaggagcccuuguacugaacguaagcuuccauaaacaaccuggaaacggcuagaucugcucauuaggugucauguaucuuuggcuggcacuugucauuuucccacccuguuaugaggaauuccuuuauggcuuucaguaacuggcagguuuuuuuacaaggacucggauucuagucuaguuuauuggucagucuuuuuuuuuuuuuuuuuuuuuuuuaaauauuuucuuuucuuuuuuuuuaagguuuauuuauuauuauacauaggcacacuguagcugacuucagaugcaccagaagagggcgucagaucucauuacgggugguugugggccaccauguggcugcugggaauugaacucaggaccuuugaaagagcaguaacugcucuuaaccgcggagccaucucaccagccccuguuggucagucuuaagacuccuauuggauacaaacuuugccugagagagagaugggcccucuggaagcauguggcuaacuuuucagaauugguaguuucuacaagggaguacacuggcgugguuccuugugaaagaggacugcccaccugagucacagaggucugcagaaacagcuucagccuuuucgugagcagagucuaggcgcucuucucgaccucucacgcucuggagcgaucccugcaaugaaguagaaauacauugcauugcuuccgggacauugggaggguggccccauuuuagcuaaaaaauguuaaaaugguuuucgaugugguuaaagguuuucuuaaugaugucaggaguucauucauuucaauagcuuugaggggaacaaagggacccagaugccggaaagauuuugcaaacaguggggccugagcucugucacagagagaagaugagauuagacagaugggguuuggcauccagaaagucacccauuguuacuauaccuugucaucucgguugucugauagcucacaauggaagacucucugugauucugaaguuaucuccuuucuguguguugggcgggagcugggcgguuagagggugagguugaacccaaggccucgggcucagggccuggccuggaauccucagugacuuuucacucacucuuagauaugacaagucacacaccauaaaauaaucuuggucucuucucuguggauuuuguuucuucccauaaauaagaggaaaaccccaaaccacccuacuuuaucaggcugugaaucugaaaggaaugcgcuuuggggauaccggucgcagugccuuuguuacaggaauguugcuagucuugcuuugugcuuuaccugguuucauuauuucucucuuaguucugaacaaacaucacagguuuucaaaagccuagaagaggaaaaacguauaguugcucagcuaauacuucacucaaaaggaacugcccagcgugguuuuguccgacgguucuuuuuagcgaguuagauaaggcucauugcuaugauugcccguguuuuucuuuagcauuccaacuaacucauauccguuccagugaccacuuuuucccccucggucggcuuggccauuuuccagcaggcaaguuuauuucaaaagguccuacugacuuccugagaauauaccagcuguagcaugauucauucugacacauuccugucuuccagacuucuuugcuugggaggaugggccccgggggcaucuccuuacagggacuguagaucaguccucuuaagccagggcggcuucugcggggucucugggggguuaggggaggagccucuucucccuggaauuccaguggcuuuuuuaguguguucaagugggucucugacccucagggcaccaugcaccguacagcuuuguuugugcaggcuuuuccccuggaaggggagaaguuuguguuuguucagggacaggcugaguuaucugauggguucuuugccucagaggcagaaguguauaguggaaggucgcuugcuugcaccaaggaugaguuucccugacuuggcacgcgucaccaggugugaugcucaccugcuuucuuugcugucaguuggggggcgggggacauguaauuauuuguauuucuucugugucuuugcagacugacccccuacugugcacugcaaguguguguugggggagggggugccuuuggcuuggaggguugggggcaguggguguggcuucccgagcaagcaguauugagaggggccuucugccagaugucugcggcagugaacagauccaguaagcagaacuccagagugauuuauggagaacuaaagaagugcaaaggaugcccccuccagccccacccucacacuaauaacuucaacuccaguuuuaagacacaaggggaaacuuguaugagggguuugaggaccauuuaagaagcuguucagagguguuccccguuggucucaccauuuccuuuacugcuguaaaaaugcagguguggagaacgugaccauccaacuggaccuggaagcagaauuccauuucacucaucucaucaugaccuucaagguaaggaauccaugcugucucggaugcaggcuccagagcugggcgacugccacguccagagacaauguuucuuaugaguuggccuaaaugagaacuuaaauguuaauuguuguccuaaguugggauaauugugucccuuucaaaacagggacaugauaacugcccuucacaugugcuagcuuaaguagauucuucauccuaauuuaucuauaaacuuuuaauuagagaccccuuucuuucucccauugagaaaggcagcacuugacucccuuccaaaccacgauaaaacauuugcagagugcaucuccgauccuucaugguuagagucuacggcugaauuugguaacugaaaacaaaguaauguuucaagucuuagguuccaagauuuugccaaaacugggggaagaguuuuacaguuucuaaagaaaaaugcaugccuuuuugaaugcaguuuuuuuuucccccucuccauuuuucuuuucaagauguagaaugacucuaggacuagggaaugucucuauacaaagugccuuuguugcugaagcagcugccugaaaaugacaggcuucacauggcucaaaguacacguuggcacacacaaaacucaugauuuaauuauugcuccccagaugaagaucaccuuuggguaguuuucaguuggaguuggggacuugcuggcauccucucagauuaggaaaaggggcggaggaucaguuuaccuugcuggcaaggaaccauggaaaucucgcuucugucugguacccaaguaugagaagcagaggaggagcaagggcaggcgugggagucagaaugcaacuaggaggggcaucaagcucugugguucccaggccucuguaccucaccccuuugcugucccccagugguccacugugacugauggggcaggcagggugauggagacaccaaaugcagcagacagugguuggauaagggcuauuacuagcuuaucagggacuccuugcugccugcggucuccauucaugggccacacuacaccuuagugguuaaauuuaaacucugucccacaugaagaugucauuuuuauguuuugugaccuuuaaaauauuuacaguccucuuuauugauguucguggcaccaucuuacuuuggagagagcaucugcuacacagacauggauggcucugaguucauuuaugcucaaaauccuuagagugcauauucuguggaauagugggccagagaugagauucuguucuacaccuaggugcugaagguuagucugagaaggugcugagguguggacuguagguacaggauguggaccucagcaugaaggacaagguucauccuuccagguuccagcuucugugagacagcaggacccacgccagagccgcguuugccaugcucugggccggcuagucuguuagcuuguauugugagaagacuuuuccuugggaaacaaaacacguucaucuacucauaccccagauaggaaaccccugacagaccaaaguacccgugcugaugcuaccagaauccagcgcauuggugaaccagugaguuuuauuggaguuacaggaauugaugggaaaguaacaguuacuuauagaaaugugggugagggguuacuuacaggagcagaaaugacucagauaguugcaacuccaaggcccacuucagcauugaugacagcucacaaaagcugggaaaccuggaacccucugcacagccugcaggccacugaacagguuagagagcguccuuucugugugccucgguugaucuaaaccucuuucaggcagcucagcuaauuacugcuugucucauaguugguucugucugagaguuuucuuugcugcuuggcuugcuccucucagcuuauauuugggaccuagagaaucuggucaguuucagggacuuccuggagcuguuuugaguuguuucccuuccugcucaaggagcuuccuucaggauggaaucuuuaguuuaaaucuugggaggaaaguauuacauaacagccuggcauaaggaagaaacuucaggagcggagaccaaucguacccuuuaccugggccaggaggggugagaaagauuucagagggaagauauaaaggaaaacugccauuggucugagaacagugaccuuugcugugcucuuugggcaaggcuuguucaauaaguacugcauccacuuguuucaaggucagggaggugaagaaaguaaguauggagaagcaggucccagucagcaggaccucaacucuuugcugaggagugggaacuucauaggcaguagggagccacagacuuggaggucacaaaaauaauuuugcaaggaaacccgccaugauggcaccaagcccgaacuucagaaguugggucucgguggguucaagaccagccugaucuauauagcaaguuccaggcuagacugagauacauaaccacaacggguuuuguuuuuguuuauuuuauuuuauuuuauuuuauuuuauuuuauuuuugagcuguagauuacagggcauuuuaaauuuccaaaugucaggagcucaccgguccuuggaacacuugacuguguauccacaugcuucuauaccccacaacgcuuugcccuggcugcucugagaaccgcugcagagaagaggaggccccuacuuccugcgaaugguugcuugggugcuuuagaaucugaggcugaccuugaaguggagaaggcgcggaggcaggucaggggaaggaaaggguuguguccaggauagccgggaaguugaaguccuuaggaagaugugggucucccuagcaguacuguaaaggaaagcggggacaaagaugaagagcucauguuuauccucaaccacucuggcuguggagguggcugcuuacgagguggauuagcuuguuuauaugcaugugccaguauguuguuguuauagacagauguuuccagucucuccugguuauuaugcguucagcggucccugugcagcccuagaaggggcccgagaagguuggugacuaaguacggcggugggaguggggagaggcuuccguccuuuaggugaagugugugguuccgguuuccagcagcuucuuaacuccacaggaaauuggaugacugggcagggucccuugggauuuagaaguuuccagaaagugagagacaaggcagcacagccaggacaagcaagcuucuguguguuucuucucugcugucuaaggaugcggagauaucugacuaggugugccccgcccaagccucuuaggccuucccaacugggagcguggccucaugggauuggccaugccugcacaccugccaguccagguuccgauggucagagcagcuucuccguuccccuucuaaaauccuuagucuacaguucucugcaguuugauagaaacaucguuuucuucugccuugccuccgucaggcaggguuaucaaggaugcuagcaaguagguuagcagauuuuugcuaguucccaacaucaggcucuguaaaagcucugucugccaagugaugaucuuacuuaauucaggaauucauauuuacuuaagcucuguuuucuaggcuggcugaacuuuccuuugacuuuucuccacggcaaucuggcuuccucuuccuaaagugcgcacagcauguucauggcugggaagcaucugcccguggcccauuuccaucugcauucuuucuuacguuuuacucuugacuguguccuucauggccuccugaaguccucgguguguuuugagggguuugucuuguuccuauuccuccccaaccuucugccuguucgcuuuucugcuuaggccacuggcuggggaggaggaagguacgcaugcgugagcacacacucggagcugaagcgaaagguggugacuguugccggcuccuguucucccguguccagccuguugggcauuuuccuagagugcuggccuuucucuugccauuggcuuuguuggaggaaauucaaguauuaagugaucgcagugacucccaaauccacacugcaaagcugaaugccaugcccacauauggcugcccucaaacgagguugagaggcucgcugcucgugccauuuucagcccagccacccgugcuuuggggccuaucugcuucuccucuaagaucuaauagaucgaguguauguaacucagugcagugugcugucacuaacaggacaguagacuucaucucucucuguccauguuauaccuuuagagugugagaccuucuucaucuuuucuuugguuccucugcuucuugucaucuuccauguuuaaugacagugcugucagaguuauuuucuauguauaagcuuucauuuuguuaggucccauaaaucuuuuaguguucucacuuauauggcaaaaaggcaaagaaagucuguuagcaugucaaacaguaaugccccccugugcugcacugggcauugaaccuggggccacccagagcugaauccccagcccgagauccaguuugaugucaucccucugaaauagucucugguuuuuguuuuuccuuuaaaacuacuuacuuuugugguacaguaugcauaucaguauuccccauucuuauguguaccacucagugauguuagacauacucaggauagcgcaagacuaucacugcugucaguuuccagaacuuugucaucacccuagauaggaacuugaacuagucacuaaauagucaccccugcugucucaccccucuuccccaugaccccuuuccauucccaucuaaaacccuagguguuucauauacaugaaaucauaauauuugaaaauguauauggcuuauuucacuuagcacagugccuucaagguccuuguauguuacagagaguauggcaucccuuccuuuugcagcuaaauuagucuauuguauuuaucacauuuaguucuuucauuaauuuaucuacuuauucacuuuauaucccauuauacaaccccuccuuccagcccuaccacaguuccugcccccuuucuucccucaccuucucugagaaggcagaacccccaccccccacccccaaucacucucccauccccacccuugguacaucaagucucuauaggacuaggugcauccucucccacugaggucagacaaggcagcccaguuggggaauggguuccacaggcaggcaacaacuugagggagagccccuauuccaguuguugggggacccacaugaagaccaagcugcacaucuguuaccuguggggguggggcaggaaaucuagguccagcccaugcuugcucuuugguggaugguucagucucugggauccagaggguccagguuugucaacucuguuggucuucccguagagucccuguccccuucaggucccucaauccuucccccaacucuuccacaagacucccaagcucgucauuugacugugggucucugugcuuauuccauuggcugcuggguggagcccagaggacaguuacucuaggcucacauuguguucuuuaccagcuaauaggcacuuuggcuguugccauucuugggcuagugugaguaaugcugcuuguuuucucacauuuccugugaugguacuguggugcuugacauauuauuguacaaugacuaugauuuuuaugugugugugcuccuuauuaaacuguguguagcauauggauguuauauaagccacaggcuauaucaucuauggaaugauuaaaugaagaagugagaaagcaagcauucaaaauuaguucucuccugggcauggugguuaauauacccaaguguguuugcuacaagggccuguuuauaaucagcuucaagaaggaacaguuuacuggucuaccaggugguugcuacaagugcggccuuucaagaacagucuccacagaaauaccaagcacacagucagcuuaggcacacaggagggacaaaaggacagaguagcaagcagaaccauggaaugagacuuuccuccugcuuuuagacauuccgcccagccgccaugcugaucgagcggucuucugacuuugggaaggcuuggggcguguacagauacuucgccuacgacugugagagcucguucccaggcauuucaacuggacccaugaagaaaguggaugacaucaucugugacucucgauauucugacauugagcccucgacagaaggagagguuuguaugccucugauugaguucucuacuugcuagucugccuuuugaucauugcaaaaauaccaacccucugaucuauuuuuagguaauauuucgugcuuuagauccugcuuucaaaauugaagacccuuauaguccaaggauacagagugaguuuguuuugaaauacaugcuuuggugggaaacaguacuuacggagggucucauccuacccagugcuguguggcccgauaucuugauacucaguccuacauacaccuagaucuucuuccuuucuuuguggucuuccaaaaaaaaaaacccacuucaaauuaccaguaaucaggcuucacugauaagaaacacauuuugacuaugucagcagaacuccaaaaaucagacugaccaugccaccuucuguuuuugaugcucaguauauaaauuagaguacagauuaaacugcuguaaucaaacacccccuaaauauagcuucuggaauaaaauagauguuucuuuugcuuguaugaagucagcaugagggauguuuaauuguaugucuguggguauuuuaccuguauguaugcguaccauguucaugccucaugcucucguaggccagaggagggcaucugauccccuggacauuggaauuauagagaguugugagccacuguguagccuggaaaucaaacccagguccucuggaagaguggccagugcuuuuaaccacuuagccaucucuccagcacuuggaaggauucucaaagaagaacuacagcucaguugccauaguuagucgcacuguauaaaauacaagaugcuauccaguuagauuugagugacagaugaauaacauguucuuuuuuaguacccuuguaacauuuuaacuggcacaaguauaccccaucuaguauuuaugguuuuaugguuaguaugauuuuuuuuuauuguaugcuauuuaggacugacacuaaaacugaggguuuaucauuaauucuguuuaauugagcauccuuuauuacuuacugaauccgacaguccuagcuaugaaacucuaccucuuccuaggauugucuacacuagcagaauuaccacacugucgcugcccuaauucugaucuguagcggucaagaauaaagauaaggcuuggagguugucauaucacuucugugcauugcuauaauuagucuccuagcuagagaacagaagauacuugggaaauaucucuggcaagauggccugugcucugcuaaaacucuuggcaagagcucuuauccacaggcgaugggaaacaaccaauacugagaaaaauccgaagugccaucgugacaaggagauguagcaaggugaggcccauguaggcuuuugaugggugagaacaccgagugcagagucgugcauaccaggugauggggcagugaaauggcaggugauucuggagcucaucugauacaguucuuaguucaggggcuggagagauggcucagcccuugaaggcuaggcucacaacaguucuuaguucagugcucucuuugcuguucaacaguugcuuguuacugcaggacuacuuguaaauaaaucucaggaagcagaagcaagcucaauggcuuucaagucagaccaaguuuaaacugggacucuugucauaauguagcuccaugaccuggugacuuaaaacuuuuccauucccucuucccccaucuugaccuggagacagaaauaccaaccugaggguugcuugaaggaaaacaggucguauaaacgagcagcccagugugcaauugggugaagcucuggguacuggugauguugacucugccaacagcuacagcuuagggcuugcauugagacuguccugucagagugaaagccauagugucagggugccggagggagcuagccucccuuguucggccuugcuaugagguugcaaucaguccgaguagagacacgucugguuuuuguuggucuuugucggcugugugcagcccuauuuuuaaccaaggucucauggaacuuccacacuugcaacaugggagauaaaaguagaagaaaacccaggggauguuuacagagaacaacuuacauuaauuuuaguguggcccaaacuauucagggucuauaguucauucauucauucuguuguaaaaacaauuuuuaauggcaugucucugccgacucugaacaagccacgaggcuguuucuguaggucucaaaaacugguagugaaagauacccacauuggcuccaggacaaauggcacuggagucccucacagggcucaccugcucugcaggugaagugugugguaccaggaauguauucaguucauggccuuacauuucccuggcuuuuguuguuugguggcaucuggagaccuguuucuaggaacugcccauguuagcugaucacgccuuugauuuacuuaguaaucaagggaacagaauuucuauggcugggaccuuggagacucacuucaaagggaugugccucuuagaagagcaggcagccugaggcucuguuguugcuccuuaugucgggagagaguggggagcucuuugcuccuuggaggacucuaugaaguucaaggguuuccaaauacuccagcugcccuccacguuuguuuugcagccucuagucaauaguacucucugugccggagagguuugcagauguugcugugacagcugccauucagagcaagauuguggguucuuuguuuuguauuugauuuuuacaaagagccuaaguuuaaugcauggacucucccuuuccagccccagccauuucuauagucuucauuguaaacugugcacguguuagaacuguuugacguguucauuuggcgucugaaacaaccugacguacugggcugcucccguucugccuuguauccuaagcugacaauaugcauuagcacaaacacaguucagguuggcaggcgauuucagaauucagagagcaaugagaagcaggcaggugggcugaccagaucuggugggguucacuucaguagaagcugcuuggcuauuaaggaaaaaccaccugaguagcagguugauuggcccuuggucuauuuaguuauauagaauguguccgacaucuccucaaauaagcuuagaccuacagaccuggggaggaggagaaaagcguaaaagaggacaaacugauuauuaagaaacuguuauguagaagaaacaaugugccuggcaaccuagaacuaagccccuuugucuucaugucgcuauacugaauuaauaaauaugaaaauguuuugcaaaaauauguagacuacaauguugcuuaaaacuugcuugaaagaggcaguugugaauuggagagggaucuggggagacuagggaaaagauggggugaggaaagggagggauaauagaaauacaguacacauuuaugcuguuuuuaaaaaguacuguaagacaagcuugguugagacuuucuuccccuacaaagguagcuuuucucuauuguuaaaucuguuccuguaacuuguauuuaaguugaaggaacuuucaaaaaguguuuucucauucaaaaauaaacccaacugcucuguuacaguuaggauuggcacucaggauaaauauccuuuucuaccugaaaauaauuucugacuuugacagcaggggcugugggagccagaaggucuggaguauuuuagacuaaggggccguggguucuggaacuccguggucgugacuaaucugaggagauagugguggccuucccuguuucuggaggcugucgcccugugcuaaucuuacauucaucaucuaguucauucaggaggggcaaaguuuacuugggccucugccauuuguccaguccuucaccuaaaagaaagaacguagaauugcuacagcaugcuugucugucugaucagaccuuuccucuuggugaccucuguagaucuauuaaaaaucaccaacuugagaaucaaguuugugaaacugcacaccuugggggauaaccuuuuggacuccagaauggaaauccgagagaaguacuauuacgcuguuuaugauauggugguucgagggaacugcuucugcuauggccacgccagugaaugcgccccuguggauggagucaaugaagaaguggaaggaaugguaagugucuggggagagcuuguacuggagaucuggaaugcaaggcaaaaaaaccaaaaaaaaaaaaaaacaaaacaaaacaaaaaaaaaaacaaaaaacuuguccuuaaagccugucacaguauuuuuuuuuuuagggguuuuaauuuaccaaaauagacuuugcuuuuugcgaccuguuggugguugaaugcagauuuuccucucuuggagaguugcuuaggucaugagaauguguccugagacugcuaguuucuuagauccugaauucguuuuuggacuuuauugggacaggcuggcuguuguugacguauuuuauuugccaaggauuaaaaaguugucuaaauaacaauccagacuguauuuccaguaagaaagauuaagaaccacaaguauccagucuucaugcuagcaagagcaagguggccucagcccagagagacuggaaguuguaauaacccugacccagagucgucacuuagagaccaaauggaguuuucuuucuguccucucuguagacuuucuuucuuugccauuuucacauuguuugcacaucaacuguuucgaaaugugagauuucacuuccuugccaacuguuugacguacugcuaguaaccguuaacugccaacugcuagcaaugugcugcuaacacaacuacuagguuuugucuagugguugacaacaaacuagaguccccuggaaagagugaaccuccaucaagggauugccucaucacauagaccuguaggcaagccuggggggcauuuucuugauuggugguugaugugcggagggccuagcucacugugggaggugccaccugugggcaggugaucuaaagaaggcaagcugaaugagccgcgagacucaagcagcauuccuucaugaacucugcuugagcuccugaccugacaucccuuggugauagacugugacuuggaaauguaagccagauaaacccuuuccuuuucccaaguugguuuuggucagaacaacagagacgugagcuauagcaauuagagaagcaaggguauuauacucuaaucuacuuaaguggcugccagaaaaauuccucgaacccuuaggaauuuaauaccagacagaauucuggagcucacaggacucugccaaccuugaaaaagaccuaaaaguuagugguuaguaaaugaguaacuaguggugggcauugaaacccagucccuaccucugccucaagcaccuccccauagucucagagccucucugggugacaaguauaccuugcuuauuugcuaucugucucuucaagacuuguuagucuuuguccaaaagggugcaagauccaaacacucugcccuucuaaaaccucugcccaccccuuuccuccagcugaaagucuucauggguaaacaaguuggcuuuuuaacagccuggagggagggauguguuucuaaucaguacaucuuucugagaauuccagacagacuugacuuugcagcguagcaaaaccuuugugaccugacaccaagccauucucagaugcugggugucuugugugggcugggagacugucugcucuucaauucagcaugacggcuggccaagaaaggauuuugaacuccaccuaagugcacuccugucaaggcaggugcaggagaggagggaccugucuguccuguucccgaauuccaggcaguagaaaugaggguuaagguggagggcuuauguaugugcgcgcuugcuugguagaagugacguacugcaagggucuucagcacaacuugccacaaaaggacaugcaguaguguaccuuaggucuuaaagaaaaauuaauuugugucuuucucauaguuccauaucuuuacuugaaggaaaacagaugguagaugguuuuaaaaaaugguuuuacuuaugguuaagaaaaauuaagagcugggauuaaaggggagaaaaagcagaaaccuuucaaggaaaaugauggcuuggcgcagaggagcgcgcacauucguuagagccuguucucgcagagcagugcgugcugagugcuccacuaagaccuacagguuucuaguacaguagcuuucagagguuauucuuaaauauuacuacacuuugaaaucccuuuauucuguguguauguguguccucacacaugugcgacugaguuuguauggaggucagagcauaaccugaaagagucagcuucuccuagccacauaggaaucgaauguggguauucagggcaguaguuuuuguugugguaguuguuguaauucuuaaauaauuacuuguaaauuauuuauuuuagauuauaauuuaucucacuucacucuuugccuccuucuaaaaccuucucgcucucuuaaauauguagccucuuuuuuucauuaauuguaguuacauuugugaauguguguauauguauacauacacguguguguguguguaucuaucuauguauguauauucccaagugccugaguacagccugcucagucuguacacuguuaacuugccuguguguuuucaggacugaucauuuggcauuggauaaccaguuaguguguccuucccuggggaacaccaguuucuccuguugucagcguuccuuaguugccugcaguccuuuaaaaagggaauucuuaaguuguuaauuuugcucauucgauucuuugcauugauauucaguuacgugcccauuacgucauagaaacuauccuggaaacaaggaugauagccaucaacuuauauggcuagaacuugcucaguuggggcugaggauaaagccaguccucaccgugaggagggccuaucgucggcugacuggagaaaggguggccauucguagcuucugacugggcccgugcugguugguuaccuucccagguucacgggcacugcaugugcagacacaacaccaaaggccugaacugugagcugugcauggauuucuaccacgauuugccguggagaccugcugaaggccggaacagcaacgccugcaaaaguaaguugucagugggagggcugcuggaggccgggguuccaggcuccguuuccuggggagcugcggucugcaauugcacucuuugcagaagggaggaggauugugucguucuccuggcugugucuguuccagagcuguaauauguaugcacugaggccaaguuaaaaaaaaaaauuaguauguuuggcauugacucggggaaauggcaacgggguguccaugauguuauaucugccuuuaagacaagaggacgacagggcaacugaacggcagauacggugccuuucaugcacugaaggcuugguccccagcugguagcacuauugagaaguaauuggguccccaagacagucacucgaucaguggguuaguucacugaugacuggcugacuagguuaguggguuaguucacugauggguuccuagauaacugguugucuagauuaggccuacuuggaggaggugcuucucagaggugggccuuugauguugcuucuuguucccaacccuuucugauuguucuucugcuuccuggcugcgguuccaugccuuucugccaucacauucugccuuagcgcagagccagcagugagagcuagccagcuguggagucuaaccucucaaaacugugaccccaaggaaacccuccuugaagucauauuccucaaguguuuugucacagggagggaagaagucuggcucauuguuaagcugcccaugugccuggaguacaggauaugucaccugccugucacugucaucccccccgacauccugucauagucuucaaauacgaaaccccaaaaggcuucucuaggaauacaucaaccugcagaguagagaggaugucaaucaguuucuacccugggcggggccaaagcuaccuucaggggaguggcaucccuccuagccaaguaaaucaacauaaagcaggaaggauccaucagaccgaggucacuuggcugugcuguuucagaucugugggaaagcagaagcaucauagaagaagauagcaggguaaagcagggagacagagcuuucagaggucaccccaaggaccuacucucuccagccagaccacaccuccuacuuaccaccaucuuccaguaaggccuuuaugaguccaucaggggacuaagcaacccauggaccagggccugcaugaucccaucauuucccaaccaagucuuuuacacaugaaccucauccugauuggggauuuuguccaagaguuucccguuuaugauaacaguauuuguuuauuuauuuggauuuuugagacaggguuucucuguguagcgcugccugucugcccuggcuaguuacuccauagaucacauuggccccagacucacagaucuaccagcaucugccucccgagugcuaggauaaagagugugagucaccacgguccagccuagcaauaucuguuuauuauauagaguccacguuuuaaaaguugcuaaccugauuugaggucuucgucaggaucaacgagaaaggccaagcccugucucaucaccagaggcuucuugcuguuugacucacacacacacacacacacacacacacacacgcucuguucagugagcuuccuucccgccacaucugcccugcauugguagacagguuuuaaauucuuguucuugacuuuggucuugucacacagaauguaacugcaaugaacauuccagcucgugucacuuugacauggcagucuuccuggcuacuggcaacgucagcgggggagugugugauaacugucagcacaacaccauggggcgcaacugugaacagugcaaaccguucuacuuccagcacccugagagggacauccgggaccccaaucucugugaacguacgucgggaagugccgccauucuuggggcuugccuucuucacuucucacgcaggauaguuuguuguuagcauccuucucuuggagcacaggcucugagcagcguagccuguguuguagcuaacugcuguuugggauacugggaggggcauuuucuugcuagcugggucuucaguucucuugcacuggauuuggaagguagaagagagcauacguguuugugcaaaagacagccuaaugucuaguguguguaaccuggacuuguucuucccagcauguaccugugacccagcugguucugagaauggcgggaucugugauggguacacugauuuuucugugggucucauugcuggucagugucggugcaaauugcacguggagggagagcgcugugauguuuguaaagaaggcuucuacgacuuaagugcugaagacccguaugguuguaaauguaagucuguguggggaauucucgcagggaugcaguucccauugaugcugcaauucuaaggcuaaaccucagcuuuggacuaacucacucgguuuguguuucuuugcuuccuuuuguuuuguuuuguuuuguuuuuucauauagcaugugcuugcaauccucugggaacaauuccuggugggaauccuugugauucugagacuggcuacugcuacuguaagcgccuggugacaggacagcgcugugaccagugccugguagguaauccugaucucugcagaugagaagguagugacucugacauguuuguuuuguuuuugagguagggucucaguauguagccaaggcuggcuuugaacccacaauccucccgacccugccauccaggcccuuguaugugcauaccccauaccuggcagaugaggaaugucuuucccauuuuuauuuuuuaacccauaauuuuuacuuuuacauuuuaauguuaaggagaaaagucaaaaugagggauucuagugaaucauuugacaaacugcaaugaaugcugcuuaugaagacaagugaacaagucugucuuuuuuuuaauggcauugcuaacagcuggguaaggacaugaguuaggacuuguuagcuucgaacagaaacaggucaacuuacacugugaaaaguguuucagagaggugucucaggaacuacuaaaaauguaauauuccuaagcuagugaccucacuucuaaggcuccucaugagauccucagagaacuggacaaaggggcauuccugauagacucauugcacccuuauuaauuauggcaggaaacuguaaucgauaguggggaaaaugguugccuaaaguuggggauuuccauacaaugugauauucaguuguggaaaaugacauuaaugcaaagaaguguuuacuucauugcauuuacaaacaaaacagacucgaggugugaauaacacuuuauguaggaaaaaauuucaucaagacagacaaaaauuuggaggaagcacaccaauaauacuggccguaauuguucuuucugccagagccacuugaaugaggaaaaccgaucccugucugcucacuccgagccaggcaggccuuucuuucauguggcacaaagcugaguuucuuuaguaagauuauuccuacuccgggucuguucccuugguuggaagaaauacuugggcuaauccaggcaggcugcagcuuguucuuugcugagucucuuguacagccagaggagccguccuuuacacgauucaucuucugaucugcagccgcagcacugggguuuaagcaaugauuuggaugggugucgaccuugugacugugaccuuggaggggcgcugaacaauagguaaguggaacgucauuugaacucugacccaggcgccaagaguucaggaagucuaagguuuuguaguccuuuaagaaagucuuuucaucuuuggcuugaguaccugccaaucauuuuucuugaugauuuccagggucggugauaggcugggagagugaguuuugaaaucuuauauguuggcccagagauggcucagugguugcagaggacccgaguuugguucccagcacccacauaacugccuauaauucaagcuccaggcuccaguguccucuucuggccuccaugggaccuacacucauaugugcaugcacacacauagacacaacacacauguacauaauuaaaaaccucaaaaaaggaugauuuauuuauguauuuauuugcugugaaccauauuuaauagaacuauagaaauagaaugaagguauguugauguuagaaauguggcagaaguuuacauuugaagauagaauuaagaaaggcccauacaauaaaagcagaauauaaucaaguuagcaacaacuguuuauugauagucucuguuucuugugauaugaccagugcguuuuuguuuguuuguuuguuuuuuggaaguuaaguucuauguaucauuugcuuauuguuucauaucuuguuuuguuuuuuuuuaucuaggaaauuugucuuguuuuuuguuuuguuuuguuuuuaaauaacccuguuaguuuuguaguuuuauuucuacauaucucuuaaaguauggaagccacgccuggccacaguuuacagaagaauaguuuggccaguucacagagcuguaaacugaaaugcaaacacauuuauuuccuguucucuuuuccacguuucuccuagaagcgccacuaugagcagcuuccuguugcucacugaaacuuacuaggagaguggaguaugccuguugaaaauuaguguuguuuucuucucaucagcuuuugaaugauguuaggcuuuaucuguuguuuuuuuuuuuuuucuuuuucuuuuuuuccguguguauguugugugcauacaugugcacauguguguggcagccugagguuugacaccgggagucuuccaugagcacucucccgcuucaucuccugagacgugcacucccgucaaacccagagcucaccuacguggcuagucaguccccuuagccagcucgcccagaacccccugucucccacucaggaggcgaggaucccagguagguugccacacacugacaauagguucuggagaugcaaauucauguccucucgcacaggacagagcccugugcuucuguuuuaauagacaauuucaaagagaaaaccagcccgugauuuucuacuugccuuuauuuucauuguguccacaagugugcacacaccgcagcacacaugugaaggucagaagacaacugagggaguugagucucugacuccaguguggugcucaggucaucagacaggguggccuguccuuuaaccuguggaacgaucauagguuaaacauguuaccagaaacuugcaagguuuccauuuguaaaaccuuugucuuacacucauccacaucucuguuugcuauaguguucguaucugucaggugggaaaacacuugguaauuuccaucuucccuuuuuaaaugugcuucagugaagcucucugaagacaugucuugaugaguuaucagugaugaaacugcugagccaaauagcaugcaugguuucauuuucagagaguguccuauuguuccagacagauuaaagcagcugauuucccuucugucugucacagaagcacuggcuccccuggccccagccucggcuaguagcagcaauuguuucucauuaauuuaauagauggaaaauagauucucauuugguugugagaaucuuuucauuuuuuuuucuuuauaacuuaaaucgguucacaaguguucacaagguuuacacauuauuuuuaguucuugaaauaugcuaguguucuuggaauugauaaaacgugugaaucacuauggaaauauauaauauguguuuagccgguuguucuaugucgugggaguugaguuaaccacaauugaguccaaaaagaacucuggucucugucacuggaucagacucaacaucugguggggagagugucagugacugcagggacagcuguuucccuguccccucagucuucccuuagagaacaugcugauuguuugagcaaccuuggugugcucagaacuugacucucugacaaguucaucuccaaccucaucgucugcuaggaaggcuugagacaugagaucucaagaagguguucucuguggucucuuuauuuggguuuguucuguuucagaguguacuggggaugcaguauggccuauggccucuggaguacucuuuucuuagaaacuccugaaggggaagcaacugagaugauuugauuccauagguguagggaaggcaggcucugguccaccagugugcaauccugucuccuccacucgcagcugucagcccaaguccuuccugaacagauagaaguggccaccauaauucaggaaugccugguguuccuuuauccuucauggucucuguuuccuugcuuuuuucucuauugcacauacacuucuggucuuggucuucacucuggcccaucucaaacaccagaguauguucaucaaaaaacucuuagugagaccuugaaagcagaugguccccugagcuagcaagagugacaagacucacuguucuguuggggcaggguggggggcgggguuccgccuuuauagauagauaccuuccagccccgcagcccuacagaguccuguggcagucacuuucaggaguugcuuaggcuugucacuuaaacucugcacacacguguguaggucagaagauaagagggcagucuucaguaugccgugucucucccuccaccauuaagauccuagaaauggauuucagaucaacaggcacucuacccacugauccauaugaccagccgccccucucccuuuucuguggacacauaauacugaauaaagguagauugaguaaaagaacuugagaagcaaaaggguuuuaagauguaguaacuauguacauacuucuuaggugaagcaucucuaugacucaaacacccucugguuacuuuaacuaggggcagaaucaaguaaaagaugcuuuaagacauuuuguacagcuagccaaguaggauuugaguuguacaguaaagacuuagucauccauggcuaguaaguaauguugacaaucugaauuuuuaacuauuucaagaacuaagaucuaauuguuuuaagugaucuaaccaaagccagguuaaugaauuuuuguccagacuguuugcuuuaaugaaugaauaagcacuaguggcaaugguugcuagacaaacagaacuuuaaaauaucucuguaacauccuuccaaauguucuagguuaaauguugguccuugggucaacccugggcaucuggccuguggccugcuaugucuuggcaagagcucagagcuauaguuuccguccuccguugugucuuagaagguguaugcuauuuuaaguucucaacauugcccugauguucuuuuacauuuauuuauauugcuccgugucuaccguggcaccagcucugugaggcgugcagacgcuccaucagcgggggugugucugugugugugugugugugugugaugaaauuuaccaacugugaagcuagagcagagguuacuagacacuuuccucagcucacuaaauaacugcggucuaucuagcuuuucguuaggugcugugagggauggacacuaagguuuaggauagccugccuuccuguaaggaagcauaguugcgguggagaugaugcuacccagaagaguggguaguguggucucccaggugaaccagcucuuguuuggaaucaaucgugaaggagauaaagguguuaaauacagccguuggcucugaccaauguugcuuuuuaauacuuuaaaaguuuucauuguuaauagagaaaagcuggacuugaacucuucccgcgcauucauuuguaacugaaagcaauuauguuuccauuagaacuuuuaaaugucugcauuugugagaaaucugugcuaacuaaucuuagccuugaccuauugggaaaccgagagacuguauuaguuuuugauugcugccagaacaaauaaccacacuuuaguggcugaaaacagcauagauuaucuugcggcuggguggggcagcugucucuagauuacaggcacacgcugguguacugcacugcuuucgaaggacaauaggggcgaagguuuccugcuuauucagguuucgggugguuuccuuaaaguugcagagugauccuauuuucugcuggauguaacagaaaggcaaggcuguucccagccucuaaaggcauccacauuccaugauucacgacccccuucaagcucuuuccucaaagccaugacaccagagcuuucuaacccacuucucugagcccauguggcuggacugaguccaccuagauaauccacgaccgugucacaucuauuucaggcuuccugcccuucaucauaucugcaacgugcuuuuugccaugugaggucacggaccagcaggucccugggaagauaaacguggcucagagccuucauuuucucuuaugucaucuuuguuacugagugaacaaauagacucuauuuagguuacaggaaaacuugucaugggagugugaaaacccauauaguguuucugacaggugauguuuguuuguuuuaauauagacuaguaaagaauuugggaaugaguuuugaaagcagaauaagguugauagccuuuuagcugggaggaaaaaggguaaaggcagggacuggugagccagaggguaaaaagguuaagggguggggaaggguaggucauaggguaaagguuaagggucaaauuuuucuacuucuuugcucuccucauucacaucuuuccccugcacaugagaaacauccuccaagcuucagggccacaucaucuaggaagccucccuuaaucuucuccaucagacacccagagugcuuugcuccuggcuacaucuugucuuaguuaauugcuucauugcuucucuucccaauuaacuucuaaguugaggagugagacauuccucgcugcuccaccccauauuauuuacccauaaauaauggccccacccaaugaacgcagggguugauucagaagcaaauuagaauggagucagagcauggggcacccaugccagcacguaguuuccagggacaauauuuguucaguaaauauuugcugaagaguacggggaguguggcucgucugaaagcacagggccgugccaggaagacuagcagcuguucuacagagcaugggcugugguggagcugcagcaagccaggcagacgcaucgucccuggcaugacuaggugcagagaaacacucguggggccuguggaggcagggccguggggaggcaggcuggguagugaugguuagcaugggagagcucgguguagaaagauuuagaauauggugguaucaugaccuaagagaggaggcugcuaagugcagggacaucuaucuugagauaagacuuacauguuugguuugagaaagaaguguuaucucacaccaugagaaaggauuuaagcucugaguguuuaagaaagaaggagaagguggugcaagugagggaaggagccgaggcuggaauugcauaaguggaauuacagcaguugggcuccugagcuguaaggaugaagaacaucugugcggagacggagacagcccggggaggcuccggagacaggaguguggaauugaagcucugcuugucaguagcggugauuccacucugucacgagucuuugugaucagccacagagcugcgagaagcaaggucuuucuagaucuuuccuugcgaucgugucuuccugggaucguuguucauuuagaauugugcagcccagaaacagucucgucuguucucaucgauuuuuuuuuuuuuuuucuaaugagagugggagcuaguggccuuuggugguucaugucguuccucgggacacaucugcaguagaggaagagggucaauauguaugcugcagugucuggugacuggauuucugaagaguuguugguggccagaagugcuggauccuaauuagaacaggcuuuccuuuccugggaacugguucuguggcuuuaagaacuccuaguccugcgggguaaugacuuguggugcaagggaggguguccacuggccggugacagcugggugagauguuucaagcaagcuggggccuguucuaugcuggagcugcagcuugccugaggcuugagguccccuaaacuuugggagugggcuuaaguaaggcuauaaaucacauuuugacuuuuacugcaguggaaauggaugccugaagccaggugugggauucggucugaaaucccaacaggcaggcugagguaggaagaugauggugacuuccagaccagcaugagccauuuucugagacucccaucuuaaggaaaauaaaaccaacaagaggaugcccaucuuuggguuucaucugacuuauaaaauacuagcaugggaagaaucaaagaaauauagaaacaaaaaacaaaagcaacaacaaaacaaaaaaagaaauauagcaaaggaaaacauaaauauaucaguuuauacagauaaauuuauuaucuaaaauaauaauauauuguaagaauuuaucuaccuuaaucucuauuuuuuucuaacuuuccuucauucauuuguccacccacugggcauacucccugcauagagcacuaggcuuggguggaugugggcaguuaggcgugaaagcccagccccagcccugagguuuccaguccagcugcugguuagagaucugcuaaugauuaagauaagggagaaaaaaagcaacuggguuuuauaugcaaguaaggaagaaucacauucucagaacgagugguaggaggaaacuaagccuucuagaaguuggucuaggcuccgaguaggaccagaaggcucagugccuucacuuuagggaaguggcaggcuucguuguaaauaguaagccuacagaagucaguggcacacacagaaagcuugaauuguggacuggacacuguuggucaggaaauaaauaccacagcaggaaaguugaaucuguagacacucugcuaggauagagaggucauccaggcuaaagggacaguccgagccaagggaggagucacagucacuagugcauugaaaguugcaagcccugcagcuugguuggugaggucuggguugacaagggugagauuugaagguauagcccaccugugcauugugucaggaaauaacauccuuagugcuuccuagaagggcagugagggguagacaugugaagguguuguauugagguucgguauuugacaagaauaccaauuagaaaacuggccuuugcugaccgagagaacauagcauguccaguggaggggaggaacgcagaaguugguucuuggugacucaguguggggugggauguccucagcccaguggagaacacaggagggagggagaccucuuuggauccauuguuuugaggacugcugagucaaagaugcccaucagggaguuggguauucagauacaaaaggaauuguaauuaaaagcagaaguggccuaggaagaugucugggugguuaauagcaccggcucuucuagaggagcuggguucaauucccacauggcagcucacagcugucuaaacugcagucucagggaauccaaugcucucugcuggccuucuccaggaccagggaugcaugugguacgaacauacaugcaggcagaacagccauauauaugcauaagauaaaggaacaacagcaacaacaaagcaaaacagcguuuaagauuccaaagcaaacaguuuugcagugucugcagaaaguguugaugugguguagcuggagccuaagggaagagaggagagugaaaguccaggccacacaacacucaggaugauguguuagucaaauuugggauuuguuuacagauauuauuuuccccugcauacuuuauuguuugaaugaaauaugaaaauauuggcccaugacaagcccaauaguaaacucagaaggacuuguaguggguucgucugugccuaccguaagcccuaaugagcgcuugccuccuccucagcugcuccgaggacuccggccagugcuccugccugccccacaugauugggcggcaguguaacgagguggaguccgguuacuacuucaccacccuggaccacuacaucuacgaagccgaggaagccaaucuggggccuguaaguaggggagcuuccgacagcuugguggagcagcacuuuggggguagggggggagggcaggcugucaggggauacaagugcuucauaaagaugucacuuaaguauucuuuuagaucuugucagcacggaaauaagggugaagacaugcugugguauuuaaaugugaguugaucuggaauacacagggagacuuuggagaguucucuaauaaggcuuuugguuggugugucuauaagaauaagaauuuucuauucuucucuguauuugugcuccagaguaauuguagaucugacauccuuuagacccagauauacuuugcuuaccaccccaaacuuuacugauguuaauguaugccugguccuuacgcuuaacugaagcuuaaccgaagcacagcugccguggagacuuuuucccacgugacauguugaccugaucauccucacagcauaacuucugacuugcaauaaggaagaaagaaacugccagaacucuuaaaguccuaggcugccauccccugauacucuguagucaccaguuccugggcauguucacagagagugccucuuggugaggacuuggugguggccaauaacugugaauauucuaccagaguggacuuaucauuaauuagggaggacucaccagcauaucacacugcuuuuguguacuuggcaagagggaggaggagaaagaagggacugcccaggacacugcacuagaugcuggaguaucuuaccacuuccagacaugcucagaagccaaugcgguuuuuuuccccuuuguuuagccacugguaugucauggaagguacaucccagacuuucggcuuccaucuccaauguuccgagaugacuccaacaacaaauguaaaagcaaaccaauuacuuguguuuucgagaggaaagaguaacaaaccuaaagacuuacuaucuucagggaguuugcagcuaggagacagaaaugguuuugaaucuuuggacuuuggcugugagguguaggugaauuccauuucguacaaagaauaacuaguguccucuuguccccccagggagucauugugguggaaaggcaguacauucaggaccgcauuccuuccuggacaggaccuggguucguccgggugccugaaggggcuuauuuggaguuuuucauugacaacauaccguauuccauggaguaugaaauccugauucgcuaugagccacaggugaagaaagccaucaauaugcaucaugguggaagggggggggggguucaagggauuguaacuagaaaaacacuacucccaauagcuucuagaacauucugugaagacaaguuugcauugaaauagauaacagccacuguuuucucuaaccuccuccaugcaacuuuuugaauccagcuucuuauucagcagucuccuguuaggccccuaaccuggcugaguuacggagguaaugaugcuguaucaaaagcuuuccucccccugaacaucgcugcccaaugacuguucccccuaguguaguaaaaggccaaaagugacauuauaacagaaaaaaguggcacugggagagucauguacagggcacggagccagagcuucuagaauauucccuaaagacccagaugcagggcaggagugggaauucccagaucuaggcuuauuaugaugagugggaauuuuuguuaacugguuuuuguuuaguuuuguguuuuucuuuagggacagggucuugcuuuguaucugaggcuaaccuugaacucaaauccugccucauucucuugagugccgggauuagagauguauacgaagcgcaauagccccuaaggagaguuuugaucaacugauccaaagggaagaaaggagaugugaagagggguuugcugagaaucacucuuagugccagauacaggaaauggccagagcugcucuuggagaaaggaccagggucagaaaaggcugucuugagcaggaggugguccuuccgugagccuuaccgggaggaagcagguguuagucgggucugcagcuggguaguaacagaggaagcguuagggauggaaagcaaacugucugcuuucuaaugacucagucacuguggagagguccucccaguuggacugaccacagugggcucgcacagauacuccuuuugauucuuuguuuccuguucuagcugccggaccacugggagaaagcugucaucacuguacagcggccggggaagauuccagccagcagccgaugugguaacaccguucccgaugaugacaaccaggugguguccuugucaccgggcucaaggucagucgauggggucuuagagacugagucacuggcuauggaaggcccucuguuggacgaucaccauaagcucuuguuuuuucuuccuguugcuauucuugggagcuuaaacuuugcuuuuuuuuuucuuguguuucucccuugucugggggcagauacguuguccucccucgccccgugugcuuugagaagggaaugaacuacacggugagguuggagcugccccaguauacggcaucgggcagugacguggagagcccuuacacguucaucgacucggugaguaccaggcuccugucagucagagccuaguagaaaguaccgagcugccaccccaguauuguguggagggacagagcugggcagggaggcagaaugggcccucucugccucuagagcuucuuugucaauagcaauagggugaaaguucagaucccauuuccuggugaaaauccuugcccagaacccaccaguccuugaaugugaaaaccuaccaauuccugagcauaaaaguccuaccaauccucaccguggaaaucucuuccccccaaaucccuauauaagccugucuccuaccccguuaccugcugcuucuccccauagcagaggcagccaccuuuuggcucccuuuccuucagaguugugaacagcuuccucuggguagccuuucccucucagagcuagaacacuuacaauaggguucuacuuuucuggguagguuguguucaaaccacuuccccacagauccgugaaccucuucagcaacaguuguuucaaauccccccaagcaguaugaaaucugucucaauauuuucuggacagaguauguaugacugggaaggguucucuaagucaggagugucauuagcuucucuucccagcgcagaaggcuguuguaugguuuuggcaugggcacauccaugggaucauuguguuauucucauucacucguagcuuguucucaugcccuacuguaaaucgcuggacaucuucacuguuggcggcucaggcgauggggaggucaccaauagugccugggaaaccuuccagcgcuacaggugucuggagaacagcaggagugugguaaaaacacccaugacagaugucugcagaaacauuaucuucagcauuucugccuugauucaccagacgggccuugguagguauugcuugagccacugcagaggcuacaguuagaguguaguuacagagccaguguuucugacaccaggagguacagugagugggguacaaaccuguacuuccugcgaggcagcuugaggacaugagaucuuaaccaaguuugccuuuauuauuauaaauguuuuaguuggccuuuuaaucucaguacccaagacagaggcaggcagauaucugugaguuugaaaccagccugggucugcauaacaaguuccauccaggacuuuauaguagauagaacuuuguugugaaaaauaaaacaacauggaauccucauuaaagaaauucacaaagaggggaccgugaugugguuuagcauacacgcuguucuuguagaggucccaaguuccguucccagcacccacaccgggucgcucacagucgccuguaacuccauuucccaggcauccagcagcccugccuccaugggcccuaaacucaugguguucuuagccauaccaacauacacauaauuaaaaauaauaaaucuuaaguguacacgugagagguguuggguuuuauagaaagauaggagggaaggaauauguuuaguguagguacuguaagguguuggggaagagggugccucugcgguccgugcgaaggcaucccuucccccugagggaucagccacgggauggcauagaauagaauagaguuuauucagggaaugggaaaggggaguugaggugguagagacagagaaaggcagagagaguagaggaguagaggcuggccaugagugcguggggaaggggggaagggaauggagagagaaggggagcuggagcaagaggucagagcgagagagcaagagagagagaggagggggcgagcagccucuuuuacagugaaucaggcacaccuugcuguugccagguaacuguggggcgaagccuagacuaaaugccaacaagagguaacuagacacacuguaugaggauguagccugucuguaggcugugaacauugaggacugagaguccgggaagcaucagcuaauggaaaguuuucucuaggaaagaucagaccagcuucaaaggucacaggaguuuaaugucaucagagaguugaguucuggagcuaaggggagaaaacuguaaugacuuccugccuagaaaagcgcuuugaucugccagggcagcugguugguucucucccagucagcacaggggugauguguuuaaaccgaacuuuucugagccagaguagggaaagggucagggcguguugagggagagacagggccaguugcaaggaggugcgauguucugcuccugcagucagccuaacugcucucuucccugcagcuugugaaugugacccccagggaucucugaguucugugugugaccccaaugguggccagugccagugccguccuaaugugguuggaagaaccugcaacaggugugccccgggcaccuuuggcuuuggccccaacggaugcaaacguagguguuaucggagacuuuguaaugaauuccugugaugguccccggggggggggggggggggggauucccuggcuuucaaaagcagaauucugcuccgaaccggauggcaugagcccugaggcacagugaauguggcugggcacaggugacggcacgucugucuagcuaaugaguuuuuguuugcuuugucugcagcuugugacugccaucugcaagggucugccagugccuucugcgaugcgaucacuggccagugccacuguuuccagggcaucuaugcucggcagugugaccgaugucucccuggguauuggggcuuucccagcugccagcccugccaguguaauggucaugcucuagacugugacacagugacaggggagugucugagcugucaggacuacaccacgggccacaacugcgaaagguaugugggcaccaccucgggaaagucaagauaauagaguaggcauguugacucgugggacagaggcaagaguaucgggaguuugaggcuauccuaagcuacauaauaaggacuugucucagaaagagaaaaaaaaaagagagaaugacaucaucuuuggcgaaguaaacauuauccuagaaaccacagaauuaaucuccugaagacuccaaauagcgcuuucauuuuugacuaccccagcauuuucuaaaagcuuacucauuuauccaguacguaugugcauaccuggcugugccaagcucugcuuuggugcuagagauucagcaaagcacagccaccuacagucugcccuuugggaguugcccugcaauccagccuuggacccaggaaacccccacacuggugcuuucuggcuuggaugagaguuaagaaaucuucuugucuaguucggguuaaagcagaacccucauccaaguuggacuagucacuuuaaaaauggcuuuguuauugaaaacauuguaugcacccaguuuccuggagacauaaaaugugcaaaguaacgcaggucuccuguuggcaaauguuaauuuaauaguuaccauggauacaaaacaccacccuagguggauuuuaagacaaggacguggggugugccuucagugaugcaagcgguuucucucaguucauuuguaacgugugaaagugcgugcugccuuacauuguccguuacagacugagaaagacuuauucuagggccugcuuuaugggguaagaguuauuauacugcccaaaauaaagauaaauaaauacccucucccucaaaaaacuggaugugauaucguauugguuagaguuuugaaagcuacuaauauccaucuucucugcccagguuuggaacucaggggucacaucuguaaagagcauuccuagcagcuguguuggguaaaagcuagauagcagcauggcuuaaaccuguggccaugagcuugcuaacauagugugucuccucuacuucccucauuuaucauacucaugaacaggcuaaggagaauaagccauguaaacagaaaccgauguccuuaaggcaaagagaacguaaagucagaggcccagggcagguaggcaggcuguagcacagugagguccacguggaaaguuacuuucugagggacagucaaggagagcgucacacuaauucagaggugucacccuaaaugcauggacuugcaagcaucucccacagaagccaacaucagcaucaccaggaaucuugcuagucagaagauuugguagaggaacccagcaaaccuauugaaacaagucuuuugugggauucuaacuaaaaguuaagaauggugguuguucaugaagaaucacguccuccagcagaagagaguuucugagccuuuucuuaugacugggccauggcucauuguguccuacacccauggcaggugccuggcuggcuacuacggugaucccaucauugggucaggagaccacugucgcccuugcccuuguccugaugguccugacaguggacgacaguuugccaggagcuguuaucaagaccccgucacucuccagcuugcguguguuugugauccuggguacauugguaagucaugcacuuaagaagcaaagaggcaggagacgaugugucucugaguucacuguuaggaaaagaugaagagcaaaccaguuaaauucacauaaaacuuaagggacucacgacgaucuugcccuuuaccugguagcacgugggggcagagucgguccuuagauauagaagauaauggaguuaaagcaacaggaucaccagcauuugagcgcaugauucuccuuaggaauaauuucucacuuuuaaauacaaguaaaauuaauuuccuuuuaaauuuuuucuucuuauaaccugaccucuagcaaaugucugggagcuacgagguggcccugcgcuaggcuaaagaaaagaccauauggacaauugccaagaacaggaagggucauagcugagcacauccugccauguauacucaguuaucugcuaauagucagugaagucagccauuugugugugcgcgugcgugcaugcguguguguguguguguguguguguguguguggugugcgcgugucugugggggugggugggagugggaggguccuuuauucuagccaugaagccgcugaucgacugcuagauuggcuaugcacagcccgagaaauacuucaugcauguaugugauuuuaggguuucuuaggaaacuggcucagcccugaggagcucaguuuccuggcuguucccaaaggauucuuccguuugugucuaacgcuuggguuaggguucuaacacccaauuacacauacaugaucacaucucuguuuagcuccuagccuacuccacccaauaugacuagaagcuaagggucucccacccauugggcugcagccucuaaggcuaccauagcagugucggggagcacagaacacuuuucccucacagcgagaagcugucccuccucacugagaucacagacacgggacuuaaaggagugagucaguccuugguugccccaggacugaaaugcagcggacuaucugaacauuuugcuugguuuuaucuucccuuaggcuccagaugugaugacugugccucuggauuuuuuggcaaucccucagacuuuggggguucaugucaaccaugucagugccaccacaacauugacacuaccgauccagaagccugugacaaggagacgggacgaugccucaagugccuguaccacacagaaggggaccauugccagcucugccaguauggguacuacggcgaugcucuucggcaagacuguagaaguaagacgcacacuacggcgguucucaccccacccccacccccacccccuccuccucuuaucaggauuuuguuguuggagugcuuauuucacagggagaagcccuuguucagugaggcaaaaugacacauucaacagaugaaagaugagacugaauuuuuuuuuuuuaaucucuaaauccucauucucugagcaagacaagucucaagauguggcucugugccaggggaaauuguggcugucaucaagauaaaugccaggcaauagagggcauggagauguguucuucccacgugcuugccaacugggggguucuuagagaccuggauucccacuguggguggcuucgccucucuggugucauugguggaauccagccucucuccucaggcagagacagaaauaacaaugguaaaagcuuucuuccagaccuuauuaccucugucuuaucaggagaucagccaagcuuucuggcugcgaagcccauaggccucugcuuuuauuuauaaacauguggaauguuggggacucgcaggacuggauuccuuaaagucuuuuuagcugauagaguuucuggcuccugcuucugacauaaggcugugcuugcuuccugcuaggaguuuaaaaaucacuggaugucucaguuugcauuggugcguuuuuuuuauaauuuccaguuaaauuuugaaauuuugaaaugacucccauuugagucugugugucaugaaaacacacaagcaagcaaagucggccauagcuugugcgaacauguccccuguccgggaagcgccagaugcacaguguguaucaugagaacuucuaaaggaugguaauuuuaguguuuuuacuuccauuuuuuucuugcacgucaacauugagauuuagggaaggaaaggucuuggcuguuuagauggcgcuaacuucugcgugcuguguauccgugaugugaccagacuugaauaugaugauguuguucuauuucagagugugucugcaauuaccugggcacggugaaggaacauuguaauggcucugacugccacugugacaaagccacuggucagugcucgugccuucccaaugugaucgggcagaacugugaccggugugcgcccaacaccuggcagcuggcuagcgggacuggcugcgggcccugcaauugcaaugcugcgcauuccuuugggccauccugcaacgaggugaggggcuguggccaggggaugccucugagaggcucagguacagcuagcccaucuggugacugucccauuuggaggaaggccagaguguagacuggcuguuaguccuugcuuguccuucuuggcugaggcaauauguugugcacagaacccucauuuaacccauucauagcauuucaguacaguguccagccauggaugcagacucaaaugucauuuuuuucccuuuucugacccucaaaucaaauagcucuuauagucgcucagcucggaagaaacuacauagccgccgggcgugguggcgcacgccuuuaaucccagcacuugggaggcagagacaggcggauuucugagucugaggccagccuggucuacaaagugaguuccaggacagccagggcuauacagagaaacccugucccgaaaccaccucccccacccccacccucccccccaaaaaaauuacauagccauuuucaggauugcugacccaggcuaacgugccagagugagauaagccagggguggucuaggauugaugucaaucucugaaacuaagguugaagaugcagagaugcuacugugccagagacuauuccaagccccuuguaagagaacagcuaggaggugcugguguggcacccucccccgucuacaucacaggcgcccagguuccacgucugccauguaacuggguuggggcaaguuacagcuggcuucuccacggagaccaccugacaggucuguguuuggacugcaguucacagggcagugccagugcaugccgggcuuuggaggccgaaccugcagcgagugccaggagcucuucuggggagacccugauguggaaugccgaggugaggccaggcuccaugcugaugcuuugguugggugggccuuagguccacagggcuuuggguagacucuauaaaguguagucaaaaugacaucacacauucaugcuuuuuuuuugagggguguggccagaacuuuuaaucuagccuuguggauaaaugugucuacuaaacagaggaugugcucaauucuucagccucacaccaagcaggcauuugucuuggcacacaaacaggcagggacaugugcacauccucuaguguacacagacacuuuuuguuuguuuguuuguuuguuuguuuuugagauaggguuucucuguguagcccuggcuguccuggagcccacuuuguagaccaggcuggccucaaacucagaaauccgccugccucugccucccaagugcugggaaacagacacuuuuuauagucauugucagcaaaguggagcuauguggucaugccagccaauugauuuguuucuuucucugaacuauguacugugggcggcuuccuuggucauacauguacagauacggucauacauguacagauacgguuccucguuaaguucagccuguuacacaacucaagcagacucugacaacagggugcuaauacaguguucacuccagagacuuggggugggggugugauacagagccuugggugaaguggauauggcugggguuccaagucuuaauuuuugaugcaauuuaaacccagauucucauuuaggcugauagaaaggggacuuuuuguaauauuucugcugggugugccuguaaaugcuaacacauaggagucugaaguaggaaaggcagaaguucugggccaggcuggucaacauagcaagaaccuaucuuaaaaagcaaaagcaaacaagcagcccaacuacuaaaccccaugaguuauaagaauugcuuaauuuuuauacugauaccgucacuuucaccaggcaauugauuuuauaagcugcuuaaacuaucucccauccaucucgcccuuuuucuucccuauuuuuaagcauaucuuuggguaaauauuuccuaugguuccuuacauucuccuugguauguuuuucuucuagguccuuguuuaacucaaaauauaagaauagccuuuuccucucuuggcuacaauaacaagaaauaagaggucuccagucugucgcuagcucguucagcagccgacaggagcuggagccuuagcagcaggagagggaaaugguggcugggaccugaacaaauuaaauugcuucugcuuuugauuuuuuucagugaggcuuugcagaggguuugaauggacaucuuaggucacagucuguuucacacaggaaugauguauugcacccaucgauaagugcauuuccugugauaggucuuuaauccagaugugguuuccugggaagguucgacuuuccacuuccauuagcagggccugaaaguuguaggaccagccacucuaaccugcccagccaccuguucccuguguauuuccuuuuccccuuuaagauaaccagacucauaaacuagaaaggucauuaugcugggguggucccaguggcugcagugcaccaggaaggcaaacaaauggagugacccauggcagagagugggcuuauggggccagcugccugauuucaauucaugcggagccuccacaucaggagaagagaguccuggcucuuuugccugcaugcaccucucucaauaugguuuucaucuuucuucuucucuaguucugcauggauauacacaucuuauacauguauaguuuucaauauaauacacauagaguuugcuucuacaaguuuaaucucagaucuuuccacaauuucacccugagauucccaccccuucagcccaacacuaaaaaguuuucaaagacugauaggaccugaauguagagauucuaucucuccuugcuuccuccuaaaccaucccaucauuccacccucuuuuucagacguuuccugaaguauuaagguguaggguaaaaguccuugaucugccugucuacauuuggcaguuugguuauaaaaugucacacuuucuugaacauuaaggucuauacggucuugaacauuaagguuucuccucagucucugagacuagacagggaaggggaaggggguuagaaauuuguagaagggagaacuuagcuugaccaccgugauggcuuggcugcugcuaguacuugguguccgggagcugaaaaucguguucuaaagagcauaggccccauucaggcaggccuuuaaacaagagucuauuaggcccccaaugcuguugagacucugugaaaaaugcucagacuuuacaaagcccccaaagagaagacuggaaaguguaggguugggaaagggauucaucgcuagcccuggggcuauguguggccuggguguugacaaggcugaggacagggacugcuacagaauaagacauagcucaggguucuguuuguacuggaauguuugacaauaggaggaccccagagggcagcaaggacaagaagugcccccgggaguuaaaaaccacacucuucugguugaaucgccagauauauuuucaguugaaauguuuguuggagggcacaaauacagacuuucugcugccaagaaacagugugcuuauagaaagacuaaggucauaaccaaguagucuccuuaugggaaagaaauguaguuaugugaaagacaaaugcucggagcuuccagcguacaaacgguugaauguugcaauuguccaggcagcguggggcucuuggccuauugugccaagucugaacaagcccaccacugugcugggauggaaagucucauauagccagugcugaacgagcugguucagucuacggccugaagcuuuguuccgugcccugcagggguuggggucacaggaggaaucuuucuguccauucauugauggcagagggaagaccgcagugccuguguagggccacaggcucccugaaaggucaauggcuuucugcuuggcagaagugcaaugucaaggcguaggugagggcuugggguggugggcugggggacucuguaccucagcacuugccucccauaugggaggacccauuucucaacaccacacgaaagagagggggggggaggggggagagaggagagaagaaaggaaggaagaaaggaagggaaaggaaagaaaugccauacguuccuugccuccauauucaucuuuagaaugcccacauucuuuucuugggguugacauuucuuccacaauggcuccccuuccugcuccaucugcucuuuugagauaagaauucauguaggccaggcuggccucgaacuccuuacccucaaguuuugacuucccaaguacuagaguuacaggcguacacugucaagcccagccaguugucuuuuuacuguuauuuccauugugacucaggaaaucagacuacauuggagcuuuuagagaacucugacuuuaguuaacaaaaaguccuauauaauccuaauaacauuaauaaaguuuuacccuugacaaaauaagccaguuuaagccgaauuaaaaguauaaaagcagguuuauugggggcagcucuugggcgagcucacuggucucagaaaaugaggccaggaaaauuaccaugcagacuggagagaaagacacagagacagcacgguagagaagaggggguugggguaucuggaguagcaggaggggccuuuuauccacagcacacacaucuggcacaccaagaggccauggaugacaugagcaguugcuaggucccugagggcaggccaguggaguugguuguauacugaaaagguuagguguccuguggaaccuaacaggcaugugacccacagagugugagcuuuguauucaucuccugauagguugucuauggugccuuugauguuccagugcccgucucgauaguugggacaggcaggacccagcaaagccuagcguguggacucuccaucuccacuuaaaagcucguggagcagaggcaggaugggggccgaauccacuguccuucagcuuucguuacagaacugaacuuuuauugccaaggccgacaacaggaagggacaggaaugucagaaaaauguaagcugcaucuaagaggaugaacguauuaagauucccuuccuaucaaagcagcuuuuaauauugggggcugcuauggcacacauaaagugaaugaaaaaaggaaauaaaaaggaaagcacgcaaaugcaccgaggugugguggaggaggaaguucauuuuagauaaaagggagcgaggaggcagagacaucuagaagaguccauuguggucgugacccugagccaugcagggaaaggcagggaagaaaagagagagggaaaccagguuuggcagcuaggaggccaaagguaccaaaagggcagaucaccaagauggcuggguuguacggggaagagccugugggggaaaggcagcagaaaguggggugugccagccauauccugugacaguaagaacugagggaugcuggaagaaccuggaggccagguccccugugguaugccacaugggcaccucagccauuugucccagauuugaaccuaauaacaaggaggucaguggacggcuuagaggagucuguucaguccuucguucaugcgacuucuggcuauuaaacuuguggucagcucuguauuccuguccuuuagugagauaggaguuuucaugcaaacucuuugcaagcaagccuuuggccuuguggcaugggcugggccaugguaggaaguuggagccacagguaacccacgaccucauuuucacauugcaucauuucuguguucaaaaccagaguucaguuuccaagcacgaaggugaacaacagucuuauuaggugugcagucgaaagugaguaggcgagaccugaugguauacacuuggaggcaaagacaugaggcugaggaacucaagaccacucuucacuacauaaugaguuuagacuaacugggcuccaugagaccuuaucucaaaggcacuucuuccuaaaccagaagcacuuaauggguuauuuggggaaaacggggcauguaaauuuucagagagucuuuuuaguacugaucacuucuuagguauauacauagucuuaauuuuauggaugacaacaaauaaccugugcagaugaauguagccuccucaucacugcugacagaugucaggcucagaggguacguagcuugcccagagccgugccucugaggagagcggaacuagggcccuugcucuugccucgugccugguguuccuguuggcagcuggcaaugaaagagagaaaaugacuguccucaccagagggcaggaacaccagccaggucauaguaugccaggagaaggacccuaggagacaauuuuagcuugagucaugaggagguucaguuuucccagauacugagaagucuuaaugccaaguuggugaggguggccucuguauagugggcaggggagacccagaggaaaggggacgcugugaggaagcaagaaccucacauguaugucuagcaacggccauguaggugaauucccauugugagcgcagugggcuaggguuuucucuggguuucaaagguacugaaguugaggcaauauuguuuguaaauuuacagaaaaauuuaaaaaucagaauaaaaaaaaacccuuagugauagaacaaaaacauauuuagaaauaauaagagaguuggguuuuuguuguuaaugguauuuacuaguuuuuaauacauacaugauuaacacuuuuugcauuuuuuaauaauggccaguuggguuacacgcacacacacauacacacacacaccucaaauguaagacagauuacauccuuugggcugggcagguuuuauucccggaacauugagaccuuagccauggcagcagcuaccacgucauccagggccauccaccacacguucuuuuggcacauucucagcagcuuagucuuucucccugugauagcagagaaugcugcgguaguaguugccagcuuauacauguucucagcagagaacaugugagagaacaugucaucuaaaacguguagcaaaaucuguggaaagcaaaaacugcuagaugacauuccuucucauggugcaaaacgauccuuguuuugugggcugugugagcaucucucacuucuucaguagugacagaucugcaguggaucugcuuccagugaaggugugcaucuguguuuccucuguggccccgccccuugucaaaggagauauagcuguuaacugguuauggacaaagucagcauggcugaaauagcuacagacagcagauaccugugcaguuuaaauucuucucccgucaagacugugggccacuguaguucuaaaugugucuuaacacuguuuaaucccguacgcaguacuacacaagcguaagcaaucgacagaguuauuuuaggagucagacuuaaagagcagucauuugagcaauagcagauccuaccuagaagugcagaccucauccgcugucugccacuuagaggaccaugucugcauguuccucaaauaggcuuuugugguuugcuuguuuuuaagagcagccaggucagauguauaaugggugagacccccugugacuaguugacaugauacagccuaucuuucaugcgucaucaccuuccaugaauccaccuucaggucucuuuacaucauucauccuaucuggaugaaagguugcccucuccgguguccaguuugucauaacguuuuauguacucuuugggguagacacaagugugugcaugcauguggaaaggggcaaccuucacugcccucucucgggcacugucuaccuuguuuuuugagacaggauuucucauugaccuggagcucaccaucagucucuaggugcugccauuucugccuccacgggcugaguuauagccucugccaucacucugaacuuuuuuuuagggaccaaaaguuggacccucauguuuaugcagcaaguacuuuaccuaauacacuuucucucugccacccuggagcacuucuuaagccucuacagaguaucacaccucugugugguguguauggauucugugugguuuccuuuuaaaggcccuugaagguauccagacagggguaaaacucagauaaucugaaauuuaucuuacaggugauccguuagcauguuucauaugguccccccaacauccuacaugguguagucuuuucaugaaaauucaaagaggcagcauguauucuuucuacauacaggaauagagaugucccaugugcaucuuuagcuguguugggaaaugccaaccaauuucucucuaagggccgguaguugaacuccauuuacuaggagaucagucaacuguucagaaacaagaauucuuaaugaaacuagagccugaaaugucaacuguuugaauauagccaucauuuagugcauauuugguggugucucuggcaguuccucucuuuguuacuuaguuuuggacaucugagaaauacccguaacacucuuaugugugccucuggccugggcugugacuuauuuaccaucagcaaaggacuuucccagaugauaugcauccuugaugagaaguuggauuucuuguagacuaggggaugaugguagucaucuguucauuggucucuuccucucuacucaagacuuuugauucuguaauuuaaacauuuucuuuaccugcucagaauuaaaggcucuaacuacuuuuuuuucaguagaaacuuucuguuguagcagcugcacugucaccagcccauccaaaggccaccauucauauggcuccuuuaacacgaggucauuuugcuucuuguguuuuguuuuacaguuccaggucguuuugagcuugggagacaacugcauguuaccaagugaaauaaacuuguucuuaaaccuuaacagcaccagcucucuagccacagugucaucugagcucuuccuguucacuugaaaagcugacagagacuuggccaggccuuucccugauuucucugaguugucacuacacauuccccuacagucucccacugugaaaaugauguaaagugaagcuuggccuuugcaguccucugugacuuuaacaagcugcuugccacccccacccccgggguggccuggcuggccuggaacucagcuaucugucggcugggauuaaagggcuguacccauuacgcuuggcugaaaucgcuucuucaucuuccgagggaagagaagcucacagagugacuccggcaugagaugcuuuuuugaggaacagagaacaaaugguccacagaucauucacagcuucagugacuucuggcuugauaagucauugcccuccaaaaacaguaacaacaaaaaaguucuugcuagaaaaguugugacuggggguuguugguuuaauuuugaaauccuaaaguuucguucugaaacauggacacacccaggaaaagugcguuucacaguccugacgguuacuagaaugagcuaaacuuuaaauuuugaacaaguuauuacuggaaaauauaccaaaauaagaccaaaacaaacacacacucucuuucugccuuuauccaguggaaaugugaucagguaccuuggagcaggagaccaccaaacauguagggacggcagggacaagggaagugacugagacguguguguaccgggugggagcuuccuuuccuugcccuaggacauagggguuuggggagagacaagauuuauagccuccauccauaguuguucuaacuguggggcuggguuccuuaaccuuguuguuaaaggugauagacagguaagugagcaauguaaagcccccguggcaagugucagucaaacccuucaggcuuagguuggagauaaguggcuugggacugauccuggaugauguucuaggagaaaacauuuagguggcaaagcauagcuauugauguagcaaagguuggguuuugugcuuugucacagaggcacugucacuuuagcuggcuauuucucauacugacauaugcauacugauaggugaaaugccucuugaaugcuuauaggugauguuaggagcucauuugguaaaggcuauugaacucccgaauauaaguuaauguuuugcuuggugccauguagaaaaauguuuuaagauagcugugccuugacccugggaguccaugcucugccuagggaaacaagagggaaaguuugucuuauguucacaccuuuacccagaaugggccagagaugcauguagagacacccuuuguuguucaaacucuacaaauucugggaaaaggcaaguacugauggaaagaugguucucaccugugggucagaagucuaagcaggggugagaggcauacggauuguaagcaauuuccgucagcuguuggccagaagugcuaguuuuucccugugccaggcaggacuuuaccuuuugccauuuuugccucuggguaagguaccagcaacauugagccagucauagacaaacugacuuccagcgguuuccaagauuccugcagucucgucugacauuuccaugagucggcugcuuauacugugaggguauuuagaugcaagguguauugucuguggugggagcuuuuaaaccaggaauuuugauuucuucauauuuccuugagauuugguuuucuguugaucuucccaagcacaagguacuuugcuugguacuuugcuugguacucugcuuggugagcagguggcuugacuagcuaggugccgguccuuuaggauguaucugcuggcaaaggaugcagucugaaccaucuagacugccuuguuaugugggagcucagauuuggaagcagaggugggauggaggccaagaugggcucuggagaugcagaguacuaaaucauuuccuggcugugagacucugagcaggucauauaaugucucuaccuugguuucuacuccacagaaauaguguuaacuauuuugcccagacacagggauggugugaagguugaauaauguuacauacauguuacacauacgcaaugcuugccacaaaagaagugguuaacaaggcuuaucuacugacuuuuuaaauuaccauuacucuuaaggaagggucaguggguuagcauacuagggcaagccacuugaagcucuaacagugauuuggggauauuaaaugccagauuuugucacugaagcuugugaugucgucagucaacuagcauuucuguuucccuuccagccugugacugugaucccaggggcauugagacaccucagugugaccaguccacgggccagugugucuguguggaggguguagaggguccucgcugcgacaagugcaccagagguuacucgggggucuuuccugacugcacacccugccaccagugcuuugcucucugggaugcuaucauuggugagcugaccaacaggacccacaaauuccuggagaaagccaaggcucugaaaaucaguggugugauuggucccuaccgagagaccguggacucuguagagaagaaagucaaugagauaaaagacauccuggcccagagcccagcagcggaaccacugaaaaacauuggcauucucuucgaggaggcagaguaaguaguuaaugagccaaaaaucacucacgaaggcuuuucaguauuugaagagcaaagauuuccuggagcgguacgucugcuagguuuucuagucuguuacaggcuuugggccccuuguuuaucuacaguguugucugugagcaggguagauugaggcucagugcuugcagcuggacuggacuugaggcagaagauccauagagucucagcuuugccauguguaaggcuuugaauuugaguggcacauugauuccuggcucgcucuugccauugcccuacagcguaaugcaaggauaacacacuaccaguuaaagcccugagaguacgucaaguccuagguuuacuucaauccaguaaaaaauauuaaauguauaguaaaaauuguugaucuguccauggauaggcaguaggcacgugccugcgaugguguucacuuaguggaggacaggacagcuugcgaagucuuuuccaucuaccguguggguucuggggaucaaacgaggucaucaucagacuuagcagcaaauagcuuuuuaccugcugagucaccucacaggcucuagauagauaaugauaauuuuauuacuuguuuguuuauuucauuguuuugaagacaggauuucuuuguguagaccagccuggccucaaacucaagagauucugccugccugugcuucccaagugcugggauuaaaggcuugugccaccacccgcagccuggacauuauucuuaauuguaauauuuuugagaucugaaaagaaaugaaagccuuuuuugaaucaguucauuaauaaaagugaaacucuggggaaaaaccaucaccaggaaagccacugcguauauucagugccaccaaauccuguaacccuuuuuagugccuguucucuguguugggucacucguggcauccucucaacuuaaggagcauuaaauaugugaugugugucuguauauuuguaugucgggggcuuacugcagcugccuacauucagagcugguagccugcacucacccuuguucauuuuauaucagaggcuuaaacucccccccccccccccccacacacacacaaagagcugaggguucacugguauuuuucuucagaguauuugaagaaaagguguucgcuuccguugucucuuuaggaagaaagcugaaacacaggaguauaacugaaguauagucugaagguagagagugagagauugugcuaguggagaacccacaaguaagacugacagugugggccaguuuuagguaagcuugcuuuucuuuccacaggaaacuaaccaaagaugucacagaaaagauggcgcagguagaagugaaauuaacugauacagcuucacagaguaacagcacagcuggagagcucggcgcacugcaggcagaagcagagagccuugacaagaccgugaaggagcuggcagaacagcuggaguuuaucaaaaacuccgauauucagggugagaaaucucaaaccuggauaauaaaugacccuguaucuacccacuuaauacuuucuaaaaacaaacaaaaaaguguucuaacaguuuuaaaucuuuauuaauugagucuuuggcacaaguggggcuuaaaguucuugguuuuccaguacgggaccuggggacaagacauaguagaggcccuacugcauuaaaaugugguccguuucucaguuuaacucccuggccuguccuuagccucuguggcuacuaaaauauuguuaauucugcaaguccuuuugcaucugagauuacugcuuacuuaguaacucaaaaauauuuuaauaaucaauaaugcaggcuauaucauacccucccccaaaagcaaaggugacauauguuaaugacacaauuccacaguagucauuuuguuuuacuaggucccuauagccaaaauguacuguguucuuuauguguguaauaauuguuugaauggacccaaguagauaaagagaaacagucaccuggacaccuccaggcucccugacaccaggauuuagauauuugccuaaauacagaaauggugugugcaugauggcuugacuucuuucacaccagugcuugaccaggggcugaugggacagaagagauuuacuguucguaacauggaaacucugcuucccuccagauuucuuuuccccuugaauccuaaagccaguauaaaucagggcuaucagauaccaaaaaugggcacuguuuggggaggacccagggacaaggagguuaacugugggcaauuucgcuuccugucccaggcgccuuggauagcaucaccaaguauuuccagaugucucuugaggcagagaagcgggugaaugccuccaccacagaccccaacagcacuguggagcagucugcccucacgcgagacagaguagaagaucugauguuggagcgagagucuccguucaaggagcagcaggaggaacaggcacgccuccuggacgaacuggccggcaaacugcaaagucucgaccugucggcuguugcacagauggugaggcuuggcguuugcucucauuagcucuggguuuuuuguuuguuuuuuguuuuuauaaagagacaaagaaaacagacaccuucugccuugcuccaguauugcuguucguaauccuguaggggugacuccugagcucaaggugcugggcuccacugucaguuagccgugaucaaggcauggggaacagagcaugugugugucucccugccugcuccugccucaacuguuccucugggcagccccucccccaccuccuguaucugcugagggacuugacuucugaaacuagauccuuuuuauaguguggccuucaaaacaaaacaaaaacaaacaaaacaacaacaaaaaaaaaaaacaagaaaaaaccuugcuuguuuugcuuugaacugcaacauccaaguggaagaauuuaaaauuguucagggacagaaccuuuuuccaucgguguuugcuaaaauguuccuuuguuccaguaauauuaccugguaaagcuuaaggucugagcuggccucaaagagcagauuaauuucuuagaagcuuuuaaaaaguaacucuggagccaggugaaauugaguagugaguuuaaugaaaaccaggcagaaggccaaaaggaaaccaagccagguuucccugugguuuuccucuucuuuuucaugggaggaaaccugagacaacugagauauauuuuuauauauacaccaacauuaucuucuaguuuuucucagccuagacagaggaaucuuuaagagucaggugggaagaaaacuggcaaagacacucauuuuauggcccugggcccuagguaccuuggauaguagcaccaaguauuuucaggucucucucaagacauaagagggugacugccuccacuguagaccccagcagcaccggagagcagcaguccccacuccuguagcagccauguguacuggagacaggaaaacccuuaaccauucuguaccugccaucgccccucuugcccacgucugcagucagaaacagacaagcgugucacccauccugaacuguggucaguuuuuuuggacaccugcaaaguuuagggguugguauuaucuucugcuuucaacagaguggaucuuaaagaguggguggaaauggguguggaguggcggcacccucucugugcaggcuuuuuuuguaagacguggcuuaaugguuuuuuuuuucucacuguuuuuguuucaguuauccugugauuauuucuguagguucucagcugccaucuucuugugaauugacuuuuuccucuuuguguuccucaguacuuccugaucuucacugaggaaagcucagcugugcuggcucucuguccuuguucauguuuguugaaacagagcacauccagugugcuugccagagagcucguagaaagcacuccuaagacuuuuaaguucgcaucuugagugggcucuuuuucugccguaacacauagaagacaauuauuccaacaugcuuaugggcuguaaaccauuauuguggcuauuaacauauuugggauuauagguacuuuacaaacauuugagccaaaagaguucacagcaucucuacuaaaaauaccgucuuuaaaaugauacuuuuauguuggggguagucugguaacugcuuuccauugcaguacauccugcuugucucaguacaguuuucauaaagugcuaaguauaacuuaguuccugcacaacucuuuccguaucacacagaaugccuguaauuucccuguuugcaucuguauuucauagucaugugcuaugaucuuuaggaaguuucugcuaaggaaaaaggacugagugcucacuagcuggauggggugguugagggaacuugagaucuauuccccuguguucacgcaaacuguucuuucccaucugaaguguucuagcacuuucccuacucaaauccuacccuccagcuucccugucuguauuaaguucucagcuuuucucaauacaccuccccgaccgaugaugcaagcuauguccagguuacaugccagauagcaggccaaaaucaccagaguacuuguugcugagucuaaaccagccaggacgcugaauuggcagaacuugagaaagaucugaguuuggguagaugguauuggagauuaaaguucagugggggcgagcugggugguucacgcaucucugcacacucucuauuccuguucauguuuguugaaacaaagcagaucuagugugcuguacacuuuuuauguguccuguccaccuuuguccucugggccacccagccauucuguugcugacuuacccggaacccccguucccaacccuuggcuuauuucagaccuguggaacaccuccaggggcugacuguucugaaagugaaugugguggccccaacugcagaacugacgaaggagagaagaaguguggggggccuggcugugguggucuggucacuguggcccacagugcuuggcagaaagccauggauuuugaccgugauguccugagugcccuggcugaagucgaacagcucuccaagauggugagucaguggauggccucagguuucgcuguuuguuggcuugcaguuguagggagggucugaaaaggagucaguuccacaucacuaaauucacuguccaguguaaagcugauguuucuguguggucaaaaaggugauggugagguucuuaaucacuuaaucagaccgggaauuugcuuucucuccaugggaauagcauguauguuaggagaaagcagcguaaaucuuagauaagccauaugcgugaacaaaguugagcacgguucuagagugacauucuccucaguccacaagcuguuuuagagccaaaacacagcuuugaacacauuucaaacgcuagcccuaagaauauugaacaggaaugugcauauugagugcuuaagucuacauaaaagcaucauauuuuaacagacaaauuugcuucuaaguuuguugccaucagcuuguuugacccugcuuuagagagagcaagcugguuucauagauggcuuauuuauucuucauguuuaggucucugaagcaaaagugagagcagaugaggcgaagcagaaugcgcaggauguccuguuaaaaacaaaugcuaccaaagaaaaaguggacaagagcaacgaggaccugcggaaccucaucaagcagaucagaaacuuccugacuggucagugguggcucgguuuuacuuggacuuucagacauugguuccugugagauucuguuugagaggccagaauuccugucugaguuguagguaaaauaaguuucuggcaagaaauaaaguaacggaagaaguucagcuucauuucaagcugaacguguaagugcgugccugcaacccuagaacuugaaagguagaagcagcgucagugauaaaaagacgagaggagaccuagccugccuuaaggaaaacaauaugugugugcauguacguguacaaaggugcccagagaugccagcgggaugucagauccgcugaagcuguccaauugaaugcugagcuccaaacucuggcucucugauagggcuugaagcuaagcccucucuuuauuuagcucuuccuuucuugaaguauaugcugugauuuaccuuccaaauguucugcacugcuguaccugcuggggcuccuaagcagccucucuagaagugaaaacauuugcucugaaaacugaauuagaauuucugucuugaggaccuugaagguggucuuccuuuggcagugcccccaaggcagaaccuagcaguuggcauuuucuguggagaaaucucuagaaucugguucaaauuuuaaguuuugauuauaguacauguucuaucaauauggauauuacugguguaaaacacagaaaacucccaacugaauuagaauuaagaauuuauaucacacugggcagugguggugcacaccuuuaauccuagcacuugggaggcagaggcagguggauuuuugaguucgaggccagccuggucuacagaaugaguuccaggacagccagggcuacacagagaaacccuguuuugaaaaacaaacaaaaaauuuaaaucacauaacaaguccaaaaguaguguaaguucaugggacuuugccucucccucuuuugccauauuaagccuaucaacuucauuccugagacagccccaucauaaguuacagucugacaugguaacaguggcugaugaggaagaagacgaccccucccucccuacucuuuugcuagccccuuuuuaggaggauagaacccuuuaggcauucccaugcaucucgggccaggaaugagucacgguccauacauagauggcacugaaaguggaacgugccuauagaaaugggcagacaacgauuuagugcuuaugauuuaucuugucugacuuucagauagauauucuguugacagaaaguagaaaugacuaauaaaaacuguuuuccagugacaacuggaaacaagaugcggaagccgugacguaaccauauauuuuaccccguuuaagugcucugggguccauauuuauguucuuagucaaaaaaugaaaacaccauggagagaucugagcuccagagguuugcugaugauguugucuuggcucuuauagcauuuagucccuuccagaguucucauaacugguaaggaauauugauaccuuuuuccuuuuugagauaggguuucuaugcaguccuaguuauucucauucacuuuguagaccaggcuagccuuggucugggacaguguauaucaaccucacuaaguguaaagguuuuucuucccuugccgccccagcuguaaaugcugggcucuugucuuccauaaccugaaaccacagcuauacacauacaauaugcugucugcccucucuccagccugaaauguucuucaaaaccugcuugguucccaaacucugcuggcaucuacuucuccaugagaggggcuugucucuagcaaggguaugucucuugaaguggcaggugcuugccaugcagcugagugaaccagcucuguggucuuugcuuuucacagaggauagugcugaucuagacaguauugaagcaguugcuaaugaaguacugaaaauggaaaugccuagcacgccacagcaguuacagaaccuaacagaagacauucgggagcgaguugaaacccucucucaaguagagguuauuuugcagcagagugcagcugacauugccagagcugagcuguugcuugaggaagcuaagagagcaagguaucugaauauacaccuuggcaauccagagcugagggguggggugagaucugcuguaacgagcacacuguaagagacuucuuuaucuaauaaagggucuuucaaguggauaugcuuucaaaggaaaugcugguuuuccaguggaaaaaaugguuucauguuaaaagcaguuguuuguucuucugcucagcaaaagugcaacagauguuaaagucacugcagacauggugaaggaagcauuagaagaagcagaaaaggcccagguugcagcagagaaggcgauuaaacaagcugaugaggauauccaaggaacccaaaaccugcuaacaucgguaaggcacucgagcugggcuguauagggggacacacaucgauucccuguaacacugcaaauuaucccuuuaaauaagucagaacuguuucucuuggcacagguguuuuucccuccuuuaaaaugugucacaaauuaagcacuguugcuuaaacaauuuuauuaauuuuaauuauguacauuuuuuccaaguuaauguuacacuuaagaaacugagaaucuuugguuugauuuacaaauguuguccugugucccuaccaacauuagcuuugauaaacguuuugcuagucagucaguuuuguggaacauacauaucccugaagcucaguuuuaggggaaacuaagacaguguuguccucccaaggagaccaacuacaggcauuuaccaguugcccagcuaucuuuuuccucuggggugccuugcuauuucuaguauccugagucuucacaucuucaagcuaaugccccaucacuaccagaaucuuaacaccgagcugacaggacuaucuaaaaagauggcuggaguugccaguuuccucguccacauaauuugcaaauccuccucacagcuggcucacuugugaauguucuuaagcuaaacacagcugcgaucagcagaaaguaugaugugugacgcagaguaacugaagcuggguaacuucaucucacccagcgcuucucaacauuccuaaugcugcggcccuuuaauacaguucguguuguggugacccugaaccauagaauuauuuuguugcuacgucauaacuguaguuuugcuaguuaugaaacuaucugacaugcagcgcacugguuuagaaccccuccuaagcugucccaaugcuguccgugcgucugagcucgugcggacgagcguagcagccucccugccccugccccugccccuguacuaauggaugauuaacauuauaccguuagauugaaucugaaacggcagcuucugaggaaacccugaccaacgccucccagcgcaucagcaagcuugagaggaacguggaagagcuuaagcguaaagcugcccagaacucuggggaggcagaauauaucgaaaaaguaguauauucuguaaaacagaaugcagacgauguuaagaagguaaguagaucuuugcaacuucauagcuaaggugguaaaacgguaauuaaguuuuuuuccuuaccuuccuugacauuaauaagauacaaacagcccaaugaccuauuuuaaaacagaagucuuuuggauaaaugaguaaagaauggaauaugggauaaaacuguaaacauaggcccuuagaucucuacauggguaugaguuuagaagaaugaauuauaucuggggugugcucuaaaaguauacacuaguuauuucuguacuguagguucagagaggacuuuuugacauggcaguuagccacccauuugagaauaauuuaaagacaggaugggaaaagcuuaagagucccuuacacagaguagcuaguaggaaaucaaauugcuaccuuuucucucuccuuagaaggugauguauuuagcaaauuuauguuucacauauauauuucauuucuaaauuuacuuccagagacugcuuguuaaacuuggaagugaaguuaggaauguuaaaucuggcauguaaccuaauucugauuucuuccaauuggagaaggaaaaaaaaaaaguugccaggcagugguggcccacgccuuuaaucccagcacuugggaggcagaagcaggcagauuucugauuucgaggacagccagggcuacacagacagaaaggagaggggagggguggagagaagggaaggagggaagaaagaaaaacaaagaaaaaggaaggaaagaaagaaaagaaggaaaaguaauacuuuauagcuucccaguauaacauaaaaauaauuucagugcaccugaauugggaagacaggcaaaccuaagagaaauucuugccaggucagacuacucuuuccugaucuugguucuguacagucugaaggcacaaaucucccagacauuuucauggcacugagaaaaaugacacuauuaaaaauaucaaagcucuauauggggggggggggggggggaagcggugaccaggcuggccucagacucagaucucccuccugcuccuuaaaucuggaaugcuggaaugcccagauuuaaguguguacacaacuagcaucaccuuguuuuauguguaggcuacagugcggacuuauaauuccuaauuuuucuugcauuguaaauuuuaaaaacaacuuaauaugaagcccaaguacuuugauauuccucuuugauaagaagcuugcuuguccggaaaaaagaacugucuuucaucuagggcucuugaauguaauuacugacauacccguuucaucuuucugucuuaaacucuaucugcagacucuagauggcgaacuugaugaaaaguauaagaagguagaaaguuuaauugcccaaaaaacugaagagucagcagaugccaggaggaaagcugagcugcuacaaaaugaagcaaaaacacucuuggcucaagcuaacagcaagcuccagcuguuggaagguaggucuuuucuucccacuuacaguuuuauaaaggugaaggcuauaagcaguucauacuuaacuuuacuuuuauuucucuccacagacuuagaaagaaaauaugaggacaaucaaaaauacuuagaagauaaagcucaagaauuggugcgacuggaaggagagguucgcucccuccuuaaggacauaagugagaaaguugcgguuuacagcaccugcuuauaacaggaaggggcuguagaggggcucggugaccaagguaaaccacacgcgcaaaccgaggcagucaucuacaaauaacccaucaucuauuuaauguuuuuaaccaccuacuuuuguauggaguuaaauaaaagacauugguuuuguauaaacau

SEQ ID NO: 6624 - RNA, 917 nt, Mus musculus
aacuaaacauuggguuuaauaaagucaguauuucucaaaguggaacagugaauuuuuuuucaauuuuuuacaaauggucguuuugggaaaauuuaucacaucaaaguaacaguuaagauagaauugugcucaaccaagccacuuaucugcacuacagaauaguacuugaaagcaauccuagucagauuaaaaccauuuugagagacaagacuuguguuaauagcuaccucaaaagagguaguuuuccuuccacagucaaaggucaauuaagauugacuaaucuuuuuuuuccuugucauaucuucaguucaaaacacuaugaucacugguaauacggucuguaucuuguuugaucuggaugaugcgguccagguagugggguuugagaaggcgggcccugcauucguggaggaggagguggcccucuuggugcaggccauauaccaggacucauuccuccugguuguguaaauggagggcucagaguuccuuggucuucaguaaacugggguaaagaguuaggauuguaauggugaggagggggugcaguuacagguggaccaccaugcugagguggaggggguccuggaggaggaugauucauauaagguggcaucugggcaauaauauguccagggggagggguuauuggggguggagcagaggucauugguggagguggagcuuggcuauauaccaagugaggaguaccugcagccuggggaggguguggcauuggauggcuuauuggugguggaggagguggggguggugcguaauguugcuguggaggcauaauaugaugagggugagauaccacgggcugacccugauauucaggauggugaugagcaggugcuggggcaggagguggugguucucuagcaccugaacuggagucauccugaauagggacc

SEQ ID NO: 6625 - RNA, 689 nt, Mus musculus
cauugucuaauugugcuuuguccugaggaaccccaacgcccacucgacacgcgcguuugcccuggcucccaccguaguuucucaacugaaucgcguguuacaaugcuaacuagcccauggcucuagagaacaccaccaggcuccuggaaucccugcuaaagcuggagggagcaccaggagguccccguucaacgaaaauacaaagcaguugugugcaaagggggugaaggagggaagauagggaccgauggagucggagggagagcguuagagcuugacuagaaggaagagaugagaaagggcaggccccgacugaagaaaagagaguuaccacaacaggcgguaccuaguuccaguucuuggucccuggggucugugguugccgcuuucaucuugcucagccaaaacaaagaagagugucaacggcgacugcugaagaccuucagagcaccccccaccucgauuuggcucauaauaggucuucugccuuccccagcccuucacacuugaagcucucguaugaguagaaaggaacacaauuaguggaaaacaucagccuaggagucaagggauuugggcucuaugcuugucccuuggugacgacaucguuaccuuggguuguucacgcuuucagugccagaguuccuagaucaauaaaacauuauuauguuggccuuucuuaaaaauau

SEQ ID NO: 6626 - RNA, 24083 nt, Mus musculus
cagaccuuuuuuuuccuuuuauuugaaauaauauacaagaauauagugugcaaaauugaggggcaauauguuuaacaaguguaaaucaauuuuacagcugugauuacuaaccaaaacucucacuugguaaguaacaugagaagccaugauuguagcucagagcaagagcagcaggacugcugaaguacuugcucugucucagaagccggagggaguaaagugcaaguggugcacugcaguaagugcaaagucugccccaccagagacacacugacagcacagaugaggguauguggcugaggagacaggaacgcggucaaacacaauggugucgacugguaacagcaccauuacaaugacugucccaaugcuauuaacugacugcaccuuggccuggcuugggccccacugggaaucauggagcugugcugcccccuggugcauccacucagcacaugcccaugguaucugaagcagguggcucuuugagcugagacaaugacaccgacaccauccaccugccauguuauguugucucuuggcacuggccagacuagaagcaacuguguuuggcagagaugcugggccaugugguggcuauucauggaaaggccagcgucugcuucacuccugauaucguggguacaauacagauuaauaagcaguaaggagcugauguauaaacagcaguuacguauuuuuaaauuccccuucguacaauuuaaaauaaaacguauacacaucuuucuacuguacuuuagcaccacaggauaucaauuuucaagccuauauuaccugauagauauaugaaguuuggaaggaaaauaaggcaauuugguuuacaauguugauaguuauagcuuaaugcucuaauggagaaagcaauccucacccauuaaaucauuacaaaacucaaugcucccagcauuuuauggucacacaaauguagacaaauggugagaccaaggucuuccaagcuuuuccauccagagucaguacuuaugcagaugcagacuuacaaacacaagcaucagguuuaaugcuguugagagcccuguggaaacaaaauaauugguucucaguuuccuaauggcucauagcuuaaguaucuggaaaauuuaaacaaaugugagaccagcaugcacagaaaagugcuaaugucccaaaugaaguuccagacauuagagaauuuguagggaauggcugugugguuccauagauauacuuugccuuuaagcacagaaccuuggguucaaaccccugcacuaaauaaaaggcggcaagaccaacacuugaguuuguucugugacuugaauguacacauacacagaaccugagcuuguauugcauagcuguaaucccugaaaggaccgcaaggguuggaggcggaagcaucagaaggugaaggucauccuuggagacaaaagcaaguuugaggccagccugggcuacuuaugaaaccucgacucacacacauauacaccaaaaaacacagaacaaaucucuacacuacaguucaucugguggcugacccuacuuuaaaauaaaucccugagccauuuaaccuacaaauuauauaggauuggcuaaacacccuuaauaagccuucuuucugauuaccguuccaauaaucuucauuuuaaaaaaauaauacauaaguuuauucuagucuauccuauguauuuugugcuaaauaaucuaaaauguaaacauaaaggaugcuauucaaguaaagaacaguuauaagaauggcgucuaccagccaaagacagcauugugaaacuucuuucucauccuuccugugucuccuaguuucugccuauagcagaagccugcaaggauguuaccaaaaacuaaagaucuucuacuguaaugaguuaaugauguccaucuuuuaaccagacuacuaguaguauacucuaaaacuuccucagcacuuggggcauucuucagcuagcuugagaaaaucugcuugcuguacuacucaagugguucuugauagaaaaggcagacuccaguauuagguuugaaguauaauaauggugagggaucuuuaagacucugccugccaucauggcacaagaacacacagagcaucagaucaggacuucuguuacuacuaacacuuacugaguugguucuuuuccuuuuccaacagucaggauuuaaacgcuuuuguucuucagccaaagccuuugcuucuaauguguacauccuccuuucuucguucuucauuuuuuuccaccugucaccaaggaucacacuuauggcucugcaaaguaaauauuuacauaauguaaaguuucauaaaauguguagcagcugcuacuacuuuggggagaaauguaaaaaaaaaaaaaaaaaaaaaaaacagaaggggaaagaucaagacuaccauggucauuucaacgaaauccuggcauaugcauccauuuaucaguugguggaauaaugauaguauuuacaauuguucuaaaacauccaaaauugccagaaaacuggcaauuuuccaaaggaaaguucagugucagcagcguggggcauucaacuuguauuaaaacuuauuuugugugcaaagcuauugugguuaugauaauaaaagcuuuacuccccccaugcagugcaagccaaguaagaaagacuaucuuugcuuuagaguuuaugucuagugaucuuuuuaaaaguacauuuuaggucagauuuguacuuaacacaagacacuggaauaaauccaaaaggguaagagggagucaaaguugauaggacacauuacuguacaaacuucagacuauuucccuguuuuccuagucauucagauaccaaaacuauuagcagugacacgguagcacacaagagccuccugagaaagaagacagugaugcuucaggggcacaggagccacaacuaaaauguagagaaagcgcuuugucuugugaaguccaacacaucaaacaauugaaugugcuauauuuuauuuaaaaccaacuuauacaguuucugauuaaagauagcauaaaauagcugacauaucugccaucuaaaccacaggaauagacacauagcagucucagucccccagaguuagaauguuucaaauggggugcugaugcauucuugauguuuucucuuagguuaaacauggcgggcagugugaggugcgcuaugauucagucuagacuccuuccucgcuuaaguuucaaccucauuaauguauaugccaacuggccuaauagcuuucuauaugucuacauucugccccuaagaaaaaacuuccuuauucauggaauaaagaucuaccucuauagaagaaaaaaaaacccaaacugguuuuugauuuggaaaaagguccauuugacucauuucccguuaauguguuacucauauacaaacaauacaaaaaugcaauggaaagugagaguuaugaguuauaugggaguuaucuuugauaaauagauccuaaaauagaaaaacaaaaaaguggaaaugagacagcuacucuuaagaaagaccuuuccuccagaauuaaaguaaacccagagagcuauuggcauuccaguguuuacaaagucuuuuuaauauaauacaagaacacaaguaccauuucuagaugucagaggacacauuuaauaagcaaguaccagacagguaugaaaagagaaacacaugccccaucugucaggaagucucuaagaugaccugggggggggggguaagucauucuuaaaaugcuuuuacauuuuagaaguauguuuucugcuaaacuauaauauauuccugaccagagacuacuccaaugugaauuaaaaaaauuacagggucucacuacuuagcccuagcuacccucaauuccaguucuaaagaaaucaccaaauacuaggacaaggcuauucuguacaaacacaucaacucuuaaagaugcacuuggaaugcaaagcuucuuucuaaaauguagguaguauuagaauuacuucuuugaggagcuggagaaauggcucagcaguuaaaagcacugacugcucugcucuuccagaggacccagguucauauccuggcacccacauagcagcucauaguacaaucuauauauuauaaaaacuauauauguaaagucaacauaagaaaaugggaagaaaucaacaaacgacacugaaggaguuuauuuugcaggcacaguuacugugaacugcccugacaagucaagaguugcagucauuacuauuuuauuuaccuguuaucuuucccuggauacaucugaguauauucaacucuguauuuuuuggcaaaaagcaugaaggcauucauuggucuuuugcacuuauuaggagaaguggcacucacagucccugagcuguggcuuuugacagcuuuagcauacaaagaacuagaagagagcugugaugauccaggugaaccacagcuuuuacugaauucagaucccgaaaacucuugaccaguaccagguccuccuccacaagacagagaugcacggcgcugacgagccauacuacucaaaacauagaccgcagaagaguccauaggugugaagucauagcuagagaauuaacaaaauuagacugagguuauaaaguaucuaagacagaaauuuaaaaaucuugcauuugacugaaaccuucacugccccuuaccugaugugucuuuaccagcuucugccacuacacuuaguaggaaaccucauauaugcaacugaaaacaucuuuacaaagccaaccucuacgccccacaaaagaagucauaaccagcauaucuccuucauagcaguuaacgucuacagaccccauacguguccuucgcuccuucacucuucuagauucacuuuuuaacaaauuugaucaucucauuucuugccuagaaguauagaccuaggaaacuaaaauggagugggcuauaguucaggccugaaagcuaacugaacaacaagagcuaguagaggagggcagccuguucagcccaguacuccuagcauuuagaaaacucaggcagauggaucucuacauagaggcaaaccugagcaccacagaagguucaaggccaaccugcccuaagaugagaccuugucuccaaaacuggcuauggaaugggauaacuuaaacaacauagcaaugugagauuuguauagauacagaaaguuguaauauauucagguccaccuauguauaguuaguaucuuaacccacccauaucaguaaaggccacauucuguuauauaaguucaauuugcauaagcaccaaagcaccaaaacaaacuaggcauaguccugcucuucagcaagccuggaguuggggaguccaucugguccucuauaugaagaaagaggccagccaaaauauaaugccaaggauccucacccauaaaccaguaccuucauaauuccaauggaaaaauucaaaaguaaucaagccaccaccauauuaauuauuaacucaaaaaucaaagcuaauauauaucauacccuuaaacuaucugaagcccuuaccaaaugaaguuuaauauaaaauccaguaaaauaccaguagaauagaguaagcuaguuacuaaaauuugaaaacucuaccaucuaguggagaaaucugucauuucaauacaaauuaauuugguuucauaaacuuaguaaccauacccagaacaagcacugaagcagugacuauauucucagacagcuuacaugccucgccguacccgcugucagcaccuuuaauccuaguacauguuggucuucaaacaccuuccauguuuagguauacucuccccuuuuaaagauuuaguuuauuacuuuuaacuguguauuuggcaugucuacaaacagaugccuauggaggccagaggcaauuuggggcuugaguuacagaccgcucugagcugccugguauggguacuuagaccagcaccuggguccucuggaagugcucuucaucagugagccaucuuccaccugcuucaucacuacucugaaacacacucuacaauaauguagagccuguuaauaaagucacauggauuaacucauuuagucuucuuacaugaaucacuacuaaagacacuaucuuuguacaaugaauuuaaaaacuacagaaaaguaacuuuacuacacuguaccuaagcuuccacagccagccuucagugcagccaggaggacgagaaggcagauaguccagcucuagagcuuaugccccuaccaggcccaaggcuugucaggcaagccuugaauuucauagugagccugaaccaugagcacaugaugucauuuuaaaacuggaauuuugguauaugccaggaagagaaucuuauuuggccaggcuaucaauaaaaaaauccugugucaugagagucuaacaaacuucucugacaaaaacauuucauacauuuguauuauuuauuccuggaagcuuaagauaugcugagagaagacucaaaaaaauagggcuuguuauuucuucugggguuuucccuucuuugacugcuucguauccuuuugccaucauaaacugugacaugaacauagaugcauuugucucaugaguccaccuaguacaauccaguuuagcaauauugauauggccugugaacaauucaguuacagagcuauuuacauaauuuuauacucauuuacaacaauuuauuuuaugagccagcaaaaugagucuuucucaacugcucucuaucaucucuaacuggacugacaagcuaaccagcuugcuuggcagagcccuugccuccuuguucccacugcuggaaucacaggcaggccacuacaggggaugggcauacucggauagaaagggggccagugcccaaccccuuaaaccuuagcuuuaguuggacuucaguuauaacucagcuaucacuagggaagaaacuuuaacagaaaaaaaaugcaucuuuaccuuuuaaauguaucaaaaacaccugaaucaucgaaauuaauggcaucaggguguccaggagguagacauacgucaccaauaugaauuucacaacauggaaugccaugcuguaccacagucaagcuuggauaaaaugacgaccaaccuagaguuagacaacagaugaacaugaggaaaaaagaacaagucuacuuaggucugacacaccacgucucucacuuucaaauaaaaccauugcuaggauuaacacuucuguuucagcuauguaaaaacccccacaacuaguuuaauucaguauuuuauuuauaaaccucuaucagauacugaccacuuuuaaacaucugcaaaaacacugaaguaauaaacuaugaaauagccuacaaauuaauaaauuaugcuuuacacgguauuucuguaguaaagcucuaaagagcaacucuggcuuaauagguaaauacaaacaaaaauaaugacuaccaagcccaccacuucucacauuauaccugagagcuuacaguaugcuacaugaaugacauuucucaugcacauggcaacauuuuuucugaucauggcuaagguacuuaaacacuauuaaauauaacuguaaacaucuguugaauuuuauuugguuugaaauaaauuuucauuauuuuucuuaaagccacaaaauguaagaaguuuucuuuaaaguuuuuaucaacucggagcuaaagauggcucagcaguuaagagcacuggcugacccugucucgaaaaacaaaaacaaaacaaaaaagcacuggcuggucuucuagaaaucugggguucacuuggcaacucacaaccaguuguuaacugaaguaccaaaguaucggauauccaugcaggugaaacacgcacaaauaugaaaauaauaguaaaguugguauaaauucaauugaagcccuaccuuuauuuuuaacauagaaagggugguccagcuugcacucuacagugagcaagccaucuucuacuguaccaggaucaaaugucaacuucaguacagacucaccgaaugacacacucucuucaugggauaacaacuuuagaccaucagacccauagcccugaaagcauaugcauggacuaaauaaauuggaaacauuccauucaacagggaaacucccaauauaugucuggauuggaaaagguaaauuuagucaguaucuccagcuuuaaaguaguuucaaccaagcaguaaagaaacacacguaucaugaccacagaauauguaucagauugagauaauaugcauuuuaauccaaauauaaguaauaugaaguuuaguaaacaaagacuaucuaugauagacuaaggaggacuuugaagugagauguaaaagauaaaauuuagaaaaagaaaaugccuaggcuaagaauaguugcaugugcuggacgugguggcgcacgccuuugaucccagcacucgggaggcagaggcaggcggauuucugaguuugaggccagccuggucuacagagugaguuccaggacacccagggcuacacagagaaacccugucucaaacaaacaaacaaacaaacaaaaaaagaacaguugcauguaacuucuuugaguagugcuaaguaaguaguagugcuuaaaaacaacaacaacaaaaaaagaaaaaagguuaaguuuagacuuacgcaaauaaggcugaaaaugggacaguuuguaaguuuguagagggcaagaugaaaucucacucaggagguguuggugguaagacaauggaaguauuuuuauuaaugugguugucaauuuucagaucaugaugaugaaaaagggacucuacuauguuauuauuuuuaaagguguaucguauuuguggguguacaagcucuaguagcuguauguguagguacuacucuagccaucuuucuagcccugcauuuuaauuauuugagguuaugagauacccacuguacaucuugaguccacaacugaugagagaagaaccagaugaaacuuaaauucagugggcauuuacugaguaacacaugucagguggugggcuuacagaacacaugaacaaggugaaaagaaagaaaccagugucuacccuugcauucacagaaaaagacacaugacugcagcuagcuacagcacccaauuguauacuaggugaucaacacauaauggguuaacaaugcugugaauacuauggaauagaaaacugaauaugaagggaugagaaggaacauaaugaaagacaguuucguaguuuugaauguggucugcaaaaauauuuuaaaggaauuuuaauuuaaagaaauacuuagauaggcagaaauuaggaaugagauguaccccaagucauacugagugugaaaaauugaucauggcucacuagugaggucuaacaugcagguggaaaaguagagggcagauuaacaaauagucaaaauuaguuuucuagggcuggagagaaggcucuuuuguuaagagcacuggcugcucuuccagaggaucuggguucaauuucuagcaucuacaugguggcuuauaacuguuaacucuacuccaggggaucugacacccucacacagacaugcucaugaaggcaaaacaccaaugcacauaaaauaaauacuaaauguuaaaaaaauuagccuuuuuucuuaaagcuacuaagauuuuagccugcguuuacauuacauaucaggaugcgaaggcccagaugauuaaagucguucacauaagacuugcuggaguacacacugaguucagagugcucucuacagagaugccgccuggaugcugcugucagugcuccagucacuagggcuaugaagaggaagacacugcagcaauaagcaauggacugagaacuaggguacugcugcuguguaaacuaagggacagcaaugucaggaaguaguucaaugagcaaauguugcagagauuucaaaacuaggagacaaauuuuguguaaaguaggagaagcaaaaucagacugcacacuuuacuaagaaaagaguaacaccaagaugaagacaccaugcucaagauaaucaacuuuuucucaaaacuugacaggagacaggaagcuccaagaaggaauuuucaauugguauuuuauauuaucccauuuugcuuauuuauucauuuauuuauuuuucccugcaacagagauagagaaaugaaaaguuuuaaaaguaaaaugugucaacagauauuuauucuaauguugcuuaccacuguuuuuacuuauaaauguagaaaaugagaguuuccuggggucauuuaagaaguaaccucaaacucucaauuaaccauggaagacaugcacugcauuauauacuuaagaacugaagguuugaauuaguuuacuauuugucuuuaaggcuagucuaguuuuccagaacaagagcauuuaaagcauaaagcugccaagucacacagaccgcacaccuuagaagcauggcugggaagugcuagucaugguucugcccaccaugcuaagcacugggcggucucacucccuacccagagggcaaggugccauuuaaauaggaaugcaaguagagcguuccucuagauuaacccugaagguugaccaguuugaaauucuuuagaaggauuuuaaaugaaccuugugagugcccauuuggaucucuuccucauuaucacagcuggcggcucuagcaaagucuuccacaucuugccauuccuuauugcuuuccuuauggaagcacagccgcgugccugaaguugaauuagaaagaagggaucagauuacaagccugcugugcuaccaaggcagcugcaaaucauuuaaguacuucuuuaccuuucagaaagcagugccaaaugguggauggccaggaauugcaccagcccagaucaucaucaucugacagggaggacauacagaaaaugccugacucugacucacuguuugccuguacagagaaaacagaaacuucuguuuuguuauuuuuaaaagaucuuuuaauaccucuuuuaaacucgagcuuucaaauaaauauaacuuaguuguaagauuaaggaaaguaagcuuucacuauugaaggacuuuuuuucuugaaguuuuaaauacugucaucuguaauaaauuuucuuaaaaauagaaauacagaaucaaaugcauauaaugaacaaugaaauauuuuugugcaucuguauguucuucaaaacaaucucucagauuggggaaagguaauguuuucaaccacuguauaaacuuuguagaaguuugacuucaugaauaaacucacccuuucaugucuuacugguguuucuuccuuccaguggucaugagggaaggcuggcccacuuuuugaagaagaggacacugguggugggcgugcauaggaauguaaacuuuugcuaguagcuaugauguguacaggagaugaucuaaaauaaagcaguuuuuauuaucaguguaggcagguccauaacgaacaucuuuucucuugauaacagcauauugcuaaugcuguuacacaagagacaacuauggaaagcucuaguaaagacagcaagcugucccuugaacuuaucauuaaccuuccucauauauaaacucacugguauauguuaaaguguucuuucuuaucgaagacucaucacauuuucuuaagcuuuuuaaaaaucaaaaguggcaaggaacuugggauuuuccugccccaaggucagggauugcauguauguacacuacaccugauucccaucucuuuuauucccauacagauaaauaugcauaucauuaugaaguaaauacccaucuauuucuuaacuccgaaaacucaacaguacuaaccuggccagccauguaucacugggugaacugccuuaaguaaaacuacaaauagaaaacagccugcuugccgggcgugguggcacacacaauuaaucccagcacucgggaggcagaggcaggcagauuucugaguucgaggccagccuggucaacagagugaguuccaggacagccagggcuauacagagaaacccugucucaaaaaaccaaaagaaaagaagagaagagccgagccuguuuccauuuguaagaagacacuguuucugugaguuacacauaagcauacagauguaccgucacuuucccacaaggaucacuuacacacuggcuuccuucccuagcaaagucucuacugagcagugcucuuucaagcccagcagggaucccaaggacacacuaagcucagaaggcuuuagacaccaaccuucaguaauucacacaguuaacagcucaugaguacuugcacaggucaucacgaacagugauguaaaacagggaagaaagcaggacuggugagcagcagagaaaacaccuccaagaauaaaacuacaccccgggguacagucccuuaacuucugcauuuauaaucauucuccucuuggcuuacuacuucccaugagccucccuuucucugcaguauuacagagaaacucauguuuuuauccugcacaugcucaguaaacucucuucuacagagcugugccucagcccuucuauaaacuguaaccuggaugugaagaugaaagaaugguaauacuuaacaucaggguagcuuauuaguaaaguucuucccagccugcaaacugcccuagguuaaacagauuacugugaaaaagaggaauauagaggaaaugauacucugaaagagaaauuuccuucccuauggaaauuuacacagaauuuaacugaauugaauugcucaaucaagaccaaucuccugcaaaauagacaagcauaccuuaacagaaugcaagguagcuaggcuuucauguuuauaucauguguagcacaauauuguacaacuggggaccaauaccaaaguccagaguuccuucuacuuggcuagcauagucucaucuaauucuuccaacagagugaaaacuggggcauuucuccaagcuguuauauuuaguaaaaugauacuuacuuaggucucccuaggaauaccaacugggauuuuccauaguuucaaugcagauuaacccauuuucuugaccuuuggucuagaugaaguaauuuuauuacugggacucuaaggugguuuuuguuuaauguuuagauuuacuuccauuacguauaugaguguuuugcuggauugucagcgcaccaugugcgugcccggugcccaaguagaucagaagagggcaucagauucccuggaacuagaauuaacagagggcuggauguaaacugccaugugggugcuaggaaucaaaccugggucaucuaaaagagugcucuuaacugagcuacaucuccagcuccuacuuuaagaucagcaaaccucagaauuagcgaagauaaucaagguuacacacacaauggaaaaauaauuauagaacacaaugaaacaaucuacaguugauaaaaguuuaaaauacauuguuuaauuaugguucuuuaaacaaauaauuuuuauuuuuaaaaauuuauaaaaguagacaagagugaaacccugucccaaaacaccaaaaaauaaauuucagaaugauauaaaaauuuuuuuauaaaaguauaaaguauuuuuuuuacuuuugaaacacauauuuuuaugcuauauuuucucauaguguuauuugauuuucaaaacaaugaaaucaucuuugaucguuauaaacauuaauuccagugacuuuaaacauuaaccauccauugaauagcuaaugccauuacuguaaaauuagaagauuucaaaacaguaacuuuuugaaauuaaaaugucuuuuucauuuaugugugugcacaagcacuacagcauguaugaagugagaggacaacgugcagguuugcgcccucaggcuugguggcaagcuucuuacccacugagcuaccuacuaucuugcuggcccuaaugaugcaaguuugaaaugcaaacauaauccaugcuccuaccuguuauaaaaugagcacugcaucaggggacuuuguggacuaguggcaauauuugcuaacucuguuagccaguccaccucaucuucacggugaguauuuuccgguauaucugagguauucuggcuccaagaugaucuuggauauucuugaugagauacaucugaacuuagcugguauauggcagauuggguagggucacuuugaacagccugaaguucaggaaggucaucuggaaauaagcccaagauuauuauuuuuuaaauauuauaauuaauaauauaguaacuucaguuaggaauauacauauuuaacuaauuugcuaggaaaaauaaauucaaaauuaaaaccagucauuuguugacagaaaaaauuuucaauguaagcaauaccuguccaugccugcaggauaaacacaauggaugugaauacagcaaugguucacugccugaaacauuuaacuagaagaggucagaggcugaaaaucaagguucaguuuguuuucuauaccucaucucgaucuauauaccagauauguuccuacguuaacagauuaaugaagaaaggggcauuuaauguauacauauaguuguuauauauaaacuuuauuggcuuguuaaacaaguaacugcaauauugaaggcaauuccuaacaaugagaccagagagcauacugucaaguuuucaguagugcuacuuaauacaaaucuacuuuuuugugaguuggguaucaugauacaugcuuaaaguccaguauuugggagguucagacugcuggacuccaaguuuguagccagcaccgguaauacaagacccugacucaaaacaacaaagaaacagagaaaguggauucuauuaagucuguuuucaguucuuuuauuuagcuggacuuggugaugcaggcuguaaaccaguauuuuaagaagcugauauagaaaagcugauagagaguucaaugucagccugacaaucaaaacaguaaggcaguauucccaauucucuauuuagugcuaccuuuccccagugcauuauccccaaagguagaucacagaaccuagcuguuugaaggaaaaauuaggaaacuacccaaaauugugaaauucguuaaaagauggggugggaggaggggaggaaccucacaggccuucuaccuaccuaccuaccaaccaaccaaccaaccaaccaaccaaccaaccaaccaaccaggcaugguaguguacucuuuuaaucccaguacucaggaggcagagacaaguggaucucuuggaguuccaggcuuggucugcauaguuaggacaaccagagcuacauaauagagauccugccucaaaaagaggaaauacaaaaaacaaaaacaaacaaaccaacaaaaguaacagaaaucuccucgaaaaagcacucacacacaugcacaugcucucuacagaucugcagggucccuuaaauaugcaaggcaggaaaaacucuucuaagggcugcagagauacucagcaguuacgagaacuggcagcucuucuagaggacccagguucaauuccaagcaucuacauggaggcuaagaacggucuguacuccaggaccagaucuaauauccucuucuugcuucuuuaggcaucaagaacccauaugguucacagacauauauuuaggcaaaacacccauacauguaagauaaaaaagaaaaacuuuaaaaauuacauacaaauaucaauaaugaaagaaaauuccuuauaaaguugugccaucaccucguuuggaacuucuacugaaaaaguauaaucuaaucucaaauaauccuuucaacuguaucuuccugaauaaucaauguucuguacuaucccucugugaacauuaacuauucugcuuuaugcuauguaguaaugaccucgcuuuaccauguuuuuaaugacagcagucuguguuuucuuuccacaaggcaauggagaaucaaagaaagugaccaauacaacaggaaagaaaaaccucaaauaccucaaaaacucuccuauucaacuaaguauccccauaaacuguucuagaauagaccccuaaaacuaaaguaucuuaguuaaaaauaguaagugggguuauccauccauucuuugacuacacaguauccaucucauugaaaaaguuauaaagcacaccaacuagauucuaauugccaauuuuuaggcugcuauaauuauuucccuuaccucacugucaacacccugccuuuaaauauaucauuucuuuauuaugaaaaguuuuuguuuuucagauucagauugguuuuucuagacaggguuucucuguauagccuuggcuguccuggcacucacucuguagaacagguuggacuugaacucagaaaucugccugccucugucucccaagugcugggauuaaaggcgugcgccaccacugccaggcuaaacuacuuuuuaaaugaagccacagauagguggggcaagcugucuggccugauuuccucuggacaagugcuauaacaauggacaaucaaccauugccaaaagcauugcuccuuacucaauaguaacuacuacuccaaaaacuauuaagauccagaaaauauggauuauuuaaaguuauacagucuguccagagaccuuuaggaccuccaaauucccaaccauacaguaccaccaucauuuauuuguaaagccaaggcagucaugugcuacacccucucauuuccauaaacauucaugaugauaaagucagggugaagaguggaucagcaagccaaaggcccucauuaacucuucucuagaacagcaaugugcaagcaacuuaaaaucacuaaucaauaagccuacacauucuacaaacaucucucuggaguagcucaucagaaauaaucacuacgaaugucugauccucacauuucauggguaccaucauuuccauaucagaacagcaagccaccauggagagcucacuaagaaaguauaaagucacauggcaguuuucaaaacaaagcauguaauaguagaguuugcucuugauacgcaaaauaaaacuauuuacuuaacaaauuuucaaucucaaugaguaccuaaacacucccacuguuuucaguuauauuuuaguggagacuuccuccucaacacugaacagcauggggacucaaguuuggagcuuuaccacucacacaagagcuacacagcaggacaagaccugucuauaacugaagggagucuggggcgugagauaagagcacucugggcuuuugcuagcuugccagucucucaacuggugagcucuugaguucaccgaguaaaugaaaaggaagguggagaguaacagaggaagauccuauccagagcccuggacagcacucacaugugggccaguguaugcacaugugugcacaugcuacaccugcaccugcacacacacacucagaacagaaagaauaugaaaaauuccuauuacacaaguucuuuacauacuuuuuuagguagacaagacagguagaacagcugauuagauaugguaauuaaccuggaucuaagugagauuauaaaggaacuuuccaucuugcuuaccaagcuccaugugcucaucacaggaguuguauccuggagaggauggcaaauucucauuacacugcagcaacuccagcgagucacucaucccuggugcucucuuguccaucaccagcaggaguuucuguacugcauuaggcaucugauuugucuucacuucccacaccauguuauggugcuccgacuagaaaugaaagaaaggcagugucaugugacuuggacaguacacauaaaaagucagucaguaggucagcacuaugcugcauuucaaauuaaucacacaucgccauuuuauuuugcucaacuccuccaggacaacugcacaacugugcuuaaacggacucauacacaaaucucaaaggauuaacauuguuaauucagaaucuuuucccuuuaauaguuaacagcagaauuguacaugcuuucacuuuucugaacugucucuucagauacaaauacuaacaauucauauuucagaaaccaaagaaaauuaugcccaaccaacuuuccugaaguaaagacuaaaggaucuggggauaguggcacauaucuuuaauuccggaacuaaaugggcagaggcggguagauuucugagaucaaggucaguauggucuacauaacaaauucaaggucaguauggucuccaggacaaccauguauaccuagugagaccauauauuaguauauuagaacagagauagagcaaaaaaaaaaaaaaaaaaaaaaaaaaaaaaaaaaaaaaaaaaaagagcaugcuaucuaucacccuagguacuuaugaguuuaucugaaagucugaaguauucuagaaaaugucuuuauuuuuucccgguuacuacaacauuguaauucaucagucuuagcccacaguuacacuguugggauguuauuucccauaaauuaccagauuaaauggccagcuuaaauguaacuucucaacuauuaaaucaugcuuucugugccucucuacccaguccuucaaacacugagcaaauuuaccuuaaucagugauucucauucaccucucagcacagucauacauaugccaaaacaacuguugcccaagucccauccagaggaaaugauuuguuuguaccaaaaaccuguuuacugauuuuuauuuguuuucaaaaacccaaguguggcgaucugagaauugcugggauuaaaaaaaaaugguuguugggccaggcauugguggugcacaccuuuaaucccagcacucgggaggcagaggcaggcagauuucugaguucaaggccagccuggucuacagagugaguuccaggacagccagggcuacacagagaaacccuaucucgaaaaaccuaauaauaauaauaauauaauaauaauaauaauaauguuaacaaguugggguaauguagaggcaauggugugccaccaccugccugucaugucugacuaggguucagucaucagcacaagaacauaacuuccuuuuuaaccauaaaguuaauuuaaugaguauuauacaaggcacuacaauagcagcaacaaugaacaguuagccagaacaccaagggaucagggcuuuagcauauagaauagaggaaaggugggcucccaacaagaacacacaucagcaacagaugugguaaagugcuacuggaugaugucaggaauauagaacuaguaucacaaggauguuugauggcccugcgcauugugugcucauggaugcuaaagccguaaagugagguagagugagucuuaaucauaauguaaggaaaugaaagaagagacaaggguauggacuauaaaccagguuugucaaaugcuaggcuaaaugcucugaacaauccauuuuaauaucuugccuuguuuguaaaauggaauuaaaaguacauacuucaaugguuguugauaaaacucaaaauaaccaaaaacguuucaaacacuaacauaaaucccaucuucaguaugaaaugguuggugucauuaacaauuaccagucaacaggguuagagccacuugugauuugugggccugagaucugacgugagugaaacuacaaacuauuucuuucaaucuguucaaaucacauuaaaacacuauuugaauagacaagguauguaacacaugcagguuuuguuuuguuuuaagagcucucauccucaauuuuugucuaagccaacugcuuccagaguccuuugcaagcucuuguaaaaggcaaucguaacgaugcagacuccuuaucuagucacuccuaagacacagaacuagccauucuuuucaaguucccuccaaagcuaauacuaacaguuuggaucacacagauuuuaacuuauacuauagagaucuauugaacuuaaagaacguaauucaaucuaucguugugauuucaaauccuucugaacaucuguacuauguucuuuggacugaacaagacuuuggcuccagcugcaccuggaaacagcccacuucaccaucauugucaguuagccuuugucucaacaaugcuguucugaguccacaggauccucccuggagcugucuugguugcucucccccugcagagagccauucuucacaacuaggucuuccccucuccccaucaacaggcugcagugaagaucacucaacauggacaauauacuaacuuagaauuucuaccacucaggauuucagcacuugcccuauuuaucuuaucacaacauaauuguguauggggggaauccugacuuuaauuuuagagaacuaccuacaauuaacaggccaagugaauauguacuguuuuggauauuugcccuuccaacuacuuauggugaauuugguuuugacguaggcuuugcuaauguuuugguuuuuuucuauaaaguuuugauuuuuaagguuuuuauguccuguacaggaaaagaaagucuaaacuugcagacaacucuucugguugcccccucccucccacuucuuggcccuggcaagacccaugggccucucuuuccacugacuucugauacauacgcagcuagagacacgagcuccggggguacuggucaguucauaauguuguuccaccuauaggguugcagaccccuuuagcuccuuggguacuuucucuaacuccuccauuggggacccugugauccuauccaauagcugacugugagcauccacuucuguguuugcuagacccaagaaaauuguuuucaaagaacucucacgauagaaaucgaaguacuuaaagugaauuauaugcuuacaagugacaaaaggcacuaaaacuaucaaauauugacuauuauuuuauaaaaauauuaaauaacuaaguaucaaauucaauguucuauaucaaaagcaguuagcagacuuuacugcaguucuuuaauaauauucuaaaugucucuucucugacaaguguuucuacuacucuagcuugccacugagcuaagaaaugaaaacaagaagccacacuguggguuugguaaacuacacugcuauagcuuacacuuacugcuuaauaccgccuuugugcuuugaacagucuaaccacugauaccuauuuccuuauuugucaauaaacugaaaccuauuuacuccucaaaauuguuacagguauaaaaaauacauuucacauccuccuuugcugaacauuacaaaucacaucuaagaaaauuauuuucauguucagucaacaugaaacacuaauacagacuguaaccguccaugaaccaauucaaguaauauuuaaggcaagucauuuugaagauuuaagggcuaguugauuccuuuuucaggggccguggguucaauucccagcacccacccacaucagcuaacuauggucuguaaacuucaguuucagaugguagcucccacuaccucuucuggccuccuuggguacugcaggccauguacuacagagacagacaagacgacaaaaccuucacacgcauaaaauaaaaaaauaaaucaauguuuaaaugaaauguuuauaugacagaaaauacucuccuaaacuuaauuacaauccuggacauuuucauauuacgacaaccuguaaaacagccucuucuuuuuuuuguucagaccuggugggcuuagcacucaggaggcagaggcaggaagaucacugugaguucuaguccagccugucuauacagugaguuacagaucaccaaacaagcaaggcagcauuucuauagcagcguuaauagcuuuuuauuuucaaggauugcuaaggauggaagacugacaggaauucaaggccagccuggauuagacaucagacucuucaggacagguaguucaaugaagacuaugccaucugucuucucucucucucucucucucucucucucucacacacacacacacacacacacacacacacacacacugaaguaaccaaaaaaaguaaaaaaaaaaaaaugcucuaauaagguuaaauuuuaaauuucacucuuuuuuucaaguagcccuggcuggucuggaacucaguauguguccaaggucaugacccauuuuucugcuuauaccucccaagugcugggguuacagaccagguauggguuuaaaaaauucuaacuuccauaaugaaaauguaauauaaaguaugaccaggaguaaaguaaaugcagaacaaaauaugaaaguacacggaauuauuacugacuuuggguaguaacaauugaaaugauucaaauuuucugaauuaugagauuuguuuuccccuucuuguacacaugugaaauuuaaaacacagaaaccaucugccguuguuuuauuagcaguuggggaauaacaggagaacuuguaagagaguacugacaucuuuauuuccagccgauacacagaccagauuguggugcacacaaagaaccuucaggcccagagucuaaagauaaaauacaauagugauaaucugacgguauauuaagagcggaacaaacugccuuucaaguucacuugagaaauguaugacaaaaaaaaaaaaaaacacugagagggcauccuuguauuuaagucagggaaguuaacaaaggaagggcuuucccaggaagaaaagauaaauagguuuauaaaacuaaacugggagcuauaauagaaaaaaauuuaaaaagguucugaaauuuacuagucgaguugaaguaauguucaaaagccuaagguaucucgaaaacuugucuuaaguuuucuuuuuucaauguaacuccacuucccccaauacucuugguucgacaaagcugggguuaaagggagaggugaaacaccggaaccaaaacacaaaauuacggcuccaaaucaccgcuguaacuacuuaaguauuuauaauugcuaaaaucauucuucgacuguaacccauccuaaacccccgccccucucccuagagaauaaagcucccuuaagcccaacugagucccccccagcagguacaaagugccaggaaccgugucccgcccagcugucagugccuucgccggcugagaagucccagggagugaacuccggagcgcucagcgccgggagcacgcgaaagcgaggcucgggaagccggcugcgccccaacuccuuuuuguuuuguuuaaaucggccugcagagggaggagccgggccucgcccgcgggccuagucgccgggucaggccgagcagcgccucccggagccggccaaguccacccccaccucuuucgccauucaucgcuuccuccccucccccccaucaugugaccgcagccuggacgccaggcuuguuuuucccccuuagcgcagccccaccgcgcaccgcgcaggcgccucggagcccauucauucgaacugcguaacaaugagccccgggcccgacggcuccgcgagcucccccgcccggcccgggccccggaggcagcuucgccuccccggagcccccggcccgcuggagcucgcggccggcguccgcccucggcccccgcagcggggaguggcgaggcaaacuuuccggagcccuccggagcgccaggccccuccccugccccggccccuuccccgccggcccccaccgcgagcgccaccgagccccgagcuccgccacccccaccaccccgaguccugggagccgcggccguccaggcucggagagcucccgggaggcccggacggcggguuccgcgcaggggauccagugcccagagucccaagggucuccgcucucgcggccgcugcccggccccgaagcuccagccccucccuugcccaccccccaccccucagaaaccccgcgaccacacagagucaggacgcaggccgucugucgcgacagcgucgccagcugcuugccugcgcguuucccgacggcugcccaccucucuguggcgcgccgcgacucccaccgccgcguuuacuccucagccgaaacuuuccuacuuaccaaacccgucgccauuaccaagucuuucaagcuucgucuucccccuccccugaagcccccggggggcugagccuucguccaccuuucucgucuuuaauuggucugaagaacugccacucuaagguuccgccuuuccauuggaaagugccguaguccgucucggugggcgggcauguauugacuuuucucuuguguuuacuggagaagguggcuugucaaucacuacagaaagcgcuuuggauuggauugcugccgagacacgggggacgggagccaaacuuugcuaucgaaguggauuguggguuaguagucucagccuugcuccuuagcugaggaaauua

SEQ ID NO: 6627 - RNA, 1057 nt, Mus musculus
uuagggggcccaggcugcaggguggcagcccgcguugggcuccagguaacugaggcaccacucagugcccagcccgcugccugccaccgagccaucgaaaucagcaccgagaucagccgcaagauccggagugccauuaaggggaaauuacaagaauuaggaacuuacgugggcuccaugguguaguagauaaacugcgcucugucacaaaugagcucucuagucuaaagucuccugauacaagcaucuuugauaguaacacgccuucaaacaagagcaguuucagucggggagaugagagaaggcacgaagcugccgucccuccccuugcuguuucuaguucuagaccugaaaagaggaauuccagaguuucuacaaguucacaggagcagaaauccaguaacgucagacauucauaugauaauggagcuuccacacagcuaaugucaacagugaaaccucugagggaaccagcacccucugaagaugugauugauaucaagccagaaccagaugaucucauugaugaagaccucaauuuugugcaggagaaucccuuaucucagaaaaaaccuacagugacacuuacauaccguucuucucgcccuucuauugaaauuuaucgaccaccugcaaguagaaacgcagacacugguacucacuuaaacaggcugcaacuuaguccgcagcaaagcagugcucgcgcugccaagcagcuggauguacagagcagccagguauccgaagcaggauggcugugugagccaccagugcuuagcaguguggaagacacuuauagccccuucuucagaaacaacuuggauaaaaugaguauugaggacgaaaacuuuugaaagagaaaauugccugugguaaguucaguuguuaaaguaaaaagauuuagccauaauggagacgaggaggaagacgaugaggauuaugggacccagauagaaagcuuguccagcagcgugucaguaccagcaaagccugagaggagaccuucucuuccaccuucuaaacaagcuaacaagaaucuaauuuugaaggcugucuu

SEQ ID NO: 6628 - RNA, 33541 nt, Mus musculus
aagcaaguccacgcgccagggcaacucagaccgcaagcagcuccucugauuuuaaaggaaaaucuagaggaucggaauccacaagacggauggggaccaaagauuccauccaucguccaagcgggagacaaagguaauucagcgcgugcgggaacagggagacgacaguggguggcuccuuggccuuagcugguggcgugacuccaacaagacucucaggacgagcagggacuggguaggacaagaggaagguccggguuggggcgggcaaagagacucccggcaggaggggcgaggcugggaacgccaagccacgccccugcaucagaccacgccccucagaggcaggcgcccaggucacgcgcuggggugacggucggcuuuaggcccggggcgggcgcagcugaggcagagcgcgugccucacguccuccucagucccccccgccccugcgcugcgcacgcgcagccgugccccgccccuuguccccgggaugggcggggcgcggagccgccgggaaagccgccggagcgcgcugggcaggggagcgcgcuagccuccaccgccgcgucacggaccugcccgcccucccggccccuccccgcgcuccguucccugcucucccgccccccugcgagcgagcggugacuuaagcaacggagcgcagcgaagcccauuuuucuccuugcucgcagccgcgccgggcagcucguggcgcggcgucuccgcuccggcccgagaugaaugcugcggcagaagccgaguucaacauccugcuggccaccgacucguacaagguggaguugcgaugggggggggggggggucuccgggcccggggcggcgggagccggcgcggcgggauggggcagguggaggagccgcaacgcgguggcugaaggauggaggcgcgggccggaggcggggccuacgccgcggcgggggcgcggccggaggcucggcgggaugggcgcacgcugcagcuaccguagccgccggcggccuuggcucugggacagggaggacuggaugagaccgugggacgaucgggccgguuagguaacagccccuggcucggcagguacgguccugccccggggagcucggggagagguccuggcggugugccccucacccagccaguggucccagcgcggaggauaacccggccccgggagccgcgucugauucagcugucccacucggugggguugcauuuccaacucccuugcaccuagggaucauucacgugccugcccccugguugcagaggccagugugcucuggcucuccaggaucaacuacgugauuucugugaaauggaaagugaaacaccaagaguuaaaggaacuggaguuauaacccuggagaauuuguggggagaguaaaauggcacauugcuuuaaggugccuauugaguugacucuugcacuaauuccauuugauaugcaccuuagccaagagaggaaugaugaagaaaugcccgcccgccccccccccccauacacacugugaaaugaacugcacugaucuucaguuaaguuuguuagccaagacgcuuaaaagauaaaaugucagacuaguaggacccucgcgagaacagauuaaauuuuagcuuucaaguuuaguauuuacuugaacaucgugaugguuuugaguagcgauuuaggcguaguacucucgugguuuuguuuugguucuuugcuuuuuacuuuuuguagcccuguaaucugaauguuucagagucccauuugcuuacauacuaguuuguccuuuuuuuuuuuuuuuuuuuuuuuuugguaaacuauuguaaguaaguaauuuuucauuuuaaaggguccaagauuuaucaacagguggucuuucgcauggaauuucauuuuacuucauuuuaguuuuuugaggcagaguuucuguguagcagcccuggcuguccuagaaccugccuuguagaccaggcuggccuugaacucagagagcugccugccucugccuccuaagucauggaauuaaaggugugugccuccacauccuacuucagaugggauuuuaaaguggaaaucaccuuuucaagauuauuaccauuucuguugugguacuggaggcucuaaaaucucugcaugauguaguucaguugaaguguuuuggguauucuuagugauuuuagaaaagccucauuuuguaaaaguaaaauaucaguaaauaucccaagauaauuuucagauauuuuacuguauuauguguaaacgauugaacguaaagggaaauauaaacagacuuaaaaguccaggcuuaggagggcacauaauuauuuuaaucccaacacucagaaaccagagaggcaggcuucugugagguccaggcuagucugcucuacauagcagagaaggagcagcuggaacuacaggguuuaucaaaaagaaagcaguagcuccucccgccauugugagugccaagugugacacugcugcaggucacagugguguuuuggagauguguuuaguuaagaaguaaucuuaaagcuuucuaauguccuagcaaguccugcuuagcugagggaauuuuauuugcauauaauaaauuuuauuccugaccgguggucucagggggcuaauauuaaaguauuuauccuucuugucuuuuuaauccuagguagagagguagcaagagugcuaagcacgauauuacaaguaaugaaaauucuuucauuuggcaauuauauauucuugucagaucucaaaaauucguggcuguuuagaagagaguggcuggaggaugaagagauucuucuaaaauuaaagggaaaugguuuccuaaacuacacagcagagaaggcgguggccaagcauauagcaacaugugggauacauuuucacaguguccuuaagaaagggcaggacacucggggcuagugcaggggcauuugaagcacacuuccauuucugggaucucguauuucauuguguguaauaaggaccugagaacacaggcagaugcagcucuucaguuucaucuugaguuuauuuuccaaauaaaaagggccugcucuuacggcuucaaucauuuauauuuucagaauugcuuagggcacaucuccuacccagcuuuagugacauugcacuaacccagcuagggagaaugggugugagccacuccagccauuucggugguuggauugcauucgggacuuuccuguaaaggagacgugguuuuuccuuugaacuuaccucugggauaaucagaaauaaccagaaagcagucaaagaugauuuucuuuuggauuccacaaaacuguauacuuuuuuuccugaauaagcgccuacagcagagaauaguuuuaacauuuuuuucaacauuuuaucucuagcagauuagcagaagacacugucauugugcuauggcuggaaaagacagaauacacaaaaguaguccuucagcaguguucaggucucaucaccccacugagagaugugccgccaggguagcuugcuucucagaggcuuccuaggccucgacguagggcccagcacucugccgucauuccuuuauacggagugaaggaacccagagggaacaacauggcguuacaauccaggguggagaaagguugguuuuagggacgcuuccaagagcugccuaacuuccuuguggcaaugaaaccggcagacauuguguucgccaauggcugaggaacacaggaaguugagaauuauugcagaagagauuuggagagaugagaaucauaugaccagguugguucugacuggaacuuccaaucuuuuccucucacugguucccauuuuuuguaaucuccucuuccgugcuucugaguaaacacuacaggcuugggacauggguccauggcaccagcacuuaccacugaggaggggcagugcuaggacucagcguuuuggucuuuuguuguuguuuuuuuuuuuuucuccuguccuuaaaacacaugcauguagcagucauugacauaccucuguagaccuagcacccuugguuacauaggaaguaugggguagccugggcuauaugagaccuuguccuaaggaagagggugauauuuuaaauauauuucuccaaguaaguuuuauaaguuguaggggaaacuuggacaguugaaauaagacaguaaagcuggcaacaucagguaaagaaaggugcuugcucucaggcggggacccaaaugguggaaggagagaaccaacuccuacaagcaguuuaugcuucagagcugaauugcaacaaauuaucuucuguggcagcaaauuuccagggcuucacaaauuuuaaaaacuccugggaagcagauaacuuuugcuuuuuucccccauauauugcauuagcuguagugaagcagggugucagccaggauggggauaguagagccuacucugcuguagguguugcccauaugauggaacuuguucuguggcauugaauauguuagcccauugcauuuuaaacuuuggcucuuaauuauuucuuaccaguuaaaaauacaaguguaacugaagaagugggcaagugaguaccaguugccuuuggugauaugauaucaguuuaugaggaaagaucuugagaaaguaucucaggucaaccuauggaauaccuuaaaggagcaacuagagaaaauuacaccuaauuuccugucuuagucagaguucaguugcugugaagagacucugugacuguggcaacucuccgaaaacauuuaauugggguagcuuacaguucagagauucaguccauuaucauggugggaagcauggcagccugcaggccgacuuggugcuggaagagcuaggcuugauucaaaggccgaagaaggagaauuggguggccugcacccacagugaacacauuuccuccacuaagaccucaccuacuccaacaagguuacgcuuccuaauagucccgcuccggcugaccaggcauuuaaaugagccuuagggggccauucuuauucaaaccagcacauuccccuguaggauucugcuuacauuaagugugccuuuauccucaggccccacuguucuaguggcgcaaggguagaaacacuuggggauggaguguagucauguaguugcuuggcuaacagccuaacagccugcuuuggagaaagcucccuguguuaaaacauggaacuagaaccucuuuauucuagacaucgaaaguuauugucuagcaccuaaucuuuuagaagcguguaggaacuucuuuuuuuccuagcuaaaaaagaaaacuaacaauagauauguugccuccaugcaugucugugugccacaugugucccaggucccucuaaauuccuuggaccuggaucgacagagaguugugggcucccaggugggugcugggaacugaaguccaguucuuaaucgcugagccaucucuccaggcccugagacagcucaccuuuucaucagaaaagcaggugcagugaaggucuguuaaaggcuauauucacaggcuccuguguuccucacagagcuguuagccaccgaggacccugccaguucaaggaacgauuacuaguaagguugccugggaaugugaagaauuuucuauuucucauagaaucauuuuaucuagcaauagaaauuaaggcaguggacaaauuaacaggagucaagaucuuccuuuucauacacuuaacugagcacacgaaacugauuuaguguugcuucauguugaagacugggcucuugaucuucccacuuaucccucccauagucuucauugacucaauaaacgaacccuuuauuugaaaagaagcugaaguaggguuugaaacauaccugugguuggucuguuacucacuagguagcccaggcuggccuuccagcucaagguaaccuuccugccuucccugagugcuggcauuucaggugugugccacuacuccugguaaauggcaccauuguuaacccaguugcucaaccaaacucuaggagguauccgugaugucucuuugcucuccacauccagcucuaacccuucuuuaccuccagaaacacuggguaggucuuuuccuuaucugacuugugggcgguaacuucugaauuccugacucugcuuugagcauccaguaauccauguuucucuuucugucugcaggacugauuguuuuaugcuggugugugugugugugugugugugugugugugugugugugugugugugugugagagagagagagagagacagacagacagacagacagacagacuuucagcugugccaucuaucuucccccaaccccagacugggaaauugugaggagggcuaggaguuguagcucaguguuagagcauguucuuaccauauguaagagccuagauucaauuuucagcauuaaaaaaaauucgaaucagguuacaguuacccuggcuuaagacauagaggcuuccauugcaguuaauacacaaugggagcuccuucucaaccccugugccugugccugcgucugaucucuuaccuacaguuccaaggaccagcaacacaggccguuguucuguacugucccuuaggccgaagaguuuccugucuugucauugucuugucauuugagucuuguucacaugucaucaccuuggagaaauuucccuaggucccuucuguucucuccucaacuuuucauagcauccgucuuaaucuguaguugcuuggucugaguauuguuuuucucugauuagcacugugagaaccaggacuaugucagccuguuuuccucccuuggugucugaaaccguaaggccuggcacguagaacaaacagguugugagcuugugaaugaacugacuaguuaaggaugaagcucacucaccacuuuagcuggaaguaacgagggcagcaaacuaguaagcuagaccuguugacuguacucuuggaguaaucacucggaaacugcguaguacccguuagccauuguguauucccauauaacuagaucuaaucaucccuguauuauccuaauaacagcauguuguguucauagguuaacaguucucuuucaugguuaauuaccugucaauuugcagacauuuuaaauucuuaaccuguuuucucuaaaaaaaaaaaaauuuaauuucucuuaagauuguaaaauaugagucguuuuacuucagccuaugcaacuuugaaauaauggcaucuuccuuaaacauaggccacauucuguauauuuaggcaaaaguggguuguaaagcacuauaaaaaaguauccuaaacaaagcuuuaaaaauugaggcuguagacauggcucagcgguuaagagcacuaacuggcugcucuuuuaacggaguuaaguuccuagcauccacguggugacucaacccucuggucugaugcccucuucuggccuccccaggcacugcaugaaugugguaacacucauacacauaaaauaaauaaaugaucuuuuaaaaaaaaagaagaagaagggcauuaguuguuuuauagaaguguagcuaugaugguaaguuuuauuauacuuuuagacccugguagagcuaaaugacucagauauuuccauucaacuuuugucucuuuugacuuagccucguauauuuuuauguaugugguaugugugugcguguuugcaugcuucuuggauauucuguuuguacagacgugguguaugaacauguguggcagccagagauuaaugucugguaucuuccucaguuguucuccaaaauaacauugaagcggggucucccuugaacucagagcucaacaguucaguuagcccagccagccaguuuguucuggggacccugucggcaccucccagugaugggauugcagucgggccaccacuugcauuucuguaagugccaggcauccaaaugguccucaugccuauacagcaaguguuuccccacugacacaucccucagccugccuuacaaauuauaacaucccauaggagcuagauacacugcuaaguaguauauggacuacuaaacuccggucagggcagaugccgugagauacugcuaugacacugaguauuauaaagcauggucggugugguccagaccuuuauuucauuuucccuuuucuucuacuucagcuccgaguuacaagguuguagcuuggaagauauugugguuacaaauaucucggguauauuuuaagugugggucaucuuuuccccaguaagcuuaacuauuaacugaaaugucauuuauaaauacacuuaccuugggcuguuuguuuguuuguuaggcuggcugguuguugguuugccuggcuguagauuaaugaauggguuuaauuacugugguucuguuguagcuuucucccuuaguuuuuguagcuuuccuuaaacugacagugguaucaggccacaggcuccugugccuuuuauuaugguuuucugcugugucuaaacagaauggaacuguaggacccaggcucugaaaguccgacuucuguagagauuugcccccacacagcuuugucugugugcagcagaagggagcugccagccugccucgcugggaggaagcacagagggugguuguucggaaauaacaguggaaaugcauuuauuucagagggcuaaugcugagcuacgaagauucuuuaggauagagucgagcuucacugagaaugaggcugugcagccaaagaaacacuggcuuuccugaaccugaaaucaaagcucugcaggaaauucgguaucagcugugcucacccgugaagcuugguccgccauggcugugacuuacccuuguaccuuaaauucuaaaguuccucuuucuguucuuaccccugugcaaacacacacuucucuaguuguuugacaguaacuuuguacauuuucaaauaaauggcuuauuuaauacaauuaauugccuuaguaugacaaaaacacuauaaaacaaaauuaaaagucuagugaguaacuuuucuucaaauggaaguuaaguuuuuaacaguggccuuuaccaaauccauagaauaaaagcuguuagaagacuuucauguuuuuaaaccuauaacaguuaagaucauauagaaacuuauaguuaaaaagcaaugugagaaacaacaaaaugggagguuuugguuuuguuuuuagacguuuuacuacauuuuauguuuauguauguauagggacacgugugccuaggugcgcauguggaggucagagaaugaccugcagggaucucuucuaccacauguguuccagggauggaacuuagguugucaggauuguuaacagcaaguaccuuuauguacugagcugucucgacaacuccuaaaacaagcuuuguauuugcuuuucauuauuuugcugcugcugcugcugcuguugcuuuaauccagguuucuguagaacaaaauuguggcagucaagaacauccuuggugccucauaguugcagaaagaggugggucacgaggagacacugacuugacacauaguauugguauagguuggauguuuuagauccaaaacucaaacaucuugaguaggauguccagggucaagauucaaaacuugaccucauaaaacaagucacagucaaaauauggaggccaggaagauagcccagucagucaagugcucgauguacaagccugagacccggaguuugaucucuuaauaccugacaugaaaagcaaggcauguuggcaccugcuuacagugccagugcuggcaaagcagagaaaggggagggccccugagcuugcuggccagcuggugcagcagaaucgaugagcuccagguuugaugagagguacugucuuagaagggaagcagugaaugccugaggaagacccgaagucaccucuggccuccacacaccugcaugcacaugugcacacacaccacacaaacaugcacacagaaaugauaaaagcauuuuucauguaggcaggucuuacccccaaauacaaguacagucaaguauuccaaaaccccaaaucugaagugcccccagucucaggcauuucaccagaagcaaacaagugcacagccugugugcauuugcugccuuggucuguuggaucggguuguguaccucagacugcaagaaaggcugcacucuaagaccaagugggguccuuuccacccaaaggguuuuaagcccacuuaguauaaucuccgucgcuuguuugacgguaagaugagguaucaguggaaggaguuuggugaucugcuuguaucuugcccugugucaccagggugggagguugacccguagcaaguggaaaaaaaaguuucugauuuggaaaugauuggaaggcuugucuguggugcuuugacuguacugguaguguuuccuaauggaaguauuuuuucuuuaucuagguuacucacuauaaacaauacccacccaacacaagcaaaguuuauuccuacuuugaaugccgugaaaagaagacagaaaacuccaaaguaaggaaggugaaauacgaggaaacaguauuuuauggguugcaguacauucuuaauaaguacuuaaaagguauugcuuuucccaguccauuuaaaacacugcuuuuaugugacuucauauuuuucuauauugcuauguuauguuauuugaaguaacuuuuugaauaaucuaguuuugauauuuaguuacacuugauuaccacugccgguguuguuuggaagguuugguucugguugguuuuguuuguuuguuuguuuguuugcuuguuuugcuuuuuuuuuuuuuauuacaacaccuuacucuguagccuagccuggccuuaaauuuggugaguagcucagacuguccucaaauucacagcaguccacugccucagcuucucaaauguuaacacuguagugucgagcuaucaucaugcuuaacuacuuuuguaaaauguuuuugaucuguuaauuuaaaugcauuaaauuuuagaauuuugagagagugaguguguguuugugugguguuuuaagauggagaaagguuuucugaagcauauuuccaaaggaaguuuaggacagucaguaaucuucauaggucacucuugcuuacuuguagauggaaccauucacuaagagcuauuuacugugcacugagggauuuacuguuaauccagaaacugguuuugaauuauaguagguuuaacuagaauauuuuuauauuguuuccgauauauccuaaaguuucauuuuucaaaacuauuuauaauagugaauuuauuucuaaaugcaauucaaaacagaacacauacacaccccccaguaaugguggguuguuuguuugucaaggccauuuacagcauauuauguaauggaguuucuaggcaaagaaucagauccaaagaccuuauacaucuagaaguuucugaaacaaaauaauuucaauugaguauagauuaaguauaauuuuucugcaaaugauaauuauuuuaaggucaaauaggucaggcaugcugcauuacugaaaacccagcaagguguaaaaguucuacuauaugacaaagagacuacacaggguauuuuaaaugcaggaguuuauauuuguuuuuaaagaucauaaauuuuuauucaguucuguaacuuuguaaguuauuguauguaaguaguauucuuacacuugcuguacugauugccaacuuuguauacacaugugcacacacacugcauugauugccuacuuugcacacaugugcauacaugcugcauugccuacacugcauaccuauacagacacacaaacacgcgcucacaugcaucugcacacaugcuacauugguugccuacuuuagaguacugcuucuuuaacuucuaccauuggugauuccuucuuaaccagaggaauguuuacacaauacugaauauauaaguagauaaaacagauacacaaagcaaauauuagcugauuuuuaaaaaauuaaaaacuucauaauacaucuacauccaauguuaccuuuuauuaaggacgaaacauuaauguaccugugcuuauuuuuaccuaaagaauuaaaucuuagcugaauaguugauacucaagaauauagagaaucuucaacauauuuuaaaguucaacauuuugauuuucuaaucaccagugcuaagacugugccacuucauauagauauguaguacaaauggcugaaguguguuuagggucauuucauaaauuaaugggaguucuguucuaaucucaagcaaaaugcauagaggaauuuuuuaugaaagucagacuagcaacuuaaacagcaguuuuaaaaucaaacacuaacauaauacaguacaaauguacaguagcuucaacuacauacuuaggagaggccauaggaaaacacuaaaaauauuuucugugcuuaaaccguuguauuucuguaagggcagagaauuuauuguauauacaguaaaaauacugcaguuuguuucagagcugagcaagauacuuuaggcagcauuuguugacauuguacggugugacagcaaagugcacauguguguguucagaccccacuggauagagcugcgugauccaacacaggugaacacugccacaaaguaccuugaugucagugcuugguuuugaauuaacuuuugaugcuuguacauucagaagguuuuacaguugucauaucuuuauaaaaccacccaccuaccauuuaguuucccauccuucucaguacuuuuaagaaauugcccuagaccagugugugcuaaauagcuguguaucuuaaggcaugucuuucuucucaccauccuguaaguagauacugcaccccagccucauuguacagacggaaagcuagcuaaaaaugagaguggguagaaauuugcuaauugugaaaauuacugauuccccagccccagagacauugcugaagaaagcucaccuggaaaagaagcuauugcuuuucuuacguuuauuuuguuuugauacuauguaagcuguuguaauccaggcuggcuucagaacucaggcuucuccugccuuggcuucccgagugcuucauucaugagccucaguggcucugcguggcugcucugggcuuuucaagcagaugaccguuuaugcucagggcaagggcaaacucccagaaguacaggcuccuuuucugaaccugcuccugaccugguggaguugguucauccucccugugccuuucagucaugagcugggugagagagcugagaacccugcugaggugacucggcaguucaaaacguaacgcgaccucugugugcuuucagguaaaguagugaccaaagagaaaauccaggaggccaaagaaguguacagagaacauuuccaagaugaugucuuuaacgaaagaggauggaacuacauccuugagguaaaaauggcugucaguguuuauguuuuauuuuugguuuaauucaaaauuucuugccauggaauuugaauagaaaauucagcuauaacuaacgcuuuuuguugaugaucucaauauaaugguuauuuuuagauauacuuaacaaaaaucuguaaguaacaucucguuuucuccuguaguaugaaucacuaaccaguagcuuacaguagaccuaaguaauaagcuaugugacuuaaaauguaaauaacucauuuuuuugaaagauacuuuaauacauuucuggaaaacauaucuuagaaaugggaauagacuaauaauuuuaaaggguaugguuacuucgcaguuucagaauagaaauuuauuacaacauaauucugggaacugucucuuaccaaguagucaguggaaauacuuguagcuuucaugccuauaguaaaaugacuuuuaugcuaaaaugcgguaccugugggccuuugauaaagucagagccauaucauacugcauauuugaguaagugugccggcugagcuaaugugcguuugcugucacucccuucugggagagucucugugaagauagcaugcagugacaagucuguaauuucuaguggucaguauugauuguguaugcaggaaaucuucggguucacuagacauaaucuggucuggcccaauuuauagucuggucuagagcuguuaaaugaccccaaggucuuggcagugagguugagaucaaaccaggauguguaagcagcauucugcuacaucaugaggccuccaguguuuuucauugcaaauaguuuuuucucacuuaaauguugugccuugaaucauauaaacucuuaggguuuccuaaaaucuugccuucuacacaaggguuaacuguagcuuucagcuugagaaaggaugggagggggccacuggccuagguaguuuucuguuacugugcuaaguaagacccauaaccaaggcuacuuacagaagaguuuaucgaggcauuccauuucagaaguugagugugaccaucauagcagggaacugaugagcugaggcuaagagcuuacuuacauccuucuccacaaggcagagaaaaaugcccaccccacccccaaaugacacaccuccaauaaguccauaccuccugauccuucccaaacacuuccacuaucugggaaccaaguauucaaauacaugagauuuggggggaggggcgggggggggcuauaacuuagacuugggcauugcaugucagggucucugugguuuuaaaagucuauugccagagaacaaauaagcuuacuuaaaauucuuaaguaguuaguguauguguucucuaacacuaguauuuagucuuuccuucuuuuuucaucugugggaaggaccuaugucaagcaaguuguuuuguaggauauuuuuagagucuguuagagugaacuuucucucuuuucugaacaagucaggaaaaaugcuguuuugauccauguuggucguaaaugguagguguucuuagcagaaacagcaugaauuuaaagaguuggauuagugccuaaauuguuaaucauuuuaacucacuuuagaagcugcaggauacacucacuaacuagaugauugcuaaugauuuaacaacaucuauauuuucuacagugccaaaauuuaguuuccauaaaauguaaaaacaaaacaaaaccaaaaaaaacccaacucaauaaaacagucaacugaauuucggccuguugaaugaaugaauuuauuuuugccuccugccagaaauacgauggucaucucccgauugaaguaaaggcuguucccgagggcucugucauccccagagggaacgugcuguucacaguggaaaacacagacccagagugcuacuggcuuaccaauuggauugagguaaguaggguuuuuccuucccuccccgccccccagaauuuuucugaauucugauuuuuggggguuggugggggucaguugguuugguuugguuguugcuuuugugugugaguaaagauaagagaucauugaacuaagaaucuggaguuugcuccuacugaaaaagcugugugaucuacaguuaacuucuguuuuagcugccuuaucacuaaaugauacuuuuagguucuuuuaaugaaaucugaucuuaggggauucugucuaaaucccauuacugauacugguuucuuaaagcucgcuugacaucuacuuacaauuuuuuguguguuucuuuuggcacugcuagggcuggaauccagggcuuagugcacacuuggcaacucucccaguaaacuacacgcccugcucuuuuuucaaaaagguuuuugaggcaagguuucacuaaguuaccuuaagucgcaaugaaggcaggccuugaauugacuguccuucugccucugcuccacgaacagcugcugcaccaggccagcuaaucccuuguccuucuccacuuaaacuagcuuagagcaaaaugagaaaaguagcccaaguucauuuuuaauaacuacagacuacuucugguggacauucuauuccaauuagagucaauucauucacucuguguguguguguguaugugugugugugugugugugugugugugugugugugugugugugugagcgagagaagguuuucagcuucuaaauaucaacaugauacuguuuaauuucuaaaucuaagaaaggggcauauauguagucugggauuugggguggggcagggaugcugcuuaaauauaucucuuaaguugguaaugauaauacuggcuucuugauggauuacuauaaaguuaucuguagaggaaauaacccagcaagcaacaauaaagcaccauauugcugggagcuggagagaugacucagugguuaagagcauugacugcuauucuagagguccugaguucaauuccgagcagccacaugguagcucacaaccaucuguaaugggaucugaucaaugcccucuucuggugugucugaagacagcuacaguguacugcucuuauacauaaaauaaauaauucuuuugugugugugugguuuuucgagucaggguuucucuguguagcccuggcuguccuggaacucacuuuguagaccaggcuggccuugaacucagaaauccgccugccucugccucccgagugcuaggauuaaaggcgugcgcuaccacgcccagcaaauaauucuuuuuaaaaaaaaaaaaaaaaaagaaacguaccacacugcugaacgguguuuacauaguuaacaucaacauuucaguauugaugaacguaacuuguuauacugcagaaaauaagauuuugaaaaacuaagacccaggaaaauaaauuuuacgaaguugacagagaauuuaaaauguuguuauacucuugaugggccaucaacuaguggcaagccuaaaaaagcuagaaaagguauaguaggcuaaaauacaaguuuuaaucgucuaucguguauaguaaagcuuucgauuaacugugaucuggaagccggugacaaggaaucuuaguguguguucagagauuuugauuuugaaagacuauaaaaaccacaaaaguaggagaaaggugaagggggcuggguuuuggugguaccggagauagagcccagagcacaggaccucauacaugcuaaacacauacuugucgcacugagcuguacacugucucagugugcauucagacuagcacuuuauccucaaagcccaccaagcgcacggaucccuuuuaguuugcagcugaguaguccaucacuaguccaggugaggaguccuaugguuagguggacuuuccaaagggcagguaaagaguagagaaauggagcuggaggggcuuagugguuacagugguggccacagucuuaaaaacaugggaguccagaucuucccuuuguugaucgucuucugagagugacucuuugguguuugguguauuuuacuaagaaacuacaaugugaagaaaaaaaucuaucaggcagcugagaguggagguuaauaagaguauuugcugugagauuccaaagcccauuguccaguaaccacauaaaaauccggcaaggcuguacacaccugcagugccaaugcuggcuagagguggggagacagacagggaaauugccagagcuuacuggcguucagccucccccaaaaucagugaguucuaguuucaaaaaagaaauauccaucuccucaaggggacaaggcagaggauagaagaggacagccaaccccaccucuuaccuucacaaaggcacacagauugcuaaacauaaguacacagucauuguaucuuuuuuuuuuuuuuuuuuuuuuuuuuuugagaaaggguuuaucuguguagcccuggcuguccuagaacucacucuguagaccaggcuggccucgaacucagaaauccaccugccucugccucccaagugcugggauuaaaggcgugcgccaccacugcccggcucauuuuaucuuuugaagaaauuuauccccauuucaccagucuucagcucaguuucccacuguguacuuaaaaucuguugccagacacggaaaacacuacuuacaaauuuggcucuuccuuuaaaugauuuaacauaacaccaaaauaguugaauuuuguuucagaguguguguuugaaauaaugagugaccggcaugagcauuggugccgggagacgccuugguccuuccaacccagauuuccagcuaaguuuaagagaggcuaggagcucugcagaccgucucaggcauacaaaggggcugaggaacaaucacauuaaaaagaugauuuuuaaaagaucacaguuauaaaaugccauuucaaagauggugagacugaggccugccaggugagcagauagagcagccgcgccauuucaguuaugcaggugacuugguaauaagcacuucugaaaggaaaguucuccauuuucugcuagacacagucuugaucuguguggggauguugcgauguucuacaucuguagugcauagccuauccaucuccucauuggacuacaucuguagugcacauccugucuaucuccucagagcucacugaaguuucuaagaguccagauguacaggauaguccuucuaaggaagcuaugauuuccccagaaggagcccaguauuuuauguucauaaugugguuauuuuuuuguuacagacuauucuuguucaguccugguauccaauuacaguggccacaaauuccagagaacagaagaaaauacuggccaaauauuuguuagaaaccucugguaacuuagauggucuggaauacaaguuacaugacuuugguuacagaggagucucuucgcaagagguaaggaaccagaugagccucauggaauacaguguggacugucaguguguguuagcuacuucuguugccgugagaaagcaccaguaccaaaagcaacagaugggagguagguaggagagccugucguggcaggaggugaaacagcaggaacaggaagccaagagcuuacagcuuccaauacaagcaugaagcagaguaagaaaacuggaaugccaugaggcuugaaacccuugaagccuccugcagugaugcacuuccuccagcagguuguaccugcuaaaccuucccaaacgcaccaccaauuggagaccaagugcucaaauaucugagccuguacagaacauucuugucuaaaccgcugcagugagaggccucucaaccagaauuaucccugggacugagcuugcuuuaaguaggccauuucuugcaauucuggaggcauagcaacagaugccugcauaucuauugugugucauccuguuccuaguacauggaauauaccucucagcgcauguuccagugguuauguguuagaugggggcguagacagacaggggcagcagaugcugaugcagaacagcgcaaggguaaggacacugggaugagguccgaaagugggaugaggcaggugggaugaagcacgugggcugguauguuccuucucugaauuucgguuuguguuugaucuuccagacugcuggcauaggggcaucugcucauuugguuaacuuuaaaggaacagauacuguggcgggaauugcucuaauuaaaaaauacuaugggacaaaagauccuguuccaggcuauucuguuccagcagcagagcacagguaaaauugaauuuguucuccucgaguuugcuaugugaacacuugccuugcaugcacacggcccuggguucuaucucuggcccuacaaauauacaaaauggcuuucuaaaacuuguuugaauuuguuauuuauaacucagcaguacacagagccagaugcuaaauaaccguucauggacguuaaaaauuggaugcgcacacacuuuuuacaaagauuagcauccagcaggacuagaauuucccaaaccuuucuaguaguaaaagaauugaagaccuuuccuaacauuuaauaguugccauauugguuuuauuuuaaggaauggucuuucauuugcuauagugcauaugcagguagauuuuucuucacuaagugaaagcugggaauguccugaguccugcuuacuuacccugcuuuucuauguagucucacuugucugcccagaaaauugucaucuggacccuguaucuucaauucuagauaaaaagccauuuuaauaaugauaauuuaaaaaggaguucuguuucucuaaugcucauuuauuuguccuuacuaaaccaaagguacacuaggaaauuacaauccagguugcccccagucuaguucuagaguucccuuuauaagaaguaaacagcguauauaaguaauaaguguaugucucuaucucuaguucucagcuuccuuuccuauagucauucaggaaugcguaaagcucuguguagguuuggguauauaugaccugggccucaucacucugauacauaauaacucaccagcuuucauauacaaggcagucugcuuggugcugcaagggacagaaagauauaaagcugacccucucaagauaaaaauaguacacuaguaacagucugcucuguuugcuaagcauuuuuauuuaaagaagcacaauuacgguggagucgucucaaacuaguugagaaagguucguguucauuggccagcucaaaaaaguuuuuauagggacaguauauagaaucuugauuucauaagggaauaguuauguucaaacuaacuguuaagauucucauuccuugagcacauacuaauaaaaagaaccuguagguaaacuacaucacugccuguuacuggacauuuuaagauauaagcgguauauauacugugauaaaguacuagauaacugcucuuagaucaaagauuucacaagguaaaaaagacagauauaugucuuuugguauacaguuucaggaauucauagaaaagaaccaaguacuagcauugccaagcaaaaauggaacuauauauucacccuuucuagcaucugacauguaguacagaaggcuagcuacacgugcuuuguagcucacugaguagauugagggauaccaaaacaaaaaccaguuuauuggugauuaaugauauaagagcuaaguaguaauaacuacuaagcugaauauaaucaacuuguaauguuaaaaacauauugaccaaggagugguuuggcccaaauauuucacuccccuucugauguacacuuacuaaacuggaucuccuuccuugugacacuaaagaggugcuauaaugaacaggugguuaaugauacuucagaaauaggucgugugucugccuaauaagucugucucuucauuuugucuccuaguaccauaacggcuugggggaaagaccaugagaaagaugcuuuugaacacauaguaacacaguucucaucagugccugugucuguggucagcgauagcuaugacauuuauaaugcgugugagaaaauauggggugaagaccugagacaucugauaguaucgagaaguacagaggcaccacuaaucaucagaccugacucuggaaauccucuugacacuguauugaagguaaauuguaguguguaucauuaggaugccuggacaccagcuucuucccugcucauuuguguauacaucaguucaaggcucucuggaaaagucacccauuuuucagagagggagagcaaaagauuugcccaaggucacacauuaauugcagagaaaggauauaaagaugagcuuauuuauauauugucaaguagacaauugaggacugcuuaagacuuccuugucugcuuucagaauuaguagcauuaccauccaucagacuacucguggcuuaucccauguauuagaagucguuguuacaacuuugaagguguuagcauguguuccggguaaugaggaauacaggucauucagagcugcauuucagguccugugcggcuggagauacacugcuuaauaagcagaggcaggccuucgugguggucagggccugcuuuuccuuuucuacagaguauucgccacagcaggaguccauugaugccuucuauuagagaaccaccgugugugcuucacaccaaaguguuugcuuuaaucuuaucagagagagagagagagagagagagagagagagagagagagagagagaggcuuucacucucugcuguaaaggaggaagugaccugccgagguugagaaacauggaaaugggguccuagucagcuaaggagcagcugguaccucauuguuaacucuaggaagugggagcauagauuacaggagcucuuuuuuauucuguauucagcccagggucggaugccuuagccugaaguauuucacuuuugacaaacuaagccacuauuacaguuccauugugauaguuauaagaauaaugaaagcuauuuacaugggcuuuuucauuaggaucuuuaagcaguuuacaucagggaguaauuguugucugaaggggugugucugauagcuccucugugucuguguuuuccugaacgaguucaaaucuguguuaagugucugagcugcuggacaaucuuaaguggccgucauuggauagagugacuuaaguacuacccguguuagcauguuagcguuggggagccaagagcuuugggcagcuacacgucauacacacuuggcucuuacugugaugguugcauuucucucagcauuguaauccaaaugucagacacaaguaaagcaagcagaauaaacccaaaucaaaggcaucauuauugauuugcugugucacucccuacacuuucuuuuaaaugugugcugguuuaguaguacggguuuguuuuuuucuugaaucuguaauuugaaagauguaaaggaaaaccagcguguucugugcgacuugugacauaacugaacgaggaaagaagagcacaccuguuucugauaugguuaaaaggaauuggaaacaaacuuuauaugauuuuauacauggcuuaagauuaagugguugaauuuuuuacuucucaaaauuguuuuaacaaggaaaaauauuuuuuagcucagggagcaccccuacccugucccaguuuuaguuacuaugucauguguuuuucucacacaggucuuagauauuuuaggcaagaaguuuccuguuacugagaacucaaaaggcuacaaguugcugccaccuuaucuuagagucauucaaggagauggcguggauaucaauacuuuacaagagguguguguuuuacaugaauguuccaaucaugaaauccccauucuugaaacagcuuuuuauucauaaacagccuguuaaauuuuaagugcaauugugagucuuauuuaaaauauuuauaauggcaaauacuuuugguguaguacuuaaaguuuagaaauaauaguaccuuagaauacugaaggggcagucaaagcauauuucuccaggcuucaccaccuaccuucugacaggauucuaaagagaaagaaaaauaaaggcuuuuguuugaagagcccaagaguauguguaacaauuggugcucauugcuagaaugacagaaucuaacuagauucacuugcgaacagagucccaaagagggauuaucuaggccagguugauguaugagcuggugggguguaguuugaucacauugauugagaugggaagacccacccauuguugacaauuccuuggguuuggguccugugcugccuugacuuccccauggucccaugguaagggacuguaacuuggaauugugauccaaauagaccugccuccuugaguugcuuucagucaaagaaacuauaaggcaguaugacuucaagucagugcccagauuacaucaauuucaaaagauugauuugaaaaugauagcuuugauguguaaucauauuuguauggucuccuguguucccgagugaggggagguaucuggaguuuggcgggaacagaaugaggguacuucucccuacccucccaaacuaccuugcuuuagugggaacucucucagcuuuaagacacugggucuugggacauuagaagcuguuguaugagaaggacuaaguauugguaggacagcuuacaggggauaguagagaaccuugaguauagaaauuggggcuggcacauuuacuuguucuaaacccccucagucaccuaccuuucucaauauagcccaggccuaccucucugaaugguacuguucacagugugaugggcccuccugcaucagguagcaauuaagaaaaugucccauaaaccuggccauagacaauucuucaguugaaauucccucucccuguaacucuuagcuugugucaagaugacaacugaagguaacugucugugacaaguaguuuucuguagauguaaauacauucaccgguacaggaagacuaucuuaaauugguacucaaagcuaagcagguagaauaaacccacacuuagaggauagagccugauuuuuuucauguuggaaauaagucucaugugcuuucuaaaaggcaaugauauucauccuaacaguuucucucuacauacgcuaaacagauuguuuaauugugguaaaauuggggaggggugcuucauuuaacaagcugccaccuuuccuggacugccagccuccccuuacuccuacucccugucaacauucauccucccuagagcauccugcucuagcuucuacugucaagaagccaaagaucucaugugcaguagacaaaacagcguccuguuucuguuggugucuugggacuugaucugcuuggcugccaucaggucucuccacuaggaugacuuccuaaugacauuuaauaguacugacuccucaacauucaucgaggaggauuucuuugaugucugaaagaugcccaaggcuuucccucccuugagcugucccgaauccuuaucuuggaacccuucugucuacaucucuuggauguuucuaugacuugcucuggugaggcacagcacaggcuuccugaccacauagaauacugccuuccaucaggcuggccuaaguugccaaaaacgucacucggggaauccaauaagcaaucuuggucacuuaaguaaguuuuauauugccuuuuuuaccuuugagaaguauuugucauaaagguguagaaacaggcugucauuccuuccuauuuuucuugcuuuggguuuaauaguuguucauaauuagugcugaacacuugauuacagauaaacuuauggaacuucuagcuguaaaucuagaauucuugagcuucauagcucuugaguuguacuuacaaauguugugacuauguguauauauuaguucuuucccuaaguauaagcacuccauguuagaagugacuuugaauuauugauaacauuuuguguuugauuuuuauauaacaaguuauuaaacauguuuuugugggaaaaaaagugaauuacaacuuugauauaaaugcuaagaacaaauuacuuuuuuggcauacauaauacauaacaugugaaaagcacuuauacaauggagcaaaacuaugugaaugauauuagcagauaacuaaauccuaagggcuccugagccaacuuaaauauauaugaaaguucuguaugaaauaugaaaaugguuuaugaaguaagaguaauaauuugcccacuuauuuacacuuugauuuauuuguggguguuuuuugacuggcacaaagggaugugaaauucagcucuccuuuucaugauuguaugacgcugggugcggagucugaagcccuuuacucuccugccucuccauggggagcagccuucucccuuuucucuucuacuugcauuuauuuuguacugaaauucacuucuuucauagucaucucagugaaaacuguuuaggggccuugguuaccuuuggguuuggguaaugggggugggggcuguuugugaccaccgcagcuuacagcaauucucaggaggcaagaagcuagaucaguucaacacaacuaaggaguuguugauuuagacuucaagagucugacugagaauuuuagaccuuauuuaaaguacagcacaaugugaggaaauauuuuucuggcaauacgaacucaauccuaagacacuccuuguaaguacuugugacaucuuucauaaagaugagcucuauaaauuguaaaacagauaaguucuguagaugggugagcuuauaguaagguucugggaaaggauccaguguggucucagccccacaggaagugcagaggucacugggcugugaaccacauuugcuucuagccuucugggcagaaagcgggugauguuccucucuccaacccuguguguuuccaugccgguuccccuggcuuaccugugaacaugaggauucccaugccucccacagagcacaguaauaaauagacacaagaccagauuucuauaaacgauaaaggaaucacuuaaauaaacugugauuuuuauauuaauucuuacuggaaaacauuuggcuuuaaaaaaccuacagaaaaauuaaaugguuggauuuuugaaaaugauuggauuaguaacucaugugcuauuugggauuuccauuccuuuuacaauguugaaaaucaaaagaaaagaucaauuugagacuuaguuguucagagaacauauaaaugauguguggggagaaugugaaaauuacucauuuugagggagguugaaaugaccauugucacuacuguuacccauaaaaaaguauuauaugcucuugccaauuacauaucuguuaccuggggcuuauaauaauugucacauguaguaacacagugcacugggacuuauuugugaugauuagaaaucccuaggagcuaguauuucagccuuguugaucacguugggcagugauguuugaggaggcuagggaagagagcugagagaaccuuaaguguacauagccagucuucucacgacucuccacucccacaucccaagcacagugcccacugcaggggaaauccccuccucccacgcacccauguuaacgccuuucgcgucuugagugggacuuuagaaagaaaacguguucuauugucugccuaggccuguaaguaucuaagugcugagugauacaaagccgcuguaucucaauacuguccuuggagagcaagcucuaucaucuuuguuuuuaaucuucuagauuguagagggaaugaaacaaaagaaguggaguaucgagaaugucuccuucgguucugguggcgcuuugcuacagaaguuaacccgagaccucuugaauugcuccuucaagugcagcuauguuguaaccaauggccuugggguauguccuucagcuuucuucuccuugcuucuguguaucuaggaagagugcagugagugccacagucagagggcugucacauguugauggccacuaccuaacuuagaaacaagggagucagcugguaacaagagagacaugggaaccaauaaacugaaucauuuccgggaacuggagagucauucccaguguuugguauauuccuuuguaugaagaagcugguuccauuuggguaagauuaagguugucagcucgccuggccaucacacacuaaagaugaucaaguaugucacugucaagacccuauuaugaggguggaguuugagcuucugguuuugauaccagaauuauguucaguggccguaguauuagcugggcagccaccccuuucaucuuucaucuccccucaaaggcugagugaggagucuguggaguaggggucaggggaagcuaagagccccaaagaacagagcaggcaugauggcucagcagacagaggcucuucuucccaugccaguucaauccccagaacccacauagagguggaggaaaacccagcuccauagagcugugcuuugaccaccuucacauacguaaacaguacuaguaaguaaauccugaagaaacccugugugcuguguccaccuucuuuguggaguccugagacugucuuguuucuuucucuuccauugcuggugccaucugcuugaguuuuacccccaccuuucugguccuaaaauacuucagauacuuuaagucauucuguuacuggucugagucagggucuugcagugugacagugcuggauuagaauuugcagcagcccuuuggucuguguuucacaucugugccgccaugcccagcagguucuccaacugugugugcgugugugcaugcaugugcacgugcacacguguaacugugcauacauugccucauucauauuaggccagcaccccaccucugagcuguaucuccagccucuuacuaggauaaagguaagaaguaaugaaagaggaagguuagacgacaagagugucuuuaucuuaaacacccuaguucucucuguaguuugcaaacacaucuguuauguaaggucgacucgauacauuucucuacaucguccuauaaaagauagccaagauuugggcucccacagcguggcuauuuugaaggaagcaggcuaacuaaugaguuuuguuucuaacagccaguuguaggcugauguaguuacauauucaacacuuuuaaagcuugagucuagcuguggcccagccuugugugugcaggcaagagcuccagcacugagcuguguacagcacugagcuguguacaugcuuuagagacacucagugagagaugacuuaccacucagugagagaugacuuaccauucagugagagaugacuuaccauucagugagagaugacuuaccauucagugagagaugacuuaccacucagugagagaugacuuaccauucagugagaggugacuuaccauucagugagagaugacuuaccacucagugagagaugacuuaccauucagugagagaugacuuaccacucagugagagaugacuuaccauucagugagagaugacuuaccacucagugagagaugacuuaccauucagugagagaugacuuaccauucagugagagaugacuuaccauucagugagagaugacuuaccauucagugagagaugacuuaccauucagugagagaugacuuaccauuugucucuuaauuuggauuucucagguuaauguguuuaaggacccaguugcugaucccaacaaaaggucaaaaaagggccgguuaucuuuacauaggacaccagcggggaacuuuguuacacuugaagaaggaaaaggagaccuugaggaauauggccauguacguaucuguugacugggauuuuuaaaacagucgugaacuggauuuacaaauuaggaaaagggagucuuguguuauucuuucaaauuguuuuaagaacagugguaccagugaaauacuuuuuuuccuuuaccgggcuuuuguauauaugguuuuaaucuuaccguaaguuagcagugacuaauuucuggagaagcauagcagcagagaauacuauuagauguugcucuuggacuucacauaacugucuguauuauaguaaaauacuguaauuucauaauagacaaacuagccaaauuccaaacacuuugaugggaaguguuucuuuacaacuuaauaaugaccacucggaagguuuucuuuaguguuaauugagucucagggaauucugagcuaaagaaaauagauaaagcaaguugucuuagugucauagaacuggaguggguccuuagauuauauagcugaguuuucuuccccugguuaaccagacugaaaagcugaaguaggccaugugaucugaugguuuucagcauaaguacacuuaacauuugugaucugaaagguuaaaagaucucuaagccacuagaugggggggggaggggccuccaguuucaggggaaaaacuucucaugaguauauucuucaaauauaaguacacauuuacugauaguauguuuuaauauugugcaaaucugacugcuuacaacaauuuuauaucauuaugccuuuuaagauuugggguuggaauaaaauaauccuucuaugaaaaccauaugaacugguagaccagaauuuuagaauuaaaucucuguauguugucccaguaaaucuuugaguagauuuuacaaggcaguuggagcuaccaagguucugcuguaugaggccaucgaagacgcagcagagcccugagacuaagccaaaggaaacuugccagugcucgagagcaucuguccaguguccuagugaccagucccaagcuugauggagagucccugugaucauggagacauuuugguuaacgcguaaaacccagcauuuucugguaguuuauauugaaacuuacaaaagaaaaugcuacaucuagaacacuaauucggagcacacaagaugccagcuaacaucauguguacuguaagaaagaacauuaagaugaauuaaaguagacuuuucauguagaaacuagacuccucguggccucagggaaagugagcccuccuccucuguugaugcuucuguguggcuuugcaguuacagucuauguaacucggucauauaaaugagacagaaauaccugcuuuucuguuucugucuuggguuggguuuuuggauuguauccguuuuuaaggccaaaauuuaaggacaacaaguuuauuaaacuuguagauuggcaggucuaggcaauauuaaggcacuuggccagauccugaguaauaauuaccaggacuacguguaguucucccaagcaaacauuuucuucagcaguagaaaagaugaggcaucugaugguuugccucucccuuuaagaaaaccagucuacgaauguuuaucauaaccucacucguauugacccuugacagcuuuguggauuugaccucuuuaaguaaauuggucaaagcaugaucugaauauuugguagacggucuuuuuaauaacaaauuuuacauucggcaggaucuucuccauacgguuuucaagaaugggaaggugacaaaaagcuacucauuugaugaagucagaaaaaaugcacagcugaacaucgagcaggacguggcaccucauuaggcuucauguggccggguuguuaugugugcaguguguguauacauacaugcacguaugugugcgccugugcguauguacuaacauguucauuguacagauguguggguucguguuuaugauacacugcagccagauuauuuguugguuuauggacauacugcccuuuuuauuuuucucccaguguuuagaugaucucagauuagaaaacacuuacaaccauguacaagauuaaugcugaagcaagcuuuucaggguccuuugcuaauagauaguaauccaaucugguguugaucuuuucacaaauaacaaaccaagaaacuuuuauauauaacuacagaucacauaaaacagauuugcauaaaauuaccaugccugcuuuauguuuauauuuaacuuguauuuuuguacaaacgagauuguguaagauauauuuaaaguuucagugauuuaccagucuguuuccaacuuuucaugauuuuuaugagcacagacuuucaagaaaauacuugaaauaaauuacauugccuuuuguccauuaaucagcaaauaaaacauggccuuaaccaaguuguuugugguguuguacauuugcaaauuaugucaggacagacagacacccaacagaguuccgaacaucacugcccuuguagaguaugcagcagucauucuccguggaagagaagaaugguucuuacgcgaauguuuaggcauuguacaguucugugcccuggucaguguauguaccagugaugccaaaucccaaaggccuguucugcaauuuuauauguuggauauugccuguggcucuaauaugcaccucaagauuuuaagaagauaauguuuuuagagagaauuucugcuuccacuauagaauauauacauaaauguaaaauauugaaaguggaaguaguguauuuuaaaguaauuacacuucugaauuuauuuuucauauucuauaguugguaugucuuaaaugaauugcuggaguggguagugaguguacuuauuuuaaauguuuugauucuguuauauuuucauuaaguuuuuuaaaaauuaaauuggauauuaaacuguauggacaucauuuauuaauuuuaaguuaaacccucaguaacuaauauuuaaguaaguucuugauguuauccccaguggaaagccugauucuuaauagaagaaucuuaauacagagauuuagcuaaauuuaagauacucauccucaaaauguuuauagcgauuuacugcuagguccugagucagccauugcacucaacaagacaccagucucuuugaggugacuccuaggucaccuguaggugacacuacacaguucuaagccaagguuggccagccaacuucauacugcuucuucauuuuuaguuacacacugucuaaggauguuucccacuucgguggcagaaauagaguaguuacaauagagaccagauaguccucaaagccuggaauguucacuaaacacaaucacagagagcucgcuagccuguguucuaagaaaaggagcaugcguuugcauuuuaagagagauguugguuuuucugggaagggaggaaguugaauuuuacagaguaccucuuguucuuucucauuuaagaaucugauaauagaaaacugauuuagaaaaguuuucacaacuugccauuaagauagaauauuaaaagccauacaucauguaaaacaauuucaugaggaaccauaugaggugaauuagagggguuagcaggugauccuaagacuuggaacaguaagcauuacucauuuuuaguaaucuuuauuuuguaauacaugaaaaaaaucuuaaacugacuuuaaaaaguggaacuugaguaguguggucaugguguauacacuacaaugccuguaaucccagaaaugagguagacacagggaucggaaaccaacaucauucuugacuacauaacaaauuuuaggcuagcccgcacuaccuggcucaagaaaaaauguaccugagauuaguaguacugcagagacauguccugcauggguauaggcauagccaguaccugagacuuuauacacaggagguuuguuaaguucaaaaccagucugagcuuaaauagacccuugagucuccuccucuucacaaaggcuuguagaguacuacacaaaacccauuggugucauacuacaagcaguguuuuuguguugugugaauuccaccggcugcacaugccaguuuuguuuagaagcauguaguauaaacuaguagcuuccauuugugcacagaaugggucuagagauggaaggagucaugucucuuggcuccaguccccuuggaacggguucauuuuggauuucugucacuuagcaguauuuggccaucccccuucugaguaccaaaugguuaacaugaaugucaaauugaguugauuugcgugucacccuuagauuggacuagcucuuaagacacuagauuugcaguugacauuaguccccucaauucauaacuuugaaguaggcaguagaauuuguguuauuuguacccucuacuuaaaguaaaagguuuuuaugaguagccuuccuuucuugaaaugaaaagaaaaaaaagcuuuuuuagugaaauccaucauggaaaauuagagaaaaauagcaagauguuuguuguuguauuuaccauaccuuagaacucacacuuaaacuaguauuuuguaguuuuacauuccuuuuuaacucauucaguggagaauaucagacuuucucccaaguuguauguuaagucaauucuaauaauguacucagcaucaaagacaaacauguaauaaacauggaaauaaaguuuaguucuguuagugaaauguuaa

SEQ ID NO: 6629 - RNA, 25804 nt, Mus musculus
aaagagucuggggccuagggagcgcgcgugcgcguuagagacagagcuaggcuuuggggaagggggcgcggcacacgcauggcuuccaaagccaacaugguucgucagcgguucagccggcugagucaggugcggccgggggaggagccagcccuucccagucccuccucggccuggucucggcucgcccucucugucuccugggcgcggacucaacggccgcccggccccgccuuaaaggccaggccgucccgccccgaugccccuucguccccaccccuccggccccgcccccagccccgccggcuccgccucccgcucucgccgcggagucgcuccggucucgccgcuccccuccuccgccccgcguccugacucucuucccuccuuucccucagaggauguccgccuuccagaucaaccucaacccgcucaaggagccgcucggcuucaucaagauccucgagugggugagugcagcuugcgacgccgaccucgcccgguccagcgcggggcgccuugccgggaggcggggacgcggucgugagggagucccccacgcucgaaggccgcggggcggagauggcggccggcgucgagucgagucgccggugugggcggcuucucccggccgccccuagccgcggaggcguggaagcucgcucgcuuuuuuuucucaggcuccacugccauccgcaaaggaagacaggauuuccugcugcgguccaacugauaccgaccgcccggaggcccgcggcuuccgcgggcgaggcuagaccuggguugcgcccuucgcuggcggcggguaugggcuccuguuaaaaauagugugugucagagaagccgaggcaaagcccuugccccgacgcauuaaauugucggcccauuuaacgccuggccuggacgucgagauuguuuauagcaacauccugcuuggaaagucagcuuucugcccuuuccugccaagcaaucauuaacaucaaaggagacuuacaaguuagaccuugucacgugcagcuaguuuaucaagcucugcgauuuuccuucaaacuuagcggcccacuauaguugggugcugacuugaagaguuaauguaagcacuuggcauuuauuugccccgugugcagucagguaguguuucguagccgauaacguuuaauuccuucacaguucauguugagggugaaaaauaagaacucuccgguuucgugcguguguuuuaacgaagagcuugaaguucuccgaugacugaugacugcucgcucugauuuuuguauuuacacuuuaugccuucaauuuugugaaaacugaaaugcugcucuugcaacuggcaaaagacacgugacuuucugugcaacccuaaguuuagaagaagguuguuauuuuaauuccaaaagucauaggggagaaaucaaagaaauguguguuaagaaugaaccuuacauuuagucucauugaauguuacaauucaguuuaauaauuuagauuuucacuuaaguaagaggcagcuuauaucuuuucuugaauauuuuaaaguaggaguaauuuuguugugugcugaaauuaucuuuaaguuucuuaaaauaauacuuugaguuugaaaaccuuuuauuacacaggcaguaaguuuguaguaagacuauagaguguuaaugguguagugaguauuuacccaacaaauauuugaguagguagcauauaccagcacugugcuaaaugccagcuuacagaugugaaucaaacucuuuuucucaugaucauucaaggauguaauggagacuauaaaaaugccauaugguaaauuguguguuagagauacuuguaaaguaguagguuagacaggaaagcaucauuggggaagacuuuauagauggaagaauauuugaagagugaguacuagugagcuagggauuggcuuucuaggcaaauagaguccuguuagugggaggaaaaguugaagcagccuauguaaguagguuuuugcuuggaugaacauacugggcaaaaguaugguucuaaaugauuauaacaaguucaaagcccuuguuccuucugaggguagucaugaaaaacugguccuauguguacaagcuauagaauaucaggucguauuuagguaguuuccaguuaagcucagauuccgagucaauccuuggauuugccuguuuagaaaauuuuaguuguuaacaguauaaaaauagcccaacguggagagaaaccugcugcuuuagaaauuauucguaccuaaaauuaauuguaguaaggauggagaugacuagaaauuaaacuguuuuaugaugaugauucuauuugugacuuggguuggugauggccuuauugucuguggcagaaaaguauuugaauuguuuuuaaggauauguuguagauaaucccuucacauaguuuaagugucagucuccuauaggcccugguagauaugaaccuaacaguuuuuaaaugcugguagagacuaaagacucagcuugccagcuaagaagaaaggaauaguuaggaagguagagagaaacaucuuuauugcuguuaagaguuucaaguaaagaacguucaauaaugucaggugcuauggagaacguacuuaaaguaagagccaaagcaugccccuugcucuuaguaaucagaccguugacggcacuagcaagaacagucucaguaaaaucagaaacuguauuaauuaauguaggcuaaguggguagauauccgguaagggaaggaacucagugaagguugaccaucagagaaagguggugguauuacaaagaaaaaugaaaacuaguuucaguuuacagcucauuuguuuaaauacuuucucuagaaccagccauuauaacuugauaugcaacaaaacccccuguguuucccacuucuguuaaacuaauuuguacugcuucaucaaacacuuguuuuuuucuucaauuuuguuuuuuugagaccggguuucucuguguaguacuaacuguccuggagcucacucuguaaauuaggcuggccuccaacucagagacucaccugccccagucucccaagggcuaggaucaaaggugugugccaccauugcccagcugucaaacauauucuuaagucaaucuuuuccaaacugcuagugugugugguaguggauacacuuugguaaaacugcugauuuuuauuaaagcccagcagcuuuagacuucaaucagugcaagugucaauauacucaaaauaauaauguuuuaguguuuuuaccaaaagaguuuuuaccuuucuaggugccugggaacgucuugggagcucucaggggucugcaggcugagauuaauguuuuacuauaagaaaaacguuggcaaugaaaaacagaauagaguagacaccucaacaaaaccucuggguauaugcccuaguuagauaugaguacuucaaaagguaaacagagagacuggggaaauggcucaguggguaaagugcuugcugcagaaaccugaguuuggauccccaguggguacacaucuguaaccucuguacugucagauggagauagguggaucccuggggcuccuggccagccagucaagcagaaauaauaagcuucagguucagucagaaacccugaaaucagagaaucagguagagagcaauacaggaaagauaccucacauucauuggauuggccucuggcuccauuacggguaugcacagguuagugcaaucuuguguguguguguguguguucgcacacacucacacuuaagaaaagauagagcuaccuaacaaggaagaccuggaccagucucccuucuggagaagagacaaauugaaccuuuaucaaauacccugaaacauauggagaaaaccauucuuuuuuauuuaaaaacacaaauuuuaucagugcuccauacuauaacuuauucaugacaagccagccagaucagcaacaauggugcuuauuuacucuaaagaucaugaaaauaauugaaaagucuggauuuuuucauuauuauuaucacaugugcucagaggaucacuugcugggguugguucuccuccuaccaugcgggaccuagugauccaauucaggucaugagacuuaguggccagcagcugaggcacuggcccugaaaaugauuuuaaagcaaauauaucuauaguccuuggaauauauaacgcugaacucaaccaaacauguuuuaagaauaaagaugacaaaugcuuucagcauaaugaucucuucuuaaucauucuuaaucagaaaagacuucuagcucucucagcuauggcucaggaaucuaaauccugaggguuaugggacuguuagcagaaguuugugugguuguacugcagaaguacagagaguuuaaauaagcauuuugauucugauuuauuacucauuucaugagaguaacuugaagugucgguguucucaguguuuaacuuaguaaaaacaauaaauguguuuuuuuuuauaagaacauucacuugcaguauauuuucaggucuauuucuaaauauuuugacugcuuaacuuugaaaacgagagauuaaacauaaagaaauguauauagauaacuuugguuuaaugaugacacugaauaacagugaagauccuacaacuagaagugcuuuguuuuggcacucauaaauuagauuaauuccaguacuuuccuguagaauucugaggaguaagcuguauaaauaggaaauaguaccaugacucuggauguaggauagauaauuuacuaaaaacaccagguuucaccaauuuuuuucugcaugagcuuucaucuguguaaaaauuuugcacaaagcuccucuaugcgucuguaauuugggcguacauuucaauguuaguaccuuaagacauacuguacauuuagaacaaauuuacauuuauauauuuuggguuuuuuagcuugauuuuugagaugaggucucauauaguccaagcuggccucaagcuuacuuuauagcugaagcuggccuugaauuccugaucuuacugcuucuaacuccugaguacuagacuucuacauaggugccauacacccagcuuauauuuuuagucugcauuuaaaugguauugcaauaaugucuuuccccccuaacuucuaauuugauuaaauagaaucuuaauucugucuuacagcguggccuccaguucucuuuuguacaugaauagauuaucaaucuacacaucguagcagacauuuucaaaccacauuauguaaacguuuguuuuguuacagcuguuuuauuccauaaaucugucuagacagggacacucacauuggaauauaugaacacuaaauauaagaaauuaagugaaguuauuguuuuguccuuccaaguaugggauucagaauagcuaguuuacuacauucacauaagacauucuuaauauccaggcucagcaguaagguuuuaguuugucuaaaacuauauaaauagaaguuuaaauguuuaagcugaugcccagcuggagauugaauuccaugucugugcugucguuauucuuggguagcuggggaugggaaaauaaauuacagaaagggcaaggaacuaacuagugucgcuuauuuauuaauauaguguuaauaguauagauuaacaggcucauagagcuacccagauaaagugagugaacugugugaaaggggggaaaaagugugacuaccagcuuuuaaaugcauucugcaauagagagggagccaauguggaaagguccugccccguuuuuaauguuacuucuguuccauccgaucacuucuguaugagacugugauucugguguugccuuaucaggaaacccagcuuuuaugugaggugcccuggguuuaaugauaaauuuacacuuuaaaaauaaaaacugaaagauuuauacaaaucuuagauguaggucaggucagguuagguuuuacugacgggcauccaguauauaaguuacuauuuugguggugguggugagggguuguuuuguuuugugguuauuugaagcagagucucauuacaaagccccaguuggucuggaacuugauauacagaucagaguggucucagacucagaaaucugccugcuuuugcaucccaagugcuagaauuaaagguauaugccaacacguccagcuaguauauaacuucuaaucuugaucagacauucuguagaauaaaaaaaauauagagagagaugguuguauaguuacucugaaaaugauuuuggguguuuccguuauuauaaauguguaccuugugccuuuuuuucuggguaaggugaauacaagaauugcgagugugaacacaacacuggauacaacaguacaguacucucuaauugccacauuaagaaauuaagguggcuuucuguuuguuuuuguuuguuuauauaacaggauacacaagaaaaauacuacugguagaguuaauacagaauggauuaauguuuauagcaauuuaggagaauuaucaguuuuaucacagugaauuagguagaagcuuuaaaaaaaucaggaaugggggcauucucagaggaauauguguacagcaaagacauaaauacugguguguuucaggaacaauccaaugugcaguaauaacaguaccuggcagagaacauaguucagccaaaucuagaaagaaaaagucgcagcugcacgagccaugccauuuaugccauguuuggaaaguauugguuuuguuuuuuaaauauagaccugaaaaguauuggaggagucccuuuaaacuaggguuacaugagcagauugcuauuucagacuagugugacaucauucuaaaauagcucuguucaaaaaaauaaagcaaacaaaaauauacaagucacagaguaauugaauguuguguuaacaaagguuccuguguagccagggcugaccucggccuucugaucccccuucaccuccagaaugcuagaauuacaggcaugugccacuauuucccguuuauucaguaccgcguuauaaacauaggacuuaguacaugcugggcaagaucccuuaacaauugacuacauucucagccccagacuguauauuuuuauuuuaaaucuuuuaaaucuauggcguaguucacauuacagcaugucacaguuuagauggcaacacucacucuucugcagccaucaguagcugauggcucuuuuacugaguuuaauucuuuagagcccacacaauacaagaugugugaugauuggaaugagauuagaaacaggaaaaguuguuuuagcaacucccagugaaaucuaguuacaugccaaaacaaagaguuguggauguaauaggagcagauuuuaaaagaugguucaagacuagguaugcuggugcaagccaaaacacagacguggagacagcaaguuauacaguaacucgaguugaaggccagccucaucuacaaagugaggcuuuaucuucagaacaaaagccuuuuuacaaguuucauuuucuguauaaucuuaugcaacaugauuuuuuuuuuaacucagcauuagguuucugcaacucaucuauauuaaugugacaagcuaugcuucccauaucuuuuuuguccuccuccuuuucuaagaaugaggggcuggagagauggcuuagauauuaagaucacuuguucuugccaaggaccuggguuuuauucaccauguggcagcucacaaccauccauaauucuaguuccuggugcucuguugcccucuucagcccucuaacgacaccaggcacucagguggaucacagacacaugcaaggaaaacuuggacuaaugcacauacaucuuuuuuagaagacaguuugaguacagugcaagacggcagggagccaggguaguuacuagacuacagcuguaucuuuuuugauguauaacuuugaguuguaagcauauaccacuauaaucuguuuuccuauugcucuucccucccucguccucugacauaaacacuguuacugugaacauucauaaguaagucucaguacuugagaaagggucuccugagaccucuggacuauugaguccuuuaugacauuuuucuuauaaguauuucaccuacuuuguaacuugcuuuauauucagaaguugacuuuuuaucuuaauuuauuuuaucuguaauugaaauuaccuauguuuuaugguagugcuuuuuaaaaagaauuuuaaauuccucuacauugucacagauuuucuuuuuuuaaagcuuucucauuuaaguucacaacucacuugaaccauuuauugaauaacucuuuacuaguuaucuacuacuguauaauaaauugccccagcuuagcaacuuaaaacaacagauauuuauuaucucauagguucuauguggaagggaucugggaguuuggguucagggcuucuccugagguuaugucagcuaugagccagggaugugcuaaucucuuagccuuaagcucagucaugugguuauaggcaguccuugguucagugcucuuaaagccucuuaaaauuugccugaaggggguuaaggguauagggguagagcacuuggcaaagcaugcugcaguccuuggguucagucccuagcaugugacauggggcacaggggagaccuacaugcuggguaugguggcucaugccugugcuucuagcacucaaggaagauccccaugagcuccaggcuaacuugggcuagaguagugagacccuuucucaaaaacaaaccccaccagcaucugaauagucugaaucuccucccaacauggcagugagcuucgugaaguaaugagaacguucaagagaagacaagaaacauaaauuggcugugggaggguaguuuguuuguuuuaggcagucauauguaucucggcuggcaaacaccuuacuguguagccaaaggugcccuugaauuuauaguccucucugccuccaccuccuaauuacagggaucacagauauacuuauuuuauuccguguugggaucaauaccaggguuucuugcaugguagccaaacaaacuaccagucgagcuauaugcaagaaguagcagucuuauuauaacauaauauuagaaggaaccuguuucuucgccauauucagaacucuguauagguaaaacuuaagggaaauucagcuuuucucuugauggaauuguggcaaaggaucuagacaugccuuauggucaacaccauccuugcucagugacaugcaguggcaaacugucagguaaaaauguucaagauuacaaccuguuucuggcuuuaauuugaucuauugguucaguuuauuuacauuauuuuuuauuuuuaauaaccuuaaaugugaguuuauucccaagacucagcucuugcuuuucuccuacucuauauauucauguauauuuauuuugagagaauauucuuaucugccgauacauaugaaaucuuaacagaauaucucaaacuguauguagacauuaccucaggcucuucauauguguuaccaaauuauuuuuuuguguauuucuuuguugaggaaccucuuauuauuauuacaauacugauuauaauauuuaauacccuguaagauuuacuacccuggaaugauucaugagaaaccauaucuaguuuuccauuauuguaacaaaauaauugaggauaaucuaccuaaaaggaggacagguuuuagauucacaguuucagugguuuugauccaucguuggcagucacuuuugggccugugguaaguagugcuugguuuagcagcucuacuuaagacaacccagaagcagaaagagacagauaaggucagguuuccaauauuucuuugaaaagaaugaccuuucuuuuaguaaggguccacuucccauuaugccgucaacuggcaguauauacuggcaccuaggaaacacucauccaaacuacaacaucacauaguuagcacuauauaggcuuugauaggaauuauacauaaaaauguaucuacuguuugauggguguaacuuuuagcaaagagaccccaaaucucuuuaguuuucuagucugggaaggacaaacagcaaguauaguacauagacaaucuuaaacgugcugaagaagaaauggaacaguguacauauaauauuagagaagggugguaggggagaacccucucugcuaagauucaucagcauagugagcugaggaagugagccuguguuacaguuagagggaguggccagugaagacacugaaggaguuguuuagugacuagcuagcagauagguaauguauggaaugauaauaaaaaggaaaaaguaacgugugugaguuaaagauaguagggaacgaaaagacauuaaagaacuuaggaguuguuugaggacuuuagaagaaggguacuauucugccuuauauguggguuuaaacugcagaggcuguucuaguaguagugcgcugaaauugugguagagagggaaucaggaacacugcuauuaaggcuauuagugcagaauccagccaggagguugauaugcuggccauuuagauuaggaaguggugauaaauagaguccauguguauuuugaaaacaagaaccauugacauuuacuuaaguguugagauuucagauacuacagcacccaaaacaaaguacuuuaguuguggaaaacaaucuauaagacaaaaaaaaguuaaaucuuguaucuuguguugcacugagaaaugaccaguauuaaaauuuucauguauaacucuucuggauuuuacccucuuucuguguagguguggauauaaguguaguaaauuguaugaacaaauucucuauguaaugagaauguuucauuaaucaucaauauuguaguaauuaaaagcuuauucuguuguacaaaugaauucuaguuuauaugacucucgcaauauuuaggaugcuucuggguuuuucaauuauagguagaauuuaaggaagcuuuguuauauuuuuaagcauauacauaaucaagaaaucuguuuccaacugcuuuuucaaacccugaacuauguggaagugaugauucacaaguugaugaaguagaaucucuuuccuaacaaccucuuguuuucagcaguucacugauugcuugcacucaaaaaccaaaacaccgucaauuuauuugcauuuaaaguuuugauagggaaaaaugggucuuauuuuaauuuuguuuuuuguuuuguuuuguuuuuguuugcuuguuuugagacagggucucguauuucuugcugacuuggaacucugacucuauguacaccaagcuggcuuuaaacucaaaguaauccaccugccucugccaccaugcccagcaagucuucucugaauuucauauuguaugggcuaguauauuauacuugggaagguaaaaucucauguguugacauuugcauguuuuuauaaaguuuuuaguguaugguuaguuucuagaauauuuaugaacuuguuuuuaaugaucauguacuuagguuuuaauggccuuuguuuugguuguaguaauguuuuguuuucuuuuguuuuucuguuuuuggucucauuuuauauaguuugccuccaucuuugcuuuugccaccugugguggguuuaagggcaaaacagaaauucaagugaacuguccuaaaguuggugucaauaagaaccagacugugacagcuacuuuugguuauccauucaggugaguaauuuuuuacuugcuuaacagcuguucugacuucauacuuacucauuaggaucuuuaacaauucuggauucaggcaggggccugcaaucucaucagucucagcucuugggaagcuaagguaggaggagcguuccaagacccugccucaaccaauggacuuaggaauguuuuccugaacuuuuauucccugaaggugguagaaugguuuagaugugcauguuuuauuuguggucuuuauuuagacugugguacagaccagugccugucugcaaauuuuucauggucucuggaaggaaccuuacaaaggggaguauauucauuacuuucuaguugcugagacagaaggaagaauugguuuugcccacaguuuuagaggcugcaccauacuaaauuggcuucaugcacuuggccagaaaaucauagaaaugagaauguguggcaaaggugauucuucaucucacgguaaagcaagccugcacguaauguccuucuccuaccuccaggaaagccccuugcagaaguuccagaaccugccauaauaguaccacuagagaaacauuccuuucaugaaccuaagugagaaaucguguauaggccagcgugauggcuuuaucccagcacucaggaggcaaaagcagggggaucucaaugaguuugaggacugcuugguucuacauaagaaguuccagguccaggacaccaaagguuacauagagagacccugucuccaaaaacaaacugucauaacacaguagaucagagaugggaaaaauggggaccacucuuagugagcucaucugcugccaacacucaaacaugguuuaugaagauacacauuucucguguuucugcaguuacugaacuaauaguguucuaugucauuuuaagacauaaaggguacauguuucucaauaauaaaaccauguuuauuuuacuuuuaaagggaaauaaacagaaacaagaaucugacuucagaauuucacugaaaaguuuacuguaaauaccgucuaggauaugagucuucugcuucccuugcucuacuugacuucucaaaaacucaauuuucuguccaauaaauuggaaauauaaucuuuuaagaguguuuugagaaucagguaaaguuucaggauuucacuauauagcccuaguuggucauagagaucugccuuccucugcuucuugagugcuaggacuagagauauguauaugcuaagagcuuacuaaucaucaaaggguuuccaucucuuaaccauucauuuuguacaguaaccaucuuuaaugacauugguuuuauaauuuauaagugggagaaauguaaggcaguguaaauuuucauuuagcuaguuaaucaaggguuaaaauaugaaccauggggcccgagagauggcucagcaguuaagggcacucuuuuggaagaccuagguuuccauucucagcacucacauauggcucacaauugucugaauucuaguuccagggaaacggaugcacucuggccuuugcagccaugaggcacacaggugguagucagacauaaaugcaggcaaaacauccacacacaugaaguaaaaguuaaaacugagucugcagguugauugaaaauaccuuguaaacaacaaagagaagaagaauauuaucauaauugcucuccuagaauuagugacauagaccucugccucuuagaauagaaaugggagcuguaaaguauuuuuauaaucccuucuaauaugauaaauguuaaaguguuuaauuccauuuauagucaguuuagauucaaucugucauaaaccuauuacugaauaaauuuugggguauauguaguaugagauuuuugguuuaaauauuaauauuuaauauuaauuaaauaauuguuaaauauuuaagucuuucuuuuucaaaaagaaaauguuuauaguguacuuggggauuauauuuugaaauggcaauauucugcuuaaguauuucaguguuaggagaguccagucauuuguguauuuauuugagucucucucucucuuuuuuuuaauagguugaaucaggcaucauuucauacaccuccaaaugucagugugugugacgugaacugggaaaagcauguucucauaggugauuacuccucuucugcacaguucuacguuacguuugcagucuuuguguuccuguacugcauugcugcccuucugcucuauguugguuacacgaaccucuaccgggauagucgcaaacugcccaugaucguaaguaaccguuuuaugucucgguucaaaaguaguaugcacacauauaaguaagcuacaguucaagguaccugcugaugcuucccuacuagaaauacaaacgguugguuggcauguguguuugauaugagcagagcuuuaguuauuaaguucacuucaauuuucagucuguucaugcuucagagauuucuuuuuaagccuagaaaacccucaaauauuugauaacuuguuaaguuuaaaguagcaaacguuuaagaacuuaguaucuuuaauuugacaacuugcacaagucccauuuuugcuucucacccuuuucuccuuuucuccaaacucccuuaugucacuugggauucucagggaucuucauggucuuucucagagaacuggggcccaagguucacaucugaacuuuuaaaauagaauguucuuuagaauguggcucugccugacccucuauguuaugcauuguguauggcugcuaaacacuggcccagauuauucuuauauucauuaucacugguaucaguaaguuauauuugaaccuuugaaugucagcaaaggauuuggauuugauguccuuauaccuuuuugagggcuucagagucuacugagcuagaaauaaaaauaaucuuugauauuaaagggaauagacucuccuggguuaugaauggcaacucuagccauggucuauguuagaccuccacuguaaaggucagugauaguguggaggcuuuugugauacucggcauuuguagcuaugaaaaaagcacuaaagucuuuaaagaaguugugaauugaccuuaaguagaaggcuguuuuaaaaggaaggaauuauuaagauaaauuguauuuacaaacuuauuuuuaauuuuugcugcuuggaucauaagacuguaaaugguaaguaaagaagaaaaacauuuuuuauuguacagauuuucuauuuaugucuagauaaguauaagaaagcuagauguauucauucaaauacuucuuggcuauuaauuaccuuuuuaaaauguuuauucauuacaaacuaggaaucuguagcuuugaacauuuuagauuuugccuuaaaaagugacuagaucaaucacagaauuuuuuuuuaauucuauauuauuaaaagauuuuuuugcauuuugucacucuaccaacaaauuuccuuuuuacuaaauaaaaaauuaacccucucuugcauuuuaucuaauaauuuaaaaaauaauauacuucagucaauauuaagaaguagcuuguagagagcuuucuacaugaucaaaacaaucuaguauaugauucaaggauuuagaaguaagucucuauauuagagugauguuauugaucauacagauauuccagaguuggucucaucagugguuuuugcuaguauaauauagaaggauuuacuuuuuguuuucuuuugguuuuguuauacagggucucauagcacagucuggccugcuaaguagcuaaagaugaccuugaaccuccugacccuccugcugcuucuacucucaggugcugggaaugcaggcguacacugccaugcccagcacaaugggugcuucuuauuuauaaaaguaaagugcagggucaggugagacggcccagcaguuaagaacacacacugcucuucuagaggaccugaguucaguucccaggacccguguuaggcucacaacugucuguaacucuagcuccaggggaauccagugccccuagacacacacaugcacacaaaauuuaaaauaauaaaauaaauuuuuaaaguuaaauuuuuaauuauuuaaauuuacucauaaguauaaaaaggacucguguuuuaaauguaacauugaccuuuagguacuagugauuaauaagcauaaguuguugauucuguacuaagguauuuuaaguauuuuaguuucaauuuuuuuuuagucuagcuuuucuuuuuuaauauagcacuuuuucguauuaaguagcagauggcauagugguacaccaaaucaggacuaucaaaaaugaaacgaggcaaaagggauuuucaaauucuaaaaucuuuuacaaauguuuugacuuguugguugggucccagaagcgcuaguuagcugcaucacagggcucuagguagaaccauucacuuagacugcuaugugacuagagucuaggaggacauaauuuuuagggaccccaguaauuccucacuuuucauucaucagagguuuauuuugugugcugugcucagaaaaguuccuacuuuugaaauauguagauggcuuaguguaauuaucagcaaauuagaguuaaagagcagaaccagugggcugaagagaugccacaguugguaaaguucuugcucugcaggcauugcagaucugaguucacaaggaaguacaaauuauaaccccagcacugcagaggguguggggacaggugggucccuggcacccacugacagucagguuagccaaauccaugagcuccaggcucagugagaaacccugucucaaaaaguagagcccagcuguggaagacaccugacauucgguucuggccuccacacacgagguuauacacaagguuuauauacacauacacaaaaauaaguuuaaccagaaaaaaacaugucuuagccaagaauucaaaaagaaguaaauaccugaaaauuaagaacuuugacauauuuuggucaaagcuauaaauuuaacauuggggaauuuugcuuacuaugauauuuuauuggguuuccaaaagaaaagaaguacuuagaaaauauaggaguacagggguaguguucccacaauucagagaaugauggcuaugauacuuguuuucugugaucugugcauuuuaaaaggaccagaguuaaugaaagcuuaaaugcaaauauccguguuugucuaauuagcccuugguuuuguccucuaagcacaaauauuuauucacuguguaacuuaaagguggcugaugagauaauucaaaucuuuuucacuuucuuaaacauguauuucagugugugugcauaugugcauacaugcacaugcaguacugcacaugugaggucagaggacagcuugcaggaguuugcucucuccuucuaccuuguggguuucagggaucuaacucagguucucagccccagugacaaguaccuuuaucuguuaaggccucucacugguccaagauaauuaaauuuuaauuccacugauuuuuuuuuuuuaagaggucuuuggugauaagcccuagaacucagucuuggguuugaacuaacugguuugaguuaacuuugcuguuaacaaacaggagcucauacuuugaggaauaucaaagcuauaaacuucagaccauuuccuuuaauucacaggcauccaaacaggauggccuucaacaucaugguacagaggucuacuccaaguaucuaggucuuuguaaccagucuagugaacaauauuucaguucuccagcagaaaagauuaaauaaggagaaguugguugcuuuguuaguuuuucuuuaucuuauucuauaaauaauauccaguauuaaguauuaaaaccuucauuuacauuuuugggaauguaauaaauagcaggauucagaagaaaacaauugaaauucaaaagaaauuauuucaucuuuuugucacuauaaugaacauuccuuuuaaauuuuuauaguaauuuuuuacuuuuugaaauuauaguuacaucauuuccccucuucccuuuucuaccuccaaccucucccaugauucccucuacccccaaauucaugguauccuuuucuuugauuuuuguuguauauuuuuuccuaaauauauaaauaaaaccugcucaguucauauaccauugcuuguauguagaugauuucaacugaucacuugguauuggauaaccagucggccucuucacuggggaagacuguuucucuuauccuugccauuccuuaguugccuguuguucuuugucuaggguugagaccaccugggcuucuccuccuuccauauuagcaugucuauuaugucauccuuguucagaucucuaggcagccauguugauagacuucauagguguaguuucucugacaguuuuagaagauguaaucucacagcaaacuuccuguuccucugucucuuacagucuuucuaccuccuuuucuucucuuguucccuacauuuugaucaguuaugguuuucugugacagucucugccuauugcaaagagaggguuucuuugaugagcagugagagcuacacuucucuguggguauagagguagauauuuagaguguaguuagggaguaugcugguucauuuaguaaaguggcaguuaauagcuuuuccuccaaauuccaugacuucucuaugcuggguaguggcuagguuuccagucaggcuugauuuccuccuuccuugaggagacuuuacauucaguuguauaacuugguguugaccaagguauacaugccauguuagucauugugauucacagguauuauagcugaauaggucuauugguugcuuuucucucuuacaacuuuguaugaugccuucugguaccaugaaagcuaguccucagggaggaggcaaaauucaggucagauccagcucagguucucuggguucuguaucagaaaugcauagugucuucagcaauaggaaugugucuugcaucucugggggacaaccaaaggcaacagcaauuugugggaaguuucuuggacaacccugaccacaaaucuuaugccugguguuggcguuucuguuagcaagucuauuauggcucuuggcucuuacagggaacauugcuggccuaaauggggaaauuuucauuuaaacuacauguauacacagacuuauguaacuuuaggcaguuagauaauaacuucagcaugacuucagacauccugcuauuuuuaucuugcuucuauauuuaauuuccucuuccucccuaauuaaaaccccauaguuuuuaaaaauuuuauauguuuagguguuugugcaccacaugccugcugggcccacaaagaccagaagagggugucaaauucccagaaacuggaauuaaagacaguuauaagccaccauaugguugcugggaauugaaguugggucuucuggaaguauaggcauuguuuuuaacuauugagccauuuuuauagcuccuaauacaaugaacauucuuaaaauucauaguuauaaaacuuaaaaagacuugguuguauuuuuuaacuacuucauugauuucuugaagaauuauuuuugacaagacuuagaauuuuaucugaauauaggaggauaagggaguuuauuuguguaugcaagggguuauaacaauauaauuaaaggaaguaaugaugugaauaaaguugagugacaguuaaaagagaaaaccugauaccgucaguuuauaggucuuagcaggguuggcagcuugcaaugaugaugaucagcaaacauuauggaaugaacacaaugucuggucuuguggugcaugccuuuaauucccuggaagcagggacagaugaauuucugugagcuggaggccagcuuagccuauauauucaguuccaggccagccaguacuacauuguaauacugucucaaaaaagcaaaacaaaauagauauggagaaaugcacuuaauuguugacaguagaauaaagugugacucuaaguguguagauggucaagauuauggugacaacuuauaaaacuuugccuuuuuacaucaaaaguggacuuaagggcuagagaugguuugguggcuaaagagcacuuguaaaagcaagaggaucugaguuuaaaucuccagcacccaugccaugugggcccccaguuuuaguguggggugcagagauagguggguccugggggcuugcuggcuagacagccuaauucaaaaagaggaaugucaggucaguaagagacccggucucaaacagauaagguugagaacaauagaggaagacacugacuuacuccuguucuccaugugaacacauguaggugugcacacucaccaaaauuagaaguaaaaauagaaaacaaaaguuuuuuuguuuuuuuuuuuuaaauaaaaggaauacccagccguucuugcaaggaggcgaaaagauugcucugaauucaaggcuaacaaaacccugccucaaauauaaauaaaaguuuaaguuacagacuuauaaggaaaugguuaagucuuguuaugucucuggcauggugcuagagacaguaaauaccaauggugauuagacagaaugugaccuuuuaugcagaguaaauuaugaagaccauccauuucuugauaccauggaauuaaagggaauccugauuucuuuauugcugauaggaaaugcgcugcuuuuaaguugauugugcacuaacugcuuuuucuucucuaggacuuuauuguuacucuuguugcuacuuuuuugugguuggugaguuccucagccugggcuaaagcucuuacagauauuaaaguagcuacuggacacagaauuguggaggaacuugaaauuuguaauccagaaucaggagugucauguuacuuugucucugugacuaguaugggcucccugaauguauccgugguaaguggcugauacuugcaugguuuguuucauuuacuagaacaacauuuaagaaagcaauaacuuucaguaaugugaauaaauuuauucugauuuuauucagccauuuggguucaaauuaggauuuauauggaaaguaugaccuguaaccaagcuauaaaaacuagaagaagacacuaaugaugauguaccacccacugugguauacuaucuuaaguuacucauccauucugaggggaauaugaaagaugguauuguuagcuucacuauacagcuaagaaaacacauauaccucaugcauuauauuccucguaggagacaccgcuuuugaacuagaucucacuuugauccuguucucuuuaagucuguuuuacuaagaauacauaaaacucuuaauaguuuuaaaaguuucuuaaauucguaaaauuuaauauaugaaauucauugaauauuuuucuauuucaucaaacugaaguuuauuaucaauaauguugaacauuuucuauuuuggaaggcuuuuucaagaaaauacuuuuauauaaguugaugccaguacugccuuauaaagcaauuuacccacauuccaguuuauaacuuuguaauguaaaagucaggacuuggagcuuaacagagugcuuugaggagagcaaguucagaagaauuuugugugcacuuacacaaagacauguaaagcauuugcucuuuaguuacauaguacugcaagccucuuacucuacucuuacuucauaagucacaucauggagugaguguuggaagaacuuuguuaaauagcauagguagguucaguuuguucccucugaaauuucaccuaguccucugaguauguggaaaggaaauucuuguguugaugagguaggauguaaaguacagccuggcuccagcuguuggaauagcagugagcaguuagaagagggaaggaaggaggagagucaauggaagaaaaguacaaauguaaaagaugcaaacucggcuccccgucgacccuccucacccuagauaccaaagucuaaauucaaaguaauaaggggaagaucucaccuuucucagauguaaucagaaguucuacaugcagaaauaaaagguuuucauuuuuguuguuuuauguuagauauagagguuuaacauguuggguauaagucauuagcaauccauaauuuguacaguggacuguauguagucuucauuuuuauucuacucuguauguaucugaaagcaaacauuagauucuuauguguuuuccucuuuauagaucuuuggcuuucugaauaugauacuuuggggaggaaaugcuugguuuguguacaaggagaccagcuuacacaguccgucaaauacgucagcuucccacagccaaggcgguggcccacccacuucuggaauguaacuaaggggagaaauacacuguaugaaaugugugcucuagcaugccuuguugccaacaccuugaaaagcauuauuguuucuaauaaaaaguaauggcuuuuucaguaaauugguggguuuaaaaauuugcugcuuuucuacauaaaaugugccuuuucuagaaauuuaagauguaaauguauuuuuacaugaaaguuugaaaauucgggagccuguuaugagaugauguuacuuuuaacugaacaauaauuuaacuaaguugcuucuaaaguguuuacaccuuaaacuuuaacauaaaccuucauucagaaaacaguuaugucguaucauaauauaggaagaauguguuuggaaaauacacuacuguuaguuuguauacauuagaucuuucaggcuuggcuuguuuaaagaaaaccuugauugcauaaaucauauuuagaaaaaaauuagugcaauuuuauauuugaauauuguucauguuaaaauuuuuuugaauugcaaagacuggguauauauuuuguuucuguuuuuucuaaaugaucugcuguacuuauuagguguacuaaaauugucuuagaagcgaggguuugaaaauuguacaaauguguagagguaacuuugcacuugugcugcauggguauauccauuauuucuggugguuucuuaggcuugcaaagagcacgguucccaagacggguuuauacacguaggcguucuccaucaggcuuguuuacuaucuuuuguucauaccaagagaaaaaaaucuacuuuuuuuuuccagacccuguuuagaggguuacuaaaaauuaagguugccuuuuacguuugaaauguuuaacauuuagucaaugauguuucuucuccugaguuuaacauugauauugugaaaauaaaugcaguucagauuuauuucuuaagauucauucuucacaaaagggugauuaaggaauuaugcucauaaaggaaccuaagcaagcuguauugugugugugcuguguguacacacauuugugugugcucagaauacaugcuuucugcuccugacuuuuuguuguacaggauucagauuccuaguccuacaagaugauguuuguguguaaggcacaccuuuuuuguugcuuuauucaugacaaagugucaguuugagaauguauguuuaauaagcaaacaauaaagaagugaaaauaaagaaugccccguuguuauauuacaaugaacucuucauccuaaagguauaagcauugcaaaauggaaccucuuuucaaagcaggagauagaauuacaauaguaauuuuaagugccaauagaacagacuaaaaugguucagacauuucauucuuguuugaaaaauauuuauaacuauuagauugucuuccugguaaauauuuuauaauuggucacucaaauagggaagauuacugacugagggcauacaacuuccaggccuguuuccauaguucaguuggaagacugcuugucuagcuagccccguccauccuucugcacuacugcauacauaagccaacgauggcagcccaagccucaaaucucagcacuccauaguuuaagaucauccuugccugcuuggggaguucaaggcuagccugggcuauaucaaucagugaggaguacucuuuuccugcucucucucucucucucucucucucucucucucuuuacauauaccaucuuuuccucccuccuccuuccuccucuuccuuuuuccucuucaccuccccauccugaagcgaaacugcugggauuagaaccuguccuuggccagcucccaagcuggcuaacaaggugaagccuguauuuguaucugaaaacauggaaauaaagaauauugaccuuggacuggagagauggcucagggguuaggagcacugacugcuccuccagaggacccacaugacauuuaauaaccagcuauaacuccuaggaggaucuaauguucucuucuggcuucuacagguauuacauacauucacagacaguaugcaugcagguaaaacauucacauaaacuuaaacugacuucaaaaaaaauaugaaaagcaaaugggucuagagguuuugaaaugucuucagcacagguucuccauaaauguuaguugugucuaagacagccuggaguccaaggggcuaggggacacaggcugagaagcggaaaaagcuuuaagcaucuaaguuuuuccuuugguaguguuuacaauuugguuucccuuaaucaauccuaaguguuuggguguauuuguuuuucuguuggugcagauauuggcaaggcuaaugaaauuaaaaaaaaaaaaaguaguccauugaaaugagaguaaacucagaaagggcuccugcuagccuccccuccccgcuguuuuuuagggaacauuguagaggcaauuucuaggacagaagugauaagcuuuaacuucccagaagacaagcugcagagagacagcuaacagacucguuacuaauuguuuuuaaaaaacauucaccuagauaaagaucuuuaaauguguaaaagguagggguagaauuacaugguauuuuguguuugggcauaauuauaauuuuuauguaauauuuccagaaacaggugccuguaaaaucauaccgaagaacuuuauauguaccagauuuuuaaaagaaauaaaauauugcuagaagaacuuguuccucauggagauagaauugguacagauagcucagaaugaauauucuccucaguacuugaugcugccgggccacucgucacugcucugaguuugaagcgucauguuuguuuuaaagccuguuugugguugcuguugaggcugaccucccuuuaguuuaguuacagcuccucugcuucuccugccuucccuucucaaacccuuagcugaguuuucuucugugagacuuucucuguggauguacacaguucccuacaucaccuugguaguaaccccuuggcguuuccauggcugcaguguucgccccaucuguggcuuguauuuucacuggauuuugucauauaaauuuguaauuucuucauuucaaugguauguaacuaccuuccugguggguuuaguuucugcaaugguuuuggcuguggugaagucacauauuccuguauacauuuuagaauccucuuaucaagcuccuaaagacccuuugugagguuucaguugugaagaauugcauugaauuuguacaucaguuaauuugugaagaauugucaaauuuauaaugccacaguuuuguauuuauaaacaugguauauuucugcauuuuuauuuuaugcuuuccaauaaaguuuuauaauuuucuacauaaagauuuaagauuauacuuagccucaagaauuuucaugcuguuuacacaauuacauuagauuauauuuugaauugaguuguaauuguuuauugcuguuauauauaaacaacauguauagguuuuuaccuacugauaauuauagaaguuggcaguuuuucaaaccuugaauuuuuaauauguaaauuauccugguauuuaauguuuaucaucuacagauguugauaguuuuaucauguuuggaaauuacacauucuaaauauucucuaauuauaaagugaucuucaagaaaaccuguuuuaaaaguagaaaaaguacauuuaccugacauacugacugauaacugcuucaguacaucacuuguaaugacagauuugcacuguuguauauugguaguuguaguaacguaaacuggucagaucgauugguucuuuauagaguugaauuaaaccgaucacagugagaauguucauaugaaccuuguuugacucugcuuggacaagaauggcauuuauuagccgggcgugguggcacacaccuuuaaucccagcacucgggaggcagaggcagguggaucucugaguucgaggccagccuggucuacuaagugaguuccagacagccagggcuauacagagaaacccugucucgaaaaacca

SEQ ID NO: 6630 - RNA, 35893 nt, Mus musculus
cgugugcgcggggcucgggagagcgcggaguccggcaggcugagagcagagccugagugcgccgccgguucagccgggcagggucgccucgcgccaggaugcugcgccccgccgcccuguccagccagcaacccuggcgcgaccccgggaagaagcacagguucuuucguccagucgccgcuggaggaccgaaaguuuugcucgcugcaagucucuuccucccagagucccagucacccaccaugcgacgucccagaaggaucccggaggcuuagugggaacgaaaucggcuguuuugcaccccuccauccuuaucccucaggguagagcagggacucuagagaguacaccucccagcuaccauccacuucacccugucuccucucucggugagccuuggaauccggucucuucgcagaugccuucaggagucagaagcaaaggggaaauggacauaacuccgagaaaccggugagugggggcaaggggagugaucaucccauccuugguuucauagcaggcaaaauuccaaaaucauuuugucucuggcguucccggggaucugugcgaugguugugugucccagcugguagagccacugcggagacuuugcuccgcgcacaccagagacugagcgagcucaaggcucuugggugaugcuaagccccucccucagacccagcacuugcacagagcaagcagguuggccagaggacuucgcaucaccggagaaccugacugccagguguguagacgcguggcgcuuugagaugucucuucugacccuaggggcugguaaaugagaccuuaaccuucuguuaccucuuuagaauuguuugcuuacuaggaauucccuaaacuguaaagacacccuuacccccguaaucaauaacuuuucuauuugugaagcauccuuccauucuuaccacugcuguccccgggagcccuucugcuccacacugaagcguugcuuaauucugggcuguauucugguggggcuggaauguccuggcacucagcaccaugaaccucaaaaccugcauuaggaugggggcggggaaggaaccucuggaggcuuguuuucagcugugaugugugugcgcgagugggccugccucuaugggacauggauaauucucagguuuggaugaauugcuaccuaacuaaggugccaguggguaaggaauuaccuuacuuuaaauacuugugguuugggaaauauuucucagaccuugacaucuuagaugagccaggcgcuguaccugacauuacuucacccaugcaucuuuuuaaauaacauuguuucucauggaccgguugcccagggucagagagagagggagauccauccuggucuucacagagcugcagcuggagaacgaucaugcuuagcucuucagggaagcuaggcauguguacagugaccccagaccaguguggcaaggguauggacuuucacggcagggccaguuccuuggcggaaguugaaaugagcuaagaguguucagaaaaaaugugucaccaagaaaacggaaucugcucugcauauuagaaauugggaagaucuuauaguaagcugaggucuggucuugccuagaaaaggggaccaugcagaaccuugggugaauguaagcauaugugggucgaugguguggcuuagcuguguaacgucuuguguccuacuaggaccaucauugggagcuagcuggaggcagcuaggaaaaaaccaacauguuccauucaaacauguccccaaaauugcuuaauagacuucgacuuaaaugaauccaucuaucccaucugccacucuugcuaaauuucucugagcaucucaauuugugaggacuuugcuaccuacaccauucguuuuucucuaagauuucucagcaccuggaaggcaaguguaccacccaccuugcugguuggaccauguuguuuauuuuuccuaccucacuucuggugauagauuagaaacaggacuaacaucagaaauccuccucgccaccuaggaauaccaguuggagggauuucagcucuuuguuaauggauagcacuagagcccagccaugaaugagccgggcaugaugaacagacucuuuuugauaaguagaacugaaggaacccaggacauuugcauucuggcagggcagggcaaccuccaugggaauguguccucugcuuuccaguccccuugcuccuggcagagucaacagacuccugucuccuaggaugugcaaaagaguucuguacucccuguggcucggacuuaguggauccugcucuguuccuaaccacugucacuugccagggccaccauaggagcaaugguagcccuuucuuaccccuuagcucaccugggaagaaguugaaaacugauguacgcguacucacugaaacaaagccagcccucauugcuuaauguaguugggggaggggagcuugagggagcgugggauagugugagcaugugauucaaugucccgaauccuacugaaccucagcuuucuugauccguugaauggucacccaaagcugcuguucucuuuaaguuaauguauuaggggaaauucagggugcugagcccugcagauaaauaaggccugauacauagugagucauaagacauguuugucaugauucucucucucucucucucucucucucucucucucucucucucucucccucccucccucccucccucccucccucucucucucccccucccucacuugcucucaguaguugcauugguuuugguuuugguugcuuguuucuguuuuguuuuguuuuguuuugaaaugggguaucacacuauagcccaggauggccucaaacucacugugaccucacagcaaucuucccgccucggccucccaugucugaggccuguuucuuuagucaggaugcaugagaugcugggauuagcagcuggcaguuggaaagaggccagcucucugacgugauugcuuccagaagaaacucugagacuucugucccagacauuacugucuggcagcaccggauaaccuuccaggacagaguagaccccgcagaaacucuuccaccgaggacaaagcugccuuugcuucauaacgacaaggucucuuaauagagagcaaaaugggaaucucuauacauugcguuugucuucagauuucuuguuccuuacaaaagaaauuuaauauugaauucugaagauuguuuuccuucugguaaugaaaggauggaucacagagauucccauuacacagugccuugggcauucucucuccuguuuauucuucucacugugacagauccccuuuaaagaaggaaggguuugugcugguuugaacuccuagaccccagugggucgaacuaugugggaaggaguuugaggagguguaucacuuuggggugggggucuuugaggcuaaaaacgcccggccauucccaguuagcucuuucugucuuguggauguauuucaagaugugagcuuucggcugagauuucaaugccaugccugcugcccugccccccacugugaucaacucagacucacccucugaagcugugagcccccagguaaggucuuuuauaaguugccuugguguugaugucuuaucucagcaauaaaaccauaacuaaggcgaguuuauuguaacucuguccccaaaucugauaccauuuuccaaaccauuuucaauacauuuacugacacaucuauuauuauagguguaaggauaccgcuguguauguuuaaaaggugaauuuauggucauuuuuccugcgcauuuuucuuuccuuucuguguuucugccugggaguuauggacacacauaugugugugaagaccagaggcacacccuacaugcuguuucucaggagcuauccaccuugguuuuguugcuguuguuguuguuuuuuguuguuguuguuguuguuguuuuaaaaacaaccagggucucucggugauauuugggacucgcugauuggguugggcuuacuggccaauaagccccagggaucugcucaucuucauuaucccagaaccgagauauaagcaugggucaccacacccagcuuuauaagaugguuucuggaaaucuaacucagaucuucacaaaccuuuaccaacugacucauccccccacucccugccccaagccugcuuuuaucauauauaccgucacauggcauuauguauggaauacccauuccuuuuaauugcugcauacuauuccacacaaugguccagcguuccuuuagcuauugccuaauugauagcuauuuuagaguucugguuuuaugaaggagaagguggucgaugcuguuauuuuuauacaugcuuggugggcacaggagggagcguuuccacucugaguuagaauugccagguacgugcgcuuuccauuuuaauagccuugccagaucgucuuuuaagcagcugacuaguccagacucccuggagcguguagccguacccgucucuucacacacuuauuaaugcucaacauuuucaaaacgcuagcuccuggcaguacgaggggagcgugucuuauuugcucgcguuucccucauuuuggguguuuucaagcauuuuuaaugugcacuuuauucucgcucuuugaacugcugugucuguugauuuguuguuggcauuuugaggccuuuguguugauuugaaggaauuuucuaugccucccagacacacagcauccugccugcuuggaaaugcugccacuucucccuguuaauugucuuuuuccaaaguacuuagcuguccaggacuucuccuuggaaaagcuuugugucuuacuuaaggaaacugccuguccucacggccaugggucucaucuuaccguuucucuuuaugcuuggcagguuuuauuucacauuuagauacgguucuucuggugaagauagaaggcaaaaaaagugaauuucgccuggaguccuugggagacugaggcagcaggauugugaguuacaggccagccugggcuacauagcaagauucugccucacaaacacaauauaaaaguuuuuuguuuuuuuguuuuuuguuuuuuugccuucagcacuggaugcugcagggaucuaucacacacuugcucagcauuguggggucagagcugcccuuuuugucccauuucuagugccuuuucccugcgcucggccaugauggucucgugacuccauucacacccaugucuuacuuucauagcaugcauucagacccugcucucuguaugacaguguagcgugugaccuguggcaacagucaucguggagguagucuuccuaagaaauguacccuagcccgugcagaugcauccuguacacccaggcucaguagccacagccaacagaagucuccgcaaagauucucccaaggugcauuuuccaaauuaaauaucugugaccuggagagauguguggucuugucuucuaauauccaaaagacaaccccuagcucagugugggugaguaguaagauaggaggugaggcuuggacaugccuaucugccagucauuccagaaggaaaaggcuggaccguggcuagaggagagaaauaaggcucaaguggugcuggguguuugggaucuaagaggggacauggagaggagagaaacaagugagccuguggcauucagucaggccuucaacaaccaggagaggccugcugggguggccgccagguggcucugggcucauuccuagccaaugcucacuuagaagguuuucuguccugcuguuucauuuccugauucaagcuuuccaugggaaguccuugccacuacugugacauggggugucaagucucagguugacacuagaugggagcacuuagaaggauaggagcacuagccuucuuucacaccagcccugugcugagacgacaccaucacuggugagaagggcuuuugcugggaugcaggaggcagcugcuacccaguggccagcaccuccugacaccuuucccucaugccugcuccacacucugucaaggagcaggcccugagcacaggccuaugacagggagcagaagcccggagacuuucagaccacagcgcagucagagcagaaggucaaguccaggucuccauggguagggcauaucuugcucauuccccacgugaugcuggugucagauauuuuaauucucauguaggccuaggucuuucagccauggucuguccagcugccuuccuuuaggaagugcucaccaccaugucuagagacuguugggaaugcuguaauaggugugugucugugugugugugugaguguguguguguguguguguguguguguguguguguguguuggggacgggagggagguucuguccucaucuaguagaagccaguguaaacuggauacgcaucuuucccugagcucaaggcagccuccaugggccaaacugauggagguggguuuggagagccugauguuagcuaucaguggcagacucccucucucuuccguguuuuuucagagugaacguccagccucagcaacagcuuugccaccaugagcuucauugaucacauccuaccacaacuaggagaccuaaaccuugcucacugacagcauuugaagaugcaaauacugcuauggauuggaaggugccugaggaaugaaaggggacauagccauguaaguacagcaucuucuugcugccugguuacuuguaggcuguugcuuuccuacuccaaaucgagggcugcuuggugcuuaggcagaauacuacagacagcucauauugccaguucauggauuaugaaauugaguccaucagggaagcuccuucccauuguuuucccccacccccuagauaucaaacgccuggccagugcugccgcaaugcacuguacaacugcaccucuucuuucugcuauucacaucacaggcauuguagauuucuuaauacaaccugccuggaaaauagccgagagguggcacugggacuguccaggcucucuaaggcucaugaugggcuacacggaccggagaaggaacggcguuguagaugagucaccagcuccacugagaguuuuacacuuugcuagaacaagagucacucccugugaccacacaggggcagugcuccgugugguacagagcagucuccaggaaaguguuuaaguuggcugucucgaaaaaacucucucaugcucauauucgaaagauacaaugcgggcuggugaaauggcucaguggguaagagcacccgacuguucuuccaaagguccggaguucaaaucccagcaaccacaugguggcucacaaccauccguaacgagaucugacucccucuucuggagugucugaagacagcuacaguguacuuacauauaauaaauaaauaaaucuuuaaaaaaaaaaaagaaagauacaaugccuugggccauggaaugauaagguggccuugguucuacuguugcuugauucgcccuuugcuggacuaggaggagacacugacauacaucagcuuaauaaauuugacagugaggaggggcagugugugugguuucaauuacagauugacccaggauugauugaacugucugcucggcucugguagugauggagcccgaggauuggcuggacucugccaagagguggguauuggaacaucagucagcuggugggcuccaugucgcuuuguauccugggagaaucaaauuaugaguaaaaugccacugugagguggguacgaugccacggggaggguuagcucagcuugccccagcguucguuccuuguaccuguauagccucccucccccucccucauucuuuucucaccuuguucucuuucuuuaguaugacccaccucgugagauuuuagggaagaaagaccauagugauugcaucuauuaagaagcccuuacugaccugcauggugaggcucgugugaaauuucagcaugcgggagauugagacagaaggaucacaaguucaaggccacccuaggcuauguaucaagaacuuuuuuugaacaaagaaaaaagaaacggcaguacauaauuucuccuaaguaaguauucuaccauucggauacugaucaacuaaaggaauugucucaguuaaugucaugucauguaacugccccaguuagaucagccugggguaucucagagaauaacaaccucauuuucuagaaccagaaaagcggacuggcuccccuugccugauauguagaagauaaaugacacaggggccugagugggauaguggccacccugaagcagccaaggcuugggagaagagaaaucugaucugagcaggacaugccucgcugauauaaauagauggugacauaguggcccagcacugcaggcaggggcaguggcuaccuuaacaaccagccugagacacagagaugguaguuucccauagugacagccuucaguggacagugagcaaaucccaaggguggucuagauaggggugagagaauucugcagggccucaggacuacaaucacaacacgaagucaugugacauggguaagaagacagaguuuucaguuggucugacuucaaagggcuggagaugaggcugucagcugagagcuccugcuugccgaagaccaugggcuggaaucccuguacugcauggaccagaugugguggcacaugaaggucaaggcuauccucaaccacacaugaguucaaggucagccugggauacaugcaauccugucucaaaacaaagaacaguucuuucaagaggaaaucuuaacauuaaggcugugcugauccaaggugagaaagaugaguuuuucaagacuccguaacacucaguuacaaccacauuauagagacacugaaguuucuccuuuugguggucccagcacaaucuccagcccuggggauucaaagacagagagaaggaaacagucacucagauuaggcaaccaagugucucagauaccaggggcccgagcuggucaaaccaagagcaaaaauaacagcuucuccuugcacacccagaaguauucuagguuagagaguaaguucucagccaaccccaguucugagcuauguccuccaacuauuguguuugugcugcgauuccuuacuggcuaaaaaaggauauccuggcuaaagaauaauugccagaaucacacagcaccuguuugaaguagucagauuuucccucuugcauagagaacaauuguuauccaaauuuuuuuucauaggaagaaaaauccuaaaugagaacaaucugccuaaaauaaauguuagaauuuugauauguugguagccuauugcuauccacacauuaucucucuaucaucuaccugucaaucaucuuuauaggcauuuagaucccuccccauucugcaaacuaaaauacuuaacuuauuagaaaauccauagcuacauauaugaauaugaacauacuauauauuuuuauauacuuauauacauauaccaucauaguuaauauagaguggugguuugaauaugcuuggccaaugggaagugacacuauuaggaggugugguauuauuggagaagguguggccuuguuagaggaaguguguguguggggggguguugagacucuuauucucaggcucugcccaauaugaaagagagucuucuggcugccuucaaaucaagauguagaacccucgacucuucugggaccauguuugccuacacacugccauauuuccugccaugaugauaauggauugaaccucugaaacuguaagccagccacagugaaauguuuuuuuuuauaagaguuacauuggucagaguguuucuucccagccacaaaacccuaaggcacguaggccaagauaaucacuuuuuagauugucacagcaaacacaguauucaagugaaugauagaguauugaacuauaacaucuuuacuccccaauuaugagcauuuaaguuugaauuuugaaauguguuacuacagauuaauacugucucaaaaagaaaauaaauaaauugaguaaccagaaauacuaaaaagaauagcuacacauuuuuuuucuuuucaagacaauauuucucuguguagcccaggcuaugcuggaacuugcucuuuauaccaggcuggacuugaacucacagaaguccuccugccucugccucccaagugcuguguuuaaagguauccugguuguuuuuaaagaggcuuuucuguaaaugaaauuaccaagucaagggaauauucauuuaaaaauuuuaaauugcuaaauucugcugaaguguguccgaauucccauuuuccugugaucuaugcuguaucgaccuuucguuuuguuuuguuuugugguuguuguuguuuuguuuguuuguuuuugguagugcuggagauugaacacaggggccacacacauuccagacaaaugcucugccccgaggcuacaacuccaggccuuucugcguuuuuacaggggcucacuaagcuguccaggauggccuugcacuugggaggcccaagcaagacuugaaacuauaauucuccugccuuagccccucucaaggcugagcuuagaagugugcaccacuaaauccggggguugggggugagaccaaaacaagauuucucugugcagucuugacuguccucaaacucagagaucuaugugccucugccucccaagggcugagauuaaaagcaugccccgccaccaccaccacaaccuggcccaguuauauacuuuuuuaaaaagaccacauuuuuuaacaaaaguaagccguagaauugucagagucuggccugacacguucaaacaccagaguuccauuuucaaaugucacagccugggcaucauggcugggugaggguuaguuuuuguuccuauuucuggaggucaggaaaucucucugaaggcauuuaggcacuuugcaaacacacagagaagucacauuguauauauucuuccccuccacugaaaagcuguguccuuucauuagggagggccagcaaggaagcagcaacgggucuggcuuguauaggauuuauucagaaugaaucauguugucccuuugaugagcuucauagagacaauucuauacucuccaaauccccaccagcaauaacacaagucacaaauagccucagcuuaugggagcuccgcaguccaguggcauggcuucucugggucuccuguggcacaacagaggaugacaggcggcccaaaugcaugccccguuccagccagggcuguuaagaaucagacuuccucugaacccugggguaagccauguauggaccucgaagaccuugucuuugcucucagaguuagacauggccguccugcuugcucuuuggaccucccugccuacacuaggcacagggagagaagagaauccucccccaccuacaagacgugaaguugcuugugaugggagguagccacaagcacagaagcacuggccgccagcagaagcuacagaggcaaagaccagguucuuguauacagacuguacugggcauguggccuuguuuuugagcuaguuaaaaacaaaauguugaacuuguggcuucccagaaauguuugagaauaagucuguguugcuuugugccuccagguccaugguaauuuguuacaguagccccagagcucuccuugcagaugaaguagaagccugggucuaaagagacuuuggguaaguagagucacauucauucccuugggaauagauauugaaugaccaugacgguccagacacaggagcugugaacaaggaugguggcaucccugauuacacugggaugggaguggagaacagguauuacacagagaauaucuuacucacuguucgauuccugugaagagacacuaugaccaagaaaacucuuagaauggaaagcauuuaauuaagggcuugcuuacaguuucagagguuuaauccauugucuucaugacggggagccugguggcacuggagcaguagcugagagcuacauccugauucacaggcugugggagggagggagggacggggagagagagagagggagagggagaaggagagggagagagagagagagagagagagagagagagagagagagagagagagagagagagagagagagagagagagagaacaaaagccugggccugguauggacuuucgaaaccucaaagcccacaugugaccauuguuauagcaaugcuuucaagggauuguuccagggugaguggacuaggaaagagauggcccuucagaucagccauccugugaucugaacccuaaauaucaagacagccuugccaacuggagaaaguuuucuuagaggaaggcgcugucagugcaaagucccugugguggaguccacgagccagaacacacuccucugaggaaggauggaaacccucugucagcggaggcugcuucuggcuguuuuuguccugccuuggagcuaaccuggaaguaagcaugugaggcucuugaucaaguaugaucaaggaggauuuuuuuggauucagcuaaggucgugguuugggcuuuaaacucugcuggcaacguggaacaaaacgcaugguugagauugaccagggaggaaacugucuuccuaagucagcaaagggacccacauugaguguauuguuugugcaaaggccccagagcucaacaucagcagaaaaugugacacgacaaagcugucagcaaaggugacaugcaucugcaaugcuuucaagaucagggaacaccucaaggggcuuggcaagugugcugcuuucagagaugugacuggguagcacagcuuauggggucauaggaacagauaguuauucacuuauucauucaauuaauaaauguuuaaugagcaccuaucaaguucccaacaccaacuagacuuuggggaaauagcagugagugggccauagacggcgaugacuucacagaacuuacuggaaaaggacacagcacguuugcugugugauuauuauuuuccacuauuauuaaaguuuuucgauuauuaaauuguuguaguaauaaaacagaaaaaaguaauuauagaaauauauaguagcugggugguggguguuacacaccuuuaauccuagcacucaggaggcaaaggcuggaagaucuccgaguuagaggccaaccuggucuaccgagcaaguucuaggacagccagagcuacagggagaaacccagucucaaaaaaacaaacaaaaaucauagucuucugaauuugcuuuuuaguuaauaugucuugaguacccucuguucacaaauacucauuucuuuuuaagagcugaguaguagucuacauuaugaaugcagcacaguguaacuguggucuucuugguagagcuugucuguacuauaaauaacaugcaaagaaaacuaccgagcaugucuuuauguagccuaugggcgcauuuuuaaagggcaaacacauaaaagugaaugugggucaaaggggacugaguaauuuaaucgagacauugcuaugaugagcccacauguccuacacccccagcaacacgggugucagggguggccauccuguccaaugggaaugacagccacuuguuuaaaugaaccauucuaaccucuacuucagccgaugugaagcagccuaacaggaaguagucuaaggccucauaaagugugugcugugaccccauguggugucaugaggcuaaaucugaaggucucaaaggcuuuggccguauuaaaagcucacugaacauacaacaauuaaaaaguaguuuuaagccacacaacccagugcucccgggguugccgcaucacaggcccucacaaagccuuucuucugaacacuacacccguauuuugcaccguguaugacguuacucagugcugaugguuccugccggggaaggcucagcucagauuugagcuacgacugcuguagagugcuccacugugcaugcaguuuucugcucuugcagacaggccaggcuggaacuguggaaaacagaguguuuuccugccguccuuccucggcccauggguaugaaguuauugugucucugacuguucgcuguuagaaaguuugauguuaagaauuguuauuugagagcugggugugguggugcacgccuuuaaucccagcacucaggaggcagaggcagguggauaucugaauucaaggccagccuggucuacaaagugaguuccaggacagccagggcuacacagagaaacccuaucucaaaaaaaaaaaaaaaaaaaaaaagaauuguuauuugaguuucauagaaaucauucaguggauuauggugugggaguaggacagaaucucuaauaauucugaaggggucccagucauacucccaacauuuuguacuaugcauucgugagaggcagccuucuugguauugacaguuauacaaucaaaauauugacccacucugaaagaugauggaggugcuggagauccuacaauaucacauauccagccaagacuugguucauuuauggaaacaagcauggugucgaauuauuaugcaaacuugcuuuaaucguuaauaaauaguaaaaauuacauguauacuacagaauugcuuuaaaauaaauuucuuuaugauuuauuaucugcaaauguuuuauuuguacacagauuuuauagaccuauacacucucgagcugugcacaacuuuccugggcaaacagggauugugaguguagaaacuugaaaaaccuuggcucugauugaagcuguaucggcagagcucuggugaggguggccaggggaucccaggcagugcagacagcgugugcaaaggcccugugggaaagacagcccucgcucuugcagaacugagcugagagcaagacaggaaugacagugagaaguauuacacacacccagcaccuuuggaauuuuauuccuaggaaagggagaagauggugaaggauacauguaaucugaccuagcaggcuggccuuucuaacaaacccucuugggaccgggaagagggaaugguggauucagaaucaacucaggcagugaacuuggagggucugggagagccggggauggcuagaccaaagugaggacugccaggggagaaguggcaagaguuaucuagacugccuguaugcuugagugggcuuggcagagagugcagacauggcagaaauuggggagagaggaucuaccaccaggacaaaaggagaggccauagaaauuggggagccuccggacaaaagcagaccucuaggagggaaccugcuuugagaucaguacucggcccuugugcuuacagccgccccugcuuuagcugcucacacagaacagcaccugagccuugauguggugugugcgaucuggaagccugcucauggaaggaaggcacagcgccucacaggacugcuuuguggagcaggagggagagcucuagggugaucuuuggagcugggggucauaggcugcugccuaagugggaaacaggaaaugaaauuaaaaggaagccgaagaugaaggaagaaggaagaggaagagagaggcucccuggggugcucuugcugggcugcagccugggagcacugggagcacugggagcauugggaagggcaggccugaguguagcagagcaggaagagcucaucucugagucuggggugaccuggccucucugcugccauaucgguaaccuuuacuuccuggaaccacugugagaauuaaguaguugcauggaaacggaagaaaauacgugcaauacaaaaccacuagagaacauguguccagaauugaaaccgacaagagcaggagguaaaaagacagacgcaaaaggauggagcagagaaccggaaguucugacaggagaggcacagacacagcagugugugugugugugugugugugugucugugugugugugugugucugugugugucugugugugugucugugugugugucugugugucugugugugucucugugugugucuguguguguguguuaugugugugucugucuugagugugugcauguguguaucuguauuauaugggugagugcgugugugucuguguguguaucucuguguacgugagugugaguguaugugagugugugugucugucugucuugugugugugugagugugugcgugugucugugugcaucucuguguaugugaaugugugugugugugugugugugucugcaagugugugugugucuuuguugggggggcagccucauuaaugaaggaaaauacagagcaauucacaugaaaccaccuguguaacacccagcaaaagaggcaaaaaaagacagaugaaugcaugaaauauaacucauuaauauuaauaacuuaauaauauauugauugauagcauauauuaauaacuuaaguauuuuaaaaauuaguuucaucaccauugaagcucuagcuaaauaggauccauguucaucaguuuguaaaaucugaugaucccaacuggaaggaugguauuggggaacucagugcugcugaugguuggagaccugugagaccacccccuggaguacuacacagcccugaacuaugagauggaaacuugggagcgugcuugucugggauguuccaaggcucugggcucaaucuccagcaacccccaagaagacauagcaucugaaaacaaaacuaagcuacaaacgguguagcuugcauuuccuaucacauguugagaaaaguccaaagacaagaagggauuggcaugaaaucacaguggggccucucagagaggagagggugggagcccacaggggcgcucccccaacaggccauucuccaggacuugggaugcucugacuugacccuggagguaacugcacuguuugcccugugauuguuccuuauaccaugcauuuguuuugaacacuuuaauccaggaguauuuuauuccacaauuuaagcagguuuaaaaaggagauagcuaacacuuguaaaacgcuuggcacggugccuagcccauauuaagaacucaacagauggcaauuuuauuuacuguucuaacucgguuguuagagccgccuugucuccuaagcaaccuucccgcaucuccugggugaauguugucuccaugaagccuggcuuggaggcuuagaauccggacucuuguuucccagggcgacccccugugagaccugcugggcuuucccaguggaaggugugguguauaaaacgggcucacacccuccucaugugcugccagaguuuggcagugugcaaaaauaaaauaaaauaaugcaauucccaaaaacuagucugcuaaaacgaacacugugcauccuggggaccaagcuagaguccugccugcuggcauuuggaggucaagauugaacccaguggcaagcuaaguggcaagcgcuaaagaaaagggagcagggaguuggcugggcagggaggcacacauuuguaaucccagcgcucuggaaguggaggcaggaggaucagaaauguaaggugguccucagccccccucacuugguagcuagcuugggauacaugagacccugccucaaacaaaacagagcaaagcacaagcaacaaacagaaaagaagaaacaauggggagagggagggagggagggagggagggagggagggagggagggagggagggagggaggggugaaaugguaccugugaaucugaaagauaccucugaguaccaaguaaggcaaugggccagaagaacccugggguagcugcuaugauauauauauauauauauauauauauauauauauauauauauauauauauauauauauauauauauauauaugucuucaguuccacggacaggcaagcaaucacuaucuuaaggguuucuagcaaugucucucuuccuuccaaaccuaacacugcaauccuacaccgcaaccacuaaacagccuguaucauacuaucugauuagugcuguucaccacaagcaggguggagugcuaauucgcagagagcugcugccagucauuugcaaguuggcagccccgcagagacacacgucugcaggaaugugcugaaggucacacagccagcaagugccagaccaagaaggaucuuccuuugugauugguucagaagggaggggguggaggguggggguggcagcaggaguggccuagaggcuuggaguuagauggaugccugguuugcuaacaguucagaaacuacuuaaacugacccaggguggaaaugggggucugggugugguuaaggagacagaagcacucccucuggcagcuugaauggcugaacagcuuccugcugaguggugaguuagaagaaauggcuuacaagauccugaaaggagccaucaugaaaaguccuguuuugugcagagcuucugauggggacuagcuuuuagcuuuuguuuuaaaacucaacucuccaaaaucccaaagcaugccaccauguuuaugcucugcaaucguaucacccgugggugcaucucuagagcucuagaauaggucagacuccaguaaggcugcuugcauguagaugacaguugcacagagccucuggcaauuuaaacagacuaagccucuaagagagagaaagaauuugcacacccccccuccccacuucuuugaccccacaccagugacaccgaucuuuccguggcaaccuuccugccaucggagggugaacagcuugugugugugccgugugcugugugugcagcacuggccguggcaguuggcuguguuuggacacuuugcaaucuguacucugugcuuuuguuuccagggucucgugagccacuuuacucugcucaugacucuccgguggaaacaucuugcuuccaugguucagagugccugugugucaggaaugauggacaugcuaauuuggagcaggcuuccauuaaaccuuugccaugauuuggcaaaacugccuuggcuguggcugguauucugacccaggaauggaaacagauucuggcaucucucuguggcaagaauaacacagcugaguuguauguugugguucuuacagucucuuaauacuauuuuauagagacuuacaaauugucccauguucagcucaauuuguuguuuauugauuuuuuuucuuucauuuguuuguuuguucguuuguuuguuuauuaaggcaucuuucuauauagcucuggcuaguuuggaacccacucauucgugccaucaugccuggcccacaucugcuauuuugauaggcuuuuucuuuuaagcaguuuuugauugauggcaaaacugagcaggaaguacaguuuccaaaacauguaacuuccuccucuaugaauauuucucagccaaguggcacaugugucacagaugagggucugacacugucaucacugucaccccuguauauccaccauuguagugguuucacugcccugagaaauaccuggcuuauuuaucucugcucucugcuaacccccuguaaagccacagcuuugucuuaaccaucccaguagguguucuuuuccggucugcucuuuuucuugugugugcacuuaagauuguucugugucauucuauggcuuggcagcucauuucuuuucagugcugaguaauacuccauuugucuggauguaccacaguguuuccuuucuuccguucuccugcugagggacaucuuggcugcuuccucauuuuagcaagucugaaugaagcugagauaaacauccacgcgcagguuucuguguggacauaacuuuucaaucuuuuggguaaauacccaaaaagcaugauuaccggaucauaugguaagaguauauuuaguuuugugagucugccaagcugucuuccaacguggcgguuccaccggcagcauagugaagucccugcuucuagucuuggcagcguuuggcacugccaguguuuuuagauguuagccacgcuaaugguuguaugauggcaucuuccuguugcucucauuuucauucccgaguacuggaugcgucuuccaucucuauaucuucuuugaugaggcaucuguucagagaguuugcccauuuuaaaacuauguucguugcucauaucccuauuggguuuuaagagggucuuguggaguuuggauaacgguccuucaucggguaugucuucugccaguauagucucccagccuuggcuuucccuguuuuccugcacauacaacacugugauguuauaugugguagggguuauaaaugcauuuaaaggaagcguuuccuuuuagguugcuuauucucauggagaaaagucuacugccugggcauagcaguccucugguguuuuuauauuggcugucugugauacugauaagagaucauaggugugacaaaccguccagagaccugcccuacugggacguugucuuacucaggaagaguuuaagcaaaacucuccuggccuguguauucagauccugcacuggaagacuggauguuacuggugaucuaagacuaccaaugacugguaauuacacagucuuucagaauccauguucacuggcgucaccuccauggcuuagugaaauagcaaaugacuuacccaaaugaggugggcuguggcaagaaucaucuuuauuucguuugccuggcauaaccauuucuaaguagcauggaguucuaagcugugugcuucauguaacuucccaugaaguugagucucacaugggugaauggacaagacacucuggcacgccccgcccccaaguaaugcaggcagggcuauuucgauguguagguggaaaacagcgugcuagagcccagcacaagcucagagaccugcaguuggacacaaccaauccacugaaucaauaggcaaggugccacugcagaauguggugcccggccuucagucugagcugagcagcagagaagcaaccauuucuuaagacagcaucagcuuuagcuaacaagagcugaaccgggcauccaggcugugcucccaacaccagucucugccucauaagucaucaaggucccuagagauggcauucuuuuugacauucaagaaguucugaaggacagaaaggagugagaggggccaagggacacagcccugucucuagccaggaagaauuucugagccaccugacugcaaacacucuucuuggugagacugccacaaauggucuccagaaaugcaucucucagucuuaguuucuagccuggugagugacaauuucugccaacucagcacugugauaagaguagucacaaaccaauuucagccagcucaguacuguugcaagaugagucacagaccacugucuggcacauaguagggacucaagaagugcuaggaaaucaaaacauccauccuuauucagucucaccccaaccagaagaacccagguguggccuaaagacacauggcuucugcugggagugggauucugucuuucauaagcaaaauugccaaugaaaacuagcuuuaaaaaugauggugaauuuguaucaguucaugucacuggaaaguuuuaccaggccagcuuuagcuugacucagaagcccuaggauauaguaaaagaccuggcuccucuccuccccugcuucugcuccccuuucucugcaccccauuuaucucauccacuggucuuccccccacuccuccucuucuuccuccuccuccuccucuccuuccuucuuuuccccucauccccccuuucuccaggauccugauauaucgcucaggcugguucugaacuccugcaguuugcugcuucauccucgauggaggugagaccacagacagcauuaugccuggcaccgaccugguuucaacucggcuucuaagguuugagcuccuucccaagucuggccucccuuaucuguacaagauggucgugaacagacgucuggguccaucuguuacauuuuuuuaccccgugacgggaaacucuuugugacaagagcuaucacaagacagaagucuguuucuuccucaaaaaaagagaagcuuugagagucuggggcugauucucugaugccacucuucacgucuagcaugauccuccacuuccuggagcauggcucuuucuuuaaggucaccucaagguccaaaugacuucuggagcuccagccauuacaucuaacaccugcauuuuaggcuggaggaaggggcagaggaaagagugucccuucaucuuuacgguuggucgcaucauagaacauuuuuuacuacauuuuguuggcagauauguagucacauaggaucuuuacaagagagccuggguagaguguguuuuguuggacuucagugucuauauuuaggaauucaguuauucuuauuccuaaggauaauuugcugccauacagaaccacaugcuucuauuuuggggaccaggggacaguggcaguccuuggggggaucaucacagaaagaaagaaauauggcucaaagacugcagaagcucaaaccaagugucuuaguuaggguuuuacuucugagaacagauaccaugacuaaggcaacuguuauaaaagacagcauuuaauuggggcuggcuuacagguucagaaguucagucuaucaucaaagcaggaacauggcagcauccaggcaggcauggugcaggaggaguugagguucuacaucuuuaucugaaggaccccaggagaagacucucucuacucagacuugagcauauauauauauauauauaaaaccucaaaguccacccccacagugacacacuucuuccuacaaggcuauaccuccuucaauaagaccacacaggcacagcauauucaaaccaccacacaggguuuuguacugcaucccuggaccgaucauugcagggggugucagagaugcuaauguugauuggaugagcauaguagagacugcaccuauuuaaacagaggaauccacuccacuagccguugccuagaauauucagagagcugacaagauaauaaagggggacgggggaugucaacaaagagucccccugccacuccggcacccuuuucaauaagccgaacaauccuagguuguuaaacuuuuccauauaagucaaugccagguguuaagucauaagccagcacaaauuccaaacaccaguuagcuuuaguuucaggcucauuguagguaccuauacuugugcaaagauuaagacaaagcgucacuaugcuugcuuggguagggguaaguaauugucaacacaguauuuccccauucuugacuccugucucuggucuucuuuuucuguuguguuugcuucuucccugagccuuagacuugccaucuugcuuugucagcuucagugucugcccuuuccucuccuucucaaaguuuuguuuaguaaaugccuccgagucaauuucuaacuugcuucuguugucugccaagguuauuuucagugcccaaaggcaugaaaguaagagaaaaagauuggggaaagcagguaauggaagaggaaaccugagggcaagggcauccucucucaggguugaggccucccagagcacacgugagcuuuuccacugcucacgugcauggacgagagaaagccugccuucuucugugugaugcucagaguugagcccgaacacauucggguggggaacucaaggcuguggcucucggccuugaggagugagaugccuccccgagcugagcuagaucaagggagacuugaguucacucucugccuccuucugacacacccugcagcagcaaggguggaggagcugucagggucugcccucaguuucucuugcagagugcuacucgugaaaucccucaggaaaucaagguuucucgggaugcccaccugucccgguaaugggguggggauaauagcucacuucaauugccagucacucuaaguaccuugcaugugugauaacaauagcagauagcacucaauauggugaguacuccguuucaggcacagucaaaacuaguugaaaccuagaaauguauuuuauucucuugcauuccccugaguaucagcuaucauuaauaacuacccagaucgaucugauugugagauaaaagucuaggcuggagcuguuucacugguucauggcuggcaacaugaccugguuucaagucagcugugugcucuuucuuggaaaguguguguguauggcaugugugugugccauacaugugcauguguguaugugcuugugugccuagguuuuguuucauguugcugugauaaaaauguccugacaaaacaacccaggaaggguuuauuuuagcucacaauucuagguggcaguccaucguaguggggaagucacaggagcagucagagggagcaaacagaacacacucauggcggcucucagcaaccucuccucucuucagccugugcagcuccuagcccugaaauggugccacucacguucaggguagaccuucccaccguaauuaacccacuccaaaaaaaucuuuuccaggcauguccacaggucaacccaaucuagacaguguuuccuggagauucuuccuaggugauuuccccaguguaauaaauggacaauuguaacuagcuaucacaguuuucaauuaccuaagagcucucaagucuacuccugguucugagucaccuagaaauuguucaaaucagggugcuggauggggccgcuccaauuucugauuuaguaggucucaggaaagcccugaaaguaugacuaacaagucuccaguguguagauagggauguccccgaccauauauggaggagagccucugacucaaagcucuccuuccucaguucuucuuucuggaaagaaucuucagauuugaggaaagaguaaauggauauuaaauacacacacacacacacacacacacacacacacacacacacacagacagacaccaaugaccuaugaauaacaggccuaagguaccugugggauggagaagaaacgugugagaacccacccacagggaggacaugccuugaaaacugcuaaagcaugcagucacaaagggcauguguuauauggaucuaguuccaugucucaagcaggccaguucagagauggcuguucaggacugagagcaaggaggaauggggaguaugcuugccgggcuucccuuggggaugauaaaaauguccucgaacuagguauuugugaugguugccaccauuguaaguguacuucaucacuaaaucaagcaccuuaaggugaccaaagaggucacuuuuaugaugugagcauuuuaccacaauaagauauuaaacgugugaaugaaguccaacucaauuuagguagccaguugaaauguuugcaggauuacggcugagaaugcaaaggccccuacaggacucacauaaaugaaucaccaggggguguugcucuauagcucuaucuuagacacccucuggaccacggucucuggaggugaggcauccacagguuuaaagcaugccuccaaagaucuuaugcacagccaagacaggggucauuguccauagggcuccuggccacugccacugacccuuguuugggaacagggugaggaguugaagggggagacucuugggaucagcucagcucucagaccuuggagaucagcuuugcuaccucagacaaauucugagcacgcagagaacagcauuucauugaauuuuugcaagaugcacagggagggacgggaccacauccgaucucugccacugccuguguuuuccagccuggaaggaacacacaguacucugugcaugugaaaguccuacgcugcagcaucuucacccuaaguccaaccugcucccuuccauagggacaaaguguguugagguagaguuaguagcgagaggcuaaagcccauugaaauucauucuguccuuucauucugucccaaacucaaauuuacuuugucugucaaaaccagacuaaagauaaaaauccacucauaauuucuaauaaaaauauugucugaauuuuuccaugaguuaguucaguccuuagacauagguauauugguaauauauauguauucaaccacguugugguacagacacaaugauauacucugcaauuuuuuccucuuggcacugugucuauagcaaugucugguuucaauaguucauuccugacguuuuguucuugugguuuuugacacgggaucucacuauuuaguuccuggaacucacuacguauaccagguuauucuugaacacgcggagauccaccggccucugcuucccaagggcugggcuuaaaggugugugccaccauggccggccauuacugacauuuuaaccucacguuucauggugguuuugcuauaguuuccuuugauaaucugucauuaagccuuagccugcgucugagucuucagugguagaaaccaugccagauugaagcauugugugaugacuuuuaaacuuguuuccuuaagauaaauuucccccaaguuccugggccaagggugugagcgcugcaggcuuugaccacacugcucaauaucuucccuuacauuugauuguaaccugccagugugcgcaucauuuucaacaacuugccgaugcugaauuccagaguuuguaaaagccuuacaaacagcacagauucuaacuugacacagaccggugacucuuccagcuuugggacucaaacaauaccccuuuccucauucuucuucagaugcaagucccugauguuuguaagcugccugagggcacauugugaaaaucaauacuuacagguuuuuugguuuuuuuuuuuuuuugaagcaaugaguuauucaaccaaucccacuucccaauauguuuucuguuuuucuaauagcagaagguuuuguuuugcuuguuuguuuccaaaguaaacuaaauaauacuuuauuucauguuugcuggcugccuuagggggcugugcacacgagagacguaugaagauuuucacugggugaacagacaucuucccacauugcuaagucaucacuguucucguccagugucucucugcacccccauuuuauuuccugccuaugccaagaucacaggaaaagcuauuuguacagugcauuggaagaaaauaaacucuuguaauuaaaagcaacaacaacaaacuaaaacaaacacuaguggacaguuggagagacagcagaacucugcuuucccagaggagcaaaguuugguuccuacaauggaugggucacaaccucuugugucuucagggacucuucuucuggccuccacagagagacacuuacacacacacacacacacacacacacacacacacacacgucccuucuucccagcuggggacgggcuguaaugggcccgugugauagacauacacauugguaccuauugacuggggcugaagaaggguuggaugugcccaugugauaaacauacaagcauauacauugguacccauugaccuggcagugugugaagaugaaaagaugcugugauuccgguaaugcuuuuaaaaacgacucugcaccucauuaauuccaauaggacuuaggcaaguuuaaaaaacauuaguaaaaaauuaagcauaagaugaaugcaucuggcuacaccuauuugguguaugcuuguucucucagauuccuuauuuccuuuucuacaaagcuagggaaaaugcugcucucagaacaagccaguaucuugugacugauaagggcuuagccaaugaaggagacuagggaaguacuauauaaccacuguuuugcuaguacuuuuuaaaaugugugcaugugugucuguauguuugugugugucaguguguguguguguguguguguguguguguguguguguguguguguaaguguuugucuguggagaccagaugaagauucccugaagucacaagagguugugacccacccauuguaggaaccaaaccuuggguccucuagaaaagcaguguucuuaccugccgacuugugucuccagcuguccacuaguguuuguuuguuucauuuugauuugguuugguuuuuuaaaugguaaaaucucagcacuggaguggggaagguggacaugaagccccacguuuagcugaguggcuccuggcauuugaaagcugcuauguuugucgagggauagagcacagucccgagcaaauguguauugcugacaugggcuuggccauggccaggaccccagggccucagcugccuggccauggcaaaggcuucuccagguggcgcucagcaggacagcaaagccuuccuugggucagaauggaaacucuaacaguggaugcagaaaaugcccaccacagcuuucugcugcagaauauuuaccaccugcagacuaaucccuacagagacuguuccgacggagauuagcuaaaccugccuuccuaauccaccauauacccuaaacccugcuuucuuguuuuaucugcaggcaauaacucugccugucuguccaauaggacacaacaaauacugcuucugaggugccugccgcaccuucucugugggacugcguuuugcugcgcugcuggggugucaugacaccccucagggaagugaaacagaggugcuuggcuacuuuccuuccuuaccaccaccggggugcuguguuugcgggacacacugaaacaagacgcugcugguggagguaaaauguagccuaagaucggggccccagaccauguuuuuccgggugaggcuggggcaguucgagcuggggcagacggaggcugugguucucuaacucccggacacgcagacacgucugggaagaggacaaaggcuucuccccauagcaguccuuguggaagaagacagucuuugcuuguccaaacuauuuaauagugguggaaaaggacacauaugacuugcucaggguggaccagagauuaaacaccuuuugcaggaagagaugcccaggaagggaagcucauuggcuaaacccuggagggcggggcaucuaaauaccucauuagcauggagaacuaggcucuaugguaguuagucaguuguccuggugugaugagaauugcugggguuccuuaaucugcucaacuuuuaucaguuuuucugucuagugacagguuuccacucaucucacacuucuccauccgugaguucagguuauccauuccagcauuucucugcccauuuaucugucauuucuuuguuccucgccuugucccuaaucagaguuuuaaauucccaaccuugcaaggacaaagcaguuguggguucugguauauugaugguguggguucacacccaagacuacuugggcaacauaaauuggacucaaaguauuuuauaagauagagaaaaagagagcaaagaauuguguguauaaggaaggacagauauggggggggggguugggaggguaauuaugaucauaauacauuauaugaaauuguguuuguugauuuguguguguauguguguauggguggcacaugcaugccacugugcgugaagagggcagaauaugacuugagggaauugguugguugguuccauccuuuggguccuaggaauggaauucaggucaucccauugguaaugccuaccuuuugucacugagccaccucucaggccugcuucacuaguacugaacacuagccugucuuucauuccaggccuuugggacucaucuuuaauuuucaacacuggcugauuucaagcacgcuuccuguauguucaccucuuaucacugacagcaacaaacaauuaauggcuuuacuuaaaugucucacugccugaaauaacauccucuuccaauuacaaaguaacaaaagccgcgccucuccucuguuccuuucacuggcugcaacaucuugacaucugccucccucucuagcuuugccuaaaacagagcuuaucucaaacgcacuaggucauauguuucuauuaaggacauaguauuugugacuucaaggacccuucggacugguacuuugcagacacugacauucucaaagcuuccauucuucaggauccccagagucuacucugggcaugcauacauuguucuaggaugcaaucacccaaauauuuauguauacucuuaccgcaucaggauuuccuacaaaacaacucuagcuccaucuuugcuucuuguuuuguguuuguuuuugguuuugguuuugaaacaugguugcucuauguggcccuggcuauccuggaacucacucuguagaucaggcaucuucaacacagacauuuccugccucuguaucccaagagcuggaauuaaagguaugcaucaccucugccuggcccaaccuuauuuuuuuaaaacuccaauuagcauaggugcuugaacuaagggaacagagaggucacaagggugucuuccaagccugaccuuccagcagaauuuuuuugagaauuuuauaaagucggcuuguuuuacuaagguucugaaggacugcuugugaccaugaaaucuacauuguauguucauaugcacauguaugugugcuuaccugcaugucuuuaaaaagcaacaacaacaaaaaaaucaaccaagauauuauuaauuauccccacccagacucaaaguugcuauucauuggccucugccucugggugcugggauuggaauaugaaccaccaugccaugaagccugcacucuaugacacuuuucuguguuucagaagaucagccccguuucugaaacauuaagcaagccaggcuccucaaauaucaucucugacaggccguugugagaugucccucccauggcuucgaccaggacaugguccacugacugcucucaauuauguguuuuaaagccaagcuauucuuuucuccacgacuuuugaaacauucaaagacacguaguguuccuuccuggggauuucucuucaguuucaagauccuucagcagaacaugaguagauuggauuuucauuuggauaaugucuuuugauguacaaagcuuuuuaaugaucauacaaguuauuauucauauuuuuccuuuccccaaaugccauaugcuagguucacaaucccagcacucagaggcagagauaugggagcuguuguuuaggaccaaccugggcuauacacuugggcccugccuagggacuggggcuguucaugcuaacuaugcaugagggccugggcucaauguccagcacuacacacacguacauggcaagacugagaguuccuacauaauuccagccaacaacugaccucucccacugcugacaucccacaccaaaccagcauguuggcuacaaagcuuaagccuagaucaacgcauuggcacccagagcccagauuacauugggauuccuucuugauuucuaagugccaugggguuuaacuucauccaucauucuaguaccagacauacagcuucaucacuauucaugucugugaucugccuacacauccccuuucaccuuuugggcauccacugaacuuugcuucccugguuccccucuuucaggaugucuucugcuuggaaccccacuggcuggauccugcuaguauagcugcuauuuucuuuuuaguagcguucaagcuugcuccauguaucuuuagccuugacucauugucgggguguaccagguauauucaccccuuuaccauuuacuuagcuuccaguccagugcuuuugaaacuaugguuuucgaucucugagcugagcacgagagcuccugagagcucaagagcuuuagaauuuugccuggggagacagcuugguggguaaagugcgggcucugaaagaauggggacuaguguguaagcuccucgcugauacagguaagcgccaagcugauacaggccccaaaucccagugcugaagaagcagagacagauaggcccgcaguagagggucugcaacccuauagguggaacaacaauaugaacuaaccaguacccccagagcucaugucucuagcugcauauguagcagaagauguucuaguuggccaucacugggaagagaggccccuugguauugcaaacuuuauaugccccaguacagggaaacgccagggacaagaagugagagugaguguguaggggagcagggcagggggaggguauagggaacuuucgggauaguauuugaaauguauauaaagaaaauaucuaauaaauaucuaauaagggauauguacaugauguucauuuaauggaaccgcucucaugaguucaugcucaaugauaguuaaugaaaucuuccuugaauaauguaauaauaaacauuuucauacucuuaaaaaaaaaagauaggccugcagagcucacugacuucagcggagucagcgagcuacagguuggucucaaaagaaugaggcucauggccaacaauuugcagugcuaggugacgcccgcugcugugaccugacaaucucucacaacucugcuucaagcuuggaccauuuugucaucucuggcaugacucccauguuuuguaaauuugcagagauuugcaugguccccaguagccucugugauuguacuggcugauuuugugugucaacuugacacaagcuggaguuuucacagagaaaggagcuccauugaggaaaugccuccaugagauccagcuauaaggcauuuucucaauuagugaucaaggugggagggucccauguggguggugccaucccugggcugguaggcuuggguucuauaaaaaagcaaguugagcaagccaggggaagcaagccaguaaauaacauaccuacguggccucugcaucagcuccugcucccugaccugcuugaguuccaguccugacuuccuuuggugaaguguaagcugaauaaacccuuugcuccccaacuuucuucuccgacaugauguuuugugcaggaauaaaaacccugacuaagacagugaggucuucugcuucccugggcuguaauucauggggcauagaaacacauuuagcgcugcaugggacacccuagguaccgcugcaucugccaucagcuugaggucugucacagcauguguucugcucuaccaguguugaucgugucucucccagauggccaggcagcagcaccacccaucaccaaccucugccuuuacugggucauuguuucuuguuccaagcaggaauuuccaggucuguguuuguguaacaugaguucugcucugggcugguccucaggugcccuuccauuugccuaugaguaaaaguguucucuguggacagaagugguuucagguacuuuuguguucaucaagacugugccuuuuuuguuguuguuguuuuguuuuguauuuucauacauucaagcucuugagcccucuaguuuuggagucuaauuuccugaaacccuuguguauuuguuuucaaucauagcuaaauauuagaaugauuaaaguagccacaucaguggggaaggguuccacaaauagaaagaaugagagcggggggggggggggagggaaaaaaggaaggaaaaaaggaaggaagggagaaagaaaauuauuaaguagauaucauaaaaaucaaaaacuucuccuccccuccccccuccucucuccccucuuuccccuccccuccuccuggccuucaauauucuccugcucucuuuguccuccuuuucagugguggugguggagucaaacccaggucacaugcaugcugaagucugagcucuacaguggagccauuuauagcuaaaguuacaaauuucugcucaucaauagccacuuacagaaaguuauuugcuccaucucuaucugagagaggacucacagacaguacaucuuagcagcucacagggcucaguaauaaaaugacaauuagccuaguuaacaaauuagccacaaaacuuggcuaagcacuaugcaagggaaauaaugggcaguaaacacaugaaaaguuucuuguuuguuaguuuguuuguauuucuuucucucuauguaucagcccuagcuauccuggagcucucuuuguagaccacacuggccuugaacucacagagauccaccugcugcugucugcagagugccacaaugcccagcgugaaaagguucgauaauaauaaagggaacugaaguugaaaccaaagugagguaccugugaaaggggcccaaguuaagauggccagcacuggcagcggcuggggcucaggcuccggagagcagcagggaaugguaccgagcgcuuuagaaacuggccugagagcuucccaugaagugagacacauacccaccaauggucaaaauacauuccagguuuucaccccagagaaaugaaaacagacaccugccaguagacuuaacagcuuuaguaauaacccaaagugaagcaauucaaaugucccccagaaaauggauacucaaaucguucuauagucguaucauaaacacuauuucacaacagagaaagagugagcuauaucauaugacaacuugaauggcccuugaaaauaugaugcuguguuaaaaagaccacgcacagaaaguacccaccuugugcuucauucauauaaaguuauagauaggcaagcauggagggaggaaucaggcaccacagugcuucuaagguagcgacuuuugaguaauugacaggcccaggacagaacuuucuagaaccauggaccucuccucucuucauugugguguggauaauaaagcauaugugcucaucaaagauaauuuuuaaagugggacaguaaggacuguacauuuaaacuccaugcauucaacauauaugaauuauaaaggaacaagaaagacugaauuugaaaaaguucugcagcuggaguugcugaacagguggucuuuaccucgaagucugaagcccccucccgcuccucacaaccaccucacaggcccugucugucagcauucugcuaucugaucgcuugucaucagaacuccaguuaccugacauggcucucauuccggcacagcuagcaaaccucugugcugcacaacaaagcuggaaagcacuggguguucucucccagcaaggagggcccucugcucugcuggucagagaagagagaggcagagacugggcccucacaaacugcacaugugcggacaugauucuguaggacuuuggcucucucugaugggaacuucuuuucuauugguucaacucuucucccgucuccuccucccucccuucuuugcuucuuccuuuucuuuuuaaacccccauuauuaugcuauacaauccugucugucuuuuguggcaaggagacagaugggacucagucccacaagcaugcccucuugccuggagcuccagcacuagaccaaggucuguccuuuucucuuuagaucugaucaguagaucuucaucauauguaacuaacacuaaucuguuaauaauauauaucuuuccgucuguacucugauuuccuguuuaucucacaacuucuuuguuccguugguuucuccaaaccaaaagccaaguaacaucugcgcacugcccuugcugggaacgacucuugcuugcucucugucaucucuaggcuuccuuccuuuuauuuuuccuugccauuuauuugcugaagaaacugagcuuuuugucucacaaaccaguaaauaccggagugugccucuuucuuaccuguaguucugcucagcugauagcugaucaucaugaaaacacuucuuccccaaaacaacagcuuccgugucugacaucugaucacgcugaggaagacccuggccuaaacucuccugagacaacagcaccgaagaacgauuaauccuccggcgguagcgacuagucuagucuguucacuuaaaagaagccaaacagaaaacugccugccacccuuagccucacaccgaccaugaacuagaauacgaaagccccgcuuuguguuugugaacucguggggcugauaagaaagaacacagccuuggagcuagaugccuucugguuugaaucccaagcucgaguuuacuaaguacaaacuuuuucucagaaucugugucugauuccuuauaaauaaggauaaugucucuuucaccaggcugcugagaugcaccugccauguauggugaguucaauaaauguuucuuucuuuucuggcuuagguuaaaaauagga

SEQ ID NO: 6631 - RNA, 26869 nt, Mus musculus
guuuuucaagacuccguaacacucaguuacaaccacauuauagagacacugaaguuucuccuuuugguggucccagcacaaucuccagcccuggggauucaaagacagagagaaggaaacagucacucagauuaggcaaccaagugucucagauaccaggggcccgagcuggucaaaccaagagcaaaaauaacagcuucuccuugcacacccagaaguauucuagguuagagaguaaguucucagccaaccccaguucugagcuauguccuccaacuauuguguuugugcugcgauuccuuacuggcuaaaaaaggauauccuggcuaaagaauaauugccagaaucacacagcaccuguuugaaguagucagauuuucccucuugcauagagaacaauuguuauccaaauuuuuuuucauaggaagaaaaauccuaaaugagaacaaucugccuaaaauaaauguuagaauuuugauauguugguagccuauugcuauccacacauuaucucucuaucaucuaccugucaaucaucuuuauaggcauuuagaucccuccccauucugcaaacuaaaauacuuaacuuauuagaaaauccauagcuacauauaugaauaugaacauacuauauauuuuuauauacuuauauacauauaccaucauaguuaauauagaguggugguuugaauaugcuuggccaaugggaagugacacuauuaggaggugugguauuauuggagaagguguggccuuguuagaggaaguguguguguggggggguguugagacucuuauucucaggcucugcccaauaugaaagagagucuucuggcugccuucaaaucaagauguagaacccucgacucuucugggaccauguuugccuacacacugccauauuuccugccaugaugauaauggauugaaccucugaaacuguaagccagccacagugaaauguuuuuuuuuauaagaguuacauuggucagaguguuucuucccagccacaaaacccuaaggcacguaggccaagauaaucacuuuuuagauugucacagcaaacacaguauucaagugaaugauagaguauugaacuauaacaucuuuacuccccaauuaugagcauuuaaguuugaauuuugaaauguguuacuacagauuaauacugucucaaaaagaaaauaaauaaauugaguaaccagaaauacuaaaaagaauagcuacacauuuuuuuucuuuucaagacaauauuucucuguguagcccaggcuaugcuggaacuugcucuuuauaccaggcuggacuugaacucacagaaguccuccugccucugccucccaagugcuguguuuaaagguauccugguuguuuuuaaagaggcuuuucuguaaaugaaauuaccaagucaagggaauauucauuuaaaaauuuuaaauugcuaaauucugcugaaguguguccgaauucccauuuuccugugaucuaugcuguaucgaccuuucguuuuguuuuguuuugugguuguuguuguuuuguuuguuuguuuuugguagugcuggagauugaacacaggggccacacacauuccagacaaaugcucugccccgaggcuacaacuccaggccuuucugcguuuuuacaggggcucacuaagcuguccaggauggccuugcacuugggaggcccaagcaagacuugaaacuauaauucuccugccuuagccccucucaaggcugagcuuagaagugugcaccacuaaauccggggguugggggugagaccaaaacaagauuucucugugcagucuugacuguccucaaacucagagaucuaugugccucugccucccaagggcugagauuaaaagcaugccccgccaccaccaccacaaccuggcccaguuauauacuuuuuuaaaaagaccacauuuuuuaacaaaaguaagccguagaauugucagagucuggccugacacguucaaacaccagaguuccauuuucaaaugucacagccugggcaucauggcugggugaggguuaguuuuuguuccuauuucuggaggucaggaaaucucucugaaggcauuuaggcacuuugcaaacacacagagaagucacauuguauauauucuuccccuccacugaaaagcuguguccuuucauuagggagggccagcaaggaagcagcaacgggucuggcuuguauaggauuuauucagaaugaaucauguugucccuuugaugagcuucauagagacaauucuauacucuccaaauccccaccagcaauaacacaagucacaaauagccucagcuuaugggagcuccgcaguccaguggcauggcuucucugggucuccuguggcacaacagaggaugacaggcggcccaaaugcaugccccguuccagccagggcuguuaagaaucagacuuccucugaacccugggguaagccauguauggaccucgaagaccuugucuuugcucucagaguuagacauggccguccugcuugcucuuuggaccucccugccuacacuaggcacagggagagaagagaauccucccccaccuacaagacgugaaguugcuugugaugggagguagccacaagcacagaagcacuggccgccagcagaagcuacagaggcaaagaccagguucuuguauacagacuguacugggcauguggccuuguuuuugagcuaguuaaaaacaaaauguugaacuuguggcuucccagaaauguuugagaauaagucuguguugcuuugugccuccagguccaugguaauuuguuacaguagccccagagcucuccuugcagaugaaguagaagccugggucuaaagagacuuuggguaaguagagucacauucauucccuugggaauagauauugaaugaccaugacgguccagacacaggagcugugaacaaggaugguggcaucccugauuacacugggaugggaguggagaacagguauuacacagagaauaucuuacucacuguucgauuccugugaagagacacuaugaccaagaaaacucuuagaauggaaagcauuuaauuaagggcuugcuuacaguuucagagguuuaauccauugucuucaugacggggagccugguggcacuggagcaguagcugagagcuacauccugauucacaggcugugggagggagggagggacggggagagagagagagggagagggagaaggagagggagagagagagagagagagagagagagagagagagagagagagagagagagagagagagagagagagagagagaacaaaagccugggccugguauggacuuucgaaaccucaaagcccacaugugaccauuguuauagcaaugcuuucaagggauuguuccagggugaguggacuaggaaagagauggcccuucagaucagccauccugugaucugaacccuaaauaucaagacagccuugccaacuggagaaaguuuucuuagaggaaggcgcugucagugcaaagucccugugguggaguccacgagccagaacacacuccucugaggaaggauggaaacccucugucagcggaggcugcuucuggcuguuuuuguccugccuuggagcuaaccuggaaguaagcaugugaggcucuugaucaaguaugaucaaggaggauuuuuuuggauucagcuaaggucgugguuugggcuuuaaacucugcuggcaacguggaacaaaacgcaugguugagauugaccagggaggaaacugucuuccuaagucagcaaagggacccacauugaguguauuguuugugcaaaggccccagagcucaacaucagcagaaaaugugacacgacaaagcugucagcaaaggugacaugcaucugcaaugcuuucaagaucagggaacaccucaaggggcuuggcaagugugcugcuuucagagaugugacuggguagcacagcuuauggggucauaggaacagauaguuauucacuuauucauucaauuaauaaauguuuaaugagcaccuaucaaguucccaacaccaacuagacuuuggggaaauagcagugagugggccauagacggcgaugacuucacagaacuuacuggaaaaggacacagcacguuugcugugugauuauuauuuuccacuauuauuaaaguuuuucgauuauuaaauuguuguaguaauaaaacagaaaaaaguaauuauagaaauauauaguagcugggugguggguguuacacaccuuuaauccuagcacucaggaggcaaaggcuggaagaucuccgaguuagaggccaaccuggucuaccgagcaaguucuaggacagccagagcuacagggagaaacccagucucaaaaaaacaaacaaaaaucauagucuucugaauuugcuuuuuaguuaauaugucuugaguacccucuguucacaaauacucauuucuuuuuaagagcugaguaguagucuacauuaugaaugcagcacaguguaacuguggucuucuugguagagcuugucuguacuauaaauaacaugcaaagaaaacuaccgagcaugucuuuauguagccuaugggcgcauuuuuaaagggcaaacacauaaaagugaaugugggucaaaggggacugaguaauuuaaucgagacauugcuaugaugagcccacauguccuacacccccagcaacacgggugucagggguggccauccuguccaaugggaaugacagccacuuguuuaaaugaaccauucuaaccucuacuucagccgaugugaagcagccuaacaggaaguagucuaaggccucauaaagugugugcugugaccccauguggugucaugaggcuaaaucugaaggucucaaaggcuuuggccguauuaaaagcucacugaacauacaacaauuaaaaaguaguuuuaagccacacaacccagugcucccgggguugccgcaucacaggcccucacaaagccuuucuucugaacacuacacccguauuuugcaccguguaugacguuacucagugcugaugguuccugccggggaaggcucagcucagauuugagcuacgacugcuguagagugcuccacugugcaugcaguuuucugcucuugcagacaggccaggcuggaacuguggaaaacagaguguuuuccugccguccuuccucggcccauggguaugaaguuauugugucucugacuguucgcuguuagaaaguuugauguuaagaauuguuauuugagagcugggugugguggugcacgccuuuaaucccagcacucaggaggcagaggcagguggauaucugaauucaaggccagccuggucuacaaagugaguuccaggacagccagggcuacacagagaaacccuaucucaaaaaaaaaaaaaaaaaaaaaaagaauuguuauuugaguuucauagaaaucauucaguggauuauggugugggaguaggacagaaucucuaauaauucugaaggggucccagucauacucccaacauuuuguacuaugcauucgugagaggcagccuucuugguauugacaguuauacaaucaaaauauugacccacucugaaagaugauggaggugcuggagauccuacaauaucacauauccagccaagacuugguucauuuauggaaacaagcauggugucgaauuauuaugcaaacuugcuuuaaucguuaauaaauaguaaaaauuacauguauacuacagaauugcuuuaaaauaaauuucuuuaugauuuauuaucugcaaauguuuuauuuguacacagauuuuauagaccuauacacucucgagcugugcacaacuuuccugggcaaacagggauugugaguguagaaacuugaaaaaccuuggcucugauugaagcuguaucggcagagcucuggugaggguggccaggggaucccaggcagugcagacagcgugugcaaaggcccugugggaaagacagcccucgcucuugcagaacugagcugagagcaagacaggaaugacagugagaaguauuacacacacccagcaccuuuggaauuuuauuccuaggaaagggagaagauggugaaggauacauguaaucugaccuagcaggcuggccuuucuaacaaacccucuugggaccgggaagagggaaugguggauucagaaucaacucaggcagugaacuuggagggucugggagagccggggauggcuagaccaaagugaggacugccaggggagaaguggcaagaguuaucuagacugccuguaugcuugagugggcuuggcagagagugcagacauggcagaaauuggggagagaggaucuaccaccaggacaaaaggagaggccauagaaauuggggagccuccggacaaaagcagaccucuaggagggaaccugcuuugagaucaguacucggcccuugugcuuacagccgccccugcuuuagcugcucacacagaacagcaccugagccuugauguggugugugcgaucuggaagccugcucauggaaggaaggcacagcgccucacaggacugcuuuguggagcaggagggagagcucuagggugaucuuuggagcugggggucauaggcugcugccuaagugggaaacaggaaaugaaauuaaaaggaagccgaagaugaaggaagaaggaagaggaagagagaggcucccuggggugcucuugcugggcugcagccugggagcacugggagcacugggagcauugggaagggcaggccugaguguagcagagcaggaagagcucaucucugagucuggggugaccuggccucucugcugccauaucgguaaccuuuacuuccuggaaccacugugagaauuaaguaguugcauggaaacggaagaaaauacgugcaauacaaaaccacuagagaacauguguccagaauugaaaccgacaagagcaggagguaaaaagacagacgcaaaaggauggagcagagaaccggaaguucugacaggagaggcacagacacagcagugugugugugugugugugugugugucugugugugugugugugucugugugugucugugugugugucugugugugugucugugugucugugugugucucugugugugucuguguguguguguuaugugugugucugucuugagugugugcauguguguaucuguauuauaugggugagugcgugugugucuguguguguaucucuguguacgugagugugaguguaugugagugugugugucugucugucuugugugugugugagugugugcgugugucugugugcaucucuguguaugugaaugugugugugugugugugugugucugcaagugugugugugucuuuguugggggggcagccucauuaaugaaggaaaauacagagcaauucacaugaaaccaccuguguaacacccagcaaaagaggcaaaaaaagacagaugaaugcaugaaauauaacucauuaauauuaauaacuuaauaauauauugauugauagcauauauuaauaacuuaaguauuuuaaaaauuaguuucaucaccauugaagcucuagcuaaauaggauccauguucaucaguuuguaaaaucugaugaucccaacuggaaggaugguauuggggaacucagugcugcugaugguuggagaccugugagaccacccccuggaguacuacacagcccugaacuaugagauggaaacuugggagcgugcuugucugggauguuccaaggcucugggcucaaucuccagcaacccccaagaagacauagcaucugaaaacaaaacuaagcuacaaacgguguagcuugcauuuccuaucacauguugagaaaaguccaaagacaagaagggauuggcaugaaaucacaguggggccucucagagaggagagggugggagcccacaggggcgcucccccaacaggccauucuccaggacuugggaugcucugacuugacccuggagguaacugcacuguuugcccugugauuguuccuuauaccaugcauuuguuuugaacacuuuaauccaggaguauuuuauuccacaauuuaagcagguuuaaaaaggagauagcuaacacuuguaaaacgcuuggcacggugccuagcccauauuaagaacucaacagauggcaauuuuauuuacuguucuaacucgguuguuagagccgccuugucuccuaagcaaccuucccgcaucuccugggugaauguugucuccaugaagccuggcuuggaggcuuagaauccggacucuuguuucccagggcgacccccugugagaccugcugggcuuucccaguggaaggugugguguauaaaacgggcucacacccuccucaugugcugccagaguuuggcagugugcaaaaauaaaauaaaauaaugcaauucccaaaaacuagucugcuaaaacgaacacugugcauccuggggaccaagcuagaguccugccugcuggcauuuggaggucaagauugaacccaguggcaagcuaaguggcaagcgcuaaagaaaagggagcagggaguuggcugggcagggaggcacacauuuguaaucccagcgcucuggaaguggaggcaggaggaucagaaauguaaggugguccucagccccccucacuugguagcuagcuugggauacaugagacccugccucaaacaaaacagagcaaagcacaagcaacaaacagaaaagaagaaacaauggggagagggagggagggagggagggagggagggagggagggagggagggagggagggaggggugaaaugguaccugugaaucugaaagauaccucugaguaccaaguaaggcaaugggccagaagaacccugggguagcugcuaugauauauauauauauauauauauauauauauauauauauauauauauauauauauauauauauauauauauaugucuucaguuccacggacaggcaagcaaucacuaucuuaaggguuucuagcaaugucucucuuccuuccaaaccuaacacugcaauccuacaccgcaaccacuaaacagccuguaucauacuaucugauuagugcuguucaccacaagcaggguggagugcuaauucgcagagagcugcugccagucauuugcaaguuggcagccccgcagagacacacgucugcaggaaugugcugaaggucacacagccagcaagugccagaccaagaaggaucuuccuuugugauugguucagaagggaggggguggaggguggggguggcagcaggaguggccuagaggcuuggaguuagauggaugccugguuugcuaacaguucagaaacuacuuaaacugacccaggguggaaaugggggucugggugugguuaaggagacagaagcacucccucuggcagcuugaauggcugaacagcuuccugcugaguggugaguuagaagaaauggcuuacaagauccugaaaggagccaucaugaaaaguccuguuuugugcagagcuucugauggggacuagcuuuuagcuuuuguuuuaaaacucaacucuccaaaaucccaaagcaugccaccauguuuaugcucugcaaucguaucacccgugggugcaucucuagagcucuagaauaggucagacuccaguaaggcugcuugcauguagaugacaguugcacagagccucuggcaauuuaaacagacuaagccucuaagagagagaaagaauuugcacacccccccuccccacuucuuugaccccacaccagugacaccgaucuuuccguggcaaccuuccugccaucggagggugaacagcuugugugugugccgugugcugugugugcagcacuggccguggcaguuggcuguguuuggacacuuugcaaucuguacucugugcuuuuguuuccagggucucgugagccacuuuacucugcucaugacucuccgguggaaacaucuugcuuccaugguucagagugccugugugucaggaaugauggacaugcuaauuuggagcaggcuuccauuaaaccuuugccaugauuuggcaaaacugccuuggcuguggcugguauucugacccaggaauggaaacagauucuggcaucucucuguggcaagaauaacacagcugaguuguauguugugguucuuacagucucuuaauacuauuuuauagagacuuacaaauugucccauguucagcucaauuuguuguuuauugauuuuuuuucuuucauuuguuuguuuguucguuuguuuguuuauuaaggcaucuuucuauauagcucuggcuaguuuggaacccacucauucgugccaucaugccuggcccacaucugcuauuuugauaggcuuuuucuuuuaagcaguuuuugauugauggcaaaacugagcaggaaguacaguuuccaaaacauguaacuuccuccucuaugaauauuucucagccaaguggcacaugugucacagaugagggucugacacugucaucacugucaccccuguauauccaccauuguagugguuucacugcccugagaaauaccuggcuuauuuaucucugcucucugcuaacccccuguaaagccacagcuuugucuuaaccaucccaguagguguucuuuuccggucugcucuuuuucuugugugugcacuuaagauuguucugugucauucuauggcuuggcagcucauuucuuuucagugcugaguaauacuccauuugucuggauguaccacaguguuuccuuucuuccguucuccugcugagggacaucuuggcugcuuccucauuuuagcaagucugaaugaagcugagauaaacauccacgcgcagguuucuguguggacauaacuuuucaaucuuuuggguaaauacccaaaaagcaugauuaccggaucauaugguaagaguauauuuaguuuugugagucugccaagcugucuuccaacguggcgguuccaccggcagcauagugaagucccugcuucuagucuuggcagcguuuggcacugccaguguuuuuagauguuagccacgcuaaugguuguaugauggcaucuuccuguugcucucauuuucauucccgaguacuggaugcgucuuccaucucuauaucuucuuugaugaggcaucuguucagagaguuugcccauuuuaaaacuauguucguugcucauaucccuauuggguuuuaagagggucuuguggaguuuggauaacgguccuucaucggguaugucuucugccaguauagucucccagccuuggcuuucccuguuuuccugcacauacaacacugugauguuauaugugguagggguuauaaaugcauuuaaaggaagcguuuccuuuuagguugcuuauucucauggagaaaagucuacugccugggcauagcaguccucugguguuuuuauauuggcugucugugauacugauaagagaucauaggugugacaaaccguccagagaccugcccuacugggacguugucuuacucaggaagaguuuaagcaaaacucuccuggccuguguauucagauccugcacuggaagacuggauguuacuggugaucuaagacuaccaaugacugguaauuacacagucuuucagaauccauguucacuggcgucaccuccauggcuuagugaaauagcaaaugacuuacccaaaugaggugggcuguggcaagaaucaucuuuauuucguuugccuggcauaaccauuucuaaguagcauggaguucuaagcugugugcuucauguaacuucccaugaaguugagucucacaugggugaauggacaagacacucuggcacgccccgcccccaaguaaugcaggcagggcuauuucgauguguagguggaaaacagcgugcuagagcccagcacaagcucagagaccugcaguuggacacaaccaauccacugaaucaauaggcaaggugccacugcagaauguggugcccggccuucagucugagcugagcagcagagaagcaaccauuucuuaagacagcaucagcuuuagcuaacaagagcugaaccgggcauccaggcugugcucccaacaccagucucugccucauaagucaucaaggucccuagagauggcauucuuuuugacauucaagaaguucugaaggacagaaaggagugagaggggccaagggacacagcccugucucuagccaggaagaauuucugagccaccugacugcaaacacucuucuuggugagacugccacaaauggucuccagaaaugcaucucucagucuuaguuucuagccuggugagugacaauuucugccaacucagcacugugauaagaguagucacaaaccaauuucagccagcucaguacuguugcaagaugagucacagaccacugucuggcacauaguagggacucaagaagugcuaggaaaucaaaacauccauccuuauucagucucaccccaaccagaagaacccagguguggccuaaagacacauggcuucugcugggagugggauucugucuuucauaagcaaaauugccaaugaaaacuagcuuuaaaaaugauggugaauuuguaucaguucaugucacuggaaaguuuuaccaggccagcuuuagcuugacucagaagcccuaggauauaguaaaagaccuggcuccucuccuccccugcuucugcuccccuuucucugcaccccauuuaucucauccacuggucuuccccccacuccuccucuucuuccuccuccuccuccucuccuuccuucuuuuccccucauccccccuuucuccaggauccugauauaucgcucaggcugguucugaacuccugcaguuugcugcuucauccucgauggaggugagaccacagacagcauuaugccuggcaccgaccugguuucaacucggcuucuaagguuugagcuccuucccaagucuggccucccuuaucuguacaagauggucgugaacagacgucuggguccaucuguuacauuuuuuuaccccgugacgggaaacucuuugugacaagagcuaucacaagacagaagucuguuucuuccucaaaaaaagagaagcuuugagagucuggggcugauucucugaugccacucuucacgucuagcaugauccuccacuuccuggagcauggcucuuucuuuaaggucaccucaagguccaaaugacuucuggagcuccagccauuacaucuaacaccugcauuuuaggcuggaggaaggggcagaggaaagagugucccuucaucuuuacgguuggucgcaucauagaacauuuuuuacuacauuuuguuggcagauauguagucacauaggaucuuuacaagagagccuggguagaguguguuuuguuggacuucagugucuauauuuaggaauucaguuauucuuauuccuaaggauaauuugcugccauacagaaccacaugcuucuauuuuggggaccaggggacaguggcaguccuuggggggaucaucacagaaagaaagaaauauggcucaaagacugcagaagcucaaaccaagugucuuaguuaggguuuuacuucugagaacagauaccaugacuaaggcaacuguuauaaaagacagcauuuaauuggggcuggcuuacagguucagaaguucagucuaucaucaaagcaggaacauggcagcauccaggcaggcauggugcaggaggaguugagguucuacaucuuuaucugaaggaccccaggagaagacucucucuacucagacuugagcauauauauauauauauauaaaaccucaaaguccacccccacagugacacacuucuuccuacaaggcuauaccuccuucaauaagaccacacaggcacagcauauucaaaccaccacacaggguuuuguacugcaucccuggaccgaucauugcagggggugucagagaugcuaauguugauuggaugagcauaguagagacugcaccuauuuaaacagaggaauccacuccacuagccguugccuagaauauucagagagcugacaagauaauaaagggggacgggggaugucaacaaagagucccccugccacuccggcacccuuuucaauaagccgaacaauccuagguuguuaaacuuuuccauauaagucaaugccagguguuaagucauaagccagcacaaauuccaaacaccaguuagcuuuaguuucaggcucauuguagguaccuauacuugugcaaagauuaagacaaagcgucacuaugcuugcuuggguagggguaaguaauugucaacacaguauuuccccauucuugacuccugucucuggucuucuuuuucuguuguguuugcuucuucccugagccuuagacuugccaucuugcuuugucagcuucagugucugcccuuuccucuccuucucaaaguuuuguuuaguaaaugccuccgagucaauuucuaacuugcuucuguugucugccaagguuauuuucagugcccaaaggcaugaaaguaagagaaaaagauuggggaaagcagguaauggaagaggaaaccugagggcaagggcauccucucucaggguugaggccucccagagcacacgugagcuuuuccacugcucacgugcauggacgagagaaagccugccuucuucugugugaugcucagaguugagcccgaacacauucggguggggaacucaaggcuguggcucucggccuugaggagugagaugccuccccgagcugagcuagaucaagggagacuugaguucacucucugccuccuucugacacacccugcagcagcaaggguggaggagcugucagggucugcccucaguuucucuugcagagugcuacucgugaaaucccucaggaaaucaagguuucucgggaugcccaccugucccgguaaugggguggggauaauagcucacuucaauugccagucacucuaaguaccuugcaugugugauaacaauagcagauagcacucaauauggugaguacuccguuucaggcacagucaaaacuaguugaaaccuagaaauguauuuuauucucuugcauuccccugaguaucagcuaucauuaauaacuacccagaucgaucugauugugagauaaaagucuaggcuggagcuguuucacugguucauggcuggcaacaugaccugguuucaagucagcugugugcucuuucuuggaaaguguguguguauggcaugugugugugccauacaugugcauguguguaugugcuugugugccuagguuuuguuucauguugcugugauaaaaauguccugacaaaacaacccaggaaggguuuauuuuagcucacaauucuagguggcaguccaucguaguggggaagucacaggagcagucagagggagcaaacagaacacacucauggcggcucucagcaaccucuccucucuucagccugugcagcuccuagcccugaaauggugccacucacguucaggguagaccuucccaccguaauuaacccacuccaaaaaaaucuuuuccaggcauguccacaggucaacccaaucuagacaguguuuccuggagauucuuccuaggugauuuccccaguguaauaaauggacaauuguaacuagcuaucacaguuuucaauuaccuaagagcucucaagucuacuccugguucugagucaccuagaaauuguucaaaucagggugcuggauggggccgcuccaauuucugauuuaguaggucucaggaaagcccugaaaguaugacuaacaagucuccaguguguagauagggauguccccgaccauauauggaggagagccucugacucaaagcucuccuuccucaguucuucuuucuggaaagaaucuucagauuugaggaaagaguaaauggauauuaaauacacacacacacacacacacacacacacacacacacacacacagacagacaccaaugaccuaugaauaacaggccuaagguaccugugggauggagaagaaacgugugagaacccacccacagggaggacaugccuugaaaacugcuaaagcaugcagucacaaagggcauguguuauauggaucuaguuccaugucucaagcaggccaguucagagauggcuguucaggacugagagcaaggaggaauggggaguaugcuugccgggcuucccuuggggaugauaaaaauguccucgaacuagguauuugugaugguugccaccauuguaaguguacuucaucacuaaaucaagcaccuuaaggugaccaaagaggucacuuuuaugaugugagcauuuuaccacaauaagauauuaaacgugugaaugaaguccaacucaauuuagguagccaguugaaauguuugcaggauuacggcugagaaugcaaaggccccuacaggacucacauaaaugaaucaccaggggguguugcucuauagcucuaucuuagacacccucuggaccacggucucuggaggugaggcauccacagguuuaaagcaugccuccaaagaucuuaugcacagccaagacaggggucauuguccauagggcuccuggccacugccacugacccuuguuugggaacagggugaggaguugaagggggagacucuugggaucagcucagcucucagaccuuggagaucagcuuugcuaccucagacaaauucugagcacgcagagaacagcauuucauugaauuuuugcaagaugcacagggagggacgggaccacauccgaucucugccacugccuguguuuuccagccuggaaggaacacacaguacucugugcaugugaaaguccuacgcugcagcaucuucacccuaaguccaaccugcucccuuccauagggacaaaguguguugagguagaguuaguagcgagaggcuaaagcccauugaaauucauucuguccuuucauucugucccaaacucaaauuuacuuugucugucaaaaccagacuaaagauaaaaauccacucauaauuucuaauaaaaauauugucugaauuuuuccaugaguuaguucaguccuuagacauagguauauugguaauauauauguauucaaccacguugugguacagacacaaugauauacucugcaauuuuuuccucuuggcacugugucuauagcaaugucugguuucaauaguucauuccugacguuuuguucuugugguuuuugacacgggaucucacuauuuaguuccuggaacucacuacguauaccagguuauucuugaacacgcggagauccaccggccucugcuucccaagggcugggcuuaaaggugugugccaccauggccggccauuacugacauuuuaaccucacguuucauggugguuuugcuauaguuuccuuugauaaucugucauuaagccuuagccugcgucugagucuucagugguagaaaccaugccagauugaagcauugugugaugacuuuuaaacuuguuuccuuaagauaaauuucccccaaguuccugggccaagggugugagcgcugcaggcuuugaccacacugcucaauaucuucccuuacauuugauuguaaccugccagugugcgcaucauuuucaacaacuugccgaugcugaauuccagaguuuguaaaagccuuacaaacagcacagauucuaacuugacacagaccggugacucuuccagcuuugggacucaaacaauaccccuuuccucauucuucuucagaugcaagucccugauguuuguaagcugccugagggcacauugugaaaaucaauacuuacagguuuuuugguuuuuuuuuuuuuuugaagcaaugaguuauucaaccaaucccacuucccaauauguuuucuguuuuucuaauagcagaagguuuuguuuugcuuguuuguuuccaaaguaaacuaaauaauacuuuauuucauguuugcuggcugccuuagggggcugugcacacgagagacguaugaagauuuucacugggugaacagacaucuucccacauugcuaagucaucacuguucucguccagugucucucugcacccccauuuuauuuccugccuaugccaagaucacaggaaaagcuauuuguacagugcauuggaagaaaauaaacucuuguaauuaaaagcaacaacaacaaacuaaaacaaacacuaguggacaguuggagagacagcagaacucugcuuucccagaggagcaaaguuugguuccuacaauggaugggucacaaccucuugugucuucagggacucuucuucuggccuccacagagagacacuuacacacacacacacacacacacacacacacacacacacgucccuucuucccagcuggggacgggcuguaaugggcccgugugauagacauacacauugguaccuauugacuggggcugaagaaggguuggaugugcccaugugauaaacauacaagcauauacauugguacccauugaccuggcagugugugaagaugaaaagaugcugugauuccgguaaugcuuuuaaaaacgacucugcaccucauuaauuccaauaggacuuaggcaaguuuaaaaaacauuaguaaaaaauuaagcauaagaugaaugcaucuggcuacaccuauuugguguaugcuuguucucucagauuccuuauuuccuuuucuacaaagcuagggaaaaugcugcucucagaacaagccaguaucuugugacugauaagggcuuagccaaugaaggagacuagggaaguacuauauaaccacuguuuugcuaguacuuuuuaaaaugugugcaugugugucuguauguuugugugugucaguguguguguguguguguguguguguguguguguguguguguguguaaguguuugucuguggagaccagaugaagauucccugaagucacaagagguugugacccacccauuguaggaaccaaaccuuggguccucuagaaaagcaguguucuuaccugccgacuugugucuccagcuguccacuaguguuuguuuguuucauuuugauuugguuugguuuuuuaaaugguaaaaucucagcacuggaguggggaagguggacaugaagccccacguuuagcugaguggcuccuggcauuugaaagcugcuauguuugucgagggauagagcacagucccgagcaaauguguauugcugacaugggcuuggccauggccaggaccccagggccucagcugccuggccauggcaaaggcuucuccagguggcgcucagcaggacagcaaagccuuccuugggucagaauggaaacucuaacaguggaugcagaaaaugcccaccacagcuuucugcugcagaauauuuaccaccugcagacuaaucccuacagagacuguuccgacggagauuagcuaaaccugccuuccuaauccaccauauacccuaaacccugcuuucuuguuuuaucugcaggcaauaacucugccugucuguccaauaggacacaacaaauacugcuucugaggugccugccgcaccuucucugugggacugcguuuugcugcgcugcuggggugucaugacaccccucagggaagugaaacagaggugcuuggcuacuuuccuuccuuaccaccaccggggugcuguguuugcgggacacacugaaacaagacgcugcugguggagguaaaauguagccuaagaucggggccccagaccauguuuuuccgggugaggcuggggcaguucgagcuggggcagacggaggcugugguucucuaacucccggacacgcagacacgucugggaagaggacaaaggcuucuccccauagcaguccuuguggaagaagacagucuuugcuuguccaaacuauuuaauagugguggaaaaggacacauaugacuugcucaggguggaccagagauuaaacaccuuuugcaggaagagaugcccaggaagggaagcucauuggcuaaacccuggagggcggggcaucuaaauaccucauuagcauggagaacuaggcucuaugguaguuagucaguuguccuggugugaugagaauugcugggguuccuuaaucugcucaacuuuuaucaguuuuucugucuagugacagguuuccacucaucucacacuucuccauccgugaguucagguuauccauuccagcauuucucugcccauuuaucugucauuucuuuguuccucgccuugucccuaaucagaguuuuaaauucccaaccuugcaaggacaaagcaguuguggguucugguauauugaugguguggguucacacccaagacuacuugggcaacauaaauuggacucaaaguauuuuauaagauagagaaaaagagagcaaagaauuguguguauaaggaaggacagauauggggggggggguugggaggguaauuaugaucauaauacauuauaugaaauuguguuuguugauuuguguguguauguguguauggguggcacaugcaugccacugugcgugaagagggcagaauaugacuugagggaauugguugguugguuccauccuuuggguccuaggaauggaauucaggucaucccauugguaaugccuaccuuuugucacugagccaccucucaggccugcuucacuaguacugaacacuagccugucuuucauuccaggccuuugggacucaucuuuaauuuucaacacuggcugauuucaagcacgcuuccuguauguucaccucuuaucacugacagcaacaaacaauuaauggcuuuacuuaaaugucucacugccugaaauaacauccucuuccaauuacaaaguaacaaaagccgcgccucuccucuguuccuuucacuggcugcaacaucuugacaucugccucccucucuagcuuugccuaaaacagagcuuaucucaaacgcacuaggucauauguuucuauuaaggacauaguauuugugacuucaaggacccuucggacugguacuuugcagacacugacauucucaaagcuuccauucuucaggauccccagagucuacucugggcaugcauacauuguucuaggaugcaaucacccaaauauuuauguauacucuuaccgcaucaggauuuccuacaaaacaacucuagcuccaucuuugcuucuuguuuuguguuuguuuuugguuuugguuuugaaacaugguugcucuauguggcccuggcuauccuggaacucacucuguagaucaggcaucuucaacacagacauuuccugccucuguaucccaagagcuggaauuaaagguaugcaucaccucugccuggcccaaccuuauuuuuuuaaaacuccaauuagcauaggugcuugaacuaagggaacagagaggucacaagggugucuuccaagccugaccuuccagcagaauuuuuuugagaauuuuauaaagucggcuuguuuuacuaagguucugaaggacugcuugugaccaugaaaucuacauuguauguucauaugcacauguaugugugcuuaccugcaugucuuuaaaaagcaacaacaacaaaaaaaucaaccaagauauuauuaauuauccccacccagacucaaaguugcuauucauuggccucugccucugggugcugggauuggaauaugaaccaccaugccaugaagccugcacucuaugacacuuuucuguguuucagaagaucagccccguuucugaaacauuaagcaagccaggcuccucaaauaucaucucugacaggccguugugagaugucccucccauggcuucgaccaggacaugguccacugacugcucucaauuauguguuuuaaagccaagcuauucuuuucuccacgacuuuugaaacauucaaagacacguaguguuccuuccuggggauuucucuucaguuucaagauccuucagcagaacaugaguagauuggauuuucauuuggauaaugucuuuugauguacaaagcuuuuuaaugaucauacaaguuauuauucauauuuuuccuuuccccaaaugccauaugcuagguucacaaucccagcacucagaggcagagauaugggagcuguuguuuaggaccaaccugggcuauacacuugggcccugccuagggacuggggcuguucaugcuaacuaugcaugagggccugggcucaauguccagcacuacacacacguacauggcaagacugagaguuccuacauaauuccagccaacaacugaccucucccacugcugacaucccacaccaaaccagcauguuggcuacaaagcuuaagccuagaucaacgcauuggcacccagagcccagauuacauugggauuccuucuugauuucuaagugccaugggguuuaacuucauccaucauucuaguaccagacauacagcuucaucacuauucaugucugugaucugccuacacauccccuuucaccuuuugggcauccacugaacuuugcuucccugguuccccucuuucaggaugucuucugcuuggaaccccacuggcuggauccugcuaguauagcugcuauuuucuuuuuaguagcguucaagcuugcuccauguaucuuuagccuugacucauugucgggguguaccagguauauucaccccuuuaccauuuacuuagcuuccaguccagugcuuuugaaacuaugguuuucgaucucugagcugagcacgagagcuccugagagcucaagagcuuuagaauuuugccuggggagacagcuugguggguaaagugcgggcucugaaagaauggggacuaguguguaagcuccucgcugauacagguaagcgccaagcugauacaggccccaaaucccagugcugaagaagcagagacagauaggcccgcaguagagggucugcaacccuauagguggaacaacaauaugaacuaaccaguacccccagagcucaugucucuagcugcauauguagcagaagauguucuaguuggccaucacugggaagagaggccccuugguauugcaaacuuuauaugccccaguacagggaaacgccagggacaagaagugagagugaguguguaggggagcagggcagggggaggguauagggaacuuucgggauaguauuugaaauguauauaaagaaaauaucuaauaaauaucuaauaagggauauguacaugauguucauuuaauggaaccgcucucaugaguucaugcucaaugauaguuaaugaaaucuuccuugaauaauguaauaauaaacauuuucauacucuuaaaaaaaaaagauaggccugcagagcucacugacuucagcggagucagcgagcuacagguuggucucaaaagaaugaggcucauggccaacaauuugcagugcuaggugacgcccgcugcugugaccugacaaucucucacaacucugcuucaagcuuggaccauuuugucaucucuggcaugacucccauguuuuguaaauuugcagagauuugcaugguccccaguagccucugugauuguacuggcugauuuugugugucaacuugacacaagcuggaguuuucacagagaaaggagcuccauugaggaaaugccuccaugagauccagcuauaaggcauuuucucaauuagugaucaaggugggagggucccauguggguggugccaucccugggcugguaggcuuggguucuauaaaaaagcaaguugagcaagccaggggaagcaagccaguaaauaacauaccuacguggccucugcaucagcuccugcucccugaccugcuugaguuccaguccugacuuccuuuggugaaguguaagcugaauaaacccuuugcuccccaacuuucuucuccgacaugauguuuugugcaggaauaaaaacccugacuaagacagugaggucuucugcuucccugggcuguaauucauggggcauagaaacacauuuagcgcugcaugggacacccuagguaccgcugcaucugccaucagcuugaggucugucacagcauguguucugcucuaccaguguugaucgugucucucccagauggccaggcagcagcaccacccaucaccaaccucugccuuuacugggucauuguuucuuguuccaagcaggaauuuccaggucuguguuuguguaacaugaguucugcucugggcugguccucaggugcccuuccauuugccuaugaguaaaaguguucucuguggacagaagugguuucagguacuuuuguguucaucaagacugugccuuuuuuguuguuguuguuuuguuuuguauuuucauacauucaagcucuugagcccucuaguuuuggagucuaauuuccugaaacccuuguguauuuguuuucaaucauagcuaaauauuagaaugauuaaaguagccacaucaguggggaaggguuccacaaauagaaagaaugagagcggggggggggggggagggaaaaaaggaaggaaaaaaggaaggaagggagaaagaaaauuauuaaguagauaucauaaaaaucaaaaacuucuccuccccuccccccuccucucuccccucuuuccccuccccuccuccuggccuucaauauucuccugcucucuuuguccuccuuuucagugguggugguggagucaaacccaggucacaugcaugcugaagucugagcucuacaguggagccauuuauagcuaaaguuacaaauuucugcucaucaauagccacuuacagaaaguuauuugcuccaucucuaucugagagaggacucacagacaguacaucuuagcagcucacagggcucaguaauaaaaugacaauuagccuaguuaacaaauuagccacaaaacuuggcuaagcacuaugcaagggaaauaaugggcaguaaacacaugaaaaguuucuuguuuguuaguuuguuuguauuucuuucucucuauguaucagcccuagcuauccuggagcucucuuuguagaccacacuggccuugaacucacagagauccaccugcugcugucugcagagugccacaaugcccagcgugaaaagguucgauaauaauaaagggaacugaaguugaaaccaaagugagguaccugugaaaggggcccaaguuaagauggccagcacuggcagcggcuggggcucaggcuccggagagcagcagggaaugguaccgagcgcuuuagaaacuggccugagagcuucccaugaagugagacacauacccaccaauggucaaaauacauuccagguuuucaccccagagaaaugaaaacagacaccugccaguagacuuaacagcuuuaguaauaacccaaagugaagcaauucaaaugucccccagaaaauggauacucaaaucguucuauagucguaucauaaacacuauuucacaacagagaaagagugagcuauaucauaugacaacuugaauggcccuugaaaauaugaugcuguguuaaaaagaccacgcacagaaaguacccaccuugugcuucauucauauaaaguuauagauaggcaagcauggagggaggaaucaggcaccacagugcuucuaagguagcgacuuuugaguaauugacaggcccaggacagaacuuucuagaaccauggaccucuccucucuucauugugguguggauaauaaagcauaugugcucaucaaagauaauuuuuaaagugggacaguaaggacuguacauuuaaacuccaugcauucaacauauaugaauuauaaaggaacaagaaagacugaauuugaaaaaguucugcagcuggaguugcugaacagguggucuuuaccucgaagucugaagcccccucccgcuccucacaaccaccucacaggcccugucugucagcauucugcuaucugaucgcuugucaucagaacuccaguuaccugacauggcucucauuccggcacagcuagcaaaccucugugcugcacaacaaagcuggaaagcacuggguguucucucccagcaaggagggcccucugcucugcuggucagagaagagagaggcagagacugggcccucacaaacugcacaugugcggacaugauucuguaggacuuuggcucucucugaugggaacuucuuuucuauugguucaacucuucucccgucuccuccucccucccuucuuugcuucuuccuuuucuuuuuaaacccccauuauuaugcuauacaauccugucugucuuuuguggcaaggagacagaugggacucagucccacaagcaugcccucuugccuggagcuccagcacuagaccaaggucuguccuuuucucuuuagaucugaucaguagaucuucaucauauguaacuaacacuaaucuguuaauaauauauaucuuuccgucuguacucugauuuccuguuuaucucacaacuucuuuguuccguugguuucuccaaaccaaaagccaaguaacaucugcgcacugcccuugcugggaacgacucuugcuugcucucugucaucucuaggcuuccuuccuuuuauuuuuccuugccauuuauuugcugaagaaacugagcuuuuugucucacaaaccaguaaauaccggagugugccucuuucuuaccuguaguucugcucagcugauagcugaucaucaugaaaacacuucuuccccaaaacaacagcuuccgugucugacaucugaucacgcugaggaagacccuggccuaaacucuccugagacaacagcaccgaagaacgauuaauccuccggcgguagcgacuagucuagucuguucacuuaaaagaagccaaacagaaaacugccugccacccuuagccucacaccgaccaugaacuag

SEQ ID NO: 6632 - RNA, 2178 nt, Mus musculus
caacucucagacaccucgcgggcucgccagcaccggcaccggcugcgccaggccggaacggggcgcgcuugcggccgucgggcgccuucuuuuuggaccucggggcccuccacaccguccccucccccgcccgccucccuccccgccuccagcgcccuccccgcggagguccccccacccccaucccgccucccugcguccuccgggccgcaccgcccgggccggcgccgagcgcggggaagcuggcgggcuagggcgccccgcuccucugcucuacccucccccgucccggcuccgcgaggccgcacgucgccgcccgcgagaugaugcaggacguguccagcucgccagucucuccggccgacgacagccugagcaacagcgaggaggagccggaccggcagcagccggcgagcggcaagcgcggggcucgcaagagacgcagcagucggcgcagcgcgggcggcagcgcggggcccggcggggccacgggcgggggcaucggaggcggcgacgagccaggcagcccggcccagggcaagcgcggcaagaaaucugcgggcggaggcggcggcggcggcgcgggcggaggugguggcggcggcggcggcagcagcagcgggggcgggagcccgcagucguacgaggagcugcagacccagcgggucauggcuaacgugcgggagcgccagcgcacgcagucgcugaacgaggcguucgccgcccugcgcaagaucauccccacgcugcccucggacaagcugagcaagauucagacccucaaacuggcggccagguacaucgacuuccuguaccagguccugcagagcgacgagcuggacuccaagauggcaagcugcagcuauguggcccacgagcggcucagcuacgccuucuccgucuggaggauggagggggccugguccauguccgcgucccacuagcagcggagcuccccacccccucugcaggccggagaccuagguaaggaccggcuccagggaucgaucgggccaggccgcggguccccuguucaccucgccaccgugcuggguaucccccccccaucccccuccacucuccucgcugcccuccaccuagccaggcaccgccaccucauuccacccgcaucccuggcaagcaguucaguccccacaggggaaacagguccuagggucggggagaaccagugugcccaggagagguguaugugugugugcgcgugcgggggugugcaugacagaagauugagaaagucaagcauaggggccuugugcccaaaacgccaucccccaaaccccuuucuuucuucuuuaaaauucccuucuuaaaacaacuguuuccaaauuccacccccuccuuuccgcccacccacuuccucuugcccuugggcugaaauccuuccagguuguucagcgaaaauucucgcugguagugauaacagggcuuagcggucauagaaaacagccacagagacauccucaauaaccgacuuuccccucuggguuuuugcagaugucauuguuuccagagaaggagaaaauggacagucuagagacucuggagcuggauaacuaaaaauaaaucuauaugacaaagauuuucauggaaauuagaagagcagagaccaaauucacaagaaucagggcguggggcacacuuuuaaaagagaaagcgagacaggcccguggacagagauucccagaggggcagcagcagaccccccacaccucugcauucugauagaagucugaacacucguuuguguccccccaccccacuuuuugacgaagaauguuuuauuuuuauuuuucaugcaugcauucucaagaggucuugccaaucagccacugacaggaaaggcaucccuguggacuggcuccauuuuaaaaugguaacaaucagaggaauuuuaacaccuuuagaaauaaaaacgcugggaucaaacuggccugcaaaaucauagucagugaauuccuuaaaaaccauacuuccucugaaggaaaagaaaaacauaaauuacaaaagacaacauucuauuuauuuauugaugacccaugguaaaaugcaaauagauccggugucuaaaugcauucauauuuuuaugacuguuuuguaaauaucuuuuguauauuauuuuucugcaauaaauaaauaugauugaaaaauuuuaagaac

SEQ ID NO: 6633 - RNA, 4266 nt, Mus musculus
agcgauuacagcguauaacuuuauuuuacaaugucugcaagcauguaccuuuuuauacauguuagaggcaaggacaacagcguugagcaguguuuauguuuauuaaaggaaaccaauggcauugaagaucaagcugccaucugauuucauggacuaaauaauaaaguauuacauacuucagcuuuacagaaaaccacgcuaaugaugauggugaaccgugcaauauauacggagaguaaaacauuuauuuuacauaucuacaacagauauuuucauauuucuagaccaaccacaaaucguauugggaaauauuuagguacaugaaaaagcuucaaaacauaaaaaaaauuaacauuuugaaaaaaaaucacaugcaagagcucauuaaauaacaacauugacaaauaaauaaccggcuuuaccuauuagcugcugccaugaauugcuggcauuccacucccagagaggucaacauucagggggauaauuucacacugagacuggaaaaaugccaccgggcuguuuuuugaagugaaaugucacaagguuugccucucuuucaaaacuaaccccuggcugucaaacuauucccauaaaaacgacuggaaaagccccuuucugaaauguucugggaagauacauuuuuuuccacgaacuucucugguucggagggauuuaguuugggaagggguuuagggaaaggagcguuuuuuguuuuuuuuuuuuuuuaaacuguaacagaaugcagcaucaggugcuuuuaaagaaaugacugggaugggggaggggauggaaacuacaggaugccuggcuuucacugcaaacuacucauuacaucuugagacacuugcaaaggaaaagcuagucccagagaaggacagccugcugggcuugaucaaagcagaaagcauauacuuucaagugaggaaagagcaauggcaggcucgagagagagucuuccaagcaaucaaaucuggguagcagaugcuuucuagucaguccaggucuagcucagacugugcuugcuggauuugcuggcucucuuccgcucucuguggugcugggcgggcuuggcgggcgacacgcuuucaaaguuguggcuggacucguugugcugacggguguaccucuugcacuugcacgccgugaccacggugauuuuguaggugcgcgugcugccguccugacacugcagcuggauccucugggugcgcgucuugucguugacacaccgccacuccugagagcuccuccggcuccaguacuuuguuccauagccuccuccgauccaguugggaagcaccggcaggggcaagcacucgcccgcgcacaccagcuccuucagagggcugaugcuggugcacuggccguccgaaauguauuugguggaccgcaguucccugcagcccacuugaacucgaccugcaggaaacaggacagaacugcaucagggacagaaagcaacugaagguguuuggguuuuguucuuguuuuaaguaauuugcaguaacuauaucuauaauauguauauaauaugauauccaaacugcaauguacuuacuuuauguucacaaugcaagucugcgggaggcuuggaagacacuuucauuauaaugguaaggcuacaaaaaggcuguaacuuuggggaggagagagagcgagauagagagggagacagcaagggagaaacucauuucuuuuucauguguuucaauaucugauuguuuauaaaaguauugaaaagucacaauuucuuagucucauucccaauaaugguuccaaccuuguaaauauucacucuucaaagaauacacuuuaauguacucgcucucauggaucacauugguuaaugacugcaagugcuuuuaauuaaguuuuucaaaaaucucuugagaaaauguggaacauauuuaaauguuguguacagugaauaugcaugcuguaauauuuuguuucaauuauaggauucagcugcguggucacacaugcauauggguagagccaaugacauuuugcauaucaaacuuaauaacuauauucuaaacauaaauucacaagcugugcuuuaaaaauauaagcagcaacauguuugaaaugcaaaaugccaccacaauucaauauuuaaagaauacaaaagccccuaaauuaggaacguaugguugccauaacaacuuggcuacauuuccaugaauuuuacagcagaaaaauaccuaacaugucugauuuacaacuguacaaggaaccacgguguucauuuccugaauaucaggcauggaaaacuuuguguuuuaguuauuuggauuugauaagcauguucucuaauuggcuguuucuggucacgugccuaguguaauuaaaauaaaauucaucucacaauacuucaaacuuucuuucuuguuacuuugauaacuaaauccuuuguuaucuaaaugagaacuguuuuugacacacuugaaaagaaaucaaggcuuauuaaccaagaaagagagggcaaggcuuaacaacauaggcagaugguguguccaagccaaaacuaauaaaaccuguugaaauuguucuucugaugccugagaauuaucucaaaguggacagugggucagaaguuuugcuccaauucuguacccugaacaucuacuuuaaggcucauagacuaaaggaagugugcagcauaugccugcauauguauguacauacggagcuaaaguuagagacggagaugaaaggguuaacgguuuggcuggacaaugugcuaggcuugccugcuuuugauuccagcucaccuuccuacagcugccuuaggaauguaccuggaaacagccagcaauaauuuugacucuccuggcuuuuuguuccucauguauaagguugggcauuguuguggugacauuucucacauugacaaugaacacccaccacacuuuucaguaaccugguacugcucagacagacacuuccuaugcucugaaauuaacuacaugcaaggaaaacacuucaguuuucuuagugggauaugaccagucauauacgguaugacuuuucaaaggucaaaacgcuuuuacacaguuggauggaguuuaagguggaggggcagagauuuguguaagguuuccuguacacuguuucucugccuuucuucacauuccuuacuaacagaaaucuuuuaaaggaagagaauagagcaaaaguuagaggaagaaauuugaaccccucuaacuaguagucacuugacguguaugucaauuaagcaaacagaaaaggguaaagaaauacucccugugccaaacauuagcauccuauuauguaaaaucuccuguuacaaauauauacccagucuuucacagaaacauacaauugucucaauuugaccuguugaauaaagaacaauuuggaaaaccaugaugcuccaacguuuuguaguauagacccguuuaacaguggacaucaagucuuuacaccucuccaaacuagacauauuuuagacaucugugugagcaauuccauauuuccugaaagcuuccuuucauccauugugauucccuauacauaguuccgguuaguuaccuuuagacacuucaccagauuccugcacgaucugaaauuagcaaaguguaagacgccaugaacuuaaacugcacacagaaccacacuuuaaagaagucucccuuuugcagaguuuuuaaaaagcagcaguucaauaccucgaugcauuuuucugugggcacuggauaaaccaugucucugcuugcauuaucaagccaccggcuuaauuuguauuaacucuaaaaucacuacccaggaaagaacgccagccuacacaugcaccagauugcucccagauuguuuuugcaaaagcguagaugguucacguuaguuuacagcaaaagcauucuacaggagugggagcugaugcuccccaaaaggaaaaaaaaaaucuguacaaguaaaacacacuuacuguuucgauccaguccagugcuacugaaaugccugccuccauuccuggcuugauucagggugcuguugcugcuggggugugccgggacagguuuaaccacaugugaauaaaggauuucuguggcaucauuuuuaaaagccaaacaguuucucaucaggaugcagagcaggggaaugagagagagaugaauggcaggaggaagcaugaugaguggaggauuugcugggcugaggagccgcuaauucuuucccccuugcuucugcacuguggacuguggaaucccuucccaagguucccuuuauauagccaga

SEQ ID NO: 6634 - RNA, 1928 nt, Mus musculus
gaaagcuacaucuacuaguguuugaugucucuaguugaacaucugcauauauccaaucauuucuuuaaacaaaggauguuaccuuccaaauaugucaugagaaauuauuuucuuaagggguacuucaaaagcaaaauccacaaaacugaguauguaguauuucuuaaaaccacagaagacuugcuuccuguagaugcuauaacaaauuucucagacuugaguaacaauacaaauguccugucuuacaauccuggaggucaaaauuucaaagucagccuuagagggcuaaaacuaagaugcuaggaacagcaacucauuuugaaggcuccagagaagccuuguuuuuuccauuuucugaggcuauauaacaacauuucaauuuugccucccuguuuaugccccuuucucugcacucacagaucuuucuagcuuccugcaagaacacauaggaugauauuuaggguuuacauagaaaacccagguugaucuuccccuucucagccuccucacuuaugcuguuuguaccuuuuaacagauaaacaauucauagguucuuggguuauaauguagcuauggggaagaucugggaaaggcuauuuauucagucuuauucaguuucccacauagccaaagaccccagagagcaaaaugcuaauugauuuauucauggaaaaaaguucuaagauuaguacauacuaagggauauugucauguaccauucaaauuuccccuuacuuugcauaaauacuuuuaaaaaaguaccucaguauaaaaauucuccuauucuaguaaaccaucuggauuaucacaucaaaccuuuauaugauuuaaauaucccuccucuccugguuaaacacguuaugguaggaaaaauagcuaaccugugauaacagcaauagcaccauuaaaucugaugcuccugccauaguauguuuuugcaaagaauuucuuuaacaucaaugaguucauucucuaugauugucagaucugcaaaugauaacugcuuaucaguaagaauaauaaacagaauaugcucuuguuaauuaaaggaacaauucuaaaaacugacuugauuucuuuuuauacugaagugaaaaauauuucuugacugauaucacaguguuugcaccagauuauaggguuccaaacugaaucauguuuuugauugugcagccuuuccagauuauauaaugaugaaacauauuggaaaaaaauugaaugcuuaguugaguccuuaauuuuuuuuaaaaaaaaucugacacaaauaagcuauuuuccaggugcaguuuggcauggacaagagauauuaaaaguaggcaaaaaauggaaagaaucaauuuaaagaaggcagauuuguauguuggacaauugcaacaagaauuucauagaagucaaguuccauaaagguauuuauguugcauucaguacuaaagacauagauaaguggugccuaggaggauagagagaggguggcugcuuuugaguucuuuggaaagcugaccaaauuuaaugagaacucaacuacucuuuuuaggacuuuauuuuauuuuauuuuauuaaaugaaacugacuuagacacuuuaaaaaauauggaaaagucuaguuuaagaagaaaaaucugauuagauuagugggugccuuuauaaaaauauugaugguuuuggaaugcucaaugaaaauguauauacaauagcugugguuuaagaauucauauauaagguagguuuucuuuccgcuuaugaacuccaauauucuuacuuaguuccauuugaaaauuauguuacuaugggaagauuuucuuuaaguuugcuugguuguauuaaaauuauaauuauaguuucagaaagcauuaugaaauucauguggugauagcaaacuaaauauggucaaaauuuaagucuaaaauaaaagcccagaaauugaaaaua

SEQ ID NO: 6635 - RNA, 2006 nt, Mus musculus
ucaauuuuuguaugagcuacauuggcuuuaauacgauugaguauacaucuucgaacugaaccaaugguaucauuuguaugagaccaaaccuccaagucaucuacuugccugcccugguuuggaaaucgaacuauaaaagagagguguuuaccacggaaagcucuugacauaggcaaaauuguucuuucuucaugauaaucacugucacauucauuuauauauucucuuagaacaguuaacacucggaccauucgaacagcuuccugucuugcacaauuaauacugucuuugucaccauccaaaacacacaaugugucauaagaggcuuucaaacgaucaaagcaagacugaaugaagucuucauggaucaccaccugauugaccugcagccuuggaccaagguuuguguauaucucuuuaaggagaucaauagcucggcaggcaauaucaucauuacucugaauuacaacucuccaaagauagucuaauguguauauauauauauauauauauauauauaccccaacaguuuuacaagcaaguauucauugcaaugagucauuggucaguucacaguuucuggcuucugacacaccauaaaugcucagauauucugcuguugccuagacucagggugaucuuguggcuagguaagaccucuggggcagcugccgugaaaacucuaggcuaccacacaccuccccacccugacacuccccaggcuagaccuuuaugcuuguaacucuugccaccguucuccuucuccaaggucugcaaacuagacaagaagcacagauggagccgcagcugcguuaugcuggagcugacccauggaucuaagauuggcccucuucaguaaugacaucuuuucuguugcacuggcuccuccacguauuccaggagcuuguagguggaauagauguugggcuggaucaacucagugauggccauggaguuaguuauccucgacuucuuggcuucuuccgaguggugcuaguuccaacaggccuggaauuaugaugguuaaagagauccugaacuacauuuaaaacuacugaaccauauaacugcccaaaucaaauacauuuuaacaaaauucaacuucaagggauugccuuaucggcaucaaugggaagggaggccuuugguccuguggaggcuggaugcgccagcuuaggggaaugcaagggcagugaggcagguauagguaggugggugugggagcacccucauagaagcagggggcagggggaaugggauaggguguuugcagaggggaaacaaaaaagggggauaacauuugaaauguaaauaaauaaaauaaccaauaaaaaauaaagucaguaucaacacuaaaaaaagaauuguaaauaaauuccaaaacuuuggaauuagcugcagcgcuccaguauguggaaucaugcagacucuucccauucuuuuuuuuuuucuuuuuuuuuuccauuuuuuauuagguauuuagcucauuuacauuuccaauguuauaccaaacgucccccauacccacccacccccacuccccuacccacccacucccccuuuuuggcccugucguuccccuguacuggggcauauaaaguuugcguguccaaugggccucaaccaguaccccggacucuucccauucuuaauccccaacaacucccugucugugguguuagcuugcaauugucauuuaaguagaauuggcuagcauauaaccaauggagauuagcuuccgucauauccuucccucaagguucauacaaaugauuguggguaucaauagcacuuguauucuuacucuucacucccaugguaugacucuaccacagucgacacauguaccaaagggcauuuggcuagugcaauaaagcuaaguaaauacucacgugaaaaugacuggcugaauacguacguuuucauuucucuagcuagcgucacuuuuaguuugcagagugccugugccauuggcagccucccagcagcuaugugugagugaccca

SEQ ID NO: 6636 - RNA, 2006 nt, Mus musculus
ugggucacucacacauagcugcugggaggcugccaauggcacaggcacucugcaaacuaaaagugacgcuagcuagagaaaugaaaacguacguauucagccagucauuuucacgugaguauuuacuuagcuuuauugcacuagccaaaugcccuuugguacaugugucgacugugguagagucauaccaugggagugaagaguaagaauacaagugcuauugauacccacaaucauuuguaugaaccuugagggaaggauaugacggaagcuaaucuccauugguuauaugcuagccaauucuacuuaaaugacaauugcaagcuaacaccacagacagggaguuguuggggauuaagaaugggaagaguccgggguacugguugaggcccauuggacacgcaaacuuuauaugccccaguacaggggaacgacagggccaaaaagggggaguggguggguaggggaguggggguggguggguaugggggacguuugguauaacauuggaaauguaaaugagcuaaauaccuaauaaaaaauggaaaaaaaaaagaaaaaaaaaaagaaugggaagagucugcaugauuccacauacuggagcgcugcagcuaauuccaaaguuuuggaauuuauuuacaauucuuuuuuuaguguugauacugacuuuauuuuuuauugguuauuuuauuuauuuacauuucaaauguuaucccccuuuuuuguuuccccucugcaaacacccuaucccauucccccugcccccugcuucuaugagggugcucccacacccaccuaccuauaccugccucacugcccuugcauuccccuaagcuggcgcauccagccuccacaggaccaaaggccucccuucccauugaugccgauaaggcaaucccuugaaguugaauuuuguuaaaauguauuugauuugggcaguuauaugguucaguaguuuuaaauguaguucaggaucucuuuaaccaucauaauuccaggccuguuggaacuagcaccacucggaagaagccaagaagucgaggauaacuaacuccauggccaucacugaguugauccagcccaacaucuauuccaccuacaagcuccuggaauacguggaggagccagugcaacagaaaagaugucauuacugaagagggccaaucuuagauccaugggucagcuccagcauaacgcagcugcggcuccaucugugcuucuugucuaguuugcagaccuuggagaaggagaacgguggcaagaguuacaagcauaaaggucuagccuggggagugucaggguggggaggugugugguagccuagaguuuucacggcagcugccccagaggucuuaccuagccacaagaucacccugagucuaggcaacagcagaauaucugagcauuuauggugugucagaagccagaaacugugaacugaccaaugacucauugcaaugaauacuugcuuguaaaacuguugggguauauauauauauauauauauauauauacacauuagacuaucuuuggagaguuguaauucagaguaaugaugauauugccugccgagcuauugaucuccuuaaagagauauacacaaaccuugguccaaggcugcaggucaaucagguggugauccaugaagacuucauucagucuugcuuugaucguuugaaagccucuuaugacacauuguguguuuuggauggugacaaagacaguauuaauugugcaagacaggaagcuguucgaaugguccgaguguuaacuguucuaagagaauauauaaaugaaugugacagugauuaucaugaagaaagaacaauuuugccuaugucaagagcuuuccgugguaaacaccucucuuuuauaguucgauuuccaaaccagggcaggcaaguagaugacuuggagguuuggucucauacaaaugauaccauugguucaguucgaagauguauacucaaucguauuaaagccaauguagcucauacaaaaauuga

SEQ ID NO: 6637 - RNA, 24000 nt, Mus musculus
aauccaggcuugccggucuguuguuuuaaagcaaagcuucaccaauucguaucuuaaacucggacaugagagcggaagccacugcagggaaucuuguuaucgcuuggcuacauuuacacuaaauauagaccaccaauuaugugcuggguuuacgggccucaggggagcacuugugagcagcaggaagauuaagagcgaacuacagaacugguagaaaguuuggcuguaguuguuccugaguaguugucuuuucuaggaaaccgagcauuggaggcucacgucuuuguaaguaauuugcaugcuauuucuuacugagaccgaaugaugauuuuugaguccuugggguuuugauugcauguauucugugcuuuucgacugcucauagaaaagauguagacuugauuuuuaaaauuaccuccugacuuggaggcaugaacucaggaaugccguucauacguggccguggcucacucaaggaagcaucguauuaagcuuugaguucagccuucauugguaaacaauucugaguucguagcauacaauaugguuuucugcuuugauaccaauaccugcagggagaauguacaaugaguuuuuuuuuuucagagacaauuuuuauuuguugaaguguccuacugguagagaaucaagcaauuauuagaugaugaaaggcucagcuguuagcagugaucaagaacacgggaaaaugaaacuacuuacgugucugaguuccaggaucagaaaagaaucugcccaguggagcucggcaggaaggccaaguuagugcgacacggaauagguagugacacucugcagcggccucggugguuguuucugaaugcccucauuucagcuuccaaagauagcaagggcugguguugacagcuguggguucugguuuucaagguguguccuuguauccguuuacuggcagagucccucagaagccaccugcaggcccuuggagcccaugaaucacacugccuuuuuuuccucuacuagcuugucuuucauuuuaacaugucgcaacacugaaaaggcuuauugaaaaaacaucuaccaacauugugagcucgcuguaaagaugucuccuucuagaggacuccauuauuuacuuggucuauuuuagauuuagaaaaaaaaucuugaacaaauuuuaugacagauuuuauucuaaauuaugugugugggcggggcauguuuaugccacaacacuuacuuggaggucagaggacaaguugcaggaguugguucccaucgaacaaaggugaaggagauugaguucuggcuaccaggcuuagugccaugucuccguagcuuagcuaucuuggcaucgccuucuuagucuguggcaagcaaaguuuaguaacuggacuauuacuuuaaaaguaggaccuuuuagcagugacuuuuguagcuagucuuccucuccuccuccuccuccuccuccuccuccuccuccuccucuucuucuccuccuccuccuccuccuccuccuccuccuccuccuccuucuucuucuucugcucucucucucucucucucucucucucucucucucucucucucucucucucucucucucaacaguagugacauuccugagggugaaauagcuauuaagucagauucagaaauaaacugugucucuguuaccaugcccaaaauagaagcugaguuuguaacaaugauccuaccaugugaccacaugcaccuauuuuuuuccugguccccuccacccccacagaaaaugguguuuggaauaauaaaguauaagcaggugaugaagaaagcacuuccaaaaauguggcuucaagccuggugcccuggcauccaacagcacuucaagggcauggcuuaucuucuaaggggugagguuugcucucugaggcacuuuccuucccuucacagcugcugcuggucuuguuuuuaacuguauccugucauucuuuuaagacugccccaaugcaggauauuugaaguacaauaauuucaauauuuaaagcacuuuauaguaaugacuccauacaugcauucuuuccaauuaacaugucaggauaauuaaaacauacaguuugaauuuaugagaaaaaaaucagugcaugacuuuuggaucuuuuuuuuaaccuugaauauuaaauacaucuuauuguauauuuucuuuauuuacauuuaaaauguucuccccuuucccgauuuccagcccccacagaagcccuccuuaucccauuucccucucccugcuucuaugaggaugcucccccacccacccacccacccacucccaccuucccacccuggcauuccccuacacuggggcaucaagccuucacaguaccaauugccucuccucccuuuugaugccugacaaggccauccucugcuacauauguggcuggagccaugggucccuccauguguacuccuugguuggugguuuagucccagggagcucuggggugucugguugguugauauuguuguucuucuuaugggguugcaaaccccuucaaauccuucaguccuuucucuaacuccucccuuggagacccuauggggaccccaugcucagcccaaugguuggcugcaagcaucugccucuguacuugucagguucuggcagagccucucaggagacagcuauaucaggcuccugucagcaugaacuucuuggaaucuacaauaguaucuguguuuggagacuauauaugggaugaauccccagguggggcagucucuggauggccuuuccuucagucucugcuccacacuuugucuccauauuugcucccaugagaguuuuguucccccuucuacacccacacuuugguauuccuucuucuugagcuuuguguggucuuuaaauuguaucuugguauucugagcuuuuggggcuaauauucacuuaucaaugaaugcauaccauguguguccuuuugugauuggguuaccucacucagggugauauuuucuaguuccauccauuugcuuaagaauuacaugaagucauuguuuuuaauagccgaguaguacuccauuguguaaauguaccauauuuucuguaucuauuccucuguuggaggacaucuagguucuuuccaccuucuggcuauuauaaauaaggcugcuaugaacuuaacagagcauguguccuuguuauauguuggagcaucuuuuggguauaugcccggaagugguauagcuggguccucagguaauacuauguucaauuuucugaagaaccaccagacugguuucuuuuuuugugugugucugugugugucuauauuuuaaauacuuuuuauuagguauuuuccucauuuacauuaccaaugcuaucccaaaagucccccauacccucucucccaauccccuacccacccacucccccuuuuugggccuggcguuccccuguacuggggcauauaaaguuugcaaguccaaugggccucuuuuuccagugauggccgacuaggccaucuuuugauacauaugcagcuagagucaagagcuccggggugcugguuaguucauaauguuguucuaccuauaggguugcagaucccuuuagcuccuuggguacuuucucuagcuccuccauugggggcccugugauccauccaauagcugacugugagcauccacuucuguguuugcuaggccccggcauagucucacaagagacagcuauaucuggguccuuucagcaaaaucuugcuaguauaugccauggugucagcguuuggaagcugauuaugggauggaacccuggauauggcaggcucuagaugguccauccuuuugacacagcuccaaacuuugucucuguaacuccuuccauggguguuuuguucccaauucuaaggaggggcaaaguguccauacuuuggucuucguucuucuugaguuucauguguuuagcaaauuguaucuuauaucuuggguauccuaaguuucugggcuaauauccacuuaucagugaguacauauugugugaguuccuuugugacugggcuaccucacucaggaugauacccuccagguccauccauuugccuaggaauuucauaaauucauuuuuuuaauagcugaauaguacuccauuguguagauguaccacauuuucuguauccauuccucuguugaggggcaucuggguucuuuccagcuucuggcuauuauuaauaaggcugcuaugaacauaguggagcauguguccuucuuaccgguugggacaucuucuggauauaugcccaggagagguauugcaggauccuccgguaguacuauauccaguuuucugaggaacugccagacugauuuccagagugguuguacaagcuugcaaucccaccaacaauagaggagugauccucuuucuccacauccucaccaucaucuacugucaccugaauuuuugaucuuagccauucugacuguugugagguggaaucuuaggguuguuuugauuugcauuucucugaugauuaaggauucugaacauuuuuucagguccuucucagccauucaguauuccucaggugagaauucuuuguuuagcucugagcuccauuuuuuaaugggguuauuugauuuucuggaguccaccuucuugaguucuuuauauauauuggauauuaguccccuaucugauuuaggauagguaaagauccuuucccaaucuuuugguggccuuuuugucuuauugacggugucuuuugccuugcagaagcuuugcacucucaugaggucccauuugucaauucucgaucuuacagcacaagccauugcuguucuauucaggaauuuuuccccugugcccauaucuucgaggguuuucccuacuuucuccucaauaaauuucagugucucugguuuuauguggaguuccuuaauccacuuagauuugaccuuaguacauggagauaggaauggaucaauccacauucuucuacaugauaacaaccaguugugccagcaccauuuguugaagaugcugucuuuuuuccacuggaugguuuuugcucccuugucaaagaucaagugaccauagguguguggguucauuucugggucuucaauucuauuccauuggucuacuugaccagacugguuucuagagugguuguaccaguuugcaauccaaccaacaauggagggguguuuuucuuucuccacauccucaccagcaucugcugucaccugaguuuuugaucuuuguuguuuugacuggugugagguggaaucucgguguuguuuugauuugcauuucccugaugacuaaggauauggaacauuucuuaggugcuucugggucauuagauauuccucaguugagaauucuuuguuuagcucuguaccccauuuuuaaauaggauuauuugguucucuggagucuaacuucuugaguucuuaguauauauuggcuauuagcuuucuaucagauguaggauugguaaagaucuuuucccaauuuguugguugccauuuuguauuauugaugguguccuuugccuuacagaagguuugcaauuuuaugagguccuguuuguugauucuugaucuuagagcauaaaagauugguguucuguucaggaaaauuuccccugugcccauguguucaaggcucuucaccacuuucuccucuguuaguuucagugucugguuuuauguggaguuccuugauccacuuggacuugagcuuuguacaaggagauaagaauggaucgauuugcauucuucuacaugcugaccgacaguugaaucagcaccauuuauugaaaaugcuuuuuuccacuggaugauuuuagcuccuuuuucuuuacuuauuuauuuuauguauaugaguauacuguagcuguuuucagacacaccaguagugggcaucggaucccauuacagauuguugugagccaccaugugguugcugggaauugaacucaggaccucuggaagagcagcuggugcucuuucccgcugagcuaucucuccagccccuccuuuuucaaauaucaagugaccauaaguguauggguucauuucugggucuucaauucuauuccauuggucuacuuguucgucgcuguaccaguaucauacaguuuuuaucacgauugcucuguaguacaacuugaggucagggaauggugauuuccccuagaaguucuuuuauuguugagaauaguuuuugcuauccuggguuuuuuguuauuccaaaugaauuugcgaaucguucuuuuuaauucuaugaagaauugaguuggaauuaugauaggaucacauugaaucuguagauugcuuuuggcaagauggccauuuuuacuauauuaauccugccaauccaagaacacgggagaucuuucuaucuucugagaucuucaauuucuuucuucagagacuugaaguuuuugucauacuuaucuuuuacuugcuugguuagagucacaccaagauauuuuauauuguuugggacuauugugacggguaucauuucccuaauuuccuguuuauccuuuuacuguaggaaggcuacugauuuguuugaguuaauuuuauauccagucacuuugcugaaguuguuuaucagguuuagaaguucucugguggaauuuuuggggucacuuaaguauaugaucauaauaucaucugcaaauagugauauuuugacuucuuucuuuccaauuuguaucccuuugaccuccuuuuguugucuaauugcucuggcuaggacuuuaaggacuauauuguauaggaugggagaaagugggcagccuugucuagucccugauuuuagugggauugcuucaaguuucucuccauuuaguuugauauuggcuauugguuuacuguauauuguuuuuacuauguuaaggcauaggccuugaauuccugaucuuuccaagacuuuuaccaugaagggcuguugaauuuugucaaauguuuucucagcaucuaaugagaugaucauaugggguuuuuuuucuuugaguuuguuuauauaguggauuauguugauggauuuucguauauugaaucaucccagcaucccugggaugaaaccuacuuaaucaugauggaugaucauuuugauguguuuuuggauucaguuagugagaauuuuauugaguauuuuugcaucgauauuaauaagggaaauuagucugaaguuuucuuuuuuguuguuguuguugagucuuuuuagagguuuugguaucagcaugacuguggcuucauagaaggaauuuggguaguguuccuuccguuucuaguuuguggaauacuuugaagaguauugauauuagaucuucuuugaaggucugauagaauucugcacuaaacuaaaaauaguccuggacucucuuuugaugggagacuauugaugacuauugaugacuauuggagacuauugaugacugcuucuuuagggguuauggggcuguuuagaugguuuaucugauccugaauuuacuuugguaccugguaucugucuagaagauuguccauuuuauccagauuucccaauuuuguugaguauaggcuuuuguauuaggauuugacgauuuuuuaaaaaaaauuucuuaguuuuuguuguuauguuucccuuuccauuucucauuuuauuaauuuggauacugucuuugugcccucuuguuagucuggcuaaggauuuaucuaucuuauugauuuucucaaagaaccagcuccugguuugguugauucuuuguauaguucuuuuuguuucuauaugguuauuucagcccugaguuugauuauuuccuacugucuacuccucuugggucuauuugcuuccuuuuguuccagagcuuucagguaugcugucaagcugcuaauguaugcucucuccaguuucuuuuuggaggcacucagagcuaugaguuucccuuuuagcacugcuuucauugugucccauaaguuuggguauguugugccuucauuuucauugaauucuaaaaagucuuuaauuucuuuauuucuucacugaacaaguuauuauugaguagaguguuguucagcuuuuaucuguaugugggcuuuccauuguuuuuguuguuauugaaggucagccuuaguccguggugaucucuucuugcaucuguugaggccuauuuugugaacaauuauauagucaguuguggagaagguaccaugaggugcugaaaagaagguauauucuuuuguuuuaggaugaaauguucuauagauaucuguuagagucaauugguucauaacuucuguuaguuuuacugugucuuuaguuucuguuuccaugaucgguccauugcugagagugggguguugaagcauuccacuauuauuaugugagcugcaaugugugcugugagcuuaguaaaguuucuuuuaugaaugugggugcccuugcauuuggagcauagauauucagaauugagaguucuucuuguuagauuuuuccuuugacgaauaugaaguguccuuccuuaucuuuuuugguaacuuuggguugaaagucaauuuuauucaauauuagaauggcuacuccagcuuguuucaugggaccauuuuccagucuuuuacucugaaauagugucuuucuuugucgcugaggugcauuucauguaugccacaaaaugcuggguccuguuuauguauccagucuguuaaucuauguuguauuuuuuuuuuaauuggggaauugaguccauugauguuaagagauauuaaggaaaagugaugguugcuuccuguuauuuuuguuguuagagguggaauuauguuuguaugauuaucuuccuuuggguuuguugaaagaagauuacuuucuugcuuuuucuaggcuguaguuucccuccuuguguuguaguuuuccaucuauuauccuuuguagggcuggguuugugaaaagauauuguguaacuuugguuuugucauggaauaucuugguuucuccaucuaugguaauugagaguuuugcuggguauaguagucugggcuggcauuuguguucucuuagggucuguaugacauaugccagaaucuucuaccuuuuauugugucuggugagaagucagguguaauuaugauaggucugccuuuauauguuacuugaccuuuuucucuuacugcuuuuaauauucuuucuuuguuuaaugaauuugguguuuugauuauuauguuacaggaggaauuucuuuucugguccagucuauuuggaguucuguaggcuucuuguauguucaugggcaucucuuucuuuagguuagaaaaguuucuuucuauaauuuuguugaagauauuuacuggcccuuuagguuggggaucuucuauaccuauuauccuuagguuuggucucauuguguccuggauuuccugauguuuugggccaggagcuuuuugcauuuugcauuuuauuugacuguuuugucaauguuuucugugguaucuucugccccugagauucucucuucuaucucuuguauuguguucgugauguuugcaucugugacuccugaucucuuuccuagguuuucuaucuccagaguugucucccuuugugauuucuuuauuguuucuauugccauuuuuagauccuggaugguuuuguucauuuccuucaccuguuucuuuguguuuuccuguaauucuuuaaggauuuuuuuuuugugugugugcguuuccuuuuuaaggauuucuaccuguuuagcuguguucugcuauauuuguuuuaaagggaguuauuuaugugacuuuuugauuuuacaguguuucuuagcuagggaucuaugcauauguuuaacacaaguaccauuaaauuuguaggugauauuggaaauccuccacuucucccuugcacaugcccauauaagccucacaugugugggugcucacaggccugaggaggagguuggaucuccuggaucaaaggugguugugagaugccugaugugagugcuaggaaacaaacucagguccucugguagaucagcaggcuuuucuaauggcugagccaucucuucagcccugaggcuuuugauucuuuuuuuuuuuuuuuuuuuuuuuuuugguuuuuugagacaggauuucucuguauagcccuggcuguccuggaacucacuuuguagaccaggcuggccuugaacucagaaauagaccuaccucugccucccgagugcugggacuaaaggcaugcgccaccauaccuggcgaggcucuugauucucaauaguguuguuuaaggagcccaauaaguaugugauauauuuccccagauuuucuauggauauauuuguucucuucuccauuuaguuucuuuuaacucuaugguugggucuuaaaucucuuuaagagaauggugucaggaaggcauuuguugccuccuguaggaagacacauuuacugcauccucuugcucuuccugagaauuauuuuaauuauggauacaugugucuaaguaugugcaugugagugcagguuccuaaaaggccagagagagaguugguuccccuggagcugguguuacagaugauuguaaaccaguagauacaggugcugagaacugaacucagguccucugaaagagcagcacucacccauaacaucugauccaucucccuagcccccuaccuugucuuuuuaaaaugccuuuauaucuuagaagcccuuuuacaucuuucaaagauccagaaucucuuauuauguguguguguaugugugcguauguguaugugugugugcccguguguaggcaggaggucacuuucaugcaucuucuuucuaccuagagaaagggucucuuaaagaaccuggagcucacugcuuuggcuagacugguuggccaaugaagcccugcaaucugcuugucuccacuaucacccaucacuggguuuacagaugggcagcacagcacccugcuuuucuguacugagaugugaagucaggaccuuaugcuugugcagcaagcacuuuacacagugagcugucuuuccagacaugcauuaaagaggcaucauuauugauuagucuaaucuauucagacuuuucaggaugggaguugugaauauuaccuugcauguaaaccucagcugaaaaaguaccuguuauauaggugaucuuaguuucuuagaaacucaauggaacggaguagaaguccugagacaaucaagauuccucuuucuacuggcuggagacaugucucagcgguuaagagcagucacuguucuugcagaguaccugggcucagauuugguguguacuggcuaguuuugugucaacuugacacagcugggguuaucacagagaaaggagcuucaguugaggaaaugccuccaugagauccaacucuaaggcauuuucucaauuagugaucaagggggaaaggccccuugugggugggaucaucucugggcugguagucuuggguucuauaagagagcaggcugagcaagccaggggaggcaagcuaguaaggaacaucccuccauggccucugcaucagcuccugcucccugaccugcuugaguuccaguccugacuucuuucagugaugaacagcaauguggaaauguaagcugaauaaacccuuuccuccccaacuugcuucuuggucaugauguuugugcaggaauagagacccugacuaagacaaauugguaccaggagugggguauuccugugacaaccugaccauguuuuggggaggacugaggaaggacuuuggaacuuugggcuugaagauccauccauuguuaagagcucugucggauguuguguaggagcuuggaagauaauguagagaacacugcagaagauggaggucugguuugugaaauuucagagggaaaauuaaagacucuuuucagggccauugcuguuuugauugugaagauucuguaguucugguuagcuggggcugaagaaucagcugugauuaacaagauaccagaacuacuaaagcaaaaacuuugcauuacugggacuauugaugcugguuagcuggagcuaagaaauuagcggugauuaagaagagaccagcaucacugaggugacaucuucugggaaguauuuucugaaagcacaguggcuguguuccagauauagccaaaguuguaccuugugcuguggcuggacuugguaauguguaagggucacccaggugguacugguuuuaaaggcaugaaggaguugagcagagcagcugaggcuuggcacugugagaggccauggaaggccauuggugaaagugcagccucaguugcaauugauggcccaggacugaaggggucaugcaguguuuuggagaugccaguaccaugagaugaccaccaagagcagcagcagcaguggaguacaggcaucuggagccuagaggaugacgcgugugcuacaaagggccuggcuggagaagugacccaagcccuuggaggagcccagaagaucguaaguuggaucccagacauuggacgguuggagauugacuuuugcuuuugauugugacugugcccugauauuuucccucuugaaggaagaaacuguuuuaguggagcccacaguuaagagacuuuuaauuguaaaaagacuuuggauuuuaaaagagauggauauuuuaaagagauugaaauuuuaagaauauguaaagacugugggacuuuuaaaguuauuuagaucuuggggaugaauaagaauguaaggguugaggcuuacuagugauguguuugugugucaaguugacaagggggucaauuguacuggcuaguuuugugucaacuugacacagcugggguuaucacagagaaaggagcuucaguugaggaaaugccuccaugagauccaacucuaaggcauuuucucaauuagugaucaagggggaaaggccccuugugggugggaucaucucugggcugguagucuuggguucuauaagagagcaggcugagcaagccaggggaggcaagcuaguaaggaacaucccuccauggccucugcaucagcuccugcucccugaccugcuugaguuccaguccugacuucuuucagugaugaacagcaauguggaaauguaagcugaauaaacccuuuccuccccaacuugcuucuuggucaugauguuugugcaggaauagagacccugacuaagacaggugguagcuuacaaccugccuuaacuuuaguuccaagaaauccagcugucuuuucuagccuccuugggcaccagacaugcaugugguccacauacauacaugcaagcaaacacucacgcagaaaauagaaauaacaaugguaaguuauuaguaucuguguuugcuaaggauugguccuggaaagccacagccuguaucuaauggcuaaaccucaauccaaacugaagaaaauagaaaaauuucaaugaauauuuuuuauauuauuuaccuuguacauguaggaguggcacuucagugcuguguggcagucggagagcagcuugggagaguccauucuuucccuccaccauauggauuucugugcucuaagucagggugucaggcuugguaaaaaguacuaggcuaucuugccaggccccaagauuacauuguuuuugugugugaguguguguguguguuaaauuaggaaauuagaagggcucagaguuaagucugucuguuuuauggucauuuuguugacuagcuuauuuggucuuuauaaguaguguuuuugcacugaggacuugaagcauauuaaacuaggaaccauguaauaggaaaaaaaaacauuuugagaggcaauuaugaaaaaaaaaaaaaaaaacagacccagaggaaauaagauagaaauggggaagccaaggaggagagagggcguuauagauaagcaggguaugaauggcuguaugcuagccacacacuuggcucuggcaagcagaggcaaaagcauaccgacaacauuguccaaccaaggaacacuuuccucuagacagccugucucuccccuagcccagcauccauggaugggaacucgugugucucuccagcuucccaaugcucuggcuugcacagcuccgcagcccagccucuucuuccuaauguuggugcuuucuuuucaggcacaaugacucauuccucucaggaugcugggucucauggcauccaggaagaaggaagacucuacguuguggauuccauaaaugacuuaaacaaacucagucucugcccgauggaaucacaacaucuauucuguauguauguauguauguauguauguacauauguauguauguauguacauauguauguauguauguccuggaagcauggccuugggacuuccuaaagauaucaagggcacgguggauguguuucaugcaguggggacacagugggcaucagcaaucacuggacacuggaaaugcuguuuaucgcuuagcaguuuuuguuucggguucccaaucugucaaacugucauugacuuccuuggcaagggcugaacucaucaaaauucccaagagaagcuaguggcccauucuuguauuuccaacacuuggaagggugaggcaggaggaucauaaauguaaggucagucugggccauaauagguaguuccugguagccugcuugcauaguaagacccugcuccaugcccuguuuuucccuguaaaauucuuaaggaaaaaucuaugguguucuguuacuggguacaaggauugcucagcccccccccccuuuuuuuauaaucucguuucccaggggucuuguuuuaucagagauuacugacaaagaaugcucaacacauucauccauuuauuuuaaaaaccauuaaaauucuguugugcaaggagucaacuuccuucucuacuuaaaaauuacaaauuuuccaacuaaaguauuggaagagacaugagagcgacccaaaaaccuccugaauacaccauguaucuugcucucuaaguguuagaaaccaggcguuugggggcuucugggcuccaucuuuucuagcuuaacugaugacuauccuaacacaggcgugaauggcccauuugccauuugccucaugcucacuccacaauuccugcccaguucuauaacugcuauuuccauucucaucuuuucugggcucuuccuuuugaucagauccucgccugguuuuagugcagcgggaagggagguguuggugccagcugugguguggcgugggguaggaagcagucuuacacgcguucgcgaccggccaggaagaacacagcaaaccagaaucuucugcggcaaaacuuuauugcuuacaucuucaggagcaagagugcaagagagagaaaaagaacaagaaagcaagagcaagagagagaaaaagcaagaacaagagagagaaaaagcaagaacaagagagagaaaaagaauggcaaaaccccgucccuuuuaaggagaauuauccuccgccuaggacguauuacucccugauuggcugcagcccaucggcccaguugucaucacgagaaaggcagaacacauggagggaaaacugccccugcacgugugcagauuauguuuaccacuuagaacacagcugucagcgccaucuuauaauggcaaaugugagggcagcucccaacaucucccccuuuucuuuuaauaagagcaauaggccacccauauuaaugagaguggagauagaggucaaauccccagugugcagguaaaggagccauguacaggauuagcucuuaggcucacaggcuuuuacccagagcaaaccugacccgcucccgugucguuuuuccuggggagaaggacacuuggacacucaaccuucuugaaagaugacaugucucccuagaauaggcucauauaugccgcagagcccuucuacugcagugcuuagccgugcaacucucucgggcugcugaagcacacucacucuaucccgugcaaugagacuagccucguggggugcaagagcugaauggccagcgaccuauugcuuaagcauagauauaucaggggaagcaccauguucuagagcugcaagugccugggcaauaaccaccuugucucuccuaguuugggccuuaagcuuacagaccaaccagagaagcaacacuaauccacagcaaaguauaucuccaaauaaucccacccauucuuuaaagaaggaaaaugcugaggagauccaauuggguaauccuuugaucagggacagguccaagcgcguggaguugaccugaagucucaauucccgaagggucuguucaaauucagccguccaauucuguaacauauacugagaaagacuuuuugacaaauuagcugcccuaguaaauuuaacauacugaauggaaguaacgcauaaugagaggucccccaagcucccgacaaacccugagccagucuuguaaaccuuuguuuucuugaggcuauggccgcucugcauuccuguguggcuugcucauaaaugaguuauucuaccagagguguggcuugcucugaaucuccaaaaauacgcucugcugccucugucauucuggccacaaaaucugagaaugacuccugaggucucuggacgaucuuuguuaguuguccaguggcuucaccugcgcgggagagcgccuuccaggcccuaauagccuuuucaucugauucagaacuauuaagaacuggcuccuugagcucaucuagugaugaguauaggcuccuucuccuagaagccuccgcugauugaucuuuuuucuuuucuuuuuccuucuccuuccuuccaaucucuccccagguauucuuaccugaccuaaacuuuuccucagguucaagacccguggaaaggccuguauacuuauuuuguguaccauauuuccucuuugcuccuacucucucucccugcuuuacuucugauagauugcccugaauuucauccagaauuuucagcccugccuuaaccacuugauaacaugugaaaaggaacaaaagggcuccuaacacuagaaaaaguucaaggccaaacauaccuuguaaagcuauuucccacuuuacuucugauagacugucuugaauuucguuagaaaguucaaggccagacuuaccuuguaaagcuauuucccacuuuacuucugauagacugucuugaauuucguuagaaaguucaagaccagacuuaccuuguaaagcuauuucccacuuuacuucugauagacugucuugaauuucguuagaaaguucaagaccagacuuaccuuguaaagcuauacuuacggguacccuguuccccagcugaagaguucugaauucacgcaguugaauccuucucaacagucuguguugugggaacacuuuauuaccaccguuccccagcugaagaguucugaauucacgcaguugaauccuucucaacagucuguuuuacgggaacacuucauuaccaccauuccccagcugaagaguucugaauccacgcuggauccuucucaacagucuguuuuacgggaaccuuuaugaccgugacccgcaguucugguuccggaaugagggaucuuccuugcgccggugaugguaaccgucccaggucuucucgucccaggucuucucgucccgggucuucucgucccggguuucagcaccaacucuucccggguuucggcaccaacucuuacacgcguuugcgaccggccaggaagaacacagcaaaccagaaucuucugcggcaaaacuuuauugcuuacaucuucaggagcaagauugcaagagagagaaaaagaacaagaaagcaagagcaagagagagaaaaagcaagaacaagagagagaaaaagcaagaacaagagagagaaaaagaauggcaaaaccccgucccuuuuaaggagaauuauccuccgccuaggacguauuacucccugauuggcugcagcccaucggcccaguugucaucacgagaaaggcagaacacauggcgggaaaacugccccugcacgugugcagauuauguuuaccacuuagaacacagcugucagcgccaucuuauaauggcaaaugugagggcagcucccaacaaagcagcagcugcugacagacgggaacauggaauguacuugauuauauaaucgaacaguauaaugugugagaccaauucagagaggaggagaaucuaaaauguaaucuggcacucugcuuacgccagggguucauggcucuuguuuaaguuuauccguaagcuuuuaggcaccuaagaguuacaaaguagcuaaugagaggcaauucucaggacagagcauugagaagcgcugguuucucagcagaucuaucuuggaaauagcuucaagaaaccaaaauaccccaggggcucuuuugucuaaauggauauagaccugagagauuauucugauaauaaaagcaguuuccugggauacaccacacagcuuuuggucuuccacucagggaaggcaucacauaccuagcucuguuuagguuaccuaggagacggccaguccagccucaucaauuuucuauuccuucuccaaagaauaauucaugugcucuauuccacaguggacaguuuucaaagaaccuuccaaacagguucaaggacauagcucaacccuauucuuuuuuuuuuuuuuuuugaauuccaacagagaagguaaacaguuacaaaauugcuuguccaaaggcauuuccgaaugcagaagucacuuuuuagggcugucuagggaaaaugagugugugcaucacaucucugugagaugcggagauucugucacuuuguuucccaucagcuuuagaggacaaaauccccaaugcuggcacagccccaggaaauggaaggcgggggcuguuuuuuguggggcugcuccugguguugacggucagccuggcucuggucuucuucgccaucuuucuaauaaguaaguacuucaggcaggucugucucuacuuugugugugcgucuuuaauaacuguugcuucuggaguuagcgcauccuagcuaucagaauuuccagaagccagugggagacccagugucuuaaggacacuuuguugcuccuggauacaaauccagggcauguuccacaucgucagguuacauuuauguuaauuuuuuauauaagcuuuuaauuugucacccggagccucuacugccaaauuguaugcaacacguccuacuuaauuuuaguuuucuuuauucaacacauaaauaucuucaucacauuuagauauacacgcauuuuccugagguuuaagugccaccugacguuuccucauuugcauaucucccagaagucuguuccaaguagcaaggguuucagcuaauggcuagagcuagcucugggguugugaggcuggguuacucugcccuguuugaugcuagguaguuucuguuugcucuugaccugggcaauacaugucacccuuaaguggugacacagccucaucaauuuucuauuccuucuccaaagaauaauucaugugcucuauuccacauauauaccugcaccucagacuagagaccucuaaguugauugugucaccauucugucggggcagguguagaggagcuauuuaucugaagugagauaagugagauguauuauguguagucuccuccauuggaccuaccacaguucucucuuagaugaccuuuuuuuuuuuuuuuaaacuguuacugggaauuauugcuauauucuuucuacuauacuauucuauacuacagaaagcuacacagagcuggggauagggagggggcuaucuuugacagcauuuugacuagacucuugggucuuccaucuugucauuucuucugcccuuucauguuuuuggcaccuggcaaguucucucuguuuugaagcaggaucucaccacauaggccaggcuagccuugacuuugagagagauccucuugucccagccuccgaguucuggggguauaggcaggcaugugccaccaccucugucuugucuucagcaguguuaaauaagaaauggaacuucgugucuuugcaauguuucuuaaaguuaaguucguuuaggagcacaggagguggaggugcugaugauaauaagacuccuugggauguuugaggcugagcuugugggaaggcguauccuuugaccuuuccugugaagaccuggaaaaaaagugucuauucaccccacccagacagaugaaaagaaaugccugcacucaaacccagcuuggugaacccaugaguuuauugggauuguuuguaugcauuaaagguguguuaguaacucuaugguugugugauaaaaacacacagcaaaggacaacuuaaggaaaagggaguuugcccaugaugauggggaggcguggcagcaagcaacaggcauguuggcgggaguaggaagcugagaggccaaaucuuucaccacaaacaucagccccuauccccaccgaugcaucuccucuaauaaggcuccaccaccuaaaccucuccacguggcgacaccaaugugagccaagcauggguaacucaaaggcaguuugcaucacccggauacaaaccuaaacuuuuacagaugggaugguacaaugugagugcugggaauggaacucuggucaucugaaagagcagcaauugcagcucuccagcccccucuccuccucccccuccucuuccuccucauaggguuucucuguguagcuguggcuguccuggaaaucucucuguagaccagacuggccucgaacucacauagauacaccugcuucugccuccugagugcugggauuaaagcuguacacuacugccuggcuccccccccaccccccgcccccgggucuucucuuacuucuucacauuuccucuucugugauguucuaugugccuuggaagggguaaaaggcauuuuguucaaaccuccccaggagaagccacagaacaaagaaugacauuuaauugcuccguuuucuuccagauuaugucccuucucacuaagaagcaguagaugaauacuuugcaauaaauguaaacuuguagcuagcuaucaacaugggagggucagccaccuaacccaaaagagauaauagguucuuauugugaaauguugacacguuagcccaaaguaaaggaaugaccugccuuuacccugccaugccuaacuucagguaaugacccaguuaaacuaucuugagauaguuuagaucugucuauagauaaaugagcacuccaaagggaguucucucuucuguaggacaaguggaaggauaagagaaauaacaauaacaagugucauacaugagcuguguaguucuagguacagccuggcugucugucaaaauccuuccaaaacuguguaguauagaaucaaaaaaaaauuaaaauaugcugaggggugaacuuuguguauaucaggcaacuuuuaucccauaaagauagauugcuagcacccuuuauacuuuuuauuuugagacauacucacuagauugccuuaaacucgcugaguagcccaguuaugcaaauacacuugugauccuccugccucaaccuucugagacauuaccaugccuggguagguucuaccauuaucuugaguugacuauugaugaaacugaagccucauaugcucaaagugauguagcuaauacgagccaugcaggacucagggacucuggcauauaguauaaggcagaacaugaacaucacugucuguuuuuauaaagacuuguuauuuuauguguaugaaugccuugaaugcauaaguguuuuauaucgaggacaggaucauauugacuaagaacaggaaaaaugaggcaaggaaaugugagugucuuuaugcugaaugggauggcacacacuuguaaucccaaagcuuggcagacagagacagggagcaugaguucaagaccaaccuaagauacacaaugagaccuacauuaaaaaaaaaaaguauguuuuuauuguacaagcacccuaggcuagauguauuaaucucauuauugugugugugugugcauguucauauguaugcagguacagacagauguuggaauacagagaauaucauuuuuuggauaaugaggaaaagccauuucugagaaagaaccuggaaaugagacaaugugacaaucauuccuaaggaacugacagccccuggcacauccuuuucagccagggguggucuagccuggcacuaggagguccucagcauaguucacuacuagcuaggcaccguuuccguuucuuucugggcuucucggaugcaugggauuugccaagggugcuucuugguacucaguugaguagccuaucagggcgcccccugcuggcucuacuguaacagucuguuuuccauuuuuuaaguucaaacaggaaaccagauggaggacgugucaagaaggcugacagcugagggaaaggacauagaugaucuuaagaaaaucaacaacaugauuguaaagcggcucaaccagcuggacucugaacagaacugaaaggauuuccccccaagaguggucgugggugcuggagcuucccacuugcuggaaguacacuagguuaaggacugagaaagugcacauacuauccauuauaccucuugguucaaggauggagauaaugcccaggcaaggaguuuaaagauggcaacugaaaggggugaacuugauucagccuuauugacugcuagccggcugcuucugcuuuggugggguuagagugguggguggcuagcauggagaagagaacuuagcucuuuacauuggauuccuuuuuggaaauaugcuugguuuagaagacuuugaauguucuagggaggucucugaugccucacguaccuguacagauuccggcacaagcuuaaggaauccaccgaacugucucuguguugaggggaaccgggugcucaugcuuuucaguagcguacauucuucuuuuugggugacacacuuugacaacagcuucugagcgcucuuccuucggugaucgcuggagaaaacauggggagcaugauguacguguggugaagcugagggacaagacaagccugcuguauucuacuacuguuuccugagccccugcuuugugaaaaucaucugacucuagaguuccuaccauacacaugugcaacgagggaauuaugucuauuuauauauaauuuauaaacccugcuagcuucgucaugcaaaauaagacaaaacaaacaccaaaaaaaaaaaaaaaaaaaaaaaaccaaacccuugguauccugcucauggcuuuggaagaaacugguuagguuuguguggucuuugcuaaauuagaguagaaaacuguguauuuggaagccuccuuguuuuagcaagaauaaaguaugcuguauauggcaagauugaggcaaaauagguguguuuaaaagcaugaauuuuuauuuaauuaaaauacacugcuaugagucaguugaagaauuauugaaauuuuuuguuauuuugguuuauucaaaauauuugaauuuacuuggaaaagaagcagaugcagagccacauuuugaauaauaauaguugaugaaauaaacacaaagaauuuuacuucuauuuuuauuuauuauuaguuuuugcacuaaaguauuuauauugcauacuguucuuaaaauugaucaauaugcagaacaucaaaaauauaaaauuuguguuuacuggaucauauugaucuguuauggcaaauccuugucauaaggauuuauuggaaaaauauuucaaaaaccaggagaucugauaccaaagcuccaaguaaacacucauuucuuucugcuuucccuaggacauuuuugucuuauguacacugugcauguuuuuaugcucaguaauaaacggucuuuauucaaaagcauuaugaauuuuacaguguaaccauuugaaaauaauuuuuuaaaaguggguucugggaucaaacucaggagucuucaugcuugcaagacgaguuuugcugacugaguccucucugcagccccugaaaaucauuuuauuuuuuuuuugaaaaccaacuaucuauguaaaguaaucuagaauguucuuuguuaacuacucucagccauuucuaauuaaaauaacugagaacacccua

SEQ ID NO: 6638 - RNA, 2849 nt, Mus musculus
cuuuugugcuuaaaauuggguagauagcaugccuggugggcugaguaaccuggaaguuuuucacacacucgauuucauuccuuagagcuaaaaugacuuugggccuuauguuugcaaugucuucuuccuuagagucgucucucuaacauuuucagucacggucuaccuugucuggcucacauacaaugacuuaccuugguugaguccauacuuaacucuuccgucccagcccagcucggagccuacuucagcagcauuaguugguucauauacccgcaaguccaggcaucuuaguuucccaccacagucacauuguuugaacucugguauuuauuccuauuuccaucuuguggcauauuccuaugcuuuuuuuuuuuuuuuuuuuuuuuuuuuuguuuaguuaggguuugaggaaugagaaauaagcacuuaacccaugcuugagauuacaaagauggaaaucuuaagaauucauugaguaacuucugcuggcaacgauugcuaagaaccugauguuuaagaauugaguugaaaguagugccagccagccaaccacugauucucagccaaauuacuguagcacaagaauuaauuucaaaacaauagacucaacucuaugauggcugggaauugacuggauaccaugaggggcauuugaaagaaauguaaggcccuagacauguuuucuacugauucaaaaagcagcauuucaguauuaagagagccgucauauucuggucaagucguugucuacgagucaaaguaaagccaggugccuucagacagguuugauggauggacacaugcaugggguugucucaucgcugccacuuuacccucccuggcaguggaggcuguuucccaucucuggaggacuaguacuugagguuauaauguuagaagaaggggaaaacagccaucaaaacugaagcaaguacuucugagaugauaggggauuugggacagauuggguaguuagaagaguuuugguuuuugaccugcaugacuagaugaugggaacaucuucauuuuuucugagcuuaguuuuaauacaggugacagcacuuaaugauaaagguaucaagugcauggucuucuugguucucaagcuaugggaagaccaaaaaaugugagauuccuguucucugacaguauaauaaugucccuaaagaaccguguaagagaagcuggaacacacagagcuauagaaugagcgggcacuugugagcgaaggcagaucuuaaacaacugcaagucuguuuucauccaaacugugugugaucuggcacccggagcuugcaggccccagcucucacuguaguaccuauuguguacaccagagggcagaaacugccugccacuuguggaaaggaaacaaggcugcuauuuccaaaaggcaggugcgcuucugaagcccauuuuggauggaaugcugaagugugcaaucuuugcacccacagacacuuuuuguaaagcuaauugaaagcccaggaguccccggaccugcugcuauaguuuagaucucugaagucuccuuaaagaaaaguguagaaggcuugcauggucaccagccuggaaccgcuggagaaugguggaucuuuaggugugaggcuugguugaagacaagucuuuggcccuuuccucucaagccucuucuuucagcuguaccuguuaccauguuuucuauuucugcaagccuagaucagaggucugaaacggggggcgggggggggggcuaguauaaagcugacuuauuuuggauacagggauggaaaucuaacacaucagccacuccgcuaguuguguuaucacagcuauccucccuguuuacugaggucucugcacaccagaugucccaguggcagcuccugccugcugcaggguauuuauacacaggagcacagcacagcagaagcgcuagcuaggaaaugugcugucagacgauacagccacuuccacugaguaaggacuuucaacuugagcuucauaugaaccacaucaguuaccaacugaauccaggcuugccggucuguuguuuuaaagcaaagcuucaccaauucguaucuuaaacucggacaugagagcggaagccacugcagggaaucuuguuaucgcuuggcuacauuuacacuaaauauagaccaccaauuaugugcuggguuuacgggccucaggggagcacuugugagcagcaggaagauuaagagcgaacuacagaacugguagaaaguuuggcuguaguuguuccugaguaguugucuuuucuaggaaaccgagcauuggaggcucacgucuuuguaaguaauuugcaugcuauuucuuacugagaccgaaugaugauuuuugaguccuugggguuuugauugcauguauucugugcuuuucgacugcucauagaaaagauguagacuugauuuuuaaaauuaccuccugacuuggaggcaugaacucaggaaugccguucauacguggccguggcucacucaaggaagcaucguauuaagcuuugaguucagccuucauugguaaacaauucugaguucguagcauacaauaugguuuucugcuuugauaccaauaccugcagggagaauguacaaugaguuuuuuuuuuucagagacaauuuuuauuuguugaaguguccuacugguagagaaucaagcaauuauuagaugaugaaaggcucagcuguuagcagugaucaagaacacgggaaaaugaaacuacuuacgugucugaguuccaggaucagaaaagaaucugcccaguggagcucggcaggaaggccaaguuagugcgacacggaauagguagugacacucugcagcggccucggugguuguuucug

SEQ ID NO: 6639 - RNA, 62984 nt, Mus musculus
uuuuagauaaguagaaagacuggcagauggaccucaaaguauccaaagagcaucaguaaauauuuagaucauguggaacacuuacaugauggcuguaguauguugguuagcacugacugaucauuaacuugacaggaucuggacccacuugggagacaaggcuccaggcauuccugugaaagaucuugucaaauggauugugaaagagcuugucgaguagauuacccucaggaauaaaaagacccagaaacgcccuuagcaagagcauuccucucucucucucucucucucucucucucucucucucucucucucucucucauuccugccugugcacugacaugucaucugcugcuggccccucauuuccccacucuaagggacuaugcccuagaacugugagccugagaaaacucuccugcccugaggguuugugaaguagccuugcucaggguacuuuaucacaccaccaggaaaaggaacucaacaaguugacauugauuuuauugauugaaaugaccauguacuugagugcaacauggauauuguauaaaaacuguauugcacuuaaaaaaauaagugcacacagcauugcagguaggccuaucugaugauggaagaaagauaauggcaaaugcagaugauuugcuaaauuuaaaagauuacauccaguucuggucaguugucagcaccccuugaagagcacaggggucuggcucucaguggagugguguuccuucuagggcagugagcaacauaggggaccagaaacuccuucaacagggcaaaguguggcuuugauguagaugacucucuucuucucuugauccaaaguucuacagaaugaaaaacuacauuuccuuccauaucaugucaagacuuggcuaauccauugugacuugaagguaugguguuuggagaacauaacaguuuuagggacucaaaaagcuucugguuucuuuaaacuguaaaaagaaaacaaaauaaucuuuagguugaaugaaauauguaauaguauuugauaaauuauaagucauauauuuguaaauaucaacauugauauguuuaucucuauaccaaacuggucaucugauacaccuuuuuauauuuuuauggaggaagaggcugaugacacuaaaugugccgaagcagucauguagcccugacaaaaaugugauuuaguuacaagcauucagugaaacacccuagaucccuaucuacuccauguaauuacuguaacuggaaggguauauagggcuagaaagauggcuccacuuaacagaacuugcuggucuuccagaaggacccuaauuggguugccaccaugugaagcaagucacaacugcccuuaacacugguuccaacacccuguccuggccucucugggcaccaauauaacauguggccuacacucacagauacauauaacauuucuuaaaaaucaaucuugaaagauaauauauuuuuaaaaaucagaaguaguuuggaagcacaaauuauaaaggaacuuuagcaaacaucaaaacuacauugaccaaauaggccaaaguuuguuuaaugaacaauuauaauaaauugaugugucuaucauuggucuuuuggaaaauagccuuuuucuauguaauuggcauuuacuucaagauggaggagaaggauugcccucuauuggauuguaaggaacacugcaggcuucagaaucccaagaaguucuuccuugucuuuuuuuuuuuuuuaauuccaaauuaaaaauaaauaucaagauuuaaaauguccauauguccauuuguuguuugauuaaugcaggaugcauuuaaaaauucuaguacauugaaacaguuguauaaucuaaguaguuauuuuuccccauaaauggaaaguguuaacccucaugacuaggcaggucuacaucuaggucauuaaaaagaacucugaaagcacuuauaugaagguuuguaucuaaauuuucuuggcagcacuguuuauaucauccaaaaaguaggaaaaaaaaaaaaacucaaggaucaucaggugauggauggacaggccaaaugaaauuuaucuacacaauggauuacaacccagcaacuaaaacaaaagaaguauacaucucugccacaagcuaaagaacucauugaagccagguccccaagauguagccuuuggcccuucuguccuuccgaaggcuagaauagagauggccaucugccugcccucucaguggaaguagaaagcugaucucagagccuguuaggaaaagaugcagucauguggauuuuuaguuauugcauaucuuuguucucuuugaaauuggacauuuauguguacgagugugacguauaucuuauaacagucaucuuuaacaugugucaaucaacauuuuaagauacugcuugggccuuguccuuaauacucaccaucaguccccgugcaacucaaccugagauucagaugcuauugggucuggugaaaaucaguaacaagugaggccuuugcccuuugcccuuugcccuuugcccuuugcccuuugcccagcauguuuauucacaggcauauuuucagauaguuaugguuucuuuuaucguugcugcagugucaugacauggaacagauggucaguuauuaccacagucuuggguuuuuuccuucuuuguuauauaauccuaauuucuguuuugauugcacccccagaauaaggaguuuguaugucgagggcaugacuaugaaagacuggaggccuuccaacagcgaaugcugaacgaguucccccaugccaucgccaugcagcaugccaaccagcccgacgagaccaucuuccaggcagaggcucaguguauccauuccugaugggccucgguugggugguaccuguuguuagcugcaggacauuguccugugaacuguugcggccacugcucccuuuucagugcccccccccccccaccccucagacuugcuaguccucucccuccugguguuagcuuauucuaauuguuaucacagagucagugggaaagaaaugccauaaacaucugguaaggaauuuucucccuuuuguuggauacuccugcaauuuacacuucugaagcucacucuuauuggauuucccauagaacaauagaauaauuuuccucugacauccaauggaaacuguuucaguucaaggaagugguagcauuguguucaggacagcccauccuccaccuccucuuccccuucuacuugcauuauauagugagggaaagaagaaaaagaggugucuccaguauccuugggguccugauauucaggacucugacuuaauaauagcauauaauucacauacacacacccccauguaaacauaucuaaacacaaagcaaacaauuuaaauggaagcauguaggcuuuagacacaaaggcaauucacccaucaguucuuccuaaauccaccagaaaucagugguuuuaaagaaaaacagguaaacucccaguggcuuauggauauacuuucaaagcagaaccuaaaugcaaaagaaauaaauuauuuaagaaaaauauuugcucuguuucuccggagaggaaguaacuauauaaacaaaauaguauuuaaagugggaaguacaacuaaccacuuagcuuaucuauaccuggccuuggaaaauggaugccacacuucagaaggcuggggucgcagcaacacuuggcaggugcaaaucccugucaguuuugguuacugccuuuggucauagucuuaugaggauuuccauaucauuauaaaugaauuuuaggagccaugaacaauagacugaagaugaaagugucuuguguacaagagguagguuauccugacucugcaaacccaagcccagcugucccuccccaacccuacuaauguaagcuguaacuucacagguuacagaaaugccaagcguguguccuguacgaaucaaacucuuaggacuagaucaaggccugaaguuggaggcgugcuuagaaguguguuauucauagcuucugggcaguuuuaaaugacuucagcuggaauggaaacaccagacugccuugccauuugucaagccggguuuccuccuugacucuuuaaucuuagauuuacagauauaugcugugacucccauuccagagagccaggagguacugcagagagagggggucccagacaacaucaaaagcuucuauaaagugaaccacauuuggaaguuccgcuacgacaggccauuccacaaaggcgcaaaagacaaggagaacgaauucaagguacccuacagugccuguaacaggcugccuccucaaaugcuuuccuagacugagcccucugacuuaguaacugaggacgaagucacgugacuggaacaaagggucuagaguucuuuuauccuaggaacaccccggcucugcaguguauccaagugacgggaaacauuuucuaagcaagaagaguuuuggucccaagcucagaaagucugagcagaucuggcaguaggucuugaaaucaacuucccuacagcaguuccaauacccguggugcuuagaccaaccuuuaaacucagguuugaacucagguauucuaacaucaaggaaggauagaguaaagaggagccaaagacuacgugagggagaacugagaagaggccacgugggcacacuguugguagccuggagaugcucuguucuguccuuugcucuaguccucguggcaacagugugauuaggauucugagaugaggaccagaguguaugcuaauccuggcaucugcaugugccagcccgucugcccucaccagcuccaugcgccuugcuaguuuagcaugcucccagucagaaaguucucacagccucacugggaaaaggauaucuaaauaacuauucagaaaucacuucuucccuugaaaaccaugauaugggaagaguuaggccccagucacuuggcauucgaaccugaacaaaauugcaaaaugagcuuauuccugugagucuguugcuuagcaucucuugcaacaaauacucaagccaugaugugucuccuaacacuaucagucuuauguaauucuaacccacacccauccuugcccagugguuucccaguguugccaaggguuacugccaggcaagggucagaggugguagcuuugcagaguuccaagaggauugaauuuuagaaaugggccuuugugguagauuugaugugcauuuucuaugaaucucuucagaaaucuaaucacaaacugcuauagugauagauagauagauagauagauagauagauagaguauauaucuaucuauauacauaccuauaucuauaucuacauauauaugucuauauauauaucuauauagauacagauaaauagauauacauuuuaaaaaaaaagacuagaaucagccaauuaucccagcagccugcccacuggccucuucucugggucuucuuucucccuguggauugagcacuaaagagaccauuggaaaacagcacugagauauuacugaaaagacucacggucauuuucuaguccuuucugcauauuucuaacucucuuuuuccccucucaggccaccuaaagaucuuacuaguuaugauacaguccuuaauacuugcagugcuuuuugguccucagaaauggaugcacuagaguccuacaguuggcuugcucagggucacgugcucauggccuuuagcuagcccuaguacuggaacccaugucuuccaacucccuuucuuuugcuuuuucuacuguaccauauuuccuccuggccagcaauuuaaugaucagugacacagcuaccuuaccaggguggguaaagcuaaauuaggcucccuuucccuagaaccugacuuuaaacugugccccaucgucuccucccuaccucuugguccgccuccccaacccucccuguuggcuugagugacacccacccucucuauauauugguuaccauacccccucaaaagcaacuccaagucugugugggcagccuccugccugcacagcucccccacucuccucccggugaacucuucacucuauaaaauccaucucacuugucuacggcuaagcugccauccuggucccccucggcggcaugaguaccugcauccugugcacaccgugagcaucucuuuugucacucugagcucuuggcugcuugucucccugucaucagacucucucaagcuccuaccacguggacucuucugcagucaccucaggaacucucccugguagaacgucauccucuuuuucaccacucuguagucagaauaaauggugcaauuccagcaauuuugucaaguuccuguuacuguuguuaacacacuaaauaacgaugauaaaauauaaauucuaaaacugguuaauaaaggaaaagacuugccgugagcaguggcucaagccaaaagcagcugucuuuuauauguccugaaggagguccucuucagaagcacacaggugucucugcauuacaguagcucagugcaucaccagaagaguggcuuuguacauaugacaauggagaggagaugaggcucuggugugugggugacagugcuagcccuucugguaacuagaauguggcuuugagggagucaagagucuuucuaaaacuuaaagucuucaccuuaaaacagaagaaucaagccauguguuucuaaaguccucaggcccuucagaugacuguuacccuaaucuugucuugauaacuuauacuguugccccuucuaaauaaaaauggcuaacccucagugagugaagagguuaaagucacauuuuggaaaagcaguggcgaagacugcauacagcuugcugcuguauucugacccuggcuuucugaagccagugcucaauuuuuuuguuuuuuguuuuuguuuuuguuuuuuuuuuuguuuuguuguuguuguuuguuuguuuguuuguuuuacauagaaaaaagguguagacagugugcagaauuacuaacuggauuguuucacaaguguaccagggaagacugaagaaaggcugcaggcaauaaggagcaccugcucagauuugucaccacucgaggccuagagaggaggaaggcauagaaacugacucuguguuguuuugcagagucucuggguggaaaggacaucgcuguacuugguccagagcuuacccggcaucucccgcugguucgaaguggaaaagcgagaagugguaagaacauagcaucuccccagcaaucauccaugcccgggucgcugagcccacugcgacucgcuucuacucuuucacuuuccuggguucccucacaguucugacugcauuacccaagguauugauugaagguaaauguugauguccugcuucaaccaaccagaacacuucuuuaaagcaguuaugguggcagcauguaaaagcaacauguuggaguucuggagugacaaccagccugccaacucuccuaccuguguuggaucagugaucuucauugcuuaucacacggcagcccaaaaccaagaaggcagccuauuuucuugugcaaucaucaugucggaguuaugacauggauauucuaaaacccagcucugucgcuuucuuugagccuuaguuuucuuguuggcaaaaugaagcuaauauggagcccuuucauauaaagcuuacauaaaaucuguuccuguggagccucggcuguuuugaucugcagugagagagacagugagaggagcugagugguccugaauagagcugcagguaaagaggccauuaugaaaucugauaaccucagcucucaagaauucucugguugccagauaccuccacagcuucuauccaaaugaagagaaaugggagagagaaaugacugcaaauuggcugguacuccauacuggugucugucucugcugcauuucagcagagacagacauacuggugucugucucugcugcauuucagcauggcggacauagcaucccagccucccaggaucuuuuccuccuuuugcacauccauuacggcucugagccuggcccuuggauugaccuaguauucugcuugaaauaaaauacaucaauuguaaaucuaucaugcaaacaauaccaaaguaaguagcaccucacuuuguuaauaaacaaauaaaaguagcucuccccaaaauguuuuuccagaauggcuucuccuacaaaaaucucucagcaucuaagaccaacuuaucauguucaaggcuaaggguugaaugaguuuuucauuuuacaaugucaaaauauuaauguggcucccuaaggaagcgaaacccaauucacaaaauuauauuaguccaguucuaucugugugcaaucugagccagggguuaguccgccauugcugguugcugguauagcauaccuuagugccuuucauagaagaggggaggcugccacugugcuuagaaaaucuuauuauuaugcuuccuacagaacagcaaaagcccaacccacggcaauguucuuugucacccacacugcauuaaugauucaaagaaucuuuucagauauauacaguccagaauguuaaauucuaugaagauucaccaacaguccuagcccagcaaacaacacacacacaccacucaugaaaaauaccaugcugauaauguuaaagggagaaauaccaaacacagccuuucaaacaucagcugccuacuuucuuagaauaugcaaucuuauguucucacauaacaagucaaacagggcuacugcauucccuaaguacagcccacucucagcagcuuccgugugguucuccuguuccugcuaccuggaacgauccaugauccauuagaguuguuggcucacugguuuaguucuuccuauauaaggacuucaagaacauaguagguacucaauagaugcagaaaaauuaauugaaauuucuuaucugcgaugcuagaaucuacaggugaauggguggcuucaaaauucauuugaucauaggguucauguuuuaggaagcccauugauaccuucuccccagugugagaacaccuuccagcacgagaaacaccagccaacagggaggcagcaggcagcuuaguucuaacuugauuucucuacuccuuacauggugucuuuagcaguaggaucuuaucagcuaguucuggugggcaaccaaaaagaauggccaaaccuauauuguuucacaggccugcagagcuucuuugaccaacaaagcaacaggcgauaucucauaccugacacuaggggcuuguuuagugacucucagcaugcggcggcagcacuauccaaauauugggcuagagcucuuugaagucuuccuuaacuucuguuuuauguuggcuuaaaaaguagugugcaucuaugauugacaguauagcuuuuuccauacaucuuaguguugguuagccuuccucuuuucacucucaucuccucuguccacccacaccuaucucugcuuaaacuuuccacccucacaaccccuccuuuguacagcuauaucucuguguugcuuucccuacucccuuaaggcauuuccucacccaguagcccuagucuuauugcauugcuucugcagcugcuccagauuaaucacacagaucugaaggucugaaacuagacucuaaaugugagagagaucaugcaguguuuaucuuucuaagccucaguauaauuuuucccuaguuccauccauuugccugcagacuuccuaacugugcauuucucugcaggugaaggaaauacacuguauauggccacauuuucacugugcgcucaucaguggucggccaucaaggcuggucccacuucuuagcuauugugaacagagcaucaaugagaaugguugagcaaguauuucugaaauacgauguccauuggguauugggucagcagcgagucauaugguaauucugucucuagguuuuuuuuuuuuuuuuuuuuuuuuugaggaaccuccacugauuuccauaguggcugcuccaguguacguucaccaacaguaaggguuuaucagucgccacauccuaaccaguguuuguucuuuaucauaaccauucugauuuuggugagauggaaucucaaugugauuugaugcccccuccacaagggggacgucauauccagugcaguauaccugccccacccccuauacaugccugaggagguuguaggcccuagagcugaacuuauccccguuuagguaaacugucauguugucaagcugccuucuaaauaucugugauuauauccauguuuaaaugcuacuuccagccauaaccggaaaugcuugacuguaauaaacuggugaauguaaacuggugaaugcagagauccagggcugugcaaggugcuggcuauaaguaacagcuggacucucagcccuaagcaggacauuuguccuacccugcuucggcucaaggaccguugcagaggaauguaagauagggagaagggcuguggaaugcugucugcuaggucuggcacaggguguguacuugugaacuguggcuuccuguaaugagccuacucaagacugggucuaucgacauucacccauagaucaagaaugggucuguggagcccugccucuaccugcugaacuagcgauggauucuagggaagggauagucauucuucauuugagugcccacugaggagcccacuaggcccaguagaugacuccaaacccauggucacacagaugauccugguuaaacucagagggucucaaaauuaggaauaacaacaacaacaacaaugaaaagaaaagaugugggcaagguauucaaaggcaggauagaaugauaggggugugagagauauuagaaaggcuucuguuuguagucaucaagauacacauuguauauguacaaaauugucaaagaacaaacucaacaacaaauauacauacauuuguccguacccagaaucccaggagucucuuccagccugauaacagugccaucuagugcuucacugcugcucuaggcuccuggucuugccuguguaagaaguccccuccugcuucaacccuuacuucauacacccaggacaugggaggcaguuacccucugacacuuaguucacacgaaagcaauagagggaauguauaacaguccuaguuugucauguucaacagcuagaaaaugaaccuauuuuguuuugucugcacuucuaaccacuuaucacaccagauaauguuaugucauagaguguccuccauaauucauuguguguguuuauaaacaaccugucauuauuaccuauaaaagaaucacaguaaaauggugaauauaaaauuucuagcgcucccuuaugccucaccaagagucugguuuucuuuucacucuuccuuugagucuagacauucacuuuaguucuuugcaguguugccuaaaggcuuuuagucuagauuuuucccuugcauguuuucuuuuaauauuuuuuguugaagaaucacagugguuugcuuuggaauguuuucuuaaaucuugauccaaguggggucauguaacauauuucucuguggccuauauuucuuguaaguugaucguuaagccucaaggcguaguaaggguuucuuuguuugugcaagaccacuuaauaguuuuuuaugccucucuccuguuuucuccuggucuccccuccucuccucuugugauguuagugagaauaauugacaaucggucuuugguugucauugcccagacccauugaucuuuuagggauggagauacugauauuugggaacuagugagauaguucaguagguaaaggugcuugccaccaagccugaaaacuugacuucaguccccagggcccauguguuagaaggaaagaaccagcucucucaaguuguucucuaagcuccauguauacaacauggcauguauguauacaugcugacacacacacacacacacacacacacacauacacacuuuacucauuugucuuuauuuauuuguugcaauauuucuauaaaauaauauccauucucaaauauuuuauuacugagauauauaggaaaggaaauauaauguucuuuuugaaaugagugaguccuggcacccugagcgaguaacagguaggcugcuuggaauugguuugcuuuagguuuuacuauuauuccccgaucauagauuuaaguguguuuguuuuguguuacuccauggcagcuguuguuauuaaauuauuccuccuaauuuuauuauuuauuuucaauugcuuugugauugcacuugugcuucuguucaguugccucuugcauucuccuuauuuaucuauagagauguuccuuuugagccaauuagacaugacuccauguuccuuccuagcgucaggcuuuauuaauaauuuaaugugguccagaugcucuuccgagacuaaagccacaucugccaucuuucuaucucacagcaaugguagcaauuuagaaucacacaugaaagcuauaaaugggguucacagggcucccuguuuuaaguguacaguaggagacacugcgugccauucuucagaggguuagccggaaaccucucagggacacuugucuuugagucuggacuucucuacuuaagaaguccuacuacagacuuccuucuacagggaucuagagaccauaucuuccucuugguugguacucucagugcauuuacaugagggguuggucagcugggagaggugaccuggccaccuguuuccuuuucaguuccucaaaggcccuuccucaggaagaggaguaggcaggccacaggccagcugcuuagugucuuccucacagacaccauugcuuucugaccugacaaggagacauguguaucaguuucuuguauuuaccgagugcuggugaagaauugcggcaguauauuuauucauucugguucuuuugaggacagucaguuccuucccugcauuccguuuuguccaacauugugaauuauuuauacuuugucucagauacauauuggaaauauucucugaaguuccuguauucuauacaaguuuuuuuaauauuuuaugugauauucacaaaauuauugaauuacuaguauuagaguuugcaaaugugaagauggauuuuuuuuucauuuuauuauugucuaaacaacucauaaaaauguuuguaaucccuuuugagugcauagugacagggcugaugguuugcagcuguugagucauugaucucuccaauuccuuccuucugucauccgagagucuguguccuuucagacgcagcucuuccccacccacagccccugagcagcaauucucgacuuuugggucaugaccccuuuaggaguugacuaagaccauuagaaaacacacacacacacauuaugguucauaacaguagcaaaauuacaguuaugaaguagcagugaaggucaugguuggaggucaccacaucaugaggagcugcacuaaagggucacagcauuagggagguugagagucacugcucuagagucagcauucuguccuguguucugaagacacuugcaaacuaacuuacaguggcucagacucagacuugccuuugugcuuuggcuuuugcacauauaaaacaaagauuuaguaucacaaauuguuuauauuuaucacucuaaagcuucguaggggcuucuuauguaccccuccaaauuacagugacaguucccugccuuuaccccugagguauccugauguuugugguaugcauucccuagcuuagauuucaccuguuuaugcuuuucuaaaccaguccacuuaguuuggcuuaacugugugcacucuguuaagacuugcuuaauucacuuaguguuauuugugguauuuuuuuuccaauuuacuaaguucgacaagaaagcuucccauuacuauauacuauuccugacuagggaaacaguuacaaacauuuuuguucaugguuccagcugcacauauagauagauguccagcuccauuuuuuuuuccagauauacaccugugaauaggauuuuuggaccaugagauagauaaagcuauagauaauauuauauauaauuuauauaaguagauaggugauagauacugcaacuguuuuccaaagcuaaugaggcagucugcacucccaacagcagaaagggggcacuggugcucacaguucuacucucauuugcugucuaucaccauauuuauuuuuaccacuauaugaggccuuguauaguauuuguaguauggcaguauuguucguguuuccucacauauaaggcuuagaucuuuugcagguauuuacuggcuacuuaaauuuacuucucucugaauuugcuguuccuguuuugugcccaguuuuucuuguguuguuucuuuuuuuuuuuuuuuucuuuuuuacuaguuucaaagucuuguacauucaaugaagggguuccuuacugauuacacauauucaaauuauucugucauguguccggugucccuucccuuuauagcauccuugacuaguauuuauucuuaauuuucauacacuugagucacuuaaaguguuaauuuaagauagcccgaguggccuuuuguucuaauuuguuucucugacugaaagaacaagagccuaagugugcuuccugcaagcccagucacuucaucacuaagaguuuggcagcccuucucuucacagagaaugucaguggcacuaacagcacagugccauauacuggggaaagcacuuugaucacagacaaaauuagguccccuguaccaacccaguaagucauuaugauucuauuuggcucugcaccaaaaauuagauccuggaauguaugugauuagcuuguuuucuguaacucccaacuguguaccauccugugccaccauauggugcuguuauaaaugcauauggggucugcaugggcauauguccccucucuccaaugagacugagaacucuuugacaccagaagaucugcuaauguaucucuggguuucucaggcugcuuuguaucaaauaagugccuagaaggguggcacagucauuauucgggguccacccaaaagauccuaaacaggggaugcuuauagcugugcuauuauagaguagacaguuccuuguuacccaaaccauacucccaccgauggauauaauuaucugauguuuucacaccuuacugaugaauggguaacuugacuuccacauccucuccuugcuaugggauagcucccagaagagauacugaugggagccacuaagaaccauagaugauucauaagguggauagucuacuuugucugucuugucccccaaccccucggcaucuuugguuuugaaugucaugaaagucaguagauauuuauacucuuuugcuuuucagguagagaugaguccucuggaaaacgccaucgaaguguuagaaaacaagaaccagcagcugaagacccugaucagccagugucagacgaggcagaugcagaauaucaaccccuugaccaugugccucaauggagucauagaugcugcagugaacgguggggucuccagguaucaagaggugagaacugaggauugcuggacaggaacucaucaguggccaugccuucagauuuuauagaucuuuuagugcaaacauggucccauuaucagugacagauggcugcggucuguccaagugcacucuuuuaucacacaggacaaauguguagccagccauuuguguagcucacauauuucaucuucaugaugagauacuuugaguguguuuguguuggggucaggagaucagaacuguuuaacaaaugucuaccuaaaguaauuugccugaucaaagaaguuagugggguagucuuguguugguugguuguuggcugguugguuggugauccuuuaagugggcuuuucaucuguuuuucauaauaggccagaagaccaucuuagccacacugaaucuuaagacaauuuauuuuagaauauaaugcauuuaguucauugacuugggucugcuuuacaagagaugcucugacuuucugaauguugccugugacaagcugccuacgguuaggaaucacuccaucuguccccaaacauguuucauaaucauaccauuucucugcauaugccaagccuuagaaaaauaauaauaagugugccugccuuucacuuccaugguaacucucccaggguagucugacugucccuucucuuccuaggcauucuuugucaaagacuauauuuuaagucauccugaagauggggagaagauugcacgguuaagagaacugaugcuugagcagguaggaugucagaaguaaccauucuaucuugcccaacucuaugcauccuugccagguacccaccuauggguauuugcaugaacagccuuacugaaguggcagucucaagcugacagauucaccugugguauaacccaacuggcuaauuucuacccacuuggacccaagagcaaucuuaacaaguuguuccccauaaguaauauuuuccauaguuucuuugaauguccuuccugaagacuugcucuguagaccuguugcuaaccugucauucaaaauuuuaugcucaaauaaauucagcccaccucaagauccugaauaagaacaugaaugaauaugaugauuauguaagugcaauaguaaagaauagacaaugaguagaguugcucugugguaguauuguguuuugcagauaaagccuaaaggaugaacuauguggacaaacuagguacucuccucauuuucuauuucaaagaagcaguuuauuuuuauuuggugccaucaagaacugagagcaagaauaaguauucuguugcugacuaugccccuguugaugguugccugaaaaggguuugcaaaccucugauauagaagaaacaguuggcaaucuggguuaaacaggaaauaauuuugucacaugaaaagcagaguauguaugauagacuggggcagaagcaucucuuccugcuugguaauauuaaucaaaaagcauguuuuuuuuuuuaacauuggaagaugaugggguuaugaugaauuuaguccauuuaugcucuguagguauuauccacaaaauaaugacaugggguaagagagauagggcuauauaauaagagcauguaaacuagugagaagguggagaacuuugacacccccccccagagaaauagaguuaauaaguuuccagugugauuaugggcaggauguagguacaagauugcauaaaaacccuaaccuuggucgauaucauaaggacucuuugagcaucagucagaguaucaccucucauaaguggucuccuuuuuuuguuuuuuggggggauuggccugaauaaguucuuucuccagaauuaaaacaguagcucagaagugaagauacuuuucaagaaaauaaaauuagaaagacuucacuaugucaugccugguauuguuuaugggacccuauggaaagagcuaccuguggccuggaaaugugaggucucugcuguagaacagcugaaacaaacaccugucauguaaccuugggcaugacacaucauuucuaugggaccauuaggaguuagacuggaaaggccaccauccuucuuggaccucugucugguuggcauagaaauaucuucaguagauauauccagcagccugaucuuacaggaguugccucaauugaggagagccacuuggccuauggucauugucuucucaauggcccacgucuaagacucggggaaccuggccauuuggguccaacacaggagagccuugaaagccuaauaaggucccaaagagggcuuaguaguguugaucagcuugcuauauagcacaucuuucucuguagagcccugcuucugcuugacccgcaggccaagcucccugcaauggacuuccugauccccaugcuggagucuauucccugauggacccaaguaaaauuaucccgagcaaaugaaaggugacccaacagcuauuuaaaaugaagaaggccagcaguugcuguagugagucacaacucuugggucccuccuaucucccaucucacaggcugucgcucccuuugugugucagauacacuccacucuuuccuccauauucauuucauagggcuuuucuccuuggaaugaaugcauuggcagggcuaggcauccagaggagaagaugcugcagccccagcucaccccagcucaguuuacuaagaugcagaagauugcugucauacaaaacccaagaaaccacacacaauauugauaguugaacaaaggaaaguuuaauguuuaucuucauuuccuuuucuuugaaacaggauuccuuguauauuauaguaacuaaacgagaauaaucguuuuaaagaaaaaugaaaagccuagcaacugcuacagaguuccugcucaauuuuuuuuuucuuucuccccuagaaaauguugccaagcucaggauugggagucuguugcaggagagaaggugucauccuaagaaagauuugcuugacccuccaaacaggaaacagcuucugccccauucccugccucacccuaggaaggggaugagggggccagggacccauagccacuaaagaggauuaucauuaaagagauccuuagggaaggugaaguagggaagucaaguucggggaguccagacagacccaaauucaaauccccacuuaggauuuguuugauccugugaccuuccuguaaaguaacuguuguucccauucaucaguguagcugcucagagagauguauggucuacagcaagcauccaugagaaguagauacuaaugcagucuuucccuucuguuuguuaucaaggcacagauucuggaauuugggcuggccgugcacgagaaguuuguaccucaagauaugagaccccuucacaaaaaacugguggaccaguucuuugugaugaaaucgagcuuugggauacaggugcgugcagaacgccaugguagggcaaucuaagcacggccauugcuguuugugagucuguggaugcaguaucuauccaacagugacaucuuuugguucuucugccacacugcagcauuugccagggagcuucuacuacuacagugacguuccugcugcuuaugaaacaaauguccguagcagaggcucaauaauacuggcauuuguaauuggucccuagguagauuccaugauguugaggaugucuguuuaguagguugaagcgccucaucaguugcucuaaucacauacccuuuaccucaucuucaggaguucccugcuuguauccaggccagcccuguccauuuucccaauggaagcccucguguguguagaaacucagccccugcuuccaugaguccagaugguaccaggguaaucccuagacgcagguaagucguauuuugaauuaccuuacaauuugccagcccugcaagaugaucuggaaugguucucucauucuuuaugguacaauuugucaaauucucuauuucuuaaugaaauaauuaagccaagaggcagcugcagacaucugccccugguaaaaacagugacagcaugagaaauaaauaaacucaaacauucuauuauaucacagcaaacaggagaaaacaaaaugagaugugucuuuuucccccuucgguuuuaugccaugccagcaugugauaaaauacaguuccaaggcugaguuaacaacuaacuggguuuuguuguuguuguuguuguuucucuccugaaacagcccauuaaguuacccagcugucaaccgguauuccucguccucgcuguccucacaggccucugcugaaguaagcaauauuacagggcaaucagaaagcucugaugaagucuuuaacaugcagguacuucauuagcuuuuugucugcuuaugucuauuuccguuucugucugcaucaugagagugucuguccaucccgcugggcucaugaacagaccuucgagcaagaacuugaccuaaggaccaaccuuuuaagaucucucaguaucgauuuguuggccuuuggaauccacaaagaugugucucuccaaaaugcccaucgcuuuaagaacauauaaguaaccaauuacaaagaccaggcaggcugccccggcuuagcuuucagauugaucuugguaguucuuugcuuucuggguccuggguucuuggaucaaauugacauacucuagcugccuccuacuguucucuaguaacucuuuaugaguucccuuguggcuugaagccccaguauaaaauuugcauaguuauauaagaaaauuuucuguaauaaaaaaauggaagaaaaugcauaguuuuguagguauuuuagaacucaugggagucuucaagcauuuuauuuugugguaguaaaauaagccuaguacugucuuuggaaacagccacaaugugacucccaguguaugcuuugaacagaguuuugaagccaaggagaaggcagauugugugccuuuuagaaacacucaccugggccagcuagauggcuuagugggcaaaacacuugucaccaagcauauacaguaaaaggaaagaacuaacucaaguucucugcaggcugucuguccucugaccuccccuugcaugccaugcacacaugcaaucacacacaugcuguggcacauauaugcuccccgucaaucaauaaaugaaaauuagaaauacuucccuauguauguccccaagacuagaaguauuucucuuuauacuacagggagggaaggcuacugacgggguuggggacuagagcugaaacuacuacauguguguuccuuccuucagcaauaguggaacucucaggccugauuaagccaggccaccuucaugguuggucugaaucccuaagacuuugcucuguuucuaaguggccuuugggguuuccguuuuucuuuuugcuaauuugaaaacgaaaugaauguuggugucuugcuucaaaugucgugaaugaaagcuccuagccauguaugacaguagugcccuguguuuccagcccaguccgucuaccucaagccugaguuccacucacucugcuucaccuaaugugaccaguucugcuccgucgagugccagagguuagugccgaguuggggauguccugucuggcgcccugagauguuuccaggcccugggaacuguggcuucaguggcccauauuguaggcagcugccacaccacucuggcuuucacuaaggccccacaggcuagcucacugauaaugucuguuucucuucccagcuucgccuuuguugucugacaaacacaaacauuccagagaaaacucuugccuguccccaagagauagaccgugcagugccauuuacccaacacccguggagccuucucagguacucuccugugggggaaucagaggcuagagaaugggagagugugggauugugugugaaucucuuuggacucauacagugccugccaaaagcaaccagugacaaggccaguuggaagaagacucuugucaguccaccucuggucucugcccauuguuuggagcaccaucugacucauccuucuagagcggugguucuucuuaauccugugacccuugaguauagucccucaugcuguggugacccccgaccauaaaauuacuguguugcuauuuccuaacuguaauuuugcuacuguuauaaauccuucauaacugucauuuuguaaauuuuaugaaucauaauguaaauaucugauaugcaugauaucugaugguacccacagguugaguaggauaucugaugugacccacaauagggccaggauccauagauuaaagaaccacuguucuagagggauaucugggucacagcccugacagugaaacugagagggacugccuggcccuugaucucaaccugguucauggcugcuacaacaacauuccaaggaaaagccagugaauaaaccaucuguguguguguuugcauguguaugaguagaagucuggggagggaagaacaacugaauuuaggggaagacuccugcuucugcccagaccuuccuguuuguccauagcuauugggaagagcugcagcugacuccuuuccccaagaauguaggugcaaucuguuugccuuugccauugaucuuccauggauuaccaggaaaggggcuguguccuggagaugucauacgagcuagggaaugugguuccgccggucacucaaaccucgcuuucaaaaaccugagugagcaugggccacaggcccaguccaggggcaacguaugugcauuggaggguggguacgaaguugaagauucguguuguaucccugaguuuuuuucacaguuuauuugggacuaauuuuaagagcagagaaaacuccuuguuucugcuccagcuaauuucucuguuuuucuacaccauccuggcagaagucuguagcugcaucuggaauuggaugagagcgagugggauuuggcuugauugguuuaucuuugcugauugugugaucuucccgaaaggcccaggauaccuccucugcgcagcacugaugucuugcagaaaugauuucugagugcguuugccugaaccagcuaaccaauuuuauuucccguugucacuggcauugcaaggggauuucaguuuguuucaucugcucuaagagaucaugugccagcaugggaaacucugaaaggcuuccuugauuaguccugaguuaucugucuuggguaaaauuugaaucaguauauauguuaccaaaauuauaauaauguauaaugcuguagguuuccacuuuuucuuuucaugaguuagguagagcuauguaauauugguaauuuuguagguuaaaauuauagaauauucauuagcucauuuuugucuauuauaguauuugaacuauaaguuugucuauauaguagguuuuuaaauuaauauuucuccuuucauucuuauucaugucauacugccagucuagcaguauacacuuguaaagaacaucauaccuagcgaauucuuacuauuaauuuucccuauguuuauuaugaguaauuauuuaccauuuauauuuaauguaaaacaccauuucuuauuauguuucuuucagaaaaccuaagacucuguuuccccuuuucuccuuaaauagaguuuaauuauuuguuccuaggcucauuauaccauauagaaaauguuuugagcaaagaguuucauaaggagauaaccaucucauuuucuaaaaggcauccuaccucagcauauuauaucauaaaaauggacucuucucccuuuccagaggaugcuguuuaaucauauuggagauggggccuugccucgaagugaccccaaccuuucugcaccugagaaagguggguaccagucauccaccccuuguagguccuagaaugugucaggguuuguuguguccucauuucccccagucuucugugugccguguggcagguagagcucuagacuguuaaugaucagggugagugugaucuuuaggcaauuagugaaaggcaguuuaucaugauccauucuccauaaacuccuaagcucugagcaaauuagaagcuccuuuguguaauggcuuucuguuguucagcgagcccaggccaagccugcucucccugaagcaaaguugccaauuaagccacuaguucacacaaugaaaguagcuacuccucagauugauuccacagaccccauccauugucuccuucacaaagcucauauucagccagcucaacuguuguugguggucacucacacaggcucuuguaccauuaaaugccaugcaagcauugcgaucagacgcauaauggaguggggcccgccucaaggucaagcacacacaaauaagaugcacacaccaaaugcaugcauagagcuaagaagccaauuagcaacacacagaccaggaagagcagauuaaaugucgcuuccuccacugugggugcagggacuugcaaagucacccguuugccucucagggucaggccucaaaaauagcagucucgcaggcuaaugaaucaagacucacuaaugaaaugucccaguaaagugcacuuuaauugcccccauuaagaacuaggcuguauuaccauuuugguacacugauagauuaacauuaaaacuucccaaagggagaugaaaauuagugagggccuagccaaaauuauuuuaaagcauggaauuagcuuuaauguuguaagucaagcauugaucuucaccaggagaaacuagggaugugcuguuauuuuuaccaacuuuacuaaagaaaacuacccagcaaauauaaaagaaauagagaaaaaaaaauaauguuuaaaauauuuccaccccauuaaaucaaagcaguaacuuggaggaauaaaacguggcaauucucacugcguccgucagauggcaguaucugcacgggaagcaagcgggaacgcugguuuuacuauuagaaacuucauuguggaguguuucauaaccuuguguguccugcccugcuuccuagcagagcugucuauauuccuacaccgugaugccuggagcagauggauugcaaaguaacaaugacguuaucagcaguccaagugguuuucucaggacuuacuuaguguaaucuguccauuuggaacucauccuuuccugacaggacuggucaguguggcacccucaacccuguccuugguacuucugccacacaguugaaauaagagagugcccuuugccucaucaccuccuuuagauggccauuuguucagacauuucuacaaauaggcugaugacuauauuuuccaucuauuucucagcaucuaaacacauuuggaauucucagcagguugcuacucccuggcauagagauuugcaguucuguuugacagcuugagggaaauaaagagaccugcuguuacucaauuaaaugucagcucuguuagguaaccaauuagagagagguuuaauauuggggaaguguccugcuugguuacugcuuaagguuuuguggucuuuuugacuacguucuggauaauucugccagacuccuaagaucucaagcauuugaaaggcaaagcuggcucuuguguguuuagcuguguuauucccuuccagcugugaaucccaccccuagcagcuggagccuggacagugggaaagaagccaagaacaugucggacagugggaaacuuaucucucccccugucccuccaaggcccacacagacugguggguauuugaagcauuugaauaaucacuuucauauaauaaguauauugagcauuucaguuugcuagcaacaucauuugccucuaguuggcuccuccuuucccuguucuucugccauacagucagacaacagucccuucuaauaagccccucggaagaauuugagcaugccaucuucuuccuggcuccauguucaacccuuguugcuugaugggccacuggccucugcccuucgcuugcacugaucucugcuaacucggccgcuuucuauaaucuuccccgaugacaucaauguuucagcugacucgagagccaacccucaguggcuuugaggagccucugacaccuugaguuaucugcugcucucagagcucuguuuccggcagugguguugcucaaagggcuaaagcguggaccugcaucucuuguaacuguggcucacgaagcacauccuaacguacgucuagccucaggucuucugagccaguagauuauguuccugaaaugaggcuggggccagcauuuuaccaggccauuugugggcugcuucugcucacuaacaucugagugcugaaaaugguugggaaacuuccagccuggcccuggguccccagagaaucacagacagaagcagagcuggcuuucaugagcuucuguugggaaaaggccaacuuucccucugaacauacaccacuugcuuggugacuugcaugcggagcaguuuuaagagaagcuugaacugacugccuuuuccaguaaccagaucuugucagcacuuuccuacaucgcuggagcuuuccagguauagccggccuaagaaccaaagaaaaugugguaccauuuccucagcagagugcccuagucugagcacucggugucacuugcuacaucguagcuucucauccuuugaauaguuucugcagggucagaaugagggaugaauuuaauccucuugaucgguauuaguauaucggucugauuguagaaaugagggcccaucagccaaaucauuuguauuucuuugcugauccauguacauucagacagucucguuauuuaaaggcuugguugugcccgugaauaugggaacuugaaagguauuuuuaagggaaaauaagauugauaguucuuacaaaggaauaaauauuaucagugcuagcugggcgucugagacaaaaagaagcuggugggucuauuuuaggcuuauagaaaguacauuuccagaaaaauagcucggagaaagagcacuaggugccaggccugcaccaugucuaagaccaagucaaguacacaggaggccuugaccucagugacaguaguggcagauguggccgauuucucuguacauaugugguuuucuuccuagucagcacucacaacgugugggaacagaaguaggagcuggcuuguguagaugagaccucccaaccccgcagugugauaauggaccacccucuguggucucuuagggcucagcacagcugggcaacccuucuccucccacauagauugguagggcugcugucccuucuguacugauugcuuucauggucuguccugaugucaucaucuguggucaguguuguggggcugugcaacugucugucuuucuuccuuucagccuuucgguagguuuuuaugaguucuagaccucagugugauggcuggaagaguggcaggaaaucacagagggacagagcucacauucgccaaaaucacucuguguggaagugggaaggacggcuuggccucgccccgucgacugggucacaagcuguuuuuaugcuaugcaguuacagucuagaaacaagacgugaucuguaagcacacaaaagagcacaugccacacaugcugggucccuggcaucagaccugaaaaccccagagaagcagaagucacucuugccaugauggugauaucucaaauuccccacccagcggacugagggaaggccuauggacaggcauuagagaagaaaugggaagcuuaucucccuuuguacugauguggacaagcuuucugucugcacugggaauguugggaggugaggugaaagggaaggguuacugaacaucccuauaggccugcucuaggcugccugcagggccuuggucuucccuguucaggccaaagacagaaggugucucccaacgacuccuagcacuuucccccaggagcauuuuaugagaucaagcaguugagugaugaaaggcaucuggacuuggagguuuagaaaggauuugagagccaagcguggcagcacagacacauaaccuaagcacuuaggaggugucaggagacuaaggaauucauggccauccacagccguguauggagcucaagucuagcuuugacuacaugaagccuuaucagcagaaaaagaacggaaaggaaagaaaaaaaggccauuggagcuguuuggggccauacccuucuagucaaagcaucauauguguacagcaguaacuuuuucacuaacuggccaaugucuugauggcaccaucuucuacaaggaaucuauucuagagagccauuguguaguuuguccucuccauuuuccucuucccuugcugagaagauccuuauccacuaauacaucugccugggcuuggacacauagagggcauaugcagccagcccucugguuuuucuuaguuaaaauguucuuucuccaucuacagcuucgccagcaagacacaccacaucagugucccccucgccugcuggacguucuccauugaagguacaggucugucauuagacuggauccaaagaucggcccugguuccuuuuucuuaaaaccuuguccuaagcucaucaaaaggugcuuucauuccuacagacaaggucauauuaagaaggggguugggggcaagaaaacagcgcugcuuuuccccuugcagagauuuacccaagaacacagaucucgugggcuacguuuuguuuucuauuguuuguuuuguuguuuaguaguaggaggaugcgcagcuuaauucuccauauuuuggcaaugagaacauaacaaacuauagucaacacauuuaaagcacauuaaacauacauguguacgccuacauugaaaaacgcccguaaucaaggucuacuaaaugcucuucuggaaguuuuggggcuuuaucaucaaccucauucauuuuggcaaagccaaacccaacuuucucucucaauacuuugcauuaaagauacuccacauuacaaacauauacugaauuauagaggacaugguggcauaaaugggaaaaaaaaaaccacagagaacaagcuagccaccuuaagggucacaugugugacauguaaaugcaggcuauuuaacaucucuaagccuacaaaucccucaggaagaucaagaacaauauucagucagacuggccacaaggcuuuucagcacacuggagaaggguugugagaagcgcagccccgggagcagacaggaggcuggagggaguguugaauggaugguuggcaccggguugacuuagguguccacacccuguguccucuguguagauaacacagugcuagcugagaugaaagacaaauuggucuccacaaacacuucggaacagguugugacccacuguaucugugcugcucaugacugucaccuauggaaacagagaauaccaaaaaggggguggggccucaaaaaaaaaguguggcuagguuuucaucgccagaguuccuguuguaaaauuuugcuggaagugcaaaugauuuucuaguuuugcugucacuccgcagugcggcuuuuauugugaaguccacgugacaguguuugcucuggaagccacugccugucaucauccugaugugaagaaggcaggcagcauggcgcuucuacaucuuugugucuguacacccucaaagcacucacucccacacauugugauggaguuaucgccuguguuucucaauuccauuaugcagaguugaaauacggcaguaaguguuggcgauuaaacucuuacagaagaaaggcagccuuaguggaaaaugcucaagugcuuauuaaauagcucaaguucgcaagcuggucuguacuauccuaaaagggaccugcgugcauuuguacuggcccagaggcaguccuuggauauaacauaucuuuauaaauagggcuugaagaacagagagagggagagaaaggagaaauaucaccagaucacaccuugugcuguaacucccagguuacuuuagagggcacccuacucccaaguuucaagcuucccuguaauuggaaugcacuuugguaucuuaucugauagaauuuggggugugccuaagcacccaaugcauuagaacugacucuuuacggaagacugaacuuaugugucuuauauugaaugugugaugucuuuucugaaaaagaugucagagaaucuggaucucauaauucacuaugcuuaauuauagacuccuauuaaaugaaaggaguugugccuaccagcacuauaucuuuuuaaaugagagguuaggggcuggagaaggaacucggaauaguacuugccuugaaagcacagggccuuaaguccagccacucugaacccuugugaaaaagcagacacacuacccauguagauguggugguguguacugcccagcccaguacugggaauagggaaaggagguaccucagggcucacuggccagcagcuccaagccaccgggaaaccuggucuuagaaaaacaaggucgguagcuccugagggaugauacccaagguugacuucugacuucgacuuguaccugcauacacacacacacacacacauaccacagcggggcagccaucaaguuaaaguuagccuagaguggcuugucuuuagaucaucuccauaagaugugggcucuuucugcagugucuaguuccuuacgaaaugccauaaaucugggcuuuauguggaaauuuuccuauuuucaaaaauuagcaacuaaauugggcuuuuuaaaaacguagcagaugaaacagcucacagcucaggggaaaaaaaaaucuaagugcugucacuuugcagcuuuggcuccaaugucuaggggcucccagaagacucuguugugaggauuccccuacagugggaaguguucccacuggcuccugaagccugucugccuccuaucuggcagucaugacccacggccaagccacaccccugaagcucuuuauccuauuuaagacagggcugaugguagucuccacauccucuugcaguuacucucaggacagguuuuucuagcagguguugaggugaacuuggcaaauggggguggggucuggcagauaagcaucuggggguguauuuucaguacugcagauggcaaugcuuaaauuuaaaucugaucuuugucuuagcuuagacuaccauaagcugccacaggcugggugguauaguugauauacuuucccuccuuccuggaggcuagagguguuagcagauuugaguugucuauaucuccucucuagggcuuacugauggcuaccuguucucaguaggcucacguggucuuuguuggcuuaaggauuccccuauaaauccaaguuugucuucauaaagagccagucagucaagugcggguuuggugaaacauuucuaacaucugucucuuuucucgcaugaccccaacucuggugggagcagggcuccguacaguccuucaccccaucuccaguggaguacaacuccccaggacugaguucaaauuccccagucuuguccggcagcuacagcagugggauuuccucgcuuagccgguguagcacgucggaaaccucgggcuuugaaaaccaagccaaugaacagucagugccugugccggugccggugccggugccggugcccgugcccagcuucagcgggucggaggaaccuguacgcaaggagagcaaaaccccaccccccuacagugucuacgagcggacucugcggcgcccugucccgcuaccucacagccucuccaucccugucaccucugagccaccugcucugccccccaagcccuuggcugcgcgguccagccaccuggagaaugggacccguaggacugagccuggcccuaggcccaggccccugccccguaaggugucucagcuauaagucacuuuucuauguaccugcgaugaauucuuugccguuuacaagauaagucugaugagaagacauuuaguguaggcacuuuaaaucucuuacucagaccuuucuuuaaaugaauggaguuaaauuugcuuauuaauauaauguugcacaauauuaaaaguuacugaucuaaaacgccagauguuacaugaaauauggggcugagucucauuaaaacguuucucauuugaaagugguaaauugugaaaaagacuccuuuuguaccuuuuuauguucaccuuuuuuauguaguuuaaucuuaaaaccaauacgauauugucaagcaauagaaugcgugauaauguuguauaccuuuuauucugaauacuugauacucugagaaagcugaucaugucugggcacauacuaacacaacggccauuucuugagacuucaggaaagaaggugaagaccucagcucuccccuugagcagaauguugagcuccuaucuucagauuuaaaggcuaaagcaggcugguugguuggaguagauacuuaaggguuucaaggauugggaacggaaguuguuuuguucuuuaaacaaaauacuucuuugacaucugacagcugucuccauccuuaacucugcuuugugaacgguugcugaaucuuuaagcauccugacaccaugcuaucuacugcauuacuuuucaaggugcaauuugcuuucggaguuccaaucagcuagauuaagcaagagaccccaggagaaguguuuacuugaauuuugugcuuccuuacuugauaacuuccuacacaaaacgugucacugauaaagagcagguguucaagguuuaaauaggcacaaauuacugugucccauuaacuaggauucgggaaucaauacaggacaguauuaaaucaauagugugaaggaagacaaaaccuuagugaaaauauauuaacaugauugaauggugaaaggacuuugaaaaggugagggcauuaacuuugaauccugcauaaaauaaagaauucuucaaacucucccuucuucccaggagagcugagugucucugcucgcuuguccugugguccuuuuucuggggaagaggauuguggaccauucuagcauggauacagcagcauagcauuagguggagguagaguagacaugauggcacaguuguaggagggugaaaaagcaccuuguauguaguaauguauuuuuuuaaucuuugucuuuuccuuuuacugacuguuuauaacacucaauugacaauagauaugaacuguauuuuaaaccaugcuguuaaauauuuucccucuuuuguugggaagcucaucuuaguuuaguuguguuuguuuuuguugcuagcuuaccuggaaggcagugaccacuuuuuuauauucucuuaaugaaaccauucagcagguauaugcuguugaggcugguuauagagguuuucuauaauaaauguucaaguauuuuuguacauaacugguuaauuuuaauaagagauaccauuauguguaaaaaaaaaaguaaaaagcaaacaguuguggaugcaguaugauuguuauaauuaugccaaauacuuuauguauggaaaauauuuguacauaugugcuuuuaacaauaauucugccauauugacuuuacaauuuugaaugucagaaaauuaauauauguaaaaauauuuauguuuagugaaaguauucauaauugaggaaaggaaccuaugaauuuuagcuuuguaucuugcagguuuugcaguuagaaauuucuugaacuagcgcuugcauuugauaauaacacuuuguguuuguaaucacacccuaaaaaaaaauauauauauauauauauauauauacauacacuuauacauguauguagaaagcuccauguuucuuuugcuuuaaagaaguaaaaucuuucccguaaguaagaugaaaagcauaagauaacaaagccgcuuugauuuccuuuuccuguguaauuuaguagauuucuugacuagugcuugggcacacaauaaaucaguguuauuugcucuugaagccuuuuuuuuuuuucuuuuuuggcacugaauaguugacuuuaucauauaaguguauuucuaaagcagcuccauagcagaacauuuuaagagauucuguuagcucagauguucauguugauugcugcagaaugguaaauauuaaauaaaguuaucagauuaaucuuaauguuucugccuuuauuccagucaucaguguggcuuugcuuagaauagcggcugcacaaaucucuuggucaugagaucuguaaacuucuuugccgaucaauccuauuucuguugcuguuggacccugaacacauuuauaccacagagcacaaagguuggaaaguuaacgguguaagugaccauccuguggagaugauaccauuaccugggcagccgaacacuaaggauuuuaaccagagccaauguagccaaucaagccaucaaaguuugucugcauuacaaagcucgacacaaaacagauaguugccagguugacugcugccuuugccagcugcgacguggucuaucugcaugccagcccuuuguauugccauuuuacaaaaugauaggacauguauuucauaauuuaaaaaauccauugauggaaaaaaugucucuuaacuaaagucugucucuuaauuucaugagauggguuuacauuuguguaagucaaugacaaacugcuguccuauuaaacaccaaaacacacuaacuacagcauuuuggauccuuugugaacauuuuuauuacaacuaagccugcaaguauuucuacucugugcacaauugcaauaugaauagcucagauuccuaccuaaguugguuucugucugguuugugguuguuacacaggagacaacgagaguaacagguuccacugucuuacuugauuucuacacauugcagggugguuaauaucaaaaugugugaauacugaaacaugguccuaauuuuguaagaaaaccaugaguaguuuggguuuuuguuuuuuaaccaaugguugaggucgaggcuggguguucucacauucuuggccucuuacucaaaggguuaaagcaagcacacaaauuugcauaaauagcaaggaaacuuuauuuaaagcaaagacaugauagcaaggcauuaagugaggauauuaagggccuugguuauuguuuggggcugccuuuuauggacuuauagaauaaggguguggugaaagaguucaguuuugauugacacauuaaguuauauaaccauucccuucgcuuaaugcaucuaauuuuaaucauguacacccaguuauacauagguguaggauggugagcaggauucacagaggauagcucacucaccaagcauguaccccaggcccauuguacacugucgagugcucguuucccagacugaugccacaaaggagagagccucacccucuucaguucucagaggagcaagagcacaauuuaauuuacauucugaaguuuugucuaaggccuugauaaaagauuaaauaaagaucacacuuaacaucuuucaggguugguuuagucaaagcugggaguuugccacuagaauaagguggacaagguucccagccugagaacaguguugugggaaaaacuagugaggcagaauuggaaauacucaaagacuagcaucuaaagagaauagcaggugucaaccucagaggugcaucuugagaagugcaggaccacagagagcucuggagguaaaggaagauggggcccggggaggaccguguccuaaggaugucuuucucauguuugaacucaauccucguguccacugugaaccauugugagaauagccuguguguucugauaccaaggaaguacagaguaaaggaaaacggaggaaugugcaagagaaaaacugggcacacuguugguagcguggagaugcccuguucuguccuuugcucuaguguccaacguugcaacagugugauuaggauucugagaugaggaccagaggguaugcuaauccuggcaucugcauguaccagccugucugcccucaccagcuccacuuagcaugcucccagucagaaaguucucacagccccacuggggaaaggauaucugaauaucuauucagaaaucaccucugaccaucccuuuccuuggaaaccaugagcugggaagaguagacuuggcauuugaaccugaacaaaauugcaaaaugagcuuauuccugugugaccuucucugcaagauuucaguggacuucauccuggaauuggcucccacaguucuuucuagacagaagugggaauuuucugcaagcuaacccuaacaugaauuuauguuucaguuggugaacugaacuaaaagacuaagggacaggguggggggaauuauagagguguucugaguucuauaaaucugaagacaauuuagcacuugauaucuuaaacuauuggauugcugagaguuugaugccagccugggcuacauaacaaguuccaggccagccugggguuacacaagauccaaucacaaagacucaaacaacaaaacauuaguaacaagccuuacaaaaaggcaaccaaugugggaaacaaaguuaauauggccuguggccuguagaacuucccaaugaagcuaccaugcuccaucaugagcaaagcauuucagagagucucaaacuuucaauuguugcuuuuuauaaaaagaguuuauaggucuauguguauauaccccacucauacagggucucugugcuugcuuucuuucucucccuuucuccuccuccuccuccuuccucucucuaucucucucugucuuaagcuucuaucuauguguugauacuaaacuucuuccuaaaacucacuuucuauggucugugaaucuuauucuuugaaguuuugagacaagaacuugaaagccacagucccuugauggcuuugauggccuucaacuuucuagagcugugccggcuaguuuguuaucaacuugacacaagcuagaguugucugaaaggaaggaaccucaguugagguucugacuguaggguauuuucuuauuuaaugaucagugggguagggcccaaccuacugugcguggugcuaccccuuggcugaugguccuggguucuauaagaaaguaggcugaguaagccaauaagcagcccuuccauggucucugcaucagcaccugcauccagguuccugugcucacugcuuugaugaugagcuauuaaguggaacuaugagugcuguuggucaugguguuccauuacagcaguaguacccuaaggcaagagcccugguacccgaagaaaagaaagguuucauuauucuuggagucacaugacuauuccucuaucagcaguagccacugacuaccaacaguuugcccuuuuuccucagcucggaagccuauccuaacaucaucaauauaucuuguaucuucuuuuaaagauuaaauauuaauaugauauacugcuccuagggauucucuuuuucugcuaauuuaauaugugggaagaaaauauugcuguuauuuccuaaacuuugaaaaauguuaauaaaucaauuaagucuuuugcagaaucugugcugaggaaauugauggccugauaaaaggaagugacagggaacaugaaaaguaauagccuuaaaacuuaggaugacauuucgagaagguauuuuauuccacaggagagauuucugggaagacccugggaucccucuguucacauugagcccacuagacggcccucagauacugcuccuaaacccaccggacuuugaaacagcgaagcuuaggggaugugguguucaugucuuugacagagucggucuucccugauccuuuaacccugucuugcuuuuguccagcauuccagguucuaaggagaagccccucuuauuaaauagucaacauguccacucuagaucuuuggauccagaaaacccaggaugucugcuggccuuggcccuuacucuuuaguuaaaaugcugcuggagggagagauccacagcugugcucuagacccuaaacuagccccgaauggaccuuccugucucuccuuuccucuccauaaaagcccucuccccugagcuugccucccacccagggacucugugauagaagagcuuucucauuccuuuuccuccuuaggauuuucucucagauccauuggacuauccaaugaagcaguguucugcauuaggcuucuugagaggaaaagagccaauaaaaagaauaggagcaacagcaauaagauguccccaaagcagauaaaggagccagcacagugugaaagccagcaagggagauggcucaagcccuuaagagcacugacugcucuucuagagguccugaguucgauucccagcaacuacauggugacguacaagcaucuguaaugggaucugaugcccucuucuggugugucugaagagagcgacaguguacuuauauccguaaaauaaauauauauuaaaaaaagaaaaagauuugaaguuuaaaaaaacaaaaagaaagaaagaaaaccagcaggcaaaaggcuuacuuuucucugagcugucacagaaagguguggcccacaguuggggguugcagaugucuucccuccuucaauuaaacugaucaagaaaaccucuggcagaaaugcucaacugucaggugauuccaaauccaaguagguugacaacuaagauucacacauuuguuguuuauuacaguagcuaaauguguaagaugacagcagaggauuguagcuagaacacagggagagcugcagucuuugauagcgcucuuggcacuaaaacaggauaaucauuuuaaaacaguuugccaacaugaaucaagcgucauguucguucuuugagcauauaaucucauccugacauuucuuucacuauagcucuuaaaguuguaacagaaaugcaaagacagaaaggccaagggacaggcaagucaacguguuuucuacgagcaggaagucccuuuugaggaauaggagggguggguuuggcagaugcuggcaacaaccacuccuggggacaauuugauaauguacugggguguuugaguaagugaugagguggccagcucuuccggcuuccuuucccucucacugugacacugagaagcucuguaaucaggacaucuggacugaugcuuacaagagaugacuguggaguagagauaaguggucagaaaaagagcuauugggccauacuaucucucugggaccaguaaaaaggauggggagggcaggggaggguaaguagguagggagggaaguaggagaggcuccuggcaggaaagagcagaaacagaaagagugcuuccagcugugggagagaguggcacaugauugagcauaucaguauuucccaucaggagcugauaacaauuuuccugaagugagaaaaauacuguuaauuugggcaaaucuauugucuucaauucaugauaguccuuaacugggagaaacuucccuucucgaaugcucugauuuccuaccaucuuuacuggugcaaaugaaacuuacuugcaacuuccucuaggccuuuccauuauaggcuucaggaaaucucaaaggccggaagacaagcagguagaaauccaacucugaauggagccugguguaggugagagccaggggcccuugccuucugcuacugucggugacauaagguagacucuggaagcacagcuuucaauacuuuuucucuaaagaggcaaacauuucacagcugcaguuuucuguaauggucucuguugcaaagaggaauuucucuggugaggggugagaacuacacuuacuugugaguaaaggaaugaugacuuagauguuguuagaaaugaugcuggucuagugaagugggauuuguagauucuccuuccggcucuaugacgucacuaauccuggggagcuggcuaggccugcgguaccaggcaagaguugugggaccucccacaccuaagcucagggaccuuuguaaaagagagggagcagaaccauuggaagaaccagaggaccagggaauuugcugagaaacuguguugucaaggagcgucagaagcuacauccacauccauucgucuuaucaacaagacugccuaaucagaaccugaacaagaacaacaacgggcaugacagagaggucaggcauccacccugcacagagaacuacaggcaacuaaggaaugaagaguauaccagcugguuauccaacaccaaauagccaauccugaaagcaugcacacaugcagacggagcagguuguacuuacauaucuuaccauuaauauauaauauauaauugaugaaaaagggggccaugaauuugaaagagggcaaagauggauauuugggaggguuuggagagagaagacaagugaagugaugugauuauaccaucaucucaaaagcugaaagaauuuuuuaaaaagaaaaguacuuuuacagaaaugauucauuauuacugcggccuacccuguaccgugggauacaguaacuuuccaucauuuaguaaccuuuaauccacuuuuauuccucucuacccugcuuuguucaacugugauuuuagacuuucuaggcuaaaagccuggaguucaucuuuaacuuugagccuugagugcuugauugcugcagaauucaagucagaaacacucaagcaacccuggugaguugauaaugucugccagacacacguuucuuuucuccaauauucccaucauugguguuuaaagaaaaucccaacauucuucaaaguuacuacuuuaaagguacuacaugucauucaaaaaauguuguucaagucaggugccucaaauauuaggagcauaaugcgaaaggaaauugauagcuugagaaggggcaagguagggguggggugcugagcacaaacagcagguuugaaaugacaggaggggcugaagugaccuuggcuuuguaugagaucucuaacaaugccacuggcugccucagcaaaaugggcacccaaugagcaaugcugaacagagaaacacuacagauuacuaugccaaaagcucaugugacagcagccaauucuccaucgguuccuucaaaggcugaaaggaaagcauuaguggagugaagcauugggcacaauaucuacgaagcacugacuagccuucucaacccagcaauugcauggcuaagaauuuauucuaagaaaguaucuuuauuaaaaaaaaugggcacagauauuuaugcauaaucauugcaacacugauugaaauagaagucgacauccuaacugauuuaauagucaggaauaguuuuaauaagaucuucauacaaugugauaaucaauaguuauuaagauuauuauguaucuguauauuuguaaauauggaacaccuugaaauauguuauuuauaaguuuucauaauuuacauguauaugaauuaaaauuaacuuaauuuaaaauuuaaauuaaauaauuaaaauaaauuuaaaaauaaaaauuaauuaaguaaaauauuuauagcuauucauaaaauagcacauauaaacacaucaucaaaauuauauauagucucagaaauauauauuagaauaugucaaaugacaguauugauuaaaucagacuauaugaauuguagguuggaauucucuccagaguuucaguuuuccuacauuaguuuguguaaagacaaagaauaagugggugaauaaaugauaagaauugaaaagucuuacagaggaugccaugguaaagcugagacagacauugacccuaaagugagauguaaugggaugaugugggccagaaauggcaucacggaugugccaacuuauuaucaaaggcuugaggaacacucagaaaugacaaaaugggcaagagacaccccauuccauugccuaugcaagcaggggccugggaauuaguacucagaagauggccagcagauccuggaguaauaagaugugucugggagacaugagcugguuugugaaggagacgagaccagguucugggggaccgaaucgggaauguucuugagaaggaagacagacguuucuuccuguggaggacucagugcagagcagagacaagcaucucuuagggauauggagggagcuuaaagaggccucuccuguuggcaggaugauuguuuguugagagagaggacagugagcuaggaaagguuuuaggagagcugugaggccugugucaacacaaauguaucagagcucguaauuccuaagcacacacaagacuuccugaacagcgcagagagaccaaagauuaugaauuuguaauggccccaauuaguacaguugugugacuuucuucagcagcauucaguggccaugggaggcagaugaagacggccaucaucuugcuuaaacacuaugacacuccaagagauggaagaacggguaaacgcugaaggcaggaggaguaggaguuggcaggagggauuggggacagggugggcuguggaacagcuucaggugagcaccacauggcagugcuguggagugagcgccugagcuugaaggaggugaaagucagaagucaaaguccagcagguaaacacaauauuugcucuccugucaguucccagagcugccucucaugccuucaacuuggcaauaacauuuuagcucuauuauuauuauuugaaaaaaaagcacacuuuucaccaauaaaauacaccaucaucguauuuauccuacuuuguaaaguaagaaucuagagaaaauuggaaaaaauaaaaaggcuagguacagucucuuggcgugcucucugcccccacugcaaucccaagcuuacuguagcagguuuucuuuugaucccucaguagacuucaccuuagcaaucuugauuugcaaagcuuuuagcucaaacccucuuguacaauagaaaauagcgaaauaaucuaguauuucugucaccagggaacugacagucacugggauaauuggccacggauucaagccacagagagacaaccucgggugccuuuccuccucuguuauuuaucuaguuguuuacuccuuggcucuggacagcaguccacauuuucuucacaacaucccuuuuguucuuucuacacacucuagcaccuucccacagacuaaccagcauuucauuuguaacaggggaaaaacuauugaugucccaucuaaagcugcaaugaagaugaaaaugugucuuuccuagauuuggaaggaaggaaggaaggaaggaaggaaggaaggaaggaaggaaggaaggaaggaaggaaggaaggaaagaagagaaagaagagaaagaaugacaggcaggcaggcaggaaggcaagcaggcuagggcagcuuacuuagucuuaaaaccuugaggauaccauccaguguaaugauucaagaaacagcuggugagccagcccuguaggcuaaaaguagggcacggggcacaucagacacagugagugcugacagccgaccuggccacagaagucucaaaggcuauguuuuuacauuaaaucccauuuauauuucuaccaugaguggugcccaggucauugaugucacauuuggagcuagcuucagagcuaagacauuuuuuuccccauguaacucaugacuaucuguugggaaacccugcuacuuacagucgagguauaccacauucagguagcuccccugagcuccaugcuaaauggauggaggacucaguuuucggcugggcuuccucuucucuccucuauguggggagcccaacccccacacucuaccugaggaaugucaagguaauccuuggcaaaauuccagguucaacauccuagaaagccucuccaugcaaauaaaguaucccuagaaccuuaaaccucagcagugaaauuucacccuaaaaagaaccccuuaccauauucaaagguuucuaccauccuuguucacccacaauaaagagcacacgcuguuucucugacuauugucuaagagaacugucuucuaaaagagcugcaaaacugaaguccuccaaggagaccuccuccuccggcauucaccacugggccaggaucuuacugacccaaccugcuccagacuucaauccauccucuccuacgcguugugcaucuggguccagacaccccaagggacgacccagaacuccacucugcucugucuuucccagcuuggugugcggcagguccuggacaccccaagggaagaagcagaaaaauggaaagacaacuaugagaccuggugcuaaucaacaagacuacagagggagaaaauagccucccauuuuccuugucaauuacagccaggcuacacuccuccaagcugcucagaagacaaugcuagggaaaaaaagcauuguuauuacucugaccuaaggguuucccaguuuccuugacucauuauccucuccuucaaaaauuaccacgagccuauuauauguucauaaauacccuugcagaguucauuuuuagaaauguaagaaagagaaccaacuagcccucaaggauucggugguccuguuaaaaggauacaucucaaagcccaaguaacuagcauuaucauuaaggcaucagaggauuuguggauaacaagugacaguuuucugguaaugagaccagaugaguagaacuggaaccucccaucaaguuaacccugccuuggagcaauugauuagcuguaagaggaaccacagaaauucaaaucuuacaguguugaggccgaccaucgguucacguguccggguucgagccuggaaggcaucuuggaaucuggaagaaaagagggagccuaggcgggucgagaaacaauggaaccaagacaugcuagucuguucaaaguucaaauuuuaaugucggggaaccgccuuauaaaagagcggggggggggggggggguccauuccuuggagccuggaaccagcugcaggugaugaugugcagaauagggcguaguuuccagaauagcucccaggccucucagcagguagcaguaucuugaagaggaacagcugaaguggcacaacaauagaucgaucuagggaggaaggcuccacccuagauaaucuucuuagugagagcgaggacagguucuggcuuagccuguuucggccuauggggggagguuacauuacaggcaucucuaugcuaacaugugguuuacccauguuucaaacucaggaugagaaaguuguaaaugacagccuuugacaacagcaucuaguuucugaugaacucaucaagccuguagcagauugaaguucccacacugguucccacuauuguucugucccacaccucacuucccaccacucuaucguuuagauuauucuggcuuguacauaccaccacaaccccaccaugaccugugcucucaaaacuggcaaggcuuuuccugauuuuuugcuguuugauuuccuccuuccucaaccaaccaggaguugcauuccuuaauaaacucuucuuccuacccacagauguuguacuuggguggugucacugugccuucacuuccaggauccagggacaguggcccaauggagacucaaguggcucucaggcuccugguccagcugaaucugugaaaucuuuucaaggaaaguggagugccagcacuacagcuuggaucagaacuaagcccccagcagguucuuucagugagucuggacagaaacguaaugaaggcuaguuugaacaccuaccacuuacguggaagacuuggucugagacaaagaugcagaagcuuacacauguaaaagaaucaugaggaggcucaaggggagaaagauaagaaggaagaggaggaggaggagaaagaaaaggagggggaaggaaauagcuccaugucacccacugaaggugagaagccaagauucccaggucuuccacauccaagauauacuaaaggcacaaugucugaucaccuggccugucuucuucaagacuccucuuauuuaccuagaaaaugcccuuugucuuuaugucucuguuggggcucaggaaucaccacacaaacuguaugaacacugaucucaguuaagcacugacccguccagcagguccaguuauucgagggucaugaggggaccuucuccuaagaaccaaguggggggacagaaggacggacaucaagugcgaggaacgacacagaaccagucugauuaccaucaaggugucacuguauucagcaaggcucaagguuuaaaugcacaagcaaaaggggaaguacuucucagcaggagggguggggcaguggaaaugcacaagcaaaaggggaaguacaaguacuuaucagcgggagggguggggcagugaaaaauuuucuuuuggcagcuacacggggaagcaggaacuuggugguaucaggguguggucaggacaucuggcgcugauuuagggcuggaacauucugugguuguucucugaacggugugucaguggccugcuuuugacccccuuuucuucucgggggggggggggaggggaggcccaauucagagaucaggacaauagcauugucuuaauagcucccaacaaagcacacacuggucagaccagggacguagcucugaauuaucuaaacuaagacaacagauacuuuuuucugucagcuuauaaagagggaaaaaauccacaaugaguuuauauuuaggaagugcugcccaguggucagcuuugacacaagauauuucagacauuaauaguucauauugaccuuugauuuaauggguccuauguaaagcuuugugggauuucuuaagauuagcaaaucucauacagaacacucagaacauucuaaacaaaacaggguauaugguuagcaugucauugcucagagccaagucauuuauuucucugucaaugacuggcaggcauguuacaguaacaguauuuucauauugguagcugguaggcaugaaacaaaaugacuacagcuguucugggggcagaaggugucagaccauagcagucuccucuucaugauuuucuaucuacuucucagccuauucuucuguuugguugugcaucccugguggacuuugauauauucagaccuuaucuuacuccccuaggguguagaggaauuuuaacugagcaaugugguugcucuggcaaaaaaucauacuccaagauauuuauggauaucuauaucuaugugaucuggcuggacauaccuuuagaacauaccuuuaaucccaaauaaaugaugucuaauugaggggcagaaaaguguugcaucagagaaagauuugacagaaggagucagagauaagauacacccaacucucaggagaacaaacaggaaagaggcugcauagagcagugcagggaauugaguucaguugaguuugaugcaguucaguugaaugccgcugaguuuggauaaguuuguggaguucagagguagauuuuccaaguagaacugugaggagcggguguggcagcagucccaagauggugcccgggacugcagcuaagucuuaugacuugcaccugacuuccucauauaccugaaaauaagccucgaccaucgugagagcugcacaggugcaccaugaugcuggcguuuuaaacaaguccauauuugguggagacaugccccugccgcccugauuggcugaagcugugugccuggugaggugacgugguucaggggagaaagaugaggaaaaagaugaagcggagagagaugaagacugaaguuugcugaauaaacuguuguuagaagaacuggugguuguguuguucuugcuggucgagagcggacaugacauagaacaauucagccaguagccaacuuaaaucagucaacuuggagaagaguuugagccagaacagcugaguugacccagccgucaagaguucagaaagagcuagaaagagugaguuuauuuagcaguaagucauggaggcugaaacauucagggccuagguuagcagauagaggcuggaagcugaggcccucaaggucuaggcuugcagaagcuuagacuguauggaagcuagaaacuuccaggccuaggccuagggagaguuagauuucuaugcucuggaaucagcccaaaccauguauucacacagcuugggaauggcucucaucucaucccucaaucagaggaaauauagugacauucacacuuggcucucaaguacugggauuggaaauguccucauccacaaccugaaggacauuuuaaugauuaaaauuauuaucuaaaaggcaauuaaguuacccuuagugguucuacacacacauaccuaugcacacacaaaguaaucauuuuaaauuuugcaauauuacagccauuuucaccccaaucgacuuaaugaacaaaguuaagucgucuauucuugcacagacucaguaaauauaaaaaucaagaugauaagcccugauaauucuuauagucuugaguguuugauguuugucuuauauguaagugauggacauaaagagauuccuugcucaaagaacaucauuuguauaccauugaaacgauggcuuaauaaugguggaaagagcuggugauguuuuccacaucagcugaccuugacuuagaaagaaauaacuaaacuacuggccuccauuccuaucauucuuucuuggguuuuguuggauuucauuacaaagacuagccucccauuuuagcuagaaauggccauguuacuagacacagaacaguggcaugugauuaugcguaacgucugucaauucugggcucugaaucacagccuuuccccuuacuacagaagugaccucaggaccagagauggaaguuacaugugucauggagcagggccaacuacccaccaugaaaccuuugugcuaucuuguguguacaaagaaggcugccgucagauucagcccacaguaucuaaauggcuuagaacaaucccuagucuaagccauacaugugcacuuucaauuagagaaccagagugcaaguaaauccugcuugcaaagacuuccugguaauuuuugugcugcaaaaauaacauaggcaauuguagggaagaugaaguaaaucaaagcagacacuugucauauucuuacauuuacaugagagacuauuuucaaguauguguguacguguguauuucuauacauuuauggauauaaaagaauauaugaaacccaaaaugcuucucaagauuaaucuuuccaucaaaacucagauuaaucuaauucaucucucccaccauacagaccaaauauaccuguuuaagagugacagcaaaucagauaugcagauuugacuugacauuggaucuuugucaccuaauccaaaagauuuuaccugaaauccuauuaaauuuuaugucuaccuuaugugcagcagauccuuuugaguuuauauuauucagaaucuaguuuuuauuguuguaggagguaugaagguccgugugcucauagauaaacaugaggagaaggaauguuaagcacacaggguuaucccuucaaagggacuaauguacaacguguuucuacccagaagccugggugaggucaugguuaacagcaugaugaccuuuguucugugugguuaagaucacauuagaaauuuaucauguguuggucaaucuauagaacccauuuuuguaaaaaaaaaaaaagguguuauaugugcuuugcaaaaaguuucaauguagucacaccuuaagcuuuauagugcacauggaauugaguuaguuaucaugaggaaagguuucaccaaauugugauguccuuaaauaugccuaaaauaaagagcucagggucagacuuccaaagcuugaaccaacaccagcuauuggguugugcugaaccaaacuaucuucuugccuaccaggaaucauuacuaugcuggccagggagaucacagacacuccucucacacugucaucuggggaagcccccauuguggauaauaugguugagggcugccuuaguuagaguucuauugcugcaccaaaccaccaggaccaaagagcaaguuggggagggaaaggauuacuuccauaucacuguucaucaucaaaggaagucaggauaggaacucaaacaagacagaaagcuggagguaggagcugaugcagagacuaugguagggugcugcuuacugguuaauucuucauggcgugcaugaccugcuuucuucuagagcccaagcuguggauaggaagcaucccacggucaguuaguacuugcaauccuugacugacuacauaaguguuuuguguauaucugauaggauaaauacagguacuuagcaaaugacaagauguagcccacacuauacuaucaugaagugcauacauaauaaaaccauuuucaucucuugcccauagaaauguaaagucaauauuaagacacaaaaaucggucaaggcuagguccccguaguuguuuguauauaaacgcuuguaacaggacugacuaacauggcucucagauccagaaaaucauucugagaaagagguuucugugcaguuuauuuacugagaacaucugaaacaggcugugagugcugaaggagagaaaggcagggagaagcuggacugagaaagcccaguuaaucccacagaaagccuagaguggaugcuuuucuccccagcgguuucgcucuggaugaggggguagguaggucuuuuuaccuugcaaagaacaguggcaguuagcagcagcugguagaaagugaggagaccucauuugguuaaacgcaauuccugagaaucagaaauucagugauauagcugugagccgacuguaccuacacuccugauaaccuacccccuaauccuggaggcgaccugagucagguacagcagcuccacuacucugccugugaugacuuguaucacugccauucugaugccaugcgacuauagcugucaccaaccaucacagcuaaggaaacaugucuaaccucagaauuccuugguagaacguauugacugaucaagagagagagagagagagagagagagcgaagcuucccuuacucccuuucaaggacaaauagaauuguuuacaaauugguuuugaaaaaacguuuucuggucauggagcuauagcaagcuaucagugggcccccaccauuggcuguccugacaggugagguauauauucucugcaggaccaacuguagaccugccuugugggggccuggaaucucaucugugguggaugaauuguucaccccagaaagagaaaugacaacagaugugagcucaaccuguuggcucuauuuaucuaaagaaagccuuuacauauauuguccaguaaagaucagcugucaggaaguccaccuuuaauaaguuuauuuuagcuacugcuuccaaaauccugguucugaucccauaaucucaaugaauuuugaaacugugacucuaauaauugaaccuaguauuacuuucccuagaaugaacuggugacugacagcuaagaaaagcauggguuauaucucuacucuagaggcagacacgaccuucuauagggugcaguucucaguuuuguuuuuuggguaguuuguuauuugguuggugucuuaguguuucucucuguggagagaccccaugacuauggcaacuauuauaaaggaaacauuuaauugaggcuggcuuacaguucagagguucaggacauaaucgucaucgugagaagcaugauggcacgcaggcaaacguggugcuagagagguagcugagaguucuacaucuggauccacagguggcaggaacaaaaggagccaugcuaggccagacuucagcuucugaguccuccaaguccaccccaaugacacacuuccuccaacaaguccacgccucccaauaaugccagucccuauguuaauuucacacaucagagaggaaggagccucaauugagaaaaugccacugucagauccagcugcaagacauuuucuuaaauagugcucaguaagggagggucuacuccauuguggguggugccaucccucagcuagugguccuggauuuaccacaagaaacagguugaaccagccauuggggaacaagacaguaagcagcacuccuccaaaacaucugcaucagcuccugccuccagguuccugccccgcuugaguuccugucuggacuuuuuuugguuaugcauagcaaugcggaaguguaagcugaauaaauccuuuccuccccaacuugccuuuuggucaugauguuuuguugcagcaauagaaacucuaacugaggcaaguagauaucaguggaguauuuaugugacagaucugaccaagaauugucaaaagacuuuggaacuuugggcuagaaaagccacugcauguugcgaccucagugagauguuccuuaggagguuggaaggaugucgagagaagugcagaagauggaggccugacuuguagaaguuucagagagaaauuuaaagacucaagccauuugauguuuucaauuaaaaguccaucauucuggucagcugaggcugaaagagucagcugugguuaacaagagaccauccagcaccacuggcugaagugaagcuuuugcguuacuggaacaacuaacugaugugaguuaagaaauuaugagugauuaagaagagacuagcuuuacugaggugaaaucuggaaacuguuuccugagagaggcagcccugguuguaucuucuguuacaucuggacuuaguaauguaaaagagucacgcaggugguacugguuuugaaggcaugaaggggucauaaagagcagcugagggcuggcauuaugagagccaugaaaggccaucaaugaaguuacugccucaauagcaggugaaggcccaggauugaagggaucaugcagagaaguguugaggcuugguaccaggaagagagccuaugagaggcuacuggucaaaguguacuccaguuguagcagaagacucaugugggguuuuuuuggagauaucaguaccauggaaugagcacuuagaacagcaguaguaauggaguggagccagucagagccuagaagacaaacugggugcuacacagggcagggcuggaaaagugacccaagcccuuuggaggaguccggaagaucauaagugguugaaccagacauugaaugguuggaauuugguuuugaucugauuugauugugaccaugccccgauuuuacccuccugaaguaaaaaaguauuuuacccgagcccacaacugagagagaaacuucgaauuuuaaaagacuauagauuuuaaaagagauuggauauuuucaaggaacuuaaauuuuaauguguuugaauuuguaaagaccaugggacuuuuaauuuuauuuauguuuuagugugagaucuuggagaggaauaagaaaggauggguuguggguuaauaguaauguguuuguguuucaaguugauaaggggucaguuguauugccugguuuaugucaacuugacacaaacuagagucaucuuguuccuguccugacauccugccucuauuaaauugguguguggggcuuuuauuuguuuuuuuuguuuguuuuauuguuguuuuguuuuguguuuugauuaaugacugauauaggaagggucagcccacuaugggugaugugaccuccaguuaggugauccaguguguauaaggaaauaaauugagcaagucagaagaagaaugccaagcauuguuccuccaugguuccugguccuguuccugccuccagguuccugcccugacuucccuggacuauuaccugaaaguauaagaugaagcaaaccuucuccuccccagguuguuuuugguccugggguuuuaucgaaucaguagaaacgcacacuaagacaggagauagggucagguaucuuggguaagcagaaccugcguaugacaugugcauuuucaguauagcaaaagacugaugaaaacaaaugagucuagaguucaaauuugcucucugagaccaaauuuguuuuggaguguucuguugaccuguacuugagggaucuucuuuuuaaauaucugcuugccugcauccagggaaugcaauuagugacucgccaggagacaagccugauuccugcucacugcuuggaagagucaaggaggccgagucagcauuuucauuugggacagguuagaaacaccagcaaacuacaggucauuuuuuuuuuaaagacacuguauaauugcugaaacucuuugacuuagcuucucuaccuuuccauaugacccauauaugccuuuaaaguagagcaaaaccagacuacauguguucaucuugccaaugcuaugggcuagacauuguuauguaccaucucugggagcuuuuaaugcauagcaauacauuguagcacaauugcaggagacaaugugagcuuuuucagaagcaugagcaucaauguuccuuaaaugucaauuaagcaccagaggcaaagggaagagaugaauacauucuaucauugaaguuauaccaaugcauuacauuucuuuacaccuauccagaauuuuuagauaugaaggaauuaagaagaauuuagaaagggagauguuuaaaaacccauacccgguucuaagguagucagaauucccuuugaagucaagaaagccuuuuacuuacauaagaagcaaaggguuuaguucccaagaaagaugauaugaaauuauguuaguugaaacuagcucucagaagcagagagcagcugggccuguaauuggcuuugucauauaaaaucaacuuagaccuuggagcucuuaagauuauauuuucucaugaagccaauuucucugccuugggaccacuuugaacucuauugggaugguguagauauucccagugaaggcuugccugaaaaaaggcagcuguuuaaguaaaacaucaaaguuuaccuaagaaaggacuucaaagauguaacaugcuaaacaauucuuguugguuuuaaaacuuuuuuuuugucgauguaggagcaaauuugaaaugcuucaguaaguucuuggcuaaguaaucacacauuaauauuauaacccaagaacugaaucuuuaggcucuuuucauuucucuuccuuccuuucucucuuuucuuucuuuuuuauaucuuacagugagaaugauuaggagacaaggguaaugcucauggaucucauauuacucaguuuuaaaacucacaaugucgacuagaacauugucaagccacaaacuucaauuccacaagcuucagguugccccacuaagacccugcaaugagaaaugcaugcaacaguucaaccuuuuuguucuuuauaauuguaauaaaucuaacaccuauuuaacagcuacucugcgacaaguaccaggauaaaccuuuugacugcuuagucugcuuaguauggucuugagguaagauuugcuaugguuccugauuuagcuuuuuaucacaaaauaccaaggcaauuaacuuacaaagaggaaaggguuauuuuuggcccacagugauggagcuuuugggccagcauccggucaucucauugcuguaguccuccaucacagcaugaccucaggcaacaggaagcacuuccaucacaauccaugaagcaaagagagaucgacucagggaguauggaaccagaguccccuuaauggugcauccccagggaccauaggauuuucuacccucuucacccacgcucuucuccaguucccacacccaagcagcaagguuauaauguauagacuuuugagggagauuguauuuaaaccauaucugucuguccuguuuuacaaagaaguggggcaugacaaaucucuuaggauuugguccuggcagccuagcuccaggggccuccuugcugcaacacugaacucacauaacacacucaaaacucacagugcuacaagcguguuucugcauuaaccacaacaguaaaagcaaaacuuuuaaugacagguaaacugugcaggaaaugugaccuacgcagaaggcaagcaucugugcaaacauccccauggcuucaauguugugagcagacagagcccucaggaagagucuuuacacaugcugaggggguacuguguugaguuuaguuuagcuuuaaaauuuuuauugccuuacuguuaugugguauucuuggagauacugccauucugaaaguguccccacccacucccccuuuucucuucauggcacugaaagaaguaguagaaauuaucagggaaacuccuaagaaauauaccucauuucuaacaauggugauacaaaaacaguuguaaaugggcacuuaaacauggagaacugccuuggagaugauaaagcccuggggacagacaguagugguggcugcauagugauguuaaugugccacuuagcuugguuaacacgaauauagaacauacugauacgauuaaugcauacauaauaguauaugcuuaaacugccuaggaaaaugucacuuauuuuuaucacauuaagaauuacacauaaggggggcuggcgagauggcucaguggguaagagcacccgacugcucuuccgaagguccagaguucaaaucccagcaaccacaugguggcucacaaccauccccaacaagaucugacucccucuucuagagugucugaagacagcuaaaguguacuuacauauaaucaauaaauaaaucuuuaaaaaaaaaaagaauuacacauaagagcaaagaauuacaaaacucuccugugcccugcagauaugucuauaaucuauauuuuaauuuauucaaguuuuaauugagugagagagagagagagagagagagucacauuauaacucuggcuggccuggaacucacuguguagaccacaguggcauugaacucauagagaucugccugguugugacucucaagggaugggauuugagaugugggccaucugccuggcuucuuuuuuuuccccaguauuuccaauagauugaaggccuaccagccaacacaugggcuuccauuuucaauuaugaguuaguguacuuuguguaagcagagcuacaacuccuaaggagcagagcaaggacugugucuaacucagcugaauuaacauuuucuaggucaucacuguuuaucuauagaauaacgaguaaauaagaugugacuuauaagcgcacuguuggccaaucuugucauuacuacagcugaaaaagcaaaacaauugugcagaugcaaucaauggcuugucagcugguggcugaugugacugagagucuggaaggauagcguaagcguauuuggccguacuuaagacacagcugauuuuacccuuuacaaaaggaaaaaaaaaacauuuaaaaaaaaauaggccauuuuguuguauuaaggcucgguuagcgaccaagucaggcugcauaucuauauuacccagugugcuggcuaguugguugagaaaugugagccucaauugagaaaaugccuccauuagauaagguugagggcaagccugaaggccauuuggauaauugauugcugugagaggguccagcccauuguggauggugccuucacugggcuagugguccuggguucuauaagaaaguaggcugagcaagccaguaggcagcaccucaucaugaccucugcuucugaaagaccccugaagaggugagacccucacucgagucucgggaugacucagcaccccaagaacucaugagauacuguccuugcugcaaucgcacaagguuuauugacaagauccagcaggcuggggucaacucguaucccaugcagggguggaagaguucagccccaguagcugggaaaggggguauuuaaaagggaaaaaaacaaacaaacaaaccacaauccaaggggguagggagggcguuauuggaaaaugccgaaaauaccagugaaaaaucacaaagggguacuaaaaaucacaaggggaaacucccugcuucucaagauuguucucaggauuuuagucuaacuuuuguggucggccaguuccuggaacagggucacugaaccagcuaaccuauauucuuggugcuagggggucugaauuuuuucuggucuuucacuucuucuucugacucucuaggucucugcucugaguucuuguccugacuuuuuucaguaaugaacagugauguggaagcguaagccaaauaaacccuuuccuccuccccagcuugcuuuugggcacggugcuuucuuacagcaauagaaauccucacuaagacucccagaaacuagaccaaccuacaaagguaaggcagguuaauagaggagaccaaaguaauuguagagcaagacggaaaccaggugucccaagggacucuagcaauaggugccugcaaucgcuggcucacucaacuauagcuacaauuuauauuuuucagggucugcagaauucuuuaaaauauuaucuuuuacaaauauaauuuucagcuuaaaaaaaacaaaaccaaaaacaaaacaaaacaaaacaaccaagggcugguguggagcagugagcugugcacagacaccuggucccugguugaacacaggccuugaacugugguaacccuaaggaauggcagauguuuggccaugucuccugggccccugucacaacugcagccuuccaaggucuccucccugcccugugcgccgcaccccccccccccaaguguaugaccaucagucauggaggcaauggcccaagcuccugauauucugucuggauuccacccccacaguuaccuggaaacagccagauaggccaggcccacuauaaaagggucuguuugccuccucccccuucucuccccucucuuacccucuugcucuuacucucaccucuugcccucccuucuccccucaucuggccucuacaucucuacucucucccucucugccuuucuacaauaaacuccuuaaaaccauggacugccucuucuucucauccacccaccaugcugaagcaauggagcaggucuucccuuagugagccuugugucuaaccuccugccccugugucuaaccuccugcccggagaccucucugcauuuccagccacagcuuccuccaacccaaacaaaggacucuugucaucgcaggaaucugcuagagcuccuucccuguucuuuuccauucagcccugggccagaguccaccugccagccccacacucaguucucagcucuucuguggcauacaguaggccagacucgggacccuacuuuuuaucccacaggccggagagauggcucagcggauaagagcacuaacugcucuaccaaaaguccugagugcaaaucccagcaaccacacaguggcucacaaccaucuguaaugagauaggaugcccucuucuggugugucugaaaauagcugcaguguauuuauaauaaauaaauaaauaaauuaauuaauuaauuuuaaaaauaaguaaauaauaacuuaaaaaaaacaaaacuauugagauuuagaaaggagagagacaauaauucaacuaacauuaaugccaugucucugagcugugugcuccaugcaccacuguauuuagcccuuuuucaaugcuuugaauuaaauauuuguuugacagcauuaagggucuuugccaaauccauuuacugcuccauuccuccaaggucuaucuacauaaacccuacuucacauuucaaccauuagccccugaccaagcagagugggcauggacugcugaucuaaucucagccuaucaagacuuuucacccaugagccuggcacuacaagugaaguuuuguuuguuuuaaagaaagaggcagcugagaaaagaaugagcccacaggcuccuuaagaauguacgaagagcugguugugcuugugcacagccguagagugugcugaagaagcaaaggcaaaaagaucauucguuggaggccagcccgaacuacacauuuuuuacuuuguuuuguuuuguuuuguuuuguuuuggagacaggguuucucuguguagcccuggcuguccuggaacucacucuguuaaccaggcuggccucaaacucagaaauuugccugccuuugcuucccaagugcugggauuaaaggugugcaccaccauggcccggcuuuacuuucuuuuauauauauuauacuuuaaucuuuuuuuuuuuuuuuacaguccaguuguuauccuccucccagucuguccucugacugaucuccaucucauaccuacucccccaucuccaagaggauguucccaccaccaccccagcccccacccuaccagaucuccccgcucccuggggucucaagucucuuaaggauugggugcauuuuuuucucacugagaccagaucaggcucugcuguauacgcguuuggggccucauaucagcuggcauaugcugccugguugguggcucagugucuaagagaucucagggauccaggcuaguugagacugcuggucccuaauuuaaccacaagugguuccuggcuucuguccauugguuggguguaaguaucugcaucugucucuuuaagcugcuuguugggccucucagagagcagccaugcuaugauccugucuauaagcacaccauaacaucaguaauagugucaggccuuggagccuucccuugagcuggaauccaauuagggccuguuacuggaccuccuuuccccagcguaagcuggagagauggcucaguauauuucugaaagaaagaugaaauuucaagaccuguaagucauauaaaguacucagaaauugcugguuaugagccuagaggcugcuuggggcugagaacaaagaaaaacaaacccgggcaugucccgucguuaaagcauuccugggaacagcuugaccauaaagacaaagaggaaugugaggacauaacagggcuaucugagcuaagucaacaaccaucuggcccggcaccucccucugcccauugcccuuugacacaguuuaaaccagauacucugcuagcauugauaaacauccaacucacagaacccugacacccugaccuacacguauucuuuugcugacauguaauuuuucugcugauguuugaauaagccaauagugugucguuaugcugaauuccccaccccuaagcccucuaccccauaaaaaccccuagcuuucgagccuuggggucgaauccacugucuccugugugagauacguuucaacccggagcuccgccauuaaacugccucguguguuugcagcaagaaggauucucauguuucuuugggugugcucucucucccaagacuagaguggggguccccgaaagggggucuuacagcucuugcagaggacuccugguugaucugaaaacaaucuguccaguuccaggggaugcaauaugcuauauugaccuccacaggccccagguaggcaagguaugugguacacugacauauuuugagcaaaacacucauguauaaacuaaaucuaaaagaaaaauuuaaaggcuuuggagacaguuccuuucauaaaguguuuauuguacaagcguaagcacccaaguuuagaaccucaacaccuagauaaaaggcugggccccauggcacaccuacgaucccaguagagacagaaggauuugcuggcccacuagucuagccaaucaguaagcucuagguuuaccaagagacccuaacucaaguaguaauguggaaucaggcagugauggugcacaccuuuaauccuagcccucaguuggacagaggcagguggauagcugaguuuaaggccaaagagaaacccugucucaccccuaauaauaauaauaguaauaacaauaauaguaauaauaauaauuaugaaguagagaugccauauagauagucaacagggaaaggugcuuauugccaaggcucaacccaaauucaguaacugguaucuguaugauagaaggagaaaacugacucuaagagccacucucacaggcucacuuugacaagugugcacaauucccccaacccaaucaaugaauaauuuaaaaaaaaaaaaaaaggaugaagagccauuuaggaagauaccugaaguucuccagcauccucauguuccacguauucauacacaugaagaacauaaaaagaucauacaaaaauacaaaaaauuuucagaaacaaagaggugaaaagcaguugcaagcaacugauugcuuuccuagcacugacugugcuuacagcccuuaauuuuguaaaauagcugggugaacgguaagauaaauucccuuguuuuguuucuguuacagguacgugguaguuugaauguaauuggcccccauggacacuauuaggaggcgugaccuugguggaguggguguggcauucuugcuaccuuagcccucccacucuagagacagcucuucacguguuugagaagagucucaccugauguaccucagacuaaacacuucauuuaacauccuacaggcaaggacucacuacugaaacaggguccagcugccauucuccgucacagugugcucaccggcauaacagagcaugcuagagaaagaguagcacuugcagggaucugaagucgagacuuucuuacaauauccuagucauuuuuuguuuaaagcuauuguuuaaauugcacccauuuaguguguguguaugcacaaguggguacacaugccuuaacauucauggagagaucaaaagacaacugucagggauaugucuccuuccacaacaugggacccagagagugaucuaaccugggcagcaagcgccuuuaccuauggagucaucucacuggccucuauuacccuuucuucaaaagcggauuuuauugacucuuuguuuuuauuaugcuaaaacaacaugaaaucuauccugucaaaaacuucaauauguacaguauagcauuaacaauaaacacaauaggcagaaagcagccgugacucaacagaaguaauuccuucuugugccccagaacccaugggugaaacuacuaaaguuccccugggaucaaguagaauuuuauaagaacauaaucgaccgaaaggaaaaaaaccuacgguggcugugaaggcccugaugccugguaugucaaguuaauauaauaucuucugauggucaugaauuuauuguacagagaacauguuauaacaucaagaacaauaacggccauguugaguggcccaggucaguuugcagagaaugaaaccccaaugaagucaauuuuagagcaaucccuccacacgugcuauggaaagugugcauguauuuuaccuacaaaguccgccacccucacagcuccacugagauuccucaacuccaaaucgcaccugaaacugcacuggaauggcuaauggccgcgaacuuucuaaauuguuaaguaaaauaaaugacaauaaacauuuuuuucaguauuaaaaaaaaacaguaagcacaaugcuguuccacacauaccuagaaauuaaucucucauggcugaaauucucugcaucgccccuuuccagcugcucuguuuucuguuuaguaauuuuacuucaguuaccucauauaaaugagucaugugcugucauauguauauauggugaaauauugcuaagcuauagaaagaaaggaacuucugucauacauuacaaaauaggugaaacuugaagagauuauggcuaacaaauaauccagccacugcaacgacaaauaacacaaauucugacuuuuuaaaauuaugagcuauauccuccauguacaagugucuuugucaggauuucuauuccugcacagagcaucaugaccaggaagcaaguuggggaggaaagaguuacucaccuuacucuuccacauugcugcucagcaccaaaggaagucaggccuggaacucaccaagggcaggaaccuggaggcaggagcugauacagacaccauggaggggugcugcuuacuggauugcuccuccuggcauguucaguuugcuuucuuauagaacccaggacuaccagcccagag

SEQ ID NO: 6640 - RNA, 8060 nt, Mus musculus
uggucgaauccacugucuccuguugugugagauacguuuugacccggagcuccgccauuaaaaaaccucuuguuguuacaucaagguguuguguucuauucgugauucuugggugcacaccgaaucgggagcugaguggggguuuccccacugaguucuuucauuuggaggucccaccgagaucugcgugacacccaggaaccccgaaggaccccuuggaggugcguuuguuugugugagucuuguuauguugucuguugucuaagugucuaaguguggcacugcugaauuugugucuuagcuuuucaguucugagauuguggguuugagccccaccuguguuaccaguucugguauucuguauucuggcagcugccacugaggaccguaaggacccuaguggcuguggggagacgacggucuauuuccccacaggcugcacccuuggaagacauuccgagggagacccuggagugcccgggguauggaacagucaggaggaccuggcuguugucuggcagagugaagaagagugagugcucuuccugccagaggaguggagcggaaucccacuccaucagagguagcauuuggcugguuguguaaguccagacgcagacgagugugcuuggaugucuuaguguuuuccgucucugucauuguguuguguuuacucuuauucuucacuaugggacagacugugucuacuccuuuaucuuugacuaaggaccauuggacggacguuggggcuagaggacaaaauuugucaguaaaagugaagaaaaagccauggaugacuuucuguuccucagaauggccuguuuuuggaguagguuggccagcagaaggaacuuuuuacuuacccaccauaagggcugugaaggccauuguuuuucaggaagggccagggucgcauccagaccaacaaccguacaucaugauaugggaggacuuggcacgcuacccacccccguggguucgcccauuccucccgccucuccgcccuggcaccaagauucuagccauccgagaaaauggugagaaagagaaaccgaaaccaccgcucgggagagaugaugaucucagcacaccagugaggaaaccccccaagaucuauccagagauugaagaacccccugaguggcccgacaccccucaaccuccacaguaugcuccccagccccaaccuucagcucccucgggaccccugccucaggccccggccggaggagggggucccuccacaggaacaaggagccggcgaggagucaccccugaggggccugcggauucaaccguggcgcucccccucagggcuauuggggcucccccugccgauccaaauagucuacauccccuacaauauuggccuuuuuccucuucugaccuuuauaacuggaaagcuaaucaccccccuuuuucagaaaacccugcaggacucacuggguugguugaaucauuaauguauucacaccagccgaccugggaugacugccagcagcuucugcagacucuauucacaaccgaggagagagagaggauucuccucgaggcucggaaaaacguccgagacgaggcugggcgcccuguccaaacuccagcugagauagaugaaggauuuccgcuaacccagccccgaugggauuauaauacggcaucagguagggaacgacuguccaauuaucgccggguccuaguggcgggucucagaggugcugcccggcagcccacgaaucuggccaagguaagagagguuaugcagggagcgacugagccccccucagucuuccuugaaaggcucauggaggcuuauaggagauauaccccauucgaccccacaucugagggucaaagggccucaguaauuauggccuucauuggccagucagcuccugacauuaggaagaaguuacagcgaauugagggcuugcaggauuacaccauaagggauguaguuagagaggcagagaaaguguaucauaggagagaaacagaagaugaaaaguaagagagagagaaaagagagaaaagagaagaggaggauaggagagacaggaggcaagaaaagguuuugacuaggauccuggccgcaguaggagaaagagauaagggaagaagagguagacagucagggaaccugggagacaaaaggcagcagggaccaaggagacccagagaaggugggcagcgccuggagaggaaccaaugcgaguauugcaaggaaaugggccacuggaagagcgacuguccgaaaaaaaacaagagguaaaggugcuuucucuuggagaagaugaagacuagggggaacggggcucggcuccccucccugagccuaggguaacuuuagaaguggaggggaaccccuguggacuuucuaguugacaugggagcugaauuuucaguacucaaaacaccuuuaggaaaaguaaagaaaaaugaaaaaaccuuggugaucggggccacgggacaaaaauuguauccauggaccacauuccgaguaguagacauagggcgaaaucgaguaacucauucguuucuagucauuccagaguguccuaugccuuuauuggggagagaauuacuaaccaaguuaaaagcacaaauaacuuucaccucucaucgaccggagguuuucuggggaauaaaagcgccccagacucuagagcugucuuuacaacuaggggaggaauaucgacuuuaccaaaauaaaguaaaacccccugagggauuacaggacugguugaaucgauacccucaggcgugggcagagacgggaggaguggggauggcaaaacugguccccacuguggugauugaacuuaaguccggggccaccccuauagggguccgacaauaucccaugagcagagaagcucaagaggguauacgcccccaaaucaacaaacugcuccaacaagggauuuuggucccaugcaaauccccuuggaacacuccucuacuuccaguaaaaaaaccagggaccagggacuaccguccaguacaggaccuuagagaagucaacaagagaguucaggaaauacaccccauggugccaaauccuuauaaccuccucagcaccuugccaccuggucggacaugguacacaguccuggaucucaaagacgcuuuuuucuguuugagguuacaccccaacagccagcccuuguucgcuuucgaauggcgagacuccgagaguggacaagccggacagcucacauggacgaggcugccucagggauucaagaacucgcccacuuuguucgaugaagcccuacaccgagaucuugcucuuuuccgagccaauaacccacaggugacucuucugcaauauguagaugaccugcuccuagcugcagaaacacgcgaggacugugaaauugggacccaaaaccuccugggcgaguuagguaagcugggguaucgggccucugcuaaaaaggcucaguuaugccagauagaagugaccuaccuaggauaugucuugagagauggacaacgguggcucacagaagccagaaaacaagcuguuaugcagaucccgaccccaaccacugcucgccagguaagagaguuccuggggaccgccggguuuuacagacucuggauucccggauuugccacacuggcagcucccuuguauccacuaaccaaagagaaaggggaauucaccuggaccagagaacaucagcuagccuuugaaacucucaaaaaggcacugcugcaggcuccggcauuggcccugccagauuuaaacaaaccuuucacccuauacauugaugaaagaaauggaguggcaaggggaguccuuacccagguuuugggaccauggaagcgcccgguagccuacuuaucaaagaaacuggacgcuguggccaguggauggcccuccugccugcgagcgauagcagccacggcugugcuaguaaaagaugcugacaaacugacuaugggccagaauguuacuauaguggccccacacucucuugagagcaucaucaggcaaccaccggaccgcuggaugaccaacgcccgaaugacgcacuaccagagccuauugcugacagagcgaguaaguuuugcacccccagccauucucaaccccgccuccuuacuaccugaggcugacgaggccccugcacauaagugugaaaaaauacuggcagaagagacuggaauccggccagaccucacagaccaaccuuggccaggggcgaugacuugguucacggacggaagcagcuuugugguagaagguaagcggaaggcugggguggcaguaguggauggaaaggcugucauaugggccagcagucugccggaggguacaucagcucaaaaagcggaacuaaucgcauuaauucaagccuuaaggcuggcagaaggaagggcucuuaaugucuauaccgacagccgguaugcuuuugccacggcucauguucacagagcaauauaccgacaccguggacugcugacgucugccggcaaagauaucaaaaauaaagaagaaauucucagcuuauuagaagcuguucauuugccccguaggguggcaauuauccauugcccaggacaccagaagggaacugggcccauugaaaagggaaaucaaauggcagaccaagaagcuaaaaaagcagcccaagggccaaugacucugguggugagaacccaacagcccgcugcugaggaaauaaauaaaagaacccucacagaagaagaggggcgagauuacuuagcuaacauacaccaucugacucauuuaggaacuaaaaaauuacuaaaauugguuaguaagucccccuauuacauuccuggauuaaaaggaauuguggaagagauaguaaaaaacugccaugcuugugcacuuaccaacgcugggucuagcaggcuccaggaaggaaaacgacugcgaggagacagaccuggagccuacugggaaacugacuucacugaggugaaaccggcuagguauggaaauaaauaucuccuaguuuuuauagacaccuuuucaggaugggucgaagcguuccccaccaagaaagaaacggcuaauguaguggucaagaagauacuugaagaaauccuuccccgcuuugggauaccuaagguaauggggucagacaacggaccugccuucgucucccagguaagucagggauuggccagacaacuggggacaaauuagaaauuacauugugcauacagaccccagaguucaggacagguagaaaggaugaacagaacgcuaaaggagacucugacuaaaauagccuuagaauccggcggaagugauuggacagccguucucccuuaugccuuguucaggguucggaauacaccuggaccccuuggccuaacuccauuugaauuaauguauggggcgcccccacccauuuuuaugaccguaggggauaagaaucgccccgaugugucuuucucuccuucuucuagucuuuuggcucgauuaaaagcucucgaaauaguaagaaaagaggucugggaacagcuaaaagaaaccuauguugcuggugacacacaggugccgcaucaguuugaaguaggagacgcaguccuggugaggagacaccgagcgggaaaccuagaaccgagguggaagggacccuacuuggugcuacugacaacgcccaccgcggucaaaguggaaggaauccccacuuggguccacgcaucccacgucaagagagcacccccuggagucagccaugaugaguggacuuuggagaagacuacuaauccuuuuaaguugcgccugcuucguaggagcgaacccaaaagacuucaacccccacaguccuguucaacaaacgugggagguacucaaugagguggguagagcuguauggacaaucgccgagguacacccucuguggacuuggugaucuuuucccugacaucuguaaguuggcuauaggagccccuccuggaugggacuuggagggguacucugacauucagagggcaccuuuaacacccccuccguauguagaaaaacauucgagagacccauggggugguugcucuaaccaaagggauagaaguaugcuucgaacccaucccuucuaugucugccccgggccccaccgaagucagucccucaauccaacguguggagguaaggcuaacuucuuuuguaagagcugggguugcgagacuucagguacagcccgcuggaagcccuccucgagcugggacuauauuagaguaacagccaacuauucccuagcgucuuauguaccuggaggauuugaccuagacgaguguacugacuggugccauccgcuccgugucaccuucacugaaccagggaagagagcucugggauggacaaaaggguauaccuggggucuuaggauuuacaaggaaagauaugaugagggauuauuguucacuaucagauuaaaaauagagacccccuacaauccuuuaggccccccaaccaaguucacaccccucacccauacaauuacucagccuacuccagugauugcggacccccuuaauauggccgcuaucacccaaccucccacuccucaguuaccucuaacuauuacccccgcgauuccuucaagacagaggauguuuaaccuagugagaggagccuuuuaugcccuuaacagaacugauccaagcgcuacugaggacugcuggcuaugccuguccucggguccgccuuauuaugaaggaaucgccuucaauggagauuucaacagaaccagcagccauacuuccugcucuugggguacaggacaaaaacugacccugacugaaguauccgcaaggaauccaggucucuguauagguaccccaccuuccacucacaaacaccuaugcggacaaauucaguccguguccagaacggaagcuaauuacuaucuuguaccuuccccgguuggauggugggcuugcaauacaggacuuacucccuguguaucaacuaagguuuuuaauucaucucaugauuuuugugucaugauccagcuguuaccccgcguauauuaucacccugcauccaguuuagaagaaagcuaugcuggccggcggucaaaaagagaaccaauuacuuuaacccuggcugcauucaugggaauagguauggcaguaggaguggggacgggagugucagcuuugauagaaggaagacagggaauucagucuuugagggaugcugucaaugaagaccuagcggcaauaaagaaguccauugacgcuuuagagaaaucuuugacaucccugucugagguaguuuuacagaacaggagaggucuugauuuguuguuccuaaaggaaggaggacugugugcugcccuuaaagaagagugcugcuucuaugcagaucauacaggaauaguuagagacucuaugcagaaacugagagaaagaauagagcgaaggaaacgggaacgggaugcucaacgggggugguuugagucgugguuugaaucacgaccaucuuggauaacuucuuuaauuuccgcuguagccggaccaauccuuaugauaugcuuagcuuuaguuuucggcccuuguauaauaaauagaggaauggcuuucauccagaguaaaauugauacaguaaaacucaugguucuucaaaggcaauaucaaccuauaguucagguagaugaagaguuaggggacaccaaucucuaaaauucuaugauuagaauuagucuaaacagaagaagaggggaaugaaaggaaauaaaacuguaauucauguaauguauguuaaauagcccaaagaguuguuucugagcuuugaaaccuggggcugaaaacagcagaacagaccaggacaugcccgggcaagcccaucgccucccuagcucccaccccucugaccuaaguuaaauguuacaggcugcugauguuuaaauggaccaaucaugugaaaccgcgccaauuccucccccagccccacuccuuuucuauaaaaaccccuagcuuccaagccucguggucgaauccacugucuccuguugugugagauacguuucgacccggagcuccgccauuaaaaaaccucuuguuguuacauc

SEQ ID NO: 6641 - RNA, 8063 nt, Mus musculus
gucgaauccacugucuccuguugugggagauacguuucgacccggagcuccgccauuaaaaaaccucuuguuguuacaucaagguguuguguucuauucgcgauucuugggugcacgccgaaucgggagcugaguggggguuuccccacugaguucuuucauuuggaggccccagcgagaucugcgugacacccaggaaccccgaaggaccccuuggaggugcguuuguuugugugagucuuguuauguugucuguugucuaagugucuaaguguggcacugcugaauuugugucuuaguuuuucaguucugagauuguggguuugagccccaccuguguuaccaguucugguauucuguauucuggcagcugccacugcggaccauaaggacccuaguggcugugggaagacgacggucuauuuccccacaggcugcacccuuggaagacauuccgagggagacccuggagugcccgggguauggaacagucaggaggaccuggcuguugccuggcagagugaagaagagugagugcucuuccugccagaggaguggagcggaaucccacuccaucagagguagcguuuggcugguuguguaaguccagacgcagacgagugugcuuggaugucuuaguguuuuccgucucugucauuguguuguguuuacucuuauucuucacuaugggacagaccgugucuacuccuuuaucuuugacuaaggaccauuggacagacguuagggcuagaggacaaaauuugucaguaaaagugaagaaaaagccauggaugacuuucuguuccucagaauggccuguuuuuggaguagguuggccagcagaaggaacuuuuuacuuacccaccauaagggcugugaaggccauuguuuuucaggaaggaccagggucgcauccagaccaacaaucguacaucaugguaugggaggacuuggcacgcuacccacccccguggguucgcccauuccucccgccucuccgcccuggcaccaagauucuagccauccaagaaaauggugagaaagagaaaccaaaaccaccgcucgggagagaugaugaucgcagcacaccagugacgaaaccccccaagaucuauucagagauugaagaacccccugaguggcccgauaccccucaacccccaccuuaugcuccccagccccaaccuucagcucccucgggaccccugccucaggccccggccggaggagggggucccuccacaggaacaaggagccggcgaggagucaccccugaggggccugcggauucaacuguggcgcucccccucagggcuauuggggcucccccugccgauccaaauagucuacagccccuacaguauuggccuuuuuccucuucugaccuuuacaacuggaaagcucaucaccccccuuuuucagaaaacccugcaggacucacuggguugguugaaucauuaauguauucacaccagccgaccugggaugacugccagcagcuucugcagacucuauucacaaccgaggagagagagaggauucuccucgaggcucggaaaaauguccgagacgaggcugggcgcccuguccaaacuccagcugagauagaugaaggauuuccgcuaacccggccccgaugggauuauaauacggcaucagguagggaacgacuguccaauuaucgccggguccuaguggcgggucucagaggugcugcccggcagcccacgaaucuggccaagguaagagagguuaugcagggagcgacugagccccccucagucuuccuugaaaggcucauggaggcuuauaggagauauaccccauucgaccccacgucugagggucaaagggccucaguaauuauggccuucauuggccagucagcuccugacauuaggaagaaguuacagcgaauugagggcuugcaggauuacaccauaagggauguaguuagagaggcagagaaaguguaucauaggagagaaacagaagaugaaaaguuagagagagagaaaagagaaaaaagagaagaggaggauaggagagacaggaggcaaaaaaagguuuugacuaggauccuggccgcaguaggagaaagagauaauagaagaagagguagacagucagggaaccugggagacaaaaggcagcagggaccaaggagacccagagaaggcgggcagcgccuggagaggaaccaaugcgcguauugcaaggaaaugggccacuggaagagcgacuguccgaaaaaaaaacaagagguaaaggugcuuucucuuggagaagaugaagacuagggggaauggggcucggccccccuccccgagccuaggguaacuuuagaaguggaggggaccccuguggacuuucuaguugacacgggagccgaauuuucaguacucaaaacaccucuaggaaaaguaaagaaaaaugaaaaaaccuuggugaucggggccacgggacaaaaaucguauccauggaccacaucccgaguaguagacauagggcaaaaucgaguaacucauucguuucuagucauuccagaguguccuaugccuuuauuagagagagacuuacuaaccaaguuaaaagcacaaauaacuuucaccucucaucgaccggagguuuucuggggaauaaaagcgccccagacucuagagcugucuuuacaacuaggggaggaauaucgacuuuaccaaaauaaaguaaagcccccugagggauuacaggacugguugaaucgauacccccaggcgugggcagagacgggaggaguggggauggcaaaacuggucccccccguggugauugaacuuaaguccggggccaccccuauagggguccgacaauaucccaugagcagagaagcucaagaggguauacgcccccaaauuaacaaacugcuccaacaagggauuuuggucccaugcaaauccccuuggaacacuccucuacuuccaguaaaaaaaccagggaccagggacuuccguccaguacaggaccuuagagaagucaacaagagaguucaggacauacaccccacggugccaaauccuuauaaccuccucagcaccuugccaccuggucggacaugguacacaguccuggaucucaaagaugcuuuuuucuguuugagguuacaccccaacagccagcccuuguucgcuuucgaauggcgagacuccgagaguggauaagccggacagcucacauggacgaggcugccucagggauucaagaacucgcccacuuuguucgaugaagcccuacaccgagaucuugcucuuuuccgagccaauaacccacaggugacucuucugcaauauguagaugaucugcuccuagcugcagaaacacgcgaggacugugaaauugggacccaaaaccuccugggcgaguuagguaagcugggguauugggccucugcuaaaaaggcucaguuaugccagauagaagugaccuaccuaggauaugucuugagagauggacaacgguggcucacagaagccagaaaacaagcuguuaugcagaucccggccccaaccacugcucgccagguaagagaguuccuggggaccgccggguuuugcagacucuggauucccggauuugccacacuggcagcucccuuauauccacuaaccaaagagaaaggggaauucaccuggaccagagaacaucagcuagccuuugaaacucucaaaaaggcacugcugcaggcuccggcauuggcccugccagauuuaaacaaaccuuucacccuauacauugauaaaagaaauggaguggcaaggggaguccuuacccagguuuugggaccauggaagcgcccgguagccuacuuaucaaagaaacuggacacuguggccaguggauggcccuccugccugcgagcgauagcagccacggcugugcuaguaaaagaugcugacaaacugacuaugggccagaauguuacuauaguggccccacacucucuugagagcaucaucaggcaaccaccggaccgcuggaugaccaacgcccgaaugacgcacuaccagagccuauugcugacagagcgaguaaguuuugcacccccagccauucucaaccccgccuccuuacuaccugaggcugacgaggccccugcacauaagugugaagaaauacuggcagaagagacuggaauccggccagaccucacagaccaaccuuggccaggggcgaugacuugguucacggacggaagcagcuuugugguagaagguaagcggaaggcuggggcggcaguaguggauggaaaggcugucauaugggccagcagucugccggaggguacaucagcucaaaaagcggaacuaaucgcauuaauucaagccuuaaggcuggcagaaggaagggcucuuaaugucuauaccgacggccgguacgcuuuugccacggcucauguacacggagcaauauaccgacaccguggacugcugacgucugccggcaaagauaucaaaaauaaagaagaaauucucagcuuauuagaagcuguucauuugccccguaggguggcaauuauccauugcccaggacaccagaagggaacugggcccguugaaaagggaaaucaaauggcagaccaagaagcuaaaaaagcagcccaagggccaaugacucugguggugagaacccaacagcccgcugcugaggaaauaaauaaaagaacccucacagaagaagaggggcgagauuacuuagcuaacauacaccaucugacucauuuaagaacuaaaaaauuacuaaaauugguuaguaagucccccuauuacauuccuggauuaaaaggaauuguggaagagauaguaaaaaacugccgugcuugugcacuuaccaacgcugggucuagcaggcuccaggaaggaaaacgacugcgaggagacagaccuggagccuacugggaaacugacuucacugaggugaaaccggcuagguauggaaauaaauaucuccuaguuuuuauagacaccuuuucaggaugggucgaagcguuccccaccaagaaagaaacggcuaauguaguggucaagaagauacuugaagaaauccuuccccgcuuugggauaccuaagguaauggggucagacaacggaccugccuucgucucccagguaagucagggauuggccagacaacuggggacaaauugaaaauuacauugugcauacagaccccagaguucaggacagguagaaaggaugaacagaacgcuaaaggagacucugacuaaaauagccuuagaauccggcggaagcgauuggauagccguucucccuuaugccuuguucaggguucggaauacaccuggaccccuuggccuaacuccauuugaauuaauguauggggcgcccccacccauuuuuaugaccguaggggauaagaaucgcccggauguaucuuucucuccuucuucuagucuuuuggcucgauuaaaagcucucgaaauaguaagaaaagaggucugggaacagcuaaaagaaaccuauguugcuggugacacacaggugccgcaucaguuugaaguaggagacgcaguccuggugaggagacaccgagcgggaaaccuagaaccgagguggaagggacccuacuuggugcuacugacaacgcccaccgcggucaaaguggaaggaauccccacuuggguccacgcaucccacguuaagagagcacccccuggagucagccaugaugaguggacuuuggagaagacuacuaauccuuuuaaguugcgccugcuucguaggagcgaucccaaaagacuucaacccccacaguccuguucaacaaacgugggagguacucaaugagggggguagggcuguauggacaaucgccgagguacacccucuguggacuugguggccugaucuuuucccugacaucuguaaguuggcuauaagagccccuccuggaugggacuuggagggguacucugacauucagagggcaccuuuaacacccccuccguacguagaaaaacauucgagagacccauggggugguugcucuaaccaaagggauaaaaguaugcuucgaacccaucccuucuaugucugccccgggccccaccgaagucagucccucaauccaacguguggagguaaggcugacuucuuuuguaaagagcugggguugcgagacuucagguacagcccgcuggaagcccuccucgaguugggacuauauuagaguaacagccaacuauucccuagcgucuuauguaccuggaggauuugaccuagacgaguguacugacuggugccauccgcuccgugucaccuucacugaaccaggaaagagagcucugggauggacaaaaggguauaccuggggucuuaggauuuacaaggaaagauaugaugagggauuauuguucacuaucagauuaaaaauagagacucccuacaauccuuuaggccccccaaccaaguucacaccccucacccauacaauuacucagccuacuccagugauugcggacccccuuaauauggccgcuaucacccaaccucccacuccucagguaccucuaacuauuacccccgagauuccuucaagacagaggauguuuaaccuagugagaggagccuuuuaugcccuuaacagaacugauccaagcgcuacugaggacugcuggcuaugccuguccucggguccgccuuauuaugaaggaaucgccuucaauggagauuucaacagaaccagcagccauacuuccugcucuugggguacaggacaaaaacugacccugacugaaguauccgugaggaauccaggucucuguauagguaccccaccuuccacucacaaacaccuaugcggacaaauucaguccguguccagaacggaagcugauuacuaucuuguaccuuccccgguuggauggugggcuugcaauacaagacuuacucccuguguaucaacuaagguuuuuaauucaucucaugauuuuugugucaugauccagcuguuaccccguguauauuaucacccugcauccaguuuagaagaaagcuaugcgggccggcggucaaaaagagaaccaauuacuuuaacccuggcugcauucaugggaauagguauggcaguaggaguggggacgggagugucagcuuugauagaaggaagacagggaauucagucuuugagggaugcugucaaugaagaccuagcggcaauagagaaguccauagacgcuuuagaaaaaucuuugaccucccugucugagguaguuuuacagaacaggagaggucuugauuuguuguuccuaaaggaaggaggacugugugcugcccuuaaagaagagugcugcuucuaugcagaucauacaggaauaguuagagacucuaugcagaaacugagagaaagauuagagcgaaggaaacgggaacgggaugcucaacgggggugguuugagucgugguuugaaucacgaccaucuuagauaacuucuuuaauuuccgcuguagccggaccaauccuuaugauaugcuuagcuuuaguuuucggcccuuguauaauaaauagaggaauggcuuucauccagaguaaaauugauacaguaaaacucaugguucuucaaaggcaauaucaaccuauaguucagguagaugaagaguuaagggacaccgaccucuaaaauucuaugauuagaauagucuaaacagaagaagaggggaaugaaaggaaauaaaacuguaauucauguaauauauguuaaauagcccaaagaguuguuucugagcuuugaaaccuggggcugagaacauagcagaacagaccaggacaugcccgggcaagcccaucgccucccuagcucccaccccucugaccuaaguuaaauguuacaggcugcugauguuuaaauggaccaaucaugugaaaccgcgccaauuccucccccagccccacuccuuuucuauaaaacccccuagcuuccaagccucguggucgaauccacugucuccuguugugggagauacguuucgacccggagcuccgccauuaaaaaaccucuuguuguuaca

SEQ ID NO: 6642 - RNA, 4769 nt, Mus musculus
ucauguguuauguauguguguuuauuuugaggggagaaguccgucaucuuugagaaugaagucucuggucuucuuagccaguccuaauuagaaaaggucuugugauacaacacuugcucucaaaaaagcaaauacacaaaaauuguagaaaauaaaaccaucaagcuacugaaauaugagauaguaacacaagagaagauaccaaauggcaauauaauaagaucgucugggggaauuucaguuacacaaaacuucaaggauauggccuaugaucagaauaugcuucacuuuauacauauuauacaucccaaaacugcauaauaaaaugacaacacugaagaucagguuguaaauauuuauaguuucucuuacucacacacaauauuguaugagacauuacuaguuuucauaugcauccauaggauuaauacucguauggaguauaacauggaaaagugcagaacuaaagaaauaacucuaacaacaaaagaagcacacauuucuuaaaauuuaaaauauugcacauaauaagguuacacagaaauuacuggcugcuuuuacaaaaagaaugagguauuagucaaucucuagauaaagauaagugcaaaagagugacuacacacaaacacacaccaaaaauaaauucauacgaagaccuagaaagucaacaaauagaaaaauauuccaaagauguuuacaaagcuaugauuuugaucaaacaaaaucauucacccaguacuaaaacacaauuucuuggcaauaugucauaaguuuuaaacuuuucagcuuaaugacgugcaauacaaucuuccccauuacaccaauucuacgguagaaaaggcaucuuugugugauaaucaaaccuucacuuucuaaagcuuucaggggcaaacagccaaaagcaauggucuucuucacuaaaugacucaaaauuacagcuucagacauuuaguaacccaagucagggccacagggcgugcaguuuugaauuugcagagguuucacugcaauuauuauucaaguucacacaauguaaaucuaugguaacuuuuaaaacuuaauuguuaaguaugugucgggcugaguuuuguuugggaauauggccggggggguggggggggugugaaaaugagccaaaggacagguaacguaaaaaaaucuugcaaaugaucuuucaaaagaacuucuccuaaucaggaaaauuacaguugucuacuagcugaauguauuuuaauuuguuuuaaaaaacaaaaaguucaauauauggaauaccuauaacaaacagcuuaacauaagugaaaucaugcauuuaccaaaauaguucacagaaaacuuuuuucaucagacauaguaaggaagaauaaacuaggugggcuuaguggaaacaggaaaagauucaacuauuguccugaacaaucaguguauguaguaaccauauuuccucuucguugagugacaguccugcagugcuugcuagauccaugaaaucuauuuucagucuguacugugugucgauuggugguaucaaagccacuaaaagaaaacauuuucuccaugucuucaaacauaucaucaaacaauccgccuccaaaagaaaacuccuggaagugaugccuuugucuacuagaaccauccuggcguguguggaagugguuuucaaaaugcuucuuagaccgaguguuuugguucugaccaaaaaaauuaaagucuuuaaauaagucaucaaaauugaaguuaaaugacuguucaaaaggacucccauugccucuuuguccuuugccauugguaaaagcacuguguccaauugugucauacucuuuccgacuauuggcauccgagaguguuucauacgcugaaacagauaaaaaccuuuuaggaauuggaagauaaaauaucccaaauuguguauaugcaaacuucaaauauaugacaaacuauuauacauaauaaagcuaaaauauaaguuagaaaacguuuuaacuguuaaagaaauaaauuaucaaauguauucagcuaauagaaaaucagauuuuuuacuuucuuacuaguugaaguaaauguuuaauuccaucccccuacauaagccuacucaccauuaacuacuuaaugcccaugauauauguaugguuucuuuuagcccuaguauuaugacaaaauguucuuuacauauuuuuaaauacacauugguuugaaauguagaugaaauagauuaauuuacuaaguaaauugauauuuacuaaguuaguugaucauuuugguguucaaauacuccuuuuuagacagagugguuucauaaauaacaacaacaacaaaaaaaagauaaaugauacccugccaacaucuuuaaaacuguaaaacaauaaaaugacauaccacaauuaauuuacuuauucaggaaccaaguauuuauucuaacaaacuacaaaauccuacauacaccucucccaucuccauaacaucuuuaagacuuacaaaauuaucagcuaccauuagcuuauuaaauacccaugggaccucagcaacauuuacuuaccuucugcaaucucucugaauuuugcuucagcaucagggcuuuuauuuuugucagggugguacuucauggcuaauuugugaaaggccuuuuugauuugucgcucugaggcagacuuuggcacaccuaagauaucauaguagcuuuuggaggccaggauuaauucuguuaucauuaaaaugcagauugcaaagacgaaaacugacuguggaguagccauuucuaauaaccuaagaaagaaaaacauagugucuuuuuaaguccaaggaacaaauuuuaagacuuaaaaaaaaaauccaacucaauaaagcucugguguugagacagcagcaucaagcuguuaugcacauaguaucacauuagucacgcucuuguacuucugauauuagagucuauuagcaaggcuuuucuuaucuacuggaaagauaaaacugauaguuucuuaggaaggcuuaggauuucuacuacuugauggugaacuugucugccugugauacaaaagguauuauuacuuguuuauauuauuauuuaauacugcauuuuccugagguggcuccugaucuaccccagcuuccucagcgcugucuucauuaccacauuuaauuucagaauauaaaccaauuacugaaaaagaaaucugucuuuucuguguuuggcuagaaccgcaggaagaaaggcaaagguggggaaggaaagauuuuucucaaaucuguaaaaucuauuugaucuuaaagugguuaaaauagucuguuugcauaaauuuaacuucccaaauacuucagaaauaucgguaaauaacaucugcuuaaggcucacaauuaguaaaacuuauacuucuuugaaagcugagcuaccagaggaagaaaaguuuauacuuuggauaaguuggguuauuacugggcuucccagauuucucagcaaguaaaauguuucucuuuaaaacaaaguuuuaccuaagaacuauugguaacacauaaugauucgagaugaaguguauuucuuugcuuuuuugaaugcuguaccacagaaguccuuaaugaccuaugaugacauaacagggcugaugaaaaaggcacuaugguuuguggaaacugccagccaaccucuccuguggccuauccuaagcauaauuagcagguagauuacuuuuuucccgagacuuagucauagucacgcguaccaaguacaaacucucuaaagaacucaagcagaaagccuggcguugugccccacgccuuuaaucgcagcacucagaaggcaggggcaggcggggaucacuuugaguucaaaaucagccuggucuccauagugagcuccagggcagccagaucuacccugacuuaaaaaaaaaaguagauuuuuuuuuuuaaaguuaauguaagcggagcauguccgaugauggucgccagaggcugcgguuguucgcuagucaaagggcugguccacaacugacagcaaggcggcucggugacaaacgagaucccgccgcuucaagcugccccuggagauguuuuuagugcccgagcuuuagcuuccccaucaaacccacucugcccaaacaaugggaucgcccuccccgaacccgcuggagggcuggccgguccggcgucccggcccacuccacucagagcgucagcuccaugcuccggcccugccggcgagcuccgcgaccugccggccuggccucggggaagacgaccccccaaccccaccgcaagcacgagcugugacgcagccaucucgggguacagucgcgucgcuuggcuucccaacgcggcugauaggugguaggacaccaaggccaaggcggaacacaaagcgggacccgacucggcgccacccuccccgguccuuaccugugcgccccgacgcagcuucuccacagcgcggcggcccggcuccgguucccugaccccggccgcacaggcuccgaccucgccuccgaacgccgaguagccuccucccagcucggcccguucccuacuggcgggagcccguggcuggcgcgaccgcuuauagagccgaccuacacgaaacgcuuccccauuggcucccgccggcccaccugacuuuggcgcccuacgcgcacguggaaaacuguuguugccguuugguccuugcgucacuuccgucgccacccuccgaggggcggugccaaggugugcggaagcggaagugagucgacgauuuccucauccuucccuggggcgcaucgcgcgcaggcgcuuuagagggugcg

SEQ ID NO: 6643 - RNA, 4769 nt, Mus musculus
cgcacccucuaaagcgccugcgcgcgaugcgccccagggaaggaugaggaaaucgucgacucacuuccgcuuccgcacaccuuggcaccgccccucggaggguggcgacggaagugacgcaaggaccaaacggcaacaacaguuuuccacgugcgcguagggcgccaaagucaggugggccggcgggagccaauggggaagcguuucguguaggucggcucuauaagcggucgcgccagccacgggcucccgccaguagggaacgggccgagcugggaggaggcuacucggcguucggaggcgaggucggagccugugcggccggggucagggaaccggagccgggccgccgcgcuguggagaagcugcgucggggcgcacagguaaggaccggggaggguggcgccgagucgggucccgcuuuguguuccgccuuggccuugguguccuaccaccuaucagccgcguugggaagccaagcgacgcgacuguaccccgagauggcugcgucacagcucgugcuugcggugggguuggggggucgucuuccccgaggccaggccggcaggucgcggagcucgccggcagggccggagcauggagcugacgcucugaguggagugggccgggacgccggaccggccagcccuccagcggguucggggagggcgaucccauuguuugggcagaguggguuugauggggaagcuaaagcucgggcacuaaaaacaucuccaggggcagcuugaagcggcgggaucucguuugucaccgagccgccuugcugucaguuguggaccagcccuuugacuagcgaacaaccgcagccucuggcgaccaucaucggacaugcuccgcuuacauuaacuuuaaaaaaaaaaaucuacuuuuuuuuuuaagucaggguagaucuggcugcccuggagcucacuauggagaccaggcugauuuugaacucaaagugauccccgccugccccugccuucugagugcugcgauuaaaggcguggggcacaacgccaggcuuucugcuugaguucuuuagagaguuuguacuugguacgcgugacuaugacuaagucucgggaaaaaaguaaucuaccugcuaauuaugcuuaggauaggccacaggagagguuggcuggcaguuuccacaaaccauagugccuuuuucaucagcccuguuaugucaucauaggucauuaaggacuucugugguacagcauucaaaaaagcaaagaaauacacuucaucucgaaucauuauguguuaccaauaguucuuagguaaaacuuuguuuuaaagagaaacauuuuacuugcugagaaaucugggaagcccaguaauaacccaacuuauccaaaguauaaacuuuucuuccucugguagcucagcuuucaaagaaguauaaguuuuacuaauugugagccuuaagcagauguuauuuaccgauauuucugaaguauuugggaaguuaaauuuaugcaaacagacuauuuuaaccacuuuaagaucaaauagauuuuacagauuugagaaaaaucuuuccuuccccaccuuugccuuucuuccugcgguucuagccaaacacagaaaagacagauuucuuuuucaguaauugguuuauauucugaaauuaaaugugguaaugaagacagcgcugaggaagcugggguagaucaggagccaccucaggaaaaugcaguauuaaauaauaauauaaacaaguaauaauaccuuuuguaucacaggcagacaaguucaccaucaaguaguagaaauccuaagccuuccuaagaaacuaucaguuuuaucuuuccaguagauaagaaaagccuugcuaauagacucuaauaucagaaguacaagagcgugacuaaugugauacuaugugcauaacagcuugaugcugcugucucaacaccagagcuuuauugaguuggauuuuuuuuuuaagucuuaaaauuuguuccuuggacuuaaaaagacacuauguuuuucuuucuuagguuauuagaaauggcuacuccacagucaguuuucgucuuugcaaucugcauuuuaaugauaacagaauuaauccuggccuccaaaagcuacuaugauaucuuaggugugccaaagucugccucagagcgacaaaucaaaaaggccuuucacaaauuagccaugaaguaccacccugacaaaaauaaaagcccugaugcugaagcaaaauucagagagauugcagaagguaaguaaauguugcugaggucccauggguauuuaauaagcuaaugguagcugauaauuuuguaagucuuaaagauguuauggagaugggagagguguauguaggauuuuguaguuuguuagaauaaauacuugguuccugaauaaguaaauuaauugugguaugucauuuuauuguuuuacaguuuuaaagauguuggcaggguaucauuuaucuuuuuuuuguuguuguuguuauuuaugaaaccacucugucuaaaaaggaguauuugaacaccaaaaugaucaacuaacuuaguaaauaucaauuuacuuaguaaauuaaucuauuucaucuacauuucaaaccaauguguauuuaaaaauauguaaagaacauuuugucauaauacuagggcuaaaagaaaccauacauauaucaugggcauuaaguaguuaauggugaguaggcuuauguagggggauggaauuaaacauuuacuucaacuaguaagaaaguaaaaaaucugauuuucuauuagcugaauacauuugauaauuuauuucuuuaacaguuaaaacguuuucuaacuuauauuuuagcuuuauuauguauaauaguuugucauauauuugaaguuugcauauacacaauuugggauauuuuaucuuccaauuccuaaaagguuuuuaucuguuucagcguaugaaacacucucggaugccaauagucggaaagaguaugacacaauuggacacagugcuuuuaccaauggcaaaggacaaagaggcaaugggaguccuuuugaacagucauuuaacuucaauuuugaugacuuauuuaaagacuuuaauuuuuuuggucagaaccaaaacacucggucuaagaagcauuuugaaaaccacuuccacacacgccaggaugguucuaguagacaaaggcaucacuuccaggaguuuucuuuuggaggcggauuguuugaugauauguuugaagacauggagaaaauguuuucuuuuaguggcuuugauaccaccaaucgacacacaguacagacugaaaauagauuucauggaucuagcaagcacugcaggacugucacucaacgaagaggaaauaugguuacuacauacacugauuguucaggacaauaguugaaucuuuuccuguuuccacuaagcccaccuaguuuauucuuccuuacuaugucugaugaaaaaaguuuucugugaacuauuuugguaaaugcaugauuucacuuauguuaagcuguuuguuauagguauuccauauauugaacuuuuuguuuuuuaaaacaaauuaaaauacauucagcuaguagacaacuguaauuuuccugauuaggagaaguucuuuugaaagaucauuugcaagauuuuuuuacguuaccuguccuuuggcucauuuucacaccccccccacccccccggccauauucccaaacaaaacucagcccgacacauacuuaacaauuaaguuuuaaaaguuaccauagauuuacauugugugaacuugaauaauaauugcagugaaaccucugcaaauucaaaacugcacgcccuguggcccugacuuggguuacuaaaugucugaagcuguaauuuugagucauuuagugaagaagaccauugcuuuuggcuguuugccccugaaagcuuuagaaagugaagguuugauuaucacacaaagaugccuuuucuaccguagaauugguguaauggggaagauuguauugcacgucauuaagcugaaaaguuuaaaacuuaugacauauugccaagaaauuguguuuuaguacugggugaaugauuuuguuugaucaaaaucauagcuuuguaaacaucuuuggaauauuuuucuauuuguugacuuucuaggucuucguaugaauuuauuuuugguguguguuuguguguagucacucuuuugcacuuaucuuuaucuagagauugacuaauaccucauucuuuuuguaaaagcagccaguaauuucuguguaaccuuauuaugugcaauauuuuaaauuuuaagaaaugugugcuucuuuuguuguuagaguuauuucuuuaguucugcacuuuuccauguuauacuccauacgaguauuaauccuauggaugcauaugaaaacuaguaaugucucauacaauauugugugugaguaagagaaacuauaaauauuuacaaccugaucuucaguguugucauuuuauuaugcaguuuugggauguauaauauguauaaagugaagcauauucugaucauaggccauauccuugaaguuuuguguaacugaaauucccccagacgaucuuauuauauugccauuugguaucuucucuuguguuacuaucucauauuucaguagcuugaugguuuuauuuucuacaauuuuuguguauuugcuuuuuugagagcaaguguuguaucacaagaccuuuucuaauuaggacuggcuaagaagaccagagacuucauucucaaagaugacggacuucuccccucaaaauaaacacacauacauaacacauga

SEQ ID NO: 6644 - RNA, 4991 nt, Mus musculus
caguacuccuacagaacagcacuccaugcccugugacagugugcuugugugagcuuuccagugacauucauggucagccauaguaaacagccuagaaaaugagauuaugaaagagugaauaaaaucuacuuuaggguucacaaguggacauuauaagcaguuuuuauuaacguaagaugucaggaugauaaagcaaccaggauaauuaugguuggucauggaggauaagcaagaaacuugucccaagggggacagugauuuuguuucugacaaaguaaauuucaaaacagaggaggaagaugaugaucaaacuccaaacacaguuuggaacaaguggacuuuaaaagugagucagagaauacgagacagacagacaguagcgaugaacaggcagacaucagggcagcgagcugugccugucagcccucugggaaguucuuagcugccgagagugaggaugacuauggcucacucuucucccaguauaguagcacacuguacaacguagccauggaagcugugacccauagccuucuuuccagucgacacauaagcuccaggaagaagucuccagccuggaagcauuucuuuauuuccccucaagauagcacuaaggcuaucugcacauacuguaugaaagaguucaguaggggcaagaaugagaaagaccugaguacaaguugccucaugagacaugugaggcgggcacaccccaccaagcucauucaagaaaauggaagucuaucggcaggguccuccuuuuccccucccucucuguugcuuccaccacagccugcagaugugggagaccuuagcacugugcucucgccugucagacuuguccagaaaauggcucccaagaucccauccccugaccaaauaauggaagagucugugacuguaguuucuucugaagaguuguccucugaugugucugucacugaaaaguacagcagagaggaggccuuggcaggcuccucccccaaccucuccaugcuccauuaugacaacgcuucagaaaccauggcagacagaaaccuuucucuucccaaaagcacaucuggguccaggaggaggucagccgucuggaagcacuucuacuugucaccccucgauagcuccaaugcugucuguguccacuguaugaaugaguucaguagagggaaaaacgggaaggaccuggguacaagcugccucaucaggcacauguggagagcacaucgcuccauuguacugcaggagaacgggggcaacacaggcaucccaccauuguacccuaugcccccaacccugcugccugcccugcugcccccagaaggggaucucaacuccgcaucguugucuccaggcaaacaagucaaagaguccccuucugccuccucauccccagaaaggcuuccugaggaccugucaucacacacuaauccuggggaugugucccgggaagauguguccauguugucauccucugaugacuugggggaggccucuguagugucuucuccagagaagcagccagcggacacgguaaaucccagguuugaaucaggcacugucuuccagcaaaauaagaaggugaugagaagacuaaagucagaagucuggcaucauuuuucccuggcccccauggacagucucaaagcagugugccgguacuguagcugcguuauuagucgggggaagaagggagauguuggcaccaguuguuugaugcgacaccuguacagacgccacccucaggugguugagaaccagaaggacuuucugggugcaaguuuggcaaacucuccauaugccacuuuggcuucugcagaaagcuccuccaaauuaacugacuugccagcaguggucagaaaaaaccaucaagguguguuuccuacuaauaacaagaagaccucaaagcugugaaaucacuuuucuauuuguucagcagacucaacaaagguggugugccugcacuguggccggaccaucagcaggggcaagaaacccaccaaccugggcaccagcugucuccugagacaucugcagcgguuccauggccauguacucaagaaugaugucucagaggccacucugccccguucuccaggcauccggaggccucugggcauagagcucucagggccuuccucuuuccgugacuccacagagaaguucuaugacucucaucuaguugccaaaaaaaucacaagucucauagcugaaaugauuguacguuggcuuuaacaggcugcucgaauacuugaaaccucaguacucuuuagccucccuuuccuacuucucuagaacagcuaucccagguauguaugacaaugugaaacagauaauuaugucacaucugaaggaagcugagagugguguaguucacuucaccucuggaauauggaugaguagccagacucgugaauaccugacccuuacagcucacugggucaccuucgcauccgauguccgaccacauugugaggaccaccauugcugggcacuuuuagaugucucacaaaucgacugugacuauaguggaaauagcauucagaagcagcuggaguguuggugggaagccugggugacuuccauuggccuucagauuggcaucacugucacugacaauccaagcauagggaagaugcugagugagggugaacacucaagugugcagugcuucagucacacagugaaucugauugugagcgaggcuaucaagagccagaggauggugcagaacuuacugaguauugcccggaagcugugugagcggguccaucggucacccagagcaagagagaagguagcagaacugcagaaagaguacgagcugccacagcaccagcugauccaggauguacagucuaaguggagcacaucguuccacaugcuugaacgucugauugagcagaagagggcaguuaacgagguauccauugaguguaacuucagagaauugaucagcugugaccagugggaggucaugcagucugugugccaugugcugagaccaauugaugcugcaagccgagagaugagugcccacaugucuacgcugagccaggucauccccaugauccacauccucagcagaaaaguggagaugcuguuuggggagaccaugggcauugacaccaugcuuaagucccugaaggaagccauggcaagccgccugucugccacucuccaugaccccagguacaucuuugccacacugcuggacccucgcuacaaagcuucccuguucacagaggaggaggcagagcaguacaggcaagacuuaaucagggagcuagaaauacugaauucuaccucagaggacacugccaccuccaauggcugugacucaggguccccacuuaaagacacuggcacagaggagagccuguggucacucgcaccgauaaagagagaucagagagagaagcuaccugaagacauggugcuugcguauuuggaggaagaggugcuggaacacagcugugacccacucaccuacuggaaccuaaagcggucaucguggccugggcugucuaccuuagcaguucgauuucugggaugucccccaaguacaguccccucagaaaagcuguucagcacacccauggaugcuggcagcuuuggccagcccaggcucaugauggagcauuuugaaaagcucaucuuuuuaaaagugaaucuuccuuuaauaugcuuucaguauugaacucagagauggagccaccagacuggaaacgugcuucagagugcuagcuauuguaccagggcugacuugccuggcagggccauguaggacaccagaccaggcaucuggggcuaccugccaguucucaccauaauauccacaugugccuuacuccuccuucaggccaggugucaaggugcguuuucagaagcccacuagaaacagucuuggcaauuaugaaauaggaugaucugguuuaaaacuauaaagguuuuuuguuuuguuuugaggggauaguaaucuguuuuacuagaaugaaaggaagauguaaacaauuuuauuauguaggguuuuuauucaguuguguaaaaaccacaaaucaggugcuguauuuuaauuaaauauuuuaauugcaacaaaacagcuuuuguggcuguuaaaugaaaccuguaaauaggagguggagguuaagccauccugacugaacaguucuuaaccacaggcuccaaaaguauguccuagagagaauauucuggaagcuguuuacagaaccaggcauuugaaaacaaaacugaacgugggcauaucauggagugucaaucacauggcuaauuggucaugagaacgguuccaugucagguguugcauucagguuuuacacggucaguuaacucagagauaucccacuuaucaugagccccuugaaauuggauccagguuuuaaagucaugcuuaggacuucaccagugcaugauaugacacauauacaacagauggccuguugaucaaaucuccaugccucugauuuacguuuugcaucucuauacaauaaagcuaucucauaagaaguaugcacugaccccccaguuugaccagauagcgcucagauucuacuuugaggagguagcuuguugacagggaaagcgcuuguuuauugcagucaugagaaaagccuuaggcauuuagauuuuuuuuuuuccuaugauagggaagccucaaccaucacugggacauuauagagucccaaggauaucaacaugaaguaucagcuaucagacucuuuaccagacuccaaaguuuuugcuuaugucuaaaagaaaaaguuuuucauuuucucauuucaaaucaguuaaauauucugggugaaacaaaucacucauugccucugaccuuuuagaaaacaaauguuguguugaaauacugugugggcucggucugaguuugccuggacugugcuuuaguguauuuauaaaugacgaacuuggauucugaaauuaaacuuuuuauuugcgauuuucuaaaaaaaaaaaaauaaaua

SEQ ID NO: 6645 - RNA, 2297 nt, Mus musculus
ggggaguaauuagcacucacuacauuagcagugaaaaaaaaucagagcuuguugccagcuccccacucccgcccccuuuccaaggcaaagcuugacuuucucucagucugagucaaagggucuuuguucauuuccugcacuaauucgccaaguggcgaugcagaagugauuuuuuuuucaauugcagaugcuuccauccuauugaaaacacagauacgaguguucuuucuucaguuuaagauugagagauggcuacauauuacagaauacacacccagaagauucuugcugguucacucacagguggcugacgugguacagacggggcuuuaguugguuugccuuucacugucggcccuugagccaaaaugcauagaucuguucugauuaugucucagccugagguggauggacaccgugcuuaacucacacauacgucacaccagcuugaugagauuccgaugcugccuuaucaguccuggcuuuguugcagcuguauaacaggcucggucccacaucugugauaaaacccucugcauugcuaacccagcuagucucuuuaccuuucuccucauacugcaccuacuuuggacucacagucuccuuugcuucugagaucacaggucuccuuccugccauugugguagccuccacuccacuccacaucacaccaugucugagggaguggggcgagagugcuaggcucugucaaccaguacacugcagaagaugggcacacagaggaaaaccucauugugucguuaaccaagccacggcacagucugugcagcugcgucauucgcuuucacaaaagcacaaggagcuaaaucauuuacaaacacccaaugacuccuucaaugccacauuuuuggucagagauacuucauuguuaagaacaaccacugcgaagcuaacacacauaucauuuugcccuucugaaagaauuugcaucccugcuaccuuggcauccauguagcaccaguuaaaugcaguuuugugagacauuaaguauacugauguggcuugcuggugugcaugugccuguguaugucuaggaaacaucgcgcuacagaggcgagagggagaaggauaaaggagggagggaggguaagugcaugagagcaagagugagcugugcgaaaagggggaaaaauauauccagaggacucacugcaaugcaguuuuacauacagaccuguaggagcaaacggaauguuauuagaccauaaaagcacaucaggcugauuuaugguuucugaucaagguuucugugaaaauuacucugcaucaccagcucaaggugacugcuaccauuaauguguggaaaauaaaugagauagagagucugauagcagaggaaggagaaaagcaggaggcaguuuauacagcacagguuccccauuuuguuuuacagugcagagaagccugucaucaaaaugauugcuguggggcaggaaaggcaauucuggguaauuagaucuuauggcauguagcuggugcuuucuuacauccaguguguuuggauauuaggauggacgagugcuuucuacauaccugcuucucugcucucugcuccuauucagguauagugccuuagauuuagaggaaaauauaauguagugccguuucccugacucuauuucuuuuuaaucacgaucacucccccucgacuguuuuguuacucuguuugcugcuaaagagaauuccucucuuccaaauaaauaagcuuucacauuugagacuuuuccaggagaacugauauccacaacuguuuugcauaucaucuugaugucagaaacaauucuacuggcauuucucuuccugacggcugagauuccaacauggaaacacuucauagaugaagguuaugcugugcauuuagaugugagaagagaccacauaucacaagaucuuucaaacacgccuucugcaaaagaaaagcuguugguuugcagaugccaaacccucuucuugauuacacuaagcauuacacauggguaggggguuggggaguguggucuggugcuagcuucucccuguaaaugcugguaaaguaucugccauuuugaaaugcuugagcugaaacaguauauugaaagguuuccaaauccugucucugcaucucucucccugacuguuaaaguuugcccucuggugcguuuguguagcaguccacauguguauugcauggugucugcuuccacagcuggccucuguaauggugaugaccauuuaaaaaaaaauaugcaugcuuucaggaaaggcacagagcagagaacacucuguaccuacagcca

SEQ ID NO: 6646 - RNA, 1955 nt, Mus musculus
acuuuuauuccacauuuggagcccuuacagaggaacauggauggagagcuacaggugguucacugugacuucuuuaaaauggauccuagauaucaggaaguaguaagaccagaugugaguucacaggcaauauuucagaaccugggaauaaaagcaguuccuuggucagcagguguuccuauaaaaguauuuggaauccuaccauauaaacaugaaagacgaauacuuuggaaaauucuguucgaucuguacuccugcgaaucuauauacagauauggacgaguagaacugaauauguuuguuagugaaaaagaauuccggaaacugauagcgacuccuaaaagaccggauuuauaucaaguaauggcuguucuuuggcaaguggccugugacguuaaguuccugcacauggaaccuuggucgucauuuagugugcauacggaaaaugggcacuuagaaaagucaaagcacggggaaucaguaaauuuacugaaacaaaaccuauaucuuguucgaaugacuccucguaggacuuuauuuacagaaaaccuaaguccuuugaacuaugauauauuuuuccacuugguaaagcauugcuuugggaaacgcaaugccccaauaauacgccauuuacguucacugaguacgguugauccuauuaauauccugaggcagauaagaaaaaacccuggagacacagcugcuagaauguauccucacgacuucaaaaaacuuuuugaaaccauagagcaaucggaagacuccgucuuuaaguggaucuaugacuacugcccggaggacauggaguucuaggaagagucugcaagccgagagugagcuggagcuguuuguccauuauuuugaaaucaugugacaaaugaacacugaauuucaagaaguucauauccuuuuaacagaagagaaacuacccuuguuuggcacaaaugaagcaaauaauuucuucucaaguugauaccuuugauacacagaaaacacaguggcugcaguauuauucaaaguuaaauaaaacgaaaaccugucaguuugaucagaucaaaucuacuuuguuuuaaaguacucucugcuguagaucaaugguagaacacauaccuaguauguccaagguuuugguuuugcucccuuguagacgcccgacuugccagcaagaaggacgccacaacaggauucuuuugcacacguuuauugggagagcuugauagcgaaagcgaaagaccccgagcccaaaaaaccagugcugcuuauauaggccuaggauaggugugucuacaccugauugguuaugcuuucaguaccucauuuacaugccuugggccaggcagugacucugcaaaaaaaaaaaaaaaaacucuacugcacaugcgcacauugguuguuuacccauauucaugggcgucagcuuauugaaaccaguaccaucuuguaauggcguuuauuggcuucccauacucccuagcacaggaaauuuuuaaaaaauuucuauuuacuguaaaggcccauagguauggaguauuuucaauuguaauuuaauuuacuuuaaaaaaacaaaaaaccuuugggccaaaccucuuuaaauaugcacuuuucaccauugccaauugcuugcaucucccucaguuucuauacuguuacgcuuagaaaauaaauugauuugggcagacaugguggcauaagucacaggccuugugagguggagggcccaucaguuuaaugccacuuucaacuguagaauugaguuugagaccaguuuaggcuaagaaaagacccugucaagcaaaacaacgguauaaacuuagaaagugaucaguuuaucuuuuauuauguugaaguggauuaucaggcacuaugcaauccaguuguuuaaauuuuaaauuguaguauguuuuaaaacuuuuugagaaauaaaagaauuuguauauaaaaaaaaaaaaaaaaag

SEQ ID NO: 6647 - RNA, 536 nt, Mus musculus
uaugguggacauucagacagagcaugcuuaccaaaagcagccuacaaucuuucaaaacaagaagcguguuuugcugggagaaaccggcaaggaaaaacucccuccguauuacaaaaacaucgcucuaggcuucaagaugcccaaagaggccaucaagggcaccuacauagacaagaaaugccccuucacuggaaaugucuccauccgagguuggauucugucugguguugugaccaagaugaagaugcagaggaccauugucaucugccaggacuaucucuguuacaucagaaaguacaaucgcuuugagaagugucacaagaacaugucugugcaccugucccccuguuucagggauguacagauuggagacauugucacuguuggagagugcaggccccugagcaagacuguucgauucaauguucucaaggucaccaaggcugcuggcaccaagaagcaguuucagaaguucuaaggggacucuggccaaugcucuagaacaaauaaaguuauuuuccaacuuacaaaagaag

SEQ ID NO: 6648 - RNA, 24898 nt, Mus musculus
uccucccccggccacggccgccgcggcgguggcucugcaucuccaaaaagggcccuccgacuucucacugggccaguccggcgcuggguggcggagcccuacacugcucccgccggucccagagccgggaucccuucucuucagaguuucgagcaacuuuccccgccucuggagcuaaaguggcucggggacugugaccaccgcaggugggagaguccccggcccggcucuccgcaucuucgcugugcgcucgcgcugggaaagcccugggugcgugcacccuggggguccccggccucggcucugugggcgagaugccucugggacacaucaugaggcuggaucuggagaagaucgcccuggaguacaucgugcccugucugcacgaggucggcuucugcuaccuggacaacuuccuaggcgagguggugggcgacugcgugcuggagcgagucaagcagcugcacuacaacggggcccugcgugacggccagcuggccgggccgugcgccggcgucuccaagcggcaccugcgaggcgaccagaucacguggaucgggggcaacgaggagggcugcgaggccaucaacuuccuccugucccucaucgaccggcugguccuguacugcgggagccggcugggcaaauacuaugucaaggagcgguccaagguaggaugcgugcgggugcccagccgcagcugcgcugcaggggacgggaagccuucauucggaguguugugucgccuucgcuggggugcagcgaacuuugguuuuuaaccaagaagucagcuugccuaucugcccuacuugcguccccuccaccuccuggccuaaccccuuaagcaaaaguccacguuaaggggcucaggugucucgugaugaugagcuucugcugacucugaaagaauugcccugguuuuggugaugaccgcaaggacaacuggcugguggagggaaaagauauuggaaacacugcgacacgcauguccaugauccgaagugccuccuuuaaagccacccgguacugcccuucacaguagccagaggcacucuuaacucuacuagaggcaagucuaauuuuugccuuguguuaguuggcuuguagaguuagguagggugggagggaagaguucgguaugacaagguuaaguccuccacuucugcugcagccuuugagcccuggggcucagaauucucauagaccccucagcccaagugcugagccccacgccaucgccuuucuuuuccuauaaacucauggcaaaauccacucaaacaaccugauaagguccaugaagagaguggugagguaccucuggguagaaaccuuguuuuuguuguucucauagcccguaaugggggcaguggguggugaugauuuaucuugaaaauguuuacagguagauuggcaggccgguagaccaaugggagguggaggagcuggugccuguaacaucacuuuggguuagucuugcuccuggccauuucuuccuauaaggauagucaaacucucucuccaggagcaauucagagagaauugcccccguguagcugcgggacaagggacucuuagagucaugaaaacuucauuugaaguccagcaagguagagcaugcuagcagcagaggaauugugggcacugaaccaugugccgcucuuuaguaauacuuguaaaguuucucaguguagguucagccuugggaucaacuacuguagucuuguuuguccccaaagcuggaaagagcacccuuauaaaaagcaagugaucaacuggaaaugucuggaagugaugggugaagagaguugggagcugcaggcugcugucaggcuaggaggaggugaagggacugucugacgaguguccuuaugaauggaaccauaguaaaucuuagaggaacuguugguuucugaaugcugggaguaguuaccugaauucuguuagagaaugauggaugauagaggguuuuauuguuuuguuuguuuuuuuuuuuucuuccaucagucuggugguagacuggaucaucugcauuuucaucugggguguuucugcacuaaauaaccuuguugauagucccgggcuuagccucuguauugggaggcacuuguagcuuuaauccgaaaggccaaaugacaccuuaucaguucuguaaaguuucuuccaagcuuagcuguuaaagaauuuacccucggugguuuaggaguaauguuuuccccucugagggagauuagaauuaaagauaugucgaaucacuagcaugguuuauuauuuagcuuugacuuaguggauggcaggaggaccccgagcuagaauuuaauucauagggaaugaaaaaagugccagggagaagcaggcaggcucuguagaucccgggguggacccaguaacuuuucaguuaacugugugaggugacugcgcucgaaaagagaaaaucugucuugcccacggaagagccaucuuuccuuauccagauucuggcugucuugacugucccuggcacaaagcucuccuucacacccuucacaaaguccaucccuagacuggacuauucccuggcuaauuagaaccaaaacaauaacaaaaccaaaaaaaaaaaaaaaaaaaaaaaaaaacaaaaaaaccaaaaccaaauaaguuucaacaaacuauuaugauaauuuuuuuucuuuucucucucucucucucucucucucucucucucucucucucucucuuuuaaguguaaaacuuugauuuacuucuguaaggacgccuguggccucgggucccguacuuggaguuugcuggugaugcauugucaagucacauccugucuauagggcuacccuggcuuccuuucacuuggccuguuuucuuucuuacgugccuuuccucccucaguguccuucguuuuguacugcuucccacaguacugauauagauagaccuaauuuccugcuuaugcuuccaggggaaaacuguucucuucauggagagaacuuguacugauuuucaacuuauuuauaacuuuugaucgagggaauuucaagcauacacacauguaggcaggcuagcaugaacucccaccaggcuuuuuuagcaacugccaguuuguacguuuaguuuagacuuuuuuuuuuuuaaauauacuuuacauuccuaugcauuguacucauauacacccucauuacauuuuuuuucuuuaaauuggauuuguuaaggucauugaauaaugugagcaggauugcaaagguauugggaauaaacaagaauauuuacuauaccuagacugugggaggacucuuaguacuccugucccugucauuuuuauauauauauauauauauauauacauauauauauauguauauauguauauguguguguauguguaacauaugucuguguguguguuagaaauuuucugcuuugccucuguuauagcaaaaugggguuuggagucccucugggaaaagucccuguggucccgaggaguaucauggcgcccccuacccucaaguguggucauugcuuuccaacuagcaaugguuaucuguuccuacucccuccugaagaucuagaccauauccaagauaaauacugcuuauaauuugcuccuuuuucuuuggcugccuagagcuugcaaauggcuguuuuccagagaacguguaauuuauagaaccgaaugucccuuugccugaagcauucacuguagacucagaguugggaacgcuaacaauaauaaauaccguuuauugagcaguuugugcugccuggugccucugcucagcacaguacuuauuuuacuuucgucucugagccuuggcccaaaaugaacgaagcacuuaaauaauagacccaaagucucucagucagggcccagaggcaguuuuagaaagagguugggggaggauugguguuacuaagccuuguggccuuagauaaguuaagucacuuggggcccuaucaaguguaaaauaauaauucaaaagcuuuaggaaaaagaacuuuauaccaauacauguaaaauucuuagaauguccaguuuucgucuuuguuuaaaagcuccagguuaguuuugagauucuucuucaaaugagucugacuugagucuguucguaacuucaggccuuccuguuuagcaccccaaaugugcaugugugucucugaguuucagugcaggacuccugugagccagcuuauacucacaaauacaugugaacuguaggcuagucuaguuccucguuaacugugucucaagccaugagacacacaucacacacuguggauauggugugggccacuugagugcaucugaggugcaagggaagugcugaguuaguucuuccaguguugguuuuaggcaagcauugcuagacugguuguuaggacccugaccagggcaucugugggcaaggggguuaaaaagguuguauugugagcagacagaucaguccuuuccuugugacaagacagaggacugagcagcaggaggcuaaugaacaagaguguguagccuggggugggggugggggugggggcuugggcuugcuuuccccuaguggagcagcuguuuggccugcccuucugguauuguuaagaaugcuuguuacuuaauggaacuuauguugguuggaaaugacucuaagcaaaaaugggaagauguaccuugcugaucugacuucucucaagacacaagugcaggaaaagcagucaggagucucagagaacggggguggggggugggggggugggcaauaaaaucucgagccuuccuacccagcuggugugagcucucuugaguuuuuuuuuuucuuuuuuuuuuuuuuuuguuuucugagacaggguuucucuguauagcccuggcuguccuggaacucacucuguagaccaggcuggccucgaacucagaaauccgccugccucugccucccgagugcugggauuaaagucugugccaccacgcccugcgcucucugaguuuugagaccuuucuuuuuucuccauuucuguucugcguuucuuccccuucauccuucuaacccagccuuugcugcugcuccacacgcauggcucauggugaugccuugcaccggcugcuucagcucuuagguaagauggccugaagcuugaacagcagcccagcuucccagcuuccacugcccuggggaaagcugcacucacuguuuugaccuuagcucuggggaacuaggagaccugguugggguggugcaagcauagagaauuguuugucacaaauacgguugcuugagcccaugacaaggugugauccuuagagagcagagauuugcagugucucuguggucaaaaucuuaaacugucugaggaagucauuuauagaacacagcccugguaagaggagugagggagauuucaugguagggcuugugggaacaggugccuccaaggcuagggcugggucaucaugagucauguggcccaggacuggcuggugaacucugccaugugcauucaguuuuuuaucugaaauuuuuaaauauggcucagacugaaaaugcuaagcaucuucauggugcuuaauugccuaucucuauaaagggcucuuggaugucaggaaacuguuucucuuucugacagcuuaaugcaaauuugguaaauucacuccugacucuggcuaggaaaacuagauuuuuccuaauaauaaaaauaguuuugcaucccaggacuguauccugggagcacgccuuauaugggagacaauaugccgaggcuugaagacuuuuacugaacggcacugccaggugagcaccuucaaacgccacaguacgaugcguccuucagggcaaggcucagaaggcugcuccccugggacuuuggucugcucggcaucucuacuuuuggcugaauucucugaugcuggguaaacaaagaacauuugacucgagccuauugaagaccgaagaguagugaacaaguucgcacaguggacaaggcuacucauuuuuguuuuuguuuuuuaaaguuauuuuagccacagauuugacgcuuccucugcagcaguacuuuguggccguuaacuaaugcuucgagauaucugucacuuuccuccgguguuugucaaaugcacacguucugacaguaaugauaguucugauguuuuccgcuggguaucugccaggggugcccagugggugacugaauccagagguacugggauuguaaauacaacagacagaucauuuuaugaugccagacgaaagaauccaacuuuggcagauggccaggaaccauugauuuggcuuggauucguagcucuguggguguuugccaaguaagauuagugagcuugguuaauuauacauaggacuuguacccuuuucucucgguuauuucuaucuucacccagaauagcacuugcuucaguuugccuccucuuguggaugaguuucugcccaugguuuuggugaacugugcaucucuuaccccuugcucaucucagccuuacugacuccugcucuacacuguuaaauguagccccucagguuuugaauugggguuuauuuggccgcuugcccaguauccccuaugcucagaacagcaucgaugcauccuuauuaaggcaagccaauuuuugauucuuuagaagccacaucgauaauguugcccaaguuuuagaguaaauauggguugucgcuuugauguaaacuacccccuccguaaguuuagguguuugaacauuuauucccgaguuggcauuguuuuguaaaguuguaaaaccuuuagaaaguggagcuuugcuggaggaagugggucacugggggagggucucgugguuuggaaacccucauguacuauguacucuuggcuuccuggcugucggcaauugagcagcagcuccccacucucuaugccuucccuggccaggaauucccucaaauuuuaauccaaagcaaaccuuuccuaucuuaagaugcuucuugucagguauuuggugacaucaaccagaaaaaucacuaaaauaacgcgugugucuuauguuaauuauuuuuugccuuucaaaaccaaaauaaccuccacguccguauaauugaaggaugugaucguagucuggauuguuugccagucagaagacaaaaugggaaacccaguuccaagugccagcgaagccugguuuugacuuuaaugggagaccgugaagcuguggggcuguuuggaggcguuguuugcauguuguccugggcuugccucugguacucacuggaugaaugauaaagcaccucucucuagccagcucaucccaaccucagggacaguauacaaaacugcucccuccucuugacaauuuugucuuuuuuuuuuuuuuuuaagcaaacaaaacccagcuuuuuccauacucaccuuguuuuguagguuacuuugagugauuugaauggaccaucaaaccuucucuucaccauuuagccagggacacacaggucagaaccgggcccauguugcuguuguaacaguauguagcucacagcuucaccguggaacugcaaguuuuccugguuuucuuuucaaguagaauguucugucuucaguagacauccuuaaggaagaagaguggcugccuuggcuucucaccuucuuucucuguuaaucccucccucugccuuugcuagaaucugguugugcaggcuccccuaggucuggaguuccuauucuuaaaagcaggauaauaaccagagccguucccuucccauuauccacuguaauaacccuuugagccucugcugaauccuagaggccuuuucugucugaccuccuggcccuuuuacccuuaaucuuccccaacuaccuucauuccuauacccugaaaugcuggaaagagacuugcuaggcacagccagcuugccucuccauugucuucuacucuauaguucccaggccauguaaugccugucuugggaagucuauccucugucuccugccuagguggccccaggacuuguucugccucucuucaauuuagaaguuccugaauucagagaccacugugcuuuguauuauacaguuccguaagauuauggcuagcuucauuucaucuuugaaaggaauuuugaacucaguggaugucaguauguguguguguguguaauuauuuuaaagcacauaugauuugcuaggagauaaaggaguuugcaucaugagagcuaccaugggaaguucaugaggaagagugugggucuuuucccaguuccucuguuagcaagaguucgguugaucaaacccaagcuuauguauuuguugcugaagcuaacagggaacaaccauuuuaauucacuugugagauuucgggggagcaaccaugccauacacgucuaugucuucucuauuauuugugccaauaaacuucauuuuucagacucuagauggaaggaagcuuggagcugauuuccucccuuuuucuaaaucaaggggaaaguaaauugugaugaccauagguuaggagaaaggaaaaaaaaagauucauggucacuuuggugauugcaaaucuggagugucuuccaaauugccgagucuccaaaaaauucccacacacauauauauauuccaacuauggauaacacuuaggagcccagaaucccuagcccuucagaauaaagaugccuaaacuauaaauggcgugagaaagccaaaguuugggacucucagcccugaaaucucuugacugucucuugacuggaaucgaaggugugauucaguggaaaucaggguguggcugccauuuugcucccuccugcuuaggaauggauguccucauuuugauccaguuggggguuggaagguauauuugguaauucagaagaacuuagaauucuuccuuuguugcuuguuuuguuguguuuuguuuguuuggagacagucuaguuaccuaggcugccuugaacgcaguaugaucuagggaggcuguccuuguauuguggauccccuccauuucccaagugcuaagauuacuggcuugacccaccauaccuugcuucaucgcuuaucuuggaguugaaggaaggcaguuucauuccuggccugucuagaaagaauagcacuuauuucagacaacacuuucccugguauuuuggaaacaggguugagugguggaaaguccuugcuuuggaacacuggcucaccuacuuagcuucauaauguccagugccucccucugacucuccguucucacauuuguuuagugggcuuugcuguuuuuaagauagaucuaacuaggaagcccagauugaucuugaacuuguggccauggaccucaggcucaguacuaggauuacaagugugugggcucauaccuggcuguucuccccacuugucagaugggaccguagugugucugaggagcuucuggacaauugaauuaacugcuugacuugggcccaggcauucuuucuaguucccuuuacauuccucaaaacuguugaggcaucucucucucucucucucucucucucucucucucucucucucucucucucucucugcgagaagccccccuccuccuaccccguuaaagaucuucuggguguccucccuccuuuaagccagcagucugcauccaaugaauucuaauuaacgugaccauagaaguucugcgucuggugaauucuaauuaaugugcuaguagcugaguucagaugucucccaaacuagcuuuaugcccuagcagggaaaauugaucucuuccccaggaugcuuuuacuuuggugagucucguuuucuuuccagggagaaaugaacuuuuauguuuccucaaaaaaaaaaaaaaaaaaaaagaaagaaagaaagaaagaaagaaagaaagaaaaagaaaagaaagaaagaaaaaaaauuuuuuuucugaauuggccauuuaucagcugacuuugaagccaguuugggaaccguagcuuguugacaugcgcuaugaaggaugguguuggaaagaagcccccaauaacccaggccuuggaaggacagcauggcuggcuguggacuggcccugggcuaacaaugaggacuggagcaucaggaaaggagaggggagaagaagcccaagggccuguguggggcugaugcagaggcugaggggcagccacaaccugauggugggguugggugggcuugucucugcaguaugguaacacaggccaagacaacagcuggaccagcgcugcuuugccacaagauuuaggcuauuuccuuuaccucuggcucagcccgcagcuuauaauucauaaauaacuucaagcacacccauuucuuguuuuuuguagguuuuuuuuuuuuuucuuuuucgguuugguuugauugguugguuguugccucucaugacuuucuuucugugggaaacagugaaaugauuauagcugucuccucugaaucuuuagaugcagucucaacuggauugagaauauuaggaaaagaugguucugcacugaacaugucuagguccuuuuuuuuuugucauuuccuaagccauagaguuugacagcuauuugcauagcaugcucuaagguguuuaaguugacucaggaugacuuacagagcacaggaggguuuggguaggccaagugcaaacaccccagcauuuuaccuggaggucgucagcguguauuuugugaucugagguggauccuggaguuguccuagaaccgaagacccuuaaaucccccaggaagcucgggacaagcuaguuagucuugcaccuuaaacagcuugcuuguuaagcuuuggauuucagccucacagucuucagccagacugacccaaagacaaguuaauuccccugcgccuccauuucuucugcugcaagugugaauacccuccuggugggcucauggugcacaugcgacacuacuugugauguacccauuacaaucagggacguggucagugcugcaugagcuuuugugcgguaacugcgcgugagugcugcauuuccugaguuguguggacugcacugucuuuuggugcguggagucuuuaaccgagcaaaugcauuuuccuaagcgcugaagugcaaauauaggauucuccuaucucaucgguguaucuggaaggccuuuuuuucuucuccaggacauuuugauuggcagcuaugucuguuaauaaagucuuuucuuacagguugcaguuaaaucacuguggauuccuucauauacuuugggauuaauuuaagaugaaagcauaaagacacucacucagagaugccuuuccauauugugucuagucuuuagugaggcacuacaggugaaguuugauuuuuuuuuuuuuccugauaaguuuguuucucacguuaaggaaguuaaaugcugugagucccaaccccauguugccuuuagggugacuaauggauuuguucugcagggacacuugguaaccucuagguccguauaauaaccaggguuaaugacucccucugagagaacagccuugaguccggacaaauucugcucacccucccaggaaccaggcaauuaaacagguucuguagaaguaccaccgggcccauaagguuuuaggaagcaacaacugcuaacaucugggucgaagccuugggaaggagaugguuaaccacuuguuuuagcguccuccagccugcuagacuggcugauuuuguaauugccgggaggaagccuccgccgaaagccuuucucuggugacuggagagcggugggggaggagccagggcuccccagagucuguucccuccucuggcugccuggcguugugcucgggugugggcuggcugccacucucacgaagcgcacguagcccugucacucagucaucucccugcuggcccagagccagaccuccacgggaagggcugcuuucccaaacccagacagccugcgcugaucuguggaugucgccaggccuguuuacuaugccuaauugcaggacuuagaagaauccccuucaagccaaggaauuagcuacagcugagaaaggaaugaagauugucccuucaagcccuggucuccugagcguuucaggggcgcccuugggagggggagugacucacucaaaaguucaugcacaaguagggacccuccguaguggcauuuugacgggauaccaguagauauuacagucuguggucucccauaguuuucugcaaacuuguuggcguauguauguguuguguguggagguggggggaugggggggaugucugugugcucuugugaguguuucuucucagaguguggagccaauuuauuucuuuaacauaaagaucccaaaagacuaugguacucgguaccuguuagcucuaucaucaagaccuuggaacaauuucauagaagguuaucuucugcagaauugcugguguuugugugaucuggaagcuagggccaaguucgcuggaacuuggagaggaguggcuggaaagugaagauggugaguuaaucugcccuuccagguacggcgccccugccagaaccggaagggcaggcagacccacuucaaaggaacucagccauuuguaacacccauuugcagaagucccgaaguuccuucuugguugugcaauucagguggaagggcacacacaucaccacgcugcacuggcaguggaguuaauguguagcaguacacugggcguguggguucagggacuggcgcuggcuuuagcgugaacauagggcaugugaggagggcagaaggaguuuuccuugugagacuggaccaauagggagcccuagggauuuggaguuuguugagaggacugugaaccugacauacacuggacucugucacuacuuccuuugggaaggaaagugggggagcuggacgcagccauggugcugcucaccaaaccacacucucuuuucucccuucuuucggucaccuuggucucuagccagaggcacuggaaaggaggaaaugggagggcuucaugggacacauugauggggauaacaagcaagaugcuaagauaaccaaugacacuuugagcccuugccuaccuuuguucucuaagagcucgaguugccuacagcuccuuucucuaaccccguaagugguugaaauaaauuuguaaaaauucuaaagcugggcaaugagauggcucaccuuguagaggcacuugaccaccugaguuuaguccucuggccucugaauguguguacacaugcuuacacacacacacacacauacacaccacacacaccauaauaauaauaagaagaaaaguuuuaagaagccgcuaaaaaaauuucuaaaacauuuugaguaggguuucgcccucacauccagaccuuccuuuuuuuguucaauuucguaugcuggcucagcugauggcuacugugaacuuugugcuggugacauuuuccuaaguuuagaaaaggcuuugcaugacuguugccaucuuauuaagaggccuucacauuaguuugugugugugugugcgcacgcgugcgcgcacacacaugcaugcucgugagcacaugcaaauguauaugagcacauucaugccaucgugugcagggcugaggucagaggacaacaaauggcauuugaucucuucauucuccuuguggcucccaaggauagaguuuggguagccuggcuugguggcaggcauauuucccagagucaaccacugcucuucagccauuaauguuguaggaaccuaaucuugggguccuuaaaggacugaggcugaaggcugagggcugaagcugcaguuccagucagcaccccaaggcucucugcauuuaguuuguaaaggauauuuggaguccuuuugcucuuugucaaagccaaauacagacuguaacuugacaugccagcuucgguugucuuuaaguuuaaaaacacauucaagagcugggcgugguggcgcaggccuuuaaucccagcacuccggaggcagaggcagguggauuucugaguucgaggccaaccuggucuacagagugaguuccaggacagccagggcuacacagagaaacccugucucgaaaaacaaaaacaaaaagaaaaaaaaaacaaaaacaaaaacaaaaaaaacccaccacauucaagaacaaaccuugcaaagacugcaacucggcuacuuugucaguucccucuggucuuuguggucuaaccguugcagagagcauuuggauauccugguaacccuguacauagauccugguaacccuguacauagacugcuguacucacuagauuuaugcuaugcacagaagguguuucuuccucucuccuccuccucucccuccuccuuuccccuccuuccuccuccuccccaucucaggcagggccauagagaugauacucaguguguagugcucagaguguguagugcucuagcagaggaccugcguuugauuccuagcacccaggucaagcugcucacaguggcuuguaccucccguuucagggggaucugauaccuccuggccuccaccagcaccaguccuuuccuacccauggagacauaauuaagcaauaauauuaaaucccccccccaaaaggagaauuaaaaaacacucuugaaaagcuguugcuaauauuuguuuaguaaguaagagguccaauuugucaguagaccaaaauuuaaaggcuguucagccagauaucuuuacaguucuacugcucaugguuuggcuuuucguuguaucuccuuuugacugcaucuccuuuuguuagacaggcuacucuaaaaugugugaugcuccugcuucagccaccucaggaacugaguaacagcugugagauacuguuucaggcuuaaacaauaucuguauaucaauuguuaauuguuauaaauaaaaugaucaguuuuaaaaaguuuuuugcucaguaaaaauuugcauaacaugcaacuuugcauuuguaaagaucaaguuauaccaagaaauaugauuccaaaguccugagcaauguguaaugugauauauauauacucauuuuaaugaaaaugcaugguauggcuucuuucuuuuugagcggcuaggagccagaccuaugcuguggcacauguuaggugugacucuacugcuugccuccacccccuccuccacccccaucugcaguuugaucuguagagaaguacuaagugugaaugaucauuguugcugagugaacaguugaagcugugcauacugguuuuaaaacugucuccuuacucuagcuguggcugguugcuuuggaacauccaguugaggccuuggaguguccacccugggcuugaucucugaacacaguaauucucccacagccccucacagaugcaugguuuucuuuucuccugguggccuuuuguaaaguagauuuuauacuuggauucugcuuuaguucuucuauaugugugcacuucuucuugccugaacgugaccauggaggugucuugaagcacauaucucugguguugagccagcucgggaacaccugguucauuccucucauuuccuguugcuacagagcuguggagaggccucuggggaugggggguuugugccggggccagugccggggccagugccggggccggugacacgucagagaaugugcagaaucagaagacacgcugauucaucugcaagcccaggccuagaaccagggguacagugaccaugcuaccacagggacacugaugugcuauuaaacugcuguagauuucaaguauuggucaagucaggaaguuuuuaccaauaaaaaaccccuauaguaagauaccuuccucguucccauaaaacaaugaaguguugcaacauuucccucggaccugcacucuggcuccuuuuacagacuugaugagguuuagauaacagaucugauaagcccaucaguuuccggagucuguuacugccccgugcacaaauuggcaugggucugaugacucaacacugagguuugcccaucagugcauccuuagcuucacaguuugagauccuggcaguugggaaugugucugagccaaaacccaucuccuauggcacucagccagaaaccucagugguacaauuggucaguaagguugcggcgggaccuuugagcggcccgugguuuccucccauuguuuaaacguggugcacauggcuucuggagucagagagagggugacuugcacucuggccagaaaaaaagauuuuuuuuccccuucccuucacaacguguaugcucacaauuagagaggugucuuagugguaaguccacaaggaacugugccggcacauucucucuuuuauaccugcagcaguuaguggaggguguguuugugggaacagucuguauuuccugccuguauuuuaauucaagcugaguucuaaagcccauuugugcuucuuaaugugcugcaagacacugcucucuccacacacgguacacugagcuccgaucgagucuucucucucuuuggacguuggaggacugugucaauuacuugucucguugcuguaacaaaacacccgaaacaccggacaaaagcaacugaaggaaggaaggauuuauuuuggcucaagucccaaggcacagugcauuguggcaggaagucguggugcaagcucaaagcagcuggucagggugauuccacagucaggaagcagagggaaaaggaugcugguggccagcuagcucguuuucucccuuuuuaguuaggacaggucuuuccaccucaauuaacccaaucuacaaaaucuaucucggacaagcccagagaucugucuccaaggugauccuacauccugucaaaucggcaaucgauauaaacugcacagcccguccuccucaucaugugaaauagccugggaccacagacaguugcagacgagguagauggcaggcauccagaccacugaccuuuucugggagcagagcuguuugggaauauaaagcuaaagcacugacugacagcaggggagacugggauggugggggaaaucauggaguaauggugcuaagugacuuucauuguuggcccuuacacuucuggccacugcuuccaggaauagguaauucccuauguuguaggcaacuucauuugucucuuccucuccagccacaccagcaaucacccuuuuucaagacaccaucuauuugauaaugccauaauuugucaaauccuuauuacagucacuucaaaauccaacuuucggggagacagacguucaggcuaacagagcaacuucagcucuacacgugacagcauaguggcucuuucugaggugggcugagggauugcuagcugcgacaaauaaaagguguagauauccucugauuuaaacuucagguucauugcaaagccaggccacuacucauccucuagcacgaagugugugugaggcccagcucuguuuucaggcucuguugggaaucacugaucugucaguggcuuaguuugggacuggucuggacuagucuuuuuacucgugaaguaaccuugcuauuuaucaaggaauauuacaacucagacccccuaaguaugucugaaaguaugcuuucacggcagaagaaagcuauuaauuugguuucaacaaagaaccaucuacaaguucauugguaucauauauguacuuuuuuuucuccuucaaagagaucucccuguauugugugugcugacucuuauugaguguuaaggucuagcuucccaccgacccuucucucuucuugccuuuuauuaagucugaccuuuaccaccuuuaggaucagacaugguuuuguaagaaaacaagcgugauuccacagcucagggccacugcuaaccaagcacggucucugagccccacaccaaagacucuuucucuuucugcacgcucucuuccuuccuuccucuuagagagggucucucccuuuguaggccagguuggccucgugcaugcugcuccagcuuccaaguacaggcauuuacauguaugugcccacugugccugccucuuguaucucuggauucugaccucguagggcucagaugcgaaccuggauccugcuuuuccaaaaagggauauuaaagaaaggcaagcaucuuguugaggauguagauggguuucuuuagaaaguucucaauguucuagaaggugggacuauuaccggaucacuuauccugcacugaggccuaagacagggucugccuguuacacuuucauaccaaagauuaccuuauauuaguuuuauguucugaucguaacccaaauuuauguauuuuaugugucugcuguaggaggagacuaucuaagcuuuucuuuuaaaacagcaucuuugggaugucucuacaggcaaugguggcuugcuauccaggaaaugggacagguuauguucgccauguggacaaccccaauggugauggccgcuguaucaccuguaucuacuaccugaauaagaauugggacgccaagguacuguggaauaguguguguguguguguguguguguguguguguguguguguguuuugugggguagggcgagcuugggggaucuauauaugcuguagaaggugccgauagggguacacugagaguucagaucaaaagaguaugccaguuccaauuagguaaaaccuuccaguaaccuuaggaaagcuauacuuucuaauagccaguguccacuguuuuaugaccugcccggccuccugccacuuauggaauuaaugccagaguugauaagauuaagaucaguggcucuagaguuaacgugguggggguaggggguugggggguggcagggugacuguggucagggguuaaugaagggagguaacugaacauugggaugcagaguugaugagacccucagcucagcaucugaugcauaccuuucccucccagcagcaacacugagagaauucaacaaaaaaaaaacaaaaaaaaacccagagugguggggucucaacgcugucccugagagcgacuucccuauccucuaucucaggaugauaugucccauggggguggcauucguugucgcuugugaacggcagcuguagaugguagagauguggaguucgugucaaguucuccgagcuagggaugauuuaggagucugugaggucggagagcucugcaaagcuuauuuagcuuuugaacuuucugcaucuccguuugcgguuuguuaguguagacuccgacuguuaagcugggguccuggaucuuuccacucuauuccguaguuagaccacaacaguuccuuuagggcuuaaaaguaucuuuugggauaccauugugagcagagcuagugggacaacagugauaaaccagaaagaacgaaaucaacagagauuugaguuucuuccgcguuuuagacugugucguguaaaacaguaaugcgugaagccugauuucuacccagaagauaguuguuccaguaggacaaguagauugauuguacacgugaaaaggaaaaggcggugaagagagugauagauguccagaaagauguagauagcauggugugagaggucacagaagugcccagucaauggggucagagggcauuggaagaguucagaggacggcuauaaauuguuacugcaggagcagcuguaugggaagcaugcuuagacuuaauauuugguggcacugugaaauuacucaggauuccucugcuuguuucuggcugguugaagcagguugacauggauaguuugguguggcacucucuggcuguccucuauuuugugucuguggccuucauagccuugggaaggggaagaugcugagaugaaguugaauauggcuauccauagcuaagucugaugcaagucugauuccaaagugugaggggggaauaaguauuuacaggaugaaacccacuuaaaguugaggaacagguaguauuucuccugcauagagcuaacacauugcugaucaaccaaccgcacaugagaccaggaaauaacugaugcucuucuuggucuucaguuacacggagggguccugcggauauuuccggaagggaaaucguuuguagcagacguggagcccauuuuugacagacuucuguucuucuggucagaccgcaggaauccacaugaaguccagcccuccuaugccaccagguaagagcuggggccacaguuccucuuccagggugcauacaaaccccagauccccgaaaacuaauguccuuuaauuugggguauaccccaaagcugauaggcgaaccuauuuggagugauagaaauugaaggaaccucuuuaggauucacuagcauacaaaucuaacuucaguuuaaaguaacuaugaacuuccuauccugugaguugugcauacugaagucucagguccucagagugcucuccccugucuuucugucccuuccuucuugaccauuagaaacaauuagaguugccugcuuugggguacacuccguaauaccagcacuugcggagcacugagaguuccaggcagcaugagcuaagcgagaucuagucucaaaagcaucagggaacaggccaagcuaagguugagcuagcccugguuaccaugugucaagagugcugcuucuuugagugaaauuacagucaguucaagcaaagaacgaaccuugggaaaggaaagaguuaauuuuucuugaauuuacuuccuuuucacucuuucauagcuuaaaguuugcccgggcaagcauuauccaugaaauaacaauuggauguuaucguuuugcuugcuccguccauccauccauccauccauccauccauccauccauccauccauccaucuauccauccuugagacaaggccuggaacucacuacacugcagaggauaacccugaaucucugauccuccugaguguugagaucacaggcaugugccauugcauguaguuuuuucugaugcuggggcuuuaugcacacaaugcaaacauucugucaacugaguagacccuagaccuacaauucaauguucuuaaaaccuuucaucuuucuuuuuuuuuuuucuuuucuuucuuuuucuuuucccucccucccucccucccucccccuucacugaacauuuuagaauugucuaaucuuuuuuuuuguuuuguuuuguuuuuuguuuuuuucgaggcaggguuucuguguguagcccuggcuguccuggagcucacuuuguagacuaggcuggccuagaacucagaaaucugccugccucugccucccaagugcugggcuuaaaggaguguaccaccacgcccagcuagaauugucuaaucuuaaucuagaaagcugauaaaaguauuuauguccucuucugccuugaguucucccuucucuuuccaaacgugggccaggcagagagcagagugauguggaguguggggcuuauacugggaagggcauugagguaggaaaggcuguguguggaaggauggcgcuaagcauuaccaagcuuagcuuuccgcagagauccucaucugagccccagaguuucagaauuggucacacugugacauguucuguauaaacaggccucuagucccucuacugcugcugacaucuaccuguggccuguuuuaugggguucaauaauagggccuuguuugguggcaggauucucgaguuacuucccagccccacugugaccaacuuuauagagaaaacauuagcaaaagugauuggaagcccuuggggguggagugggggaugagaugggaugccaugggaaguacuguggcuaaaaauaauuauaaaaguaaaagguuuaaaaacccaagcaugagauagcuccaauuacagucuaucccaugaauaggauaaagcgaguaccaggagcaguggaaaucccagaggugucuguacugagucuuugcaccaaugccuaaaacuaaagaaagcaggccgagaguuagaaagguuccgagacugaacgaagcuacuugugaaagccucucucaaauguuaccuccuuuucccuucccuguucccuucccaucaucuugagccuccauccuuagcagggcaagucucuuccagucuuaaaugagucccuacccauccaaucauccgcuggagcccgagcucuuaagagaaguuucuagggauagcauuguugaguucugagcucucagagcaggacccggcaguccccagaacaccuguguuauaagacauuuauagagcauugaacccaaggaaguacuuauaaauuaaaauaguggugguuuuacagaugauuauauuaugagcuucacagagugaguuugaagguuuugguggccucuaauagcacaugccuugcuuccacagguacgcuaugacugucugguacuucgaugcugaagaaagggcagaagccaaaaagaaauucaggaauuuaacuaguaagugucuggccauuuucuccgacuuuaguuuuauuucuuuuguaauaacacuguuucgucucaguugugaguuagcuucagaaagaaugguaucuaaagccuuggcucucaugcucuuaaaaccaucagaaggaaaugagugggacaauuucccucgagaugcccacugacugugugaugauuuguaguagauagaaauaauuaacuuuuuauugugaauguuaaucagucaugugcaacauaaaguuuuguucaugaauuuggcauuuagauagaaaauauaauggauccuagcuccaauggucaaguuaaguugguaugggauuguggcucaguauagaagcagggcacucacgcuaucaaacugauaugauuuaacaucguuccugccgccugcaggcaguguuuaugaguuaugcuucgcaauacugguuguucuaagcuaagcaugguggaacagcacucugggcugaggcagaaggaccaugaauuugaggucagcuugaccucuguaauguccugcugccccaaagcguacaaaagcaauaaugcuaccaaggugguucaugaaaaagguaaauuccuggcucuuugaguacaggaaauacuguguccuguauccuuucgaguaacugaacauuaguauauugaguugaguuccuaagaaaucuuacagggagaacuggagauguagcucagaguuagagcguuugucuaaccuguggcguguccuggguacaauucuuuccacugccaaauuaauaaaguguauguuuacauaaagaaauugaccuaacucauuaccuauuugaccuuuguaccuaucaaaugccaagacagacagacagcuuugcaaaggugugugugugugugugugagugagugagagagagagagagagagagagagcuguugacugacauaauacaucaaauuugacucccuaacuuguuuuucccguuuccaacccaggaaaaacugaaucugcucuugcuaaagacugacuguggugugcaauccgcuggccgcauucguguaguaacaguuccggaaauguuaagugucaagauccaaagaauccauacaauccccucugcccacgucguucagcuccccaccuuguuugugguacuucauguuuucuugccgggacugcggugaccuucagacacucucuuugccagaugaacucauuugcuaacuccagaaauaccugcagacgacauccuagcuggccagcgguuuaaagauagauuugggaauucggcuguugagcccaggacugcuucuuauucgcacuuuauguaugcguccugauuugaagggaggagguucgcaaagaaauaaaguuggugacagaugccacgaagggguacccuccaaacccucacagcaagaaagagaaauaucugaacgauuuccagauguuguuaaccagagucuagacagugacgacgaccuaaugacauuaucaccucuagaaagggcugcugcuuagcaaucgauuuauagauaucccacgguggaugcuccauuuuccugguuuacgacccguacuuucugaaggucauugcuaagucaauggcucucuuguggaagaugaucccagcauuuauuaugcacuauguuuacuucuuacuuggggaaccuaauuauccagagaauaaaauucgccagguaguuuggguuguuuuucugguauugaaauuugaaguuaaaucagaggauagaaagcuuccugguaauucagcacuggauucugcuaacucuaugggaagagcaaagcccaacuuacaugauucguccgagcauccccaucccgagcaguucaguucggggagggagaugggguuggaagugcagacaggguccuuucauccguguguguucccuuuaacgguucaucguccauaacaaagaacagugugcuguacucuuaaaagagauggaaauaaaaagaccucagagcuauuggaguucuuccacaucaucugcucugccagccucacuugagucgucuugauccuugacugcaacuggcugguaggacggccagaguugugggauuucccagaaccgugggagggucuccugcugcagggggcaggugucgcuuccucccgaacucuguacgaaacaccuauuuuacgaaaguuagccacccucguuucugcugcuacuuccccaacuuucaaaccucuuuaauuuccuagcuagaaucccacaagcagcauagaccugaaaguguuuuauuucgucauguucagacagauagacagacagacuuuccaagacagaaguugauacuuuuccucuaauuguuuuggaaaguguccaggaagaacugucaucccacccccacccccaacaccccacccccgcccccaacacccccacccgugccccgucccguggcucaguuuuguuuuauuuaguauuucccaccuucuaacuugcaaugucauguccuuauuuauuuuguuuauugucucuuuagccugugaugccuagaguguuaaguacaacgaagacagggauuuuguacauuuuugacccaugcaauauucccagcgccuaaccuaaugccuggcauauagcaagaaagggcuuaguaaauacaugcucaauaaacucagucuccucuguagug

SEQ ID NO: 6649 - RNA, 854 nt, Mus musculus
caagauccccuguagcacguuccaauggagcagccgggaggcagguuuaaagcuuggguuuucaacacaacugaguaaaaagucccuucugauagguggagguaagagagggauugucucaggggguggaaggugucuaaagcgaaggaagagggaggaacaagagaggccagugagagaaaacaaaacauugcuuugucuuguuucauauucugaguauagauguaaacacacacacacacacacaugcacacgcacacgcacgugaugugagagcagaaaggagacuauuuguagggaggaagggaaccaucugggguagggggcaguuagggagucaaauaugagcaaagugcaaaaauaaacauguaugaaaaugugaagcccauuauuuugugcauacaaacuuaagaaaaaaacaaccgauaacuggaucuuuaaggggguagugguggugauuuaaaaaaaaaaaaaaacaacuguuucuagaccugaaacucuuaaagaaugucacaaucaaguacagucucucagaugacuggugaccggcuuucuucguuuccacacagccguuuaaaacccuuuagcaggguaaaaggcaacccaaggguaagaaaaaaucucucccaaaucggcuccauccuggacccaaggccacgccuuccugaucuacgugcagucgcuguuugcuggacuuccuguguccacuucuggggacuuugcuucaucaucccaucccguccugucccuugacacgacuuugguucccauuucauggaagggacuagaaacucauuaacuaacgccccacgucuuaguuauuggcacccuaagucuaagucugcgugacccca

SEQ ID NO: 6650 - RNA, 4097 nt, Mus musculus
cugcggcccuccagcccgccgcccgcccgcccggcugcagcucccggcgugcccugcacucucugcugcccgccgccgaccccuccuucuucucgucccagugccaccgagccggaguccgagccaccgccgccgcagccacuucagccgcgggcacuaugguaaggugggcgcgccggcgggggaaugcugggcgcggcgcggauccccgcgcggccgccaucuuaacccugccugggccugugcggugggcgcuucggcgcugcgggccgagggcucgaggcccugcggccgcuccgagucccgaggcgggagggcccggcgcaggcccggcgcgagagggucgcuccuugggccagggcccccgcguguugcucugcccugcgcggcuuaagguuuuuaacucgcgcgcuguaagguugguacguggccagcagccucugggugagggucuaggaggccggccauaacgccguuccgaggagauugaacagguagaaaccuauuuuaaaacgcuuuucucgccguagggagccuuuucacgggaucuguuaguuucaaagcggcugccaaugggcgguggggcguaaucgcuguagccgcagcggguuggaguuuacacuugauucucuuuccuuauguggaagcagccguggcuaagacggcuuuaaagaaagaaaaaaaaaauaguagaagcguuaacugaaauccuggaguguuuuuuuuuaaggccugcagaguugacacaauacagaagguauuuuugcugcugcuccugaagcucugacaucacccagugaaauaggaaacauuucaggcauggcucaacuguauuugucccuucccaccucccguuagcgguucucuccguacuccuuuaagaaggaugaaugagcaguaugaguuagacauuuuacccguaucuucuucugauauuuaaaauugacagaccuaauaggacugcuuacguuguuuggugcaguuuuuuaauacucuggccagacugaagucuaugauuuugguuaaaaccgaaauccuuauucuaaauucccacccuuuguuuguuuucaggcaucuggaguuacagugaaugaugaagucaucaaaguuuuuaaugauaugaaaguaagaaaaucuucuacacaggaggagaucaaaaaaagaaagaaagcaguucucuucuguuugagcgaugacaaaagacaaauaauuguagaggaagccaagcagaucuuggugggugacauuggugacacuguagaggaccccuacacaucuuuugugaaguuguugccucugaaugauugccgauaugcuuuguacgaugccacguacgaaacaaaagagucuaagaaagaagaccuaguauuuauauucugguguguaaaaacaaaagaaaaaaaguacuucuaaaagugcaaggauuauuauuaucagagucaguuuuugccuuuguuuuucuuuugaaauucaacauuuucucccccguagggcuccugaaagugcaccguuaaaaagcaagaugauuuaugcuagcucuaaagaugccauuaaaaagaaauuuacagguaccaacaucgacuguucuguacaaaaaaaaaaaauuuuuuuuuuuacucuuucuuaguuauaagguuaaugagguguguuuuucuuuuccguuuuagguauuaaacaugaguggcaaguaaauggcuuggacgauauuaaggaccgcucgacgcugggagagaaacuggggggcaguguuguaguuucccuugaaggaaagccacuauaaaauaauagccaagugccauuugaucuuaaggggcuuacacguaucucuccagcucaguccacuggaauuguauuagguuuuguuuuuuuuuguuuauucccuuuucacuggucccguucgugaaugagugaauauaagaagccugucaguauugccaugagacuguuucauaugguuacuuuucuguauucccaaggaaugccuuccugucuuauuuuagccaaaacaaacugguuccaugccuuccuugcagugaacguuacaauggaugugguugucaaugugaauagcuuagaguacuacaaaggguaagcuaacugaaugccuugaaaauauuauccacuggucggucauaugggagacuuguuucaguauuauuuauaguugcacuugauuaccguucucugaggcacuggagccuucauacaccucaccugccuuggcaagccuauuuuugugaccuggcagcacagauuuaacacuauucguuaaaagcacuuuuuuuuuaaugcguuuaaucccuuauaaagaaugccaauuaaguuuuauuaccugucaucaauuuauccuaguaucucaguguucauucuucuugccuucauauuuuuuucaaagaaacagcugugcuaaugucuuugguuucccgaugaguguacacuacuguauaauuuauguuuaccauaugagucuugaaacacuacagauauuuugaauaucagucaugauggcaauuucuguauaaaagagccuuaaauggaacauuguuuugagaucaaacucccuacccucacaaaaguggccacguugcaauaaaaauuguggcagauuacagaauguugccuuguuuuccuuggaaauuuugcaaauuguuaugugaaauuuuaggguaacggugauuaagcucugcacugguauuuggaauuuuuuuuccuuuaaucuuugguuuaaaaacaucuuaaaaucacuuauauacaaucauuaaaagagugguaauuuuauaaaugcuuauuuauguuauaaaauggagaucagaaaaaaauucuuuuugcacuuuggccuauccaguaucuuauuuauucucuagauaagcuaggauauuaauccagaguuacauuacugagaauugaguaguauaaguaggauguuuuuauuacuuggucauaaugaaaauaauuuguaaaaugucauucgaagguuaaugaugauugugauguuuaggaauguuugucucagccacaguuccuucauagcuuuuccaaaaugaauugggaaaaaaaaaucguauagcagucuuaaagcuuaguaauggaacuuggcuguggcccagagcuuucuccuuauagagaauuugaucugcuccgugugcgcucucugcuauuagccggagcuauuuauggcaaacacaugcuuuuguaucuugucauagucauccacagauggcaaaacuggacuugauucuacuggcauguaagacaggcgugcuagugagcagucguguguggcucuggacucugaccccagagcucugaagaaugcucuuaucagaagauaggaaaugaaaauauccuuuuuuaaaauauguggaaguaauuuggguauaauuaguuuuuuucuaccuuuuggaaaguuguuuuuuuguuguuuuuuuuuuuuucccagaugagaacauuaacauagugguuaaaugucuaggcuuccauuuaaaacuacacaaaugacuugggaucuuuuuagcacuaaggaauuugauuucagccuuccagcuguugcugugaguuguuccagaccuuucuguggcuuuuugguaaggcugcuuagaagcaugagaagcaugagaaugguaaugugugcuaaaccuauguuuaaccaaucuuugcaccaaaggacuuuuucaccaauuuauuuuguuauucuuccaaauauuaagugauuucuaaaagguaaagggugaccuuuuguuuuuauaucuaauuucucaauuucuuuauaugcauuuuuagaauaauuugagagauuaaaugcugcuugaaacuauuauacuuugaguuuuagauuggccaaauacauuaauguaguuaaauucaucuuuaaaguacacauaugugccuagagccaaaaaauaauaaugauuuaauuuaugaccuuauguugagacuaauuucacaucuuauuuugcagucauuuacagugaaacaauguuccagcuagcuuuaaaagcuauacggugcuaauuaguaaaauauugagggcaauauuuuacugcuagcuugcaaaauuauaaguguuuuaaaaauaaaauacaugaaaauauuuaaag

SEQ ID NO: 6651 - RNA, 3801 nt, Mus musculus
cuucauggaguaggagugaaggacagccaaaugucccugcauugcaaagggccuggaacagacaaaacacagccggccccggaaccacucauauguccgucgucgcagaaauuuaggagaagcgaaucccugcaccuagccagcguuuccacucuuggguuuucaaaaagaucaaaaaccggaaaagaccugcaaacuggcaaaucgcuaagaggaacagccuagcaggucugcguccuuggaagcugcgcagcuugggaccccaaaccaaaaucgcccggugggaaaccccagggaaagaaggguucuugcagagggcugggguuacugagugcaggcugcagggaaguaccuagagggagggggccuggucgggaggacuuuccagccacucagggcucaucaaaaaguucccugugcaugaccccaguggcucaucgcagggaguuucuccgaugaaccccggcccuggguuuaggcuucucaguggaggacgagccaguucuuuuucuagucugacuggcuuggaaauuccccgcgccugaccccgccccugagaaauccccugccagcguuuauagggcgccgcggcggcgcugccgagcccacaacagucagaccucgccagccagccgccagcagccugcagccugcacccgcucagccccgcacagccauguuucagccagcugggcacggccaggacugggccauggagggcccgcgggauggccucaagaaggagcgcuugguggacgaucgccacgacagcggccuggacuccaugaaggacgaggaguacgagcaaauggugaaggagcugcgggagauccgccugcagccgcaggaggcgccgcuggccgccgagcccuggaagcagcagcucacggaggacggagacucguaaguggcgccgggcaccggugggggucgcgcggggccugcagcgcgcucgggguucugcacggcgagggcgccgggguugcggggcgccggggcugcggcgggccgccugucuuccccccucccccuccuccccuguccccggacccggagucgccgagcgcaggccggggggggcggggcggcagcggcggcgaggacgcaaagucccggccuggcagcgguggcgcgcagccgccgggcgccgcgcggccgcgaggggaaguacagggcguuccgggcggcggagggcgggccggucuggccggcgcccgcccggaggggguggggcacggaaagucccugggcggcugccaggaacacucagcucauaauaaccucgcggaaaacaccgcggccgcggccuccagaaaccccggccuugcgcaauccccccuccaaccccaccuccagcccgcgccucccccccccccacgcagugugcucaccaccccucgggggguuucccugucaucccucagguuccugcacuuggcaaucauccacgaagagaagccgcugaccauggaagucauuggucaggugaagggagaccuggccuuccucaacuuccagaacaaccugcagcaggugcgcugcuugcuugccccgcgggugcccucuuugaccccuugguggagucagauguagcacggucgcccccaaagcguuucuaaauuaauagucacuuaguucuuaucugccuuggccuuuugcauucaaaucagccaacgucuuagaaccagaagaaaaaucccuuggguuuagugaggucuuuaugacccaccuagggccuccuguuugccugaucuccuaagagacaaaugggaggaucagauuccauagcgggaggugucugggguucaggaaacucaagacuauggguuugcuccauggcuuaucccuuucuguuuccucuuccauuuguagacuccacuccacuuggcugugaucaccaaccagccaggaauugcugaggcacuucugaaagcuggcugugauccugagcuccgagacuuucgaggaaauaccccucuacaucuugccugugagcagggcugccuggccaguguagcagucuugacgcagaccugcacaccccagcaucuccacuccguccugcaggccaccaacuacaaugguaggucugccaguccauccaaggaugcagaggagggagagagauggggccacuugagucuuaaacuccgaacguauacaaaguucagacacugugaucuuuuuaaaaaguuuucuccucgaugccuauaugauauucacucagaacccagauucugaguucuucaaaacugaugauguuugugguuguccucaagacaauagacaugaguugugugaggauugaaacacguaguuacaguuuuugucuuccuccuccaggccacacgugucugcaccuagccucuauccacggcuaccuggccaucguggagcacuuggugacuuugggugcugaugucaacgcucaggugaguacaucucccuuccaccuaaucucuguugggcuggcucugauggugagcagguuuccagaugcagccguaaacuaacgccugauugcuuuugguuucaggagcccugcaauggccggacagcccuccaccuugcgguggaccugcagaauccugaccugguuucgcucuuguugaaauguggggcugaugucaacaggguaaccuaccaaggcuacucccccuaccagcuuaccuggggccgcccaaguacccggauacagcagcagcugggccagcugacccuggaaaaucuccagaugcuacccgagagcgaggaugaggagagcuaugacacggagucagaauucacagaggaugaggugaguguuccuccccucagcacgcugacggcuguucuagggcugcuuuggaucagagggauuucaguuguuuaacuucucagacucggcuugcaaagccaggaucccaagaauuugucucugguuuguuuuaagagcuuacccuuuuggguugaggaaugagggaauucuagaaauugaacccaggccuuagcacauggugauaagcacacguucaaccauuaagcuccacccccucaauagcuuagacuuuuuuuuuuuuuaaggaaagaauagguaagggaaacuccuacagccuggugcccuuguucuauuuggguuaaggagaaaaagagcccaagaauaggaguuauuucagcagcagcucuccccuuaucccaaugucuuggugaaguucuaggaauuuaauaugucuuuuuccccucucuuguuuuagcugcccuaugaugacuguguguuuggaggccagcgucugacauuauaaguggaaaguggcaaaaagaauguggacuuguauauuuguacaaauagaguuuuauuuuucuaaaaaaaaaaaaaaaaagaaaaagaaaaaaaaugagaaaggguauacuuagcaccacaccacacagcgccuagacccaggcauuuuacuggggugauucggcuguugucuuugugaaauccggggaaacagaucacugaaauucaaagaaaaugucucuuaagguucauguuugugggauuuuuuuugggggggggggaggugauuuuccagaaccuaaugaaaggaccacguuuuauuuauugugcuuuugauugaaccaccauagaccuaguaagugagcccaguguguccucccauguaagagccagguguucaguggcaugugcuuaaaagucgcccccaacuaaggucugugucgccuucuuguaaauguuguauauguuguauuuuguugguaauuauuuugguacuucuaagauguauauuuauuaaacagauuuuuacagacagcauuguc

SEQ ID NO: 6652 - RNA, 1357 nt, Mus musculus
ugggaggagaacuugggucaggaaugcaguuggagguuugacagcacauggcuucagcacgcgcaggugccucuccugcucucaggugcaaauuuauucugaguuuaaucaggggaggaggaggaagaggggagggggagggggaggggagggacagggaagaggcugcggcagcagcuuagaaguaaggcagacuguacauaaaaucuggcugcugccaagucuuauguagaccaaggucccugccuaugggcagcaucauuaggaaaggggccguugauccuucucagcaccaggaacauaauaaacccagccuacuuccccaaacuaccuggacggugucagccccucucccucauggucuaaauuugagaaauguuuuggauacagagauucagagugcaggucacugggagauugcuuuagguuacagaggaagagagguuuggccucagcaccuuccagugaggagcuccaggccccucuguugucugagaccguugucugaguucccaucacuugggugaggacucugaggcuacugggggucggggaccuguaaagucagagccugaaagcaaugcucagcuaguuuuuacacacggaaagcaagucggaaacagacuaggagacuaggaagucauggcuggaagauuugagcaaggaaggcauacauuagccuggaauguuuuuuuuuuuuuucuuuguugcuaggccucagcuguugggaguccagucccaugacugucauauucccucaagauaagucacucaacuuggcucagagauguucauuauuuccuauaggccagggcuguucccaugcuaaaguucagggaauacuuuuguuaagaacauugauauuuuuagaaagugagcugaauugagguauaucacuaaguuaucuaaagauaauuuuugaaaacggagccaaauugucggacugggagaaacagaauacaauaacugaagugacuucaaagggucacgaggaagcuggguggggugucagugugggcaugagucuugaugaaaaaucuucgugaauuugaugcaggaaagaccugaagaaucccagcuccaugaucuugaaggacucgggcccacccccagguuuccaggacaucucgagaggaacagaaacaugggggcacagcaugggggugugcgcaggaagcagaggcacggcuuacagagaagcagagguugggacuuuuccuuggcuggcaagaugaaauucagccgccaagaggcgcacagugcgcaccgugcugucugcagcgacaucuucuggccacuuuuggaauaacuuuccuuugaggaauugucuuuaaagaacgguuuaggcaaaagccag

SEQ ID NO: 6653 - RNA, 1357 nt, Mus musculus
cuggcuuuugccuaaaccguucuuuaaagacaauuccucaaaggaaaguuauuccaaaaguggccagaagaugucgcugcagacagcacggugcgcacugugcgccucuuggcggcugaauuucaucuugccagccaaggaaaagucccaaccucugcuucucuguaagccgugccucugcuuccugcgcacacccccaugcugugcccccauguuucuguuccucucgagauguccuggaaaccugggggugggcccgaguccuucaagaucauggagcugggauucuucaggucuuuccugcaucaaauucacgaagauuuuucaucaagacucaugcccacacugacaccccacccagcuuccucgugacccuuugaagucacuucaguuauuguauucuguuucucccaguccgacaauuuggcuccguuuucaaaaauuaucuuuagauaacuuagugauauaccucaauucagcucacuuucuaaaaauaucaauguucuuaacaaaaguauucccugaacuuuagcaugggaacagcccuggccuauaggaaauaaugaacaucucugagccaaguugagugacuuaucuugagggaauaugacagucaugggacuggacucccaacagcugaggccuagcaacaaagaaaaaaaaaaaaaacauuccaggcuaauguaugccuuccuugcucaaaucuuccagccaugacuuccuagucuccuagucuguuuccgacuugcuuuccguguguaaaaacuagcugagcauugcuuucaggcucugacuuuacagguccccgacccccaguagccucagaguccucacccaagugaugggaacucagacaacggucucagacaacagaggggccuggagcuccucacuggaaggugcugaggccaaaccucucuuccucuguaaccuaaagcaaucucccagugaccugcacucugaaucucuguauccaaaacauuucucaaauuuagaccaugagggagaggggcugacaccguccagguaguuuggggaaguaggcuggguuuauuauguuccuggugcugagaaggaucaacggccccuuuccuaaugaugcugcccauaggcagggaccuuggucuacauaagacuuggcagcagccagauuuuauguacagucugccuuacuucuaagcugcugccgcagccucuucccugucccuccccucccccucccccuccccucuuccuccuccuccccugauuaaacucagaauaaauuugcaccugagagcaggagaggcaccugcgcgugcugaagccaugugcugucaaaccuccaacugcauuccugacccaaguucuccuccca

SEQ ID NO: 6654 - RNA, 1694 nt, Mus musculus
cacaguucucuugcugcccgccugccgcagcacucagccaauccaccaccuccugugccaggacggcgcuacuacuaccaccggcaccaugucuuaccccuacccagcacugaccccggagcagaagaaggagcugucugacaucgcucgccgaauuguggcuccgggcaagggcauccuggcugcagaugaguccacuggaagcauugccaagcggcugcaguccauuggcaccgagaacaccgaggagaacagacgcuucuaccgucagcugcugcugacugccgacgaccgugugaaucccugcauugggggugugauccucuuccaugagacacuguaccagaaggcagaugauggacgucccuucccccagauuaucaaguccaagggugguguugugggcauuaagguggacaagggcguggugccccuggcaggaacuaacggcgagaccaccacccaagggcuggaugaucugucuggacgcugugcucaguacaagcaggauggggccgauuuugccaaauggcgcugugugcugaagauugggaaacacacccccucagcccucgccauuauggaaaaugccaauguucuggcucauuacgccagcaucugccagcagaauggcauuguacccauuguggagccagaaauccucccugauggcgaccaugacuugaagcacugucaguauguaacugagaagguacuggccgcugucuacaaggcucugagcgaccaccaugucuaccuggaaggaaccuuacugaagcccaacauggucaccgcaggccaugcuugcacucagguauuuuccagugaagagauugccauggcaacugucacagcacuucgucgcacagugcccccugcugucccuggagucacuuuccugucuggaggacagagugaagaagaggcauccaucaaccucaaugcuaucaacaaguguccccugcugaagccgugggccuugacuuucuccuauggccgagcccugcaggcuucugcccuaaaggccuggggugggaagaaggagaacacgaaggaugcccaagaggaguacaucaagcgagcccaggccaacagccuugcuugucaaggaaaguacaccccaagcaaugagucaggggcagccgccagugaaucccucuucaucucuaaccacgccuacugagcagagguggccuaaggcugccccugcagcaccccaggucccugccuacccacuugcucuugagaagagguagccuucaggcucucucccaucaaccccucuugccaccccucacgacuuuggugugugguauugucugugaaugcugacugucaucccuuccaucccgcugccagucaacaacuauuuaaagggggaaggaggaagggcccuuucucuugaagauuugcugggcgcggagguggcagguaucacauuuuuaggguaugucuguaauaccacuccagccaucccauguguuuuuaaagucugcuucaaacagguguuuguuuguuuguuucuuucuuucugucugggaacuacuguaaccuugaaaauucgaacuguuuggucagugagcacucgccaaaccucgagucuacauaucagcaaauguguuucuguuuaacuaucuuuuuacaguccuaagagaaauaaacauauaaaauaaacgcaucucaaugcauagcug

SEQ ID NO: 6655 - RNA, 1694 nt, Mus musculus
cagcuaugcauugagaugcguuuauuuuauauguuuauuucucuuaggacuguaaaaagauaguuaaacagaaacacauuugcugauauguagacucgagguuuggcgagugcucacugaccaaacaguucgaauuuucaagguuacaguaguucccagacagaaagaaagaaacaaacaaacaaacaccuguuugaagcagacuuuaaaaacacaugggauggcuggagugguauuacagacauacccuaaaaaugugauaccugccaccuccgcgcccagcaaaucuucaagagaaagggcccuuccuccuucccccuuuaaauaguuguugacuggcagcgggauggaagggaugacagucagcauucacagacaauaccacacaccaaagucgugagggguggcaagagggguugaugggagagagccugaaggcuaccucuucucaagagcaaguggguaggcagggaccuggggugcugcaggggcagccuuaggccaccucugcucaguaggcgugguuagagaugaagagggauucacuggcggcugccccugacucauugcuugggguguacuuuccuugacaagcaaggcuguuggccugggcucgcuugauguacuccucuugggcauccuucguguucuccuucuucccaccccaggccuuuagggcagaagccugcagggcucggccauaggagaaagucaaggcccacggcuucagcaggggacacuuguugauagcauugagguugauggaugccucuucuucacucuguccuccagacaggaaagugacuccagggacagcagggggcacugugcgacgaagugcugugacaguugccauggcaaucucuucacuggaaaauaccugagugcaagcauggccugcggugaccauguugggcuucaguaagguuccuuccagguagacaugguggucgcucagagccuuguagacagcggccaguaccuucucaguuacauacugacagugcuucaagucauggucgccaucagggaggauuucuggcuccacaauggguacaaugccauucugcuggcagaugcuggcguaaugagccagaacauuggcauuuuccauaauggcgagggcugaggggguguguuucccaaucuucagcacacagcgccauuuggcaaaaucggccccauccugcuuguacugagcacagcguccagacagaucauccagcccuugggugguggucucgccguuaguuccugccaggggcaccacgcccuuguccaccuuaaugcccacaacaccacccuuggacuugauaaucugggggaagggacguccaucaucugccuucugguacagugucucauggaagaggaucacacccccaaugcagggauucacacggucgucggcagucagcagcagcugacgguagaagcgucuguucuccucgguguucucggugccaauggacugcagccgcuuggcaaugcuuccaguggacucaucugcagccaggaugcccuugcccggagccacaauucggcgagcgaugucagacagcuccuucuucugcuccggggucagugcuggguagggguaagacauggugccggugguaguaguagcgccguccuggcacaggaggugguggauuggcugagugcugcggcaggcgggcagcaagagaacugug
